United States Patent 9,061,059 (MODIFIED POLYNUCLEOTIDES FOR TREATING PROTEIN DEFICIENCY) - sequence listing, part 82

SEQ ID NO: 159261 - DNA, 345 bp, Artificial Sequence
  Description of Artificial Sequence: Synthetic coding sequence
atgagcctggagcagaggagcccccactgcaagccagatgaggacctggaggcccagggcgaggacctgggcctgatgggcgcccaggagcccaccggggaggaggaggagaccaccagcagcagtgacagcaaggaggaggaggtgtctgctgctggcagcagcagccccccccagagcccccagggcggggccagcagcagcatctctgtgtactacaccctgtggagccagtttgatgagggcagcagcagccaggaggaggaggagcccagcagctctgtggaccctgcccagctggagttcatgttccaggaggccctgaagctgaaggtggccgagtag

SEQ ID NO: 159262 - DNA, 930 bp, Artificial Sequence
  Description of Artificial Sequence: Synthetic coding sequence
atgagcctggagcagaggagcccccactgcaagccagatgaggacctggaggcccagggcgaggacctgggcctgatgggcgcccaggagcccaccggggaggaggaggagaccaccagcagcagtgacagcaaggaggaggaggtgtctgctgctggcagcagcagccccccccagagcccccagggcggggccagcagcagcatctctgtgtactacaccctgtggagccagtttgatgagggcagcagcagccaggaggaggaggagcccagcagctctgtggaccctgcccagctggagttcatgttccaggaggccctgaagctgaaggtggccgagctggtgcacttcctgctgcacaagtacagagtgaaggagcctgtgaccaaggccgagatgctggagagcgtcatcaagaactacaagcgctacttccctgtgatctttgggaaggccagcgagttcatgcaggtgatctttggaacagatgtgaaggaggtggaccctgctggccacagctacatcctggtgacagccctgggcctgagctgtgacagcatgctgggagatggccacagcatgcccaaggccgccctgctgatcatcgtgctgggcgtcatcctgaccaaggacaactgtgcccctgaggaggtgatctgggaggccctgtctgtgatgggcgtgtatgtgggcaaggagcacatgttctacggggagcccaggaagctgctgacccaggactgggtgcaggagaactacctggagtaccggcaggtgcccggcagtgaccctgcccactatgagttcctgtggggcagcaaggcccacgccgagaccagctatgagaaggtgatcaactacctggtgatgctgaatgcccgggagcccatctgctaccccagcctgtatgaggaggtgctgggctag

SEQ ID NO: 159263 - DNA, 591 bp, Artificial Sequence
  Description of Artificial Sequence: Synthetic coding sequence
atgagcctggagcagaggagcccccactgcaagccagatgaggacctggaggcccagggcgaggacctgggcctgatgggcgcccaggagcccaccggggaggaggaggagaccaccagcagcagtgacagcaaggaggaggaggtgtctgctgctggcagcagcagccccccccagagcccccagggcggggccagcagcagcatctctgtgtactacaccctgtggagccagtttgatgagggcagcagcagccaggaggaggaggagcccagcagctctgtggaccctgcccagctggagttcatgttccaggaggccctgaagctgaaggtggccgagctggtgcacttcctgctgcacaagtacagagtgaaggagcctgtgaccaaggccgagatgctggagagcgtcatcaagaactacaagcgctacttccctgtgatctttgggaaggccagcgagttcatgcaggtgatctttggaacagatgtgaaggaggtggaccctgctggccacagctacatcctggtgacagccctgggcctgagctgtgacagcatgctgggagatggccacagcatgccctag

SEQ ID NO: 159264 - DNA, 294 bp, Artificial Sequence
  Description of Artificial Sequence: Synthetic coding sequence
atgagcctggagcagaggagcccccactgcaagccagatgaggacctggaggcccagggcgaggacctgggcctgatgggcgcccaggagcccaccggggaggaggaggagaccaccagcagcagtgacagcaaggaggaggaggtgtctgctgctggcagcagcagccccccccagagcccccagggcggggccagcagcagcatctctgtgtactacaccctgtggagccagtttgatgagggcagcagcagccaggaggaggaggagcccagcagctctgtggacccctag

SEQ ID NO: 159265 - DNA, 948 bp, Artificial Sequence; identical to SEQ ID NO: 159260
  Description of Artificial Sequence: Synthetic coding sequence

SEQ ID NO: 159266 - DNA, 1044 bp, Artificial Sequence
  Description of Artificial Sequence: Synthetic coding sequence
atgccccggggccagaagagcaagctgcgggcccgggagaagaggaggaaggcccgggaggagacccagggcctgaaggtggcccacgccacagctgctgagaaggaggagtgccccagcagcagccctgtgctgggggacacccccaccagcagccctgctgctggcatcccccagaagccccagggcgccccacccaccaccacagctgctgctgctgtgtcctgcacagaaagtgatgagggcgccaagtgccagggcgaggagaatgccagcttcagccaggccaccaccagcacagagagctctgtgaaggaccctgtggcctgggaggccggcatgctgatgcacttcatcctgaggaagtacaagatgagggagcccatcatgaaggctgacatgctgaaggtggtggatgagaagtacaaggaccacttcacagagatcctgaatggagccagccggcggctggagctggtgtttggcctggacctgaaggaggacaaccccagcggccacacctacaccctggtgtccaagctgaacctgaccaatgatggcaacctgagcaatgactgggacttccccagaaatggcctgctgatgcccctgctgggcgtcatcttcctgaagggcaacagcgccacagaggaggagatctggaagttcatgaatgtgctgggcgcctatgatggagaggagcacctgatctacggggagcccaggaagttcatcacccaggacctggtgcaggagaagtacctgaagtatgagcaggtgcccaacagcgaccccccacgctaccagttcctgtggggcccccgggcctatgcagagaccaccaagatgaaggtgctggagttcctggccaagatgaatggagccaccccccgggacttccccagccactatgaggaggccctgagagatgaggaggagcgggcccaggtgcgcagctctgtgcgggcccggcggaggaccacagccaccaccttccgggcccggagccgggcccccttcagccgcagcagccaccccatgtag

SEQ ID NO: 159267 - DNA, 1044 bp, Artificial Sequence; identical to SEQ ID NO: 159266
  Description of Artificial Sequence: Synthetic coding sequence

SEQ ID NO: 159268 - DNA, 1044 bp, Artificial Sequence; identical to SEQ ID NO: 159266
  Description of Artificial Sequence: Synthetic coding sequence

SEQ ID NO: 159269 - DNA, 1044 bp, Artificial Sequence
  Description of Artificial Sequence: Synthetic coding sequence
atgccccggggccagaagagcaagctgcgggcccgggagaagaggcggcaggcccggggcggcctggaggacctgattgatgccctggacatcctggaggaggaggaggagagccccccatctgccagcgcctgcctgaaggatgtgttccagagcagcctggatggagccagcaacaacccccacggcctgcgggaggcccagagcaccagcaccagcgccacagctgccagccacaccaggcaccctgagggcgtgaatgaccagatggaggagcggcccatctgcacccaggacctggaggccacagacagcttcccccggggccctgtggatgagaaggtgatcatcctggtgcactacctgctgtacaagtaccagatgaaggagcccatcaccaaggctgacatgctgagaaatgtgacccagatgagcaagagccagtttcctgtgatcctgagccgggccagcgagcacctggagctgatcttcggcctggacctgaaggaggtggagcccaacaagcacatctacgtgctggtgaacaagctggacctgggctgtgatgccaagctgagtgatgagaccggggtgcccaagacaggcctgctgatgacagtgctgggcatcatcttcaccaacggcaactgtgtggccgaggaggaggtgtggaaggtgttcaacaccatgggcctgtatgatggcatcgagcacttcatgtttggagagcccaggaagctgctgaccaaggacctggtgaaggagaactacctggagtaccagcaggtgcccaacagcgaccccccacgctaccagttcctgtggggcccccgggcccatgctgagaccagcaagatgaaggtgctggagttcctggccaaggtgaatgacacagcccccagcgagttcagcaactggtacacagaggccctgcaggatgaggaggagcgggcccgggcccgggtggccgccaaggcccgggtgtctgccacagctggggcccggagcaaggtgaagagcagcaagagcagccagctgcagtag

SEQ ID NO: 159270 - DNA, 975 bp, Artificial Sequence
  Description of Artificial Sequence: Synthetic coding sequence
atgagccaggaccaggagagcccccgctgcacccatgaccagcacctgcagaccttcagcgagacccagagcctggaggtggcccaggtgtccaaggccctggagaagaccctgctgagcagcagccaccccctggtgcctgggaagctgaaggaggccccagctgccaaggccgagagccccctggaggtgccccagagcttctgcagcagcagcattgctgtgaccaccaccagcagcagcgagagtgatgaggccagcagcaaccaggaggaggaggacagccccagcagcagcgaggacaccagtgaccccagaaatgtgcctgcagatgccctggaccagaaggtggccttcctggtgaacttcatgctgcacaagtgccagatgaagaagcccatcaccaaggctgacatgctgaagatcatcatcaaggatgatgagagccacttcagcgagatcctgctgcgggccagcgagcacctggagatgatcttcggcctggatgtggtggaggtggaccccaccacccactgctacggcctcttcatcaagctgggcctgacctatgatggcatgctgtctggagagaagggcgtgcccaagacaggcctgctgatcatcgtgctgggcgtcatcttcatgaagggcaacagagccacagaggaggaggtgtgggaggtgctgaacctgactggagtgtacagcggcaagaagcacttcatctttggagagcccaggatgctgatcaccaaggactttgtgaaggagaagtacctggagtaccagcaggtggccaacagcgaccctgcccgctatgagttcctgtggggcccccgggccaaggccgagaccagcaagatgaaggtgctggagtttgtggccaaggtgcacggcagctacccccacagcttccccagccagtatgcagaggccctgaaggaggaggaggagcgggcccgggcccgcatctag

SEQ ID NO: 159271 - DNA, 975 bp, Artificial Sequence; identical to SEQ ID NO: 159270
  Description of Artificial Sequence: Synthetic coding sequence

SEQ ID NO: 159272 - DNA, 975 bp, Artificial Sequence; identical to SEQ ID NO: 159270
  Description of Artificial Sequence: Synthetic coding sequence

SEQ ID NO: 159273 - DNA, 975 bp, Artificial Sequence; identical to SEQ ID NO: 159270
  Description of Artificial Sequence: Synthetic coding sequence

SEQ ID NO: 159274 - DNA, 1071 bp, Artificial Sequence
  Description of Artificial Sequence: Synthetic coding sequence
atgggcacagaggcccagcctgtggtgaaggctgtgatcctgcactgcctgcccagctgcccccacagctgcctgctgccccccaccagggtcatcatgagccaggaccaggagagcccccgctgcacccatgaccagcacctgcagaccttcagcgagacccagagcctggaggtggcccaggtgtccaaggccctggagaagaccctgctgagcagcagccaccccctggtgcctgggaagctgaaggaggccccagctgccaaggccgagagccccctggaggtgccccagagcttctgcagcagcagcattgctgtgaccaccaccagcagcagcgagagtgatgaggccagcagcaaccaggaggaggaggacagccccagcagcagcgaggacaccagtgaccccagaaatgtgcctgcagatgccctggaccagaaggtggccttcctggtgaacttcatgctgcacaagtgccagatgaagaagcccatcaccaaggctgacatgctgaagatcatcatcaaggatgatgagagccacttcagcgagatcctgctgcgggccagcgagcacctggagatgatcttcggcctggatgtggtggaggtggaccccaccacccactgctacggcctcttcatcaagctgggcctgacctatgatggcatgctgtctggagagaagggcgtgcccaagacaggcctgctgatcatcgtgctgggcgtcatcttcatgaagggcaacagagccacagaggaggaggtgtgggaggtgctgaacctgactggagtgtacagcggcaagaagcacttcatctttggagagcccaggatgctgatcaccaaggactttgtgaaggagaagtacctggagtaccagcaggtggccaacagcgaccctgcccgctatgagttcctgtggggcccccgggccaaggccgagaccagcaagatgaaggtgctggagtttgtggccaaggtgcacggcagctacccccacagcttccccagccagtatgcagaggccctgaaggaggaggaggagcgggcccgggcccgcatctag

SEQ ID NO: 159275 - DNA, 996 bp, Artificial Sequence
  Description of Artificial Sequence: Synthetic coding sequence
atgccccggggccaggccagcaagagaagagcccgggagaagaggcggcaggcccggggggaggaccagtgcctgggcggggcccaggccacagctgctgagaaggagaagctgcccagcagcagcagccctgcctgccagagccccccccagagcttccccaatgccggcatcccccaggagagccagagggccagctaccccagcagccctgccagcgctgtgtccctgaccagcagtgatgaaggagccaagggccagaagggggagagccccaacagcttccacggccccagcagcagcgagagcacaggccgggacctgctgaacaccaagacaggagagctggtgcagttcctgctgaacaagtacatcaggaaggagcccatcacccgggaggccatgctgaaggtgatcaacaggaagtacaagcagcacttccctgagatcctgcggcgcagcacagaaaatgtggaggtggtgtttggcctgtacctgaaggagatggaccccagccggcagagctatgtgctggtgggcaagctggacttccccaaccagggcagcctgagtgatggcggcggcttccccctgagcggcctgctgatggtgctgctgagcaccatcttcatgcacggcaacagagccacagaggaggagatgtgggagtgcctgaatgccctgggcatgtacaagggcaggaagcacttcatctatggagagccccaggagctggtgaccaaggacctggtgcgggagggctacctggagtaccagcaggtgcccagcagtgacccccccaggtatgagttcctgtggggcccccgggcccgggcagagaccagcaagatgaaggtgctggagtttgtggccaagctgaatgacacagtggccagcacctacaagagccgctatgaggaggccctgcgggaggaggaggagcaggcccgggcccgggctgtggcccgggacagcgcccgggcccgggccagctag

SEQ ID NO: 159276 - DNA, 1011 bp, Artificial Sequence
  Description of Artificial Sequence: Synthetic coding sequence
atgccccggggccaggccagcaagagaagagcccgggagaagaggcggcaggcccggggggaggaccagtgcctgggcggggcccaggccacagctgctgagaaggagaagctgcccagcagcagcagccctgcctgccagagccccccccagagcttccccaatgccggcatcccccaggagagccagagggccagctaccccagcagccctgccagcgctgtgtccctgaccagcagtgatgaaggagccaagggccagaagggggagagccccaacagcttccacggccccagcagcagcgagagcacaggccgggacctgctgaacaccaagacaggagagctggtgcagttcctgctgaacaagtacatcaggaaggagcccatcacccgggaggccatgctgaaggtgatcaacaggaagtacaagcagcacttccctgagatcctgcggcgcagcacagaaaatgtggaggtggtgtttggcctgtacctgaaggagatggaccccagccggcagagctatgtgctggtgggcaagctggacttccccaaccagggcagcctgagtgatggcggcggcttccccctgagcggcctgctgatggtgctgctgagcaccatcttcatgcacggcaacagagccacagaggaggagatgtgggagtgcctgaatgccctgggcatgtacaagggcaggaagcacttcatctatggagagccccaggagctggtgaccaaggacctggtgcgggagggctacctggagtaccagcaggtgcccagcagtgacccccccaggtatgagttcctgtggggcccccgggcccgggcagagaccagcaagatgaaggtgctggagtttgtggccaagctgaatgacacagtggccagcacctacaagagccgctatgaggaggccctgcgggaggaggaggagcaggcccgggcccgggctgtggcccgggacagcgcccgggcccgggccagccgctccttccagccctag

SEQ ID NO: 159277 - DNA, 1011 bp, Artificial Sequence; identical to SEQ ID NO: 159276
  Description of Artificial Sequence: Synthetic coding sequence

SEQ ID NO: 159278 - DNA, 960 bp, Artificial Sequence
  Description of Artificial Sequence: Synthetic coding sequence
atgccccggggccagaagagcaagctgcgggcccgggagaagaggaggaaggccagagatgagacccggggcctgaatgtgccccaggtgacagaagctgaggaggaggaggccccctgctgcagcagctctgtgtctgggggcgccgccagcagcagccctgctgctggcatcccccaggagccccagagggcccccaccacagctgctgctgctgctgctggggtgagcagcaccaagagcaagaagggggccaagagccaccagggcgagaagaatgccagcagcagccaggccagcaccagcaccaagagccccagcgaggaccccctgaccaggaagagcggcagcctggtgcagttcctgctgtacaagtacaagatcaagaagtctgtgaccaagggggagatgctgaagatcgtgggcaagcgcttccgggagcacttccctgagatcctgaagaaggccagcgagggcctgtctgtggtgtttggcctggagctgaacaaggtgaaccccaacggccacacctacaccttcatcgacaaggtggacctgacagatgaggagagcctgctgagctcctgggacttccccaggaggaagctgctgatgcccctgctgggcgtcatcttcctgaatggaaattctgccacagaggaggagatctgggagttcctgaacatgctgggcgtgtatgatggagaggagcacagcgtgtttggagagccctggaagctgatcaccaaggacctggtgcaggagaagtacctggagtacaagcaggtgcccagcagtgaccccccacgcttccagttcctgtggggcccccgggcctatgcagagaccagcaagatgaaggtgctggagttcctggccaaggtgaatggcaccaccccctgtgccttccccacccactatgaggaggccctgaaggatgaggagaaggccggcgtgtag

SEQ ID NO: 159279 - DNA, 1041 bp, Artificial Sequence
  Description of Artificial Sequence: Synthetic coding sequence
atgccccggggccagaagagcaccctgcacgcccgggagaagaggcagcagacccggggccagacccaggaccaccagggcgcccagatcacagccaccaacaagaagaaggtgtccttcagcagccccctcatcctgggcgccaccatccagaagaagtctgctggccgcagccgcagcgccctgaagaagccccagagggccctgagcaccaccacctctgtggatgtgtcctacaagaagagctacaagggggccaacagcaagattgagaagaagcagagcttcagccagggcctgagcagcacagtgcagagcaggacagaccccctcatcatgaagaccaacatgctggtgcagttcctgatggagatgtacaagatgaagaagcccatcatgaaggctgacatgctgaagatcgtgcagaagagccacaagaactgcttccctgagatcctgaagaaggccagcttcaacatggaggtggtgtttggagtggacctgaagaaggtggacagcaccaaggacagctatgtgctggtgtccaagatggacctgcccaacaatggaacagtgacccggggccggggcttccccaagacaggcctgctgctgaacctgctgggcgtcatcttcatgaagggcaactgtgccacagaggagaagatctgggagttcctgaacaagatgaggatctatgatggcaagaagcacttcatctttggagagcccaggaagctgatcacccaggacctggtgaagctgaagtacctggagtaccggcaggtgcccaacagcaacccagcccgctatgagttcctgtggggcccccgggcccatgctgagaccagcaagatgaaggtgctggagttctgggccaaggtgaacaagacagtgcccagcgccttccagttctggtatgaggaggccctgagagatgaggaggagcgggtgcaggccgccgccatgctgaatgatggcagcagcgccatgggcaggaagtgcagcaaggccaaggccagcagcagcagccacgcctag

SEQ ID NO: 159280 - DNA, 1041 bp, Artificial Sequence; identical to SEQ ID NO: 159279
  Description of Artificial Sequence: Synthetic coding sequence

SEQ ID NO: 159281 - DNA, 1041 bp, Artificial Sequence
  Description of Artificial Sequence: Synthetic coding sequence
atgccccggggccagaagagcaagctgcgggcccgggagaagaggcagaggacccggggccagacccaggacctgaaggtgggccagcccacagctgctgagaaggaggagagccccagcagcagcagctctgtgctgcgggacacagccagcagcagcctggccttcggcatcccccaggagccccagcgggagccccccaccaccagcgctgctgctgccatgagctgcaccggcagtgacaagggagatgagagccaggatgaggagaatgccagcagcagccaggccagcaccagcacagagaggagcctgaaggacagcctgaccaggaagaccaagatgctggtgcagttcctgctgtacaagtacaagatgaaggagcccaccaccaaggccgagatgctgaagatcatcagcaagaagtacaaggagcacttccctgagatcttcaggaaggtgtcccagaggacagagctggtgtttggcctggccctgaaggaggtgaaccccaccacccacagctacatcctggtgtccatgctgggccccaatgatggcaaccagagcagcgcctggaccctgcccagaaatggcctgctgatgcccctgctgagcgtcatcttcctgaatggaaactgtgcccgggaggaggagatctgggagttcctgaacatgctgggcatctatgatggcaagaggcacctgatctttggagagcccaggaagctgatcacccaggacctggtgcaggagaagtacctggagtaccagcaggtgcccaacagcgaccccccacgctaccagttcctgtggggcccccgggcccacgccgagaccagcaagatgaaggtgctggagttcctggccaaggtgaatgacaccacccccaacaacttccccctgctgtatgaggaggccctgagagatgaggaggagagagctggggcccggccccgggtggccgcccggcggggcaccacagccatgaccagcgcctacagccgggccaccagcagcagcagcagccagcccatgtag

SEQ ID NO: 159282 - DNA, 828 bp, Artificial Sequence
  Description of Artificial Sequence: Synthetic coding sequence
atgaccagcgctggggtcttcaatgccggcagtgatgagcgggccaacagcagagatgaggagtacccctgcagcagcgaggtgagccccagcacagagagcagctgcagcaacttcatcaacatcaaggtgggcctgctggagcagttcctgctgtacaagttcaagatgaagcagaggatcctgaaggaggacatgctgaagatcgtgaacccccgctaccagaaccagtttgctgagatccacagaagagccagcgagcacatcgaggtggtgtttgctgtggacctgaaggaggtgaaccccacctgccacctgtatgacctggtgtccaagctgaagctgcccaacaacggccgcatccacgtgggcaaggtgctgcccaagacaggcctgctgatgaccttcctggtggtgatcttcctgaagggcaactgtgccaacaaggaggacacctggaagttcctggacatgatgcagatctatgatggcaagaagtactacatctacggggagcccaggaagctgatcacccaggactttgtgcggctgacctacctggagtaccaccaggtgccctgcagctacccagcccactaccagttcctgtggggcccccgggcctacacagagaccagcaagatgaaggtgctggagtacctggccaaggtgaatgacatcgcccctggggccttcagcagccagtatgaggaggccctgcaggatgaggaggagagccccagccagcgctgcagcaggaactggcactactgcagcggccaggactgcctgcgggccaagttcagcagcttcagccagccctactag

SEQ ID NO: 159283 - DNA, 1224 bp, Artificial Sequence
  Description of Artificial Sequence: Synthetic coding sequence
atgccccggggccacaagagcaagctgcggacctgtgagaagaggcaggagaccaacggccagccccagggcctgaccggcccccaggccacagctgagaagcaggaggagagccacagcagcagcagcagcagccgggcctgcctgggggactgcagaagaagcagtgatgccagcatcccccaggagagccagggcgtgagccccaccggcagcccagatgctgtggtgtcctacagcaagagtgatgtggccgccaacggccaggatgagaagagccccagcaccagcagagatgcctctgtgccccaggagagccagggcgccagccccaccggcagcccagatgctggggtgtctggcagcaaatatgatgtggccgccaacggccaggatgagaagagccccagcaccagccatgatgtgtctgtgccccaggagagccagggcgccagccccaccggcagcccagatgctggggtgtctggcagcaaatatgatgtggccgcagaaggagaagatgaggagagcgtgtctgccagccagaaggccatcatcttcaagaggctgagcaaggatgctgtgaagaagaaggcctgcaccctggcccagttcctgcagaagaagtttgagaagaaggagagcatcctgaaggctgacatgctgaagtgtgtgcggcgggagtacaagccctacttcccccagatcctgaacagaaccagccagcacctggtggtggccttcggcgtggagctgaaggagatggacagcagcggggagagctacaccctggtgtccaagctgggcctgcccagcgagggcatcctgagcggggacaatgccctgcccaagagcggcctgctgatgagcctgctggtggtgatcttcatgaatggaaactgtgccacagaggaggaggtgtgggagttcctgggcctgctgggcatctatgatggcatcctgcacagcatctatggagatgccaggaagatcatcacagaggacctggtgcaggacaagtatgtggtgtaccggcaggtgtgcaacagcgaccccccctgctatgagttcctgtggggcccccgggcctatgcagagaccaccaagatgagggtgctgcgggtgctggccgacagcagcaacaccagccctggcctgtacccccacctgtatgaagatgccctgattgatgaggtggagcgggccctgcggctgcgggcctag

SEQ ID NO: 159284 - DNA, 3429 bp, Artificial Sequence
  Description of Artificial Sequence: Synthetic coding sequence
atgggagacaaggacatgcccacagctggcatgcccagcctgctgcagagcagcagcgagagcccccagagctgcccagaaggagaggacagccagagccccctgcagatcccccagagcagccctgagagtgatgacaccctgtaccccctgcagagcccccagagccgctcagaaggagaggacagcagtgaccccctgcagaggcctcctgagggcaaggacagccagagccccctgcagatcccccagagcagcccagaaggagatgacacccagagccccctgcagaacagccagagcagccctgagggcaaggacagcctgagccccctggagatcagccagagccccccagagggggaggatgtgcagagccccctgcagaacccagccagcagcttcttcagcagcgccctgctgagcatcttccagagcagccctgagagcacccagagcccctttgagggcttcccccagagcgtgctgcagatccctgtgtctgctgccagcagcagcaccctggtgtccatcttccagagcagccctgagagcacccagagcccctttgagggcttcccccagagccccctgcagatccctgtgagccgctccttcagcagcaccctgctgagcatcttccagagcagccctgagaggacccagagcacctttgagggctttgcccagagccccctgcagatccctgtgagccccagcagcagcagcaccctgctgagcctcttccagagcttcagcgagaggacccagagcacctttgagggctttgcccagagcagcctgcagatccctgtgagccccagcttcagcagcaccctggtgtccctcttccagagcagccctgagaggacccagagcacctttgagggcttcccccagagccccctgcagatccctgtgagcagcagcagcagcagcaccctgctgagcctcttccagagcagccctgagaggacccacagcacctttgagggcttcccccagagcctgctgcagatccccatgaccagcagcttcagcagcaccctgctgagcatcttccagagcagccctgagagcgcccagagcacctttgagggcttcccccagagccccctgcagatccctggcagccccagcttcagcagcaccctgctgagcctcttccagagcagccctgagaggacccacagcacctttgagggcttcccccagagccccctgcagatccccatgaccagcagcttcagcagcaccctgctgagcatcctgcagagcagccctgagagcgcccagagcgcctttgagggcttcccccagagccccctgcagatccctgtgagcagcagcttctcctacaccctgctgagcctcttccagagcagccctgagaggacccacagcacctttgagggcttcccccagagccccctgcagatccctgtgagcagcagcagcagcagcagcaccctgctgagcctcttccagagcagccctgagtgcacccagagcacctttgagggcttcccccagagccccctgcagatcccccagagccccccagagggggagaacacccacagccccctgcagatcgtgcccagcctgcctgagtgggaggacagcctgagcccccactacttcccccagagccccccccagggcgaggacagcctgagcccccactacttcccccagagccccccccagggcgaggacagcctgagcccccactacttcccccagagcccccagggcgaggacagcctgagcccccactacttcccccagagccccccccagggagaagattccatgagccccctgtacttcccccagagccccctgcagggcgaggagttccagagcagcctgcagagccctgtgtccatctgcagcagcagcacccccagcagcctgccccagagcttccctgagagcagccagagccccccagagggccctgtgcagagccccctgcacagcccccagagccccccagagggcatgcacagccagagccccctgcagagccctgagagcgcccctgagggggaggacagcctgagccccctgcagatcccccagagccccctggagggggaggacagcctgagcagcctgcacttcccccagagccccccagagtgggaggacagcctgagccccctgcacttcccccagttccccccccagggcgaggacttccagagcagcctgcagagccctgtgtccatctgcagcagcagcaccagcctgagcctgccccagagcttccctgagagcccccagagccccccagagggccctgcccagagccccctgcagaggcctgtgtcctccttcttctcctacaccctggccagcctgctgcagagcagccatgagagcccccagagccccccagagggccctgcccagagccccctgcagagccctgtgagcagcttccccagcagcaccagcagcagcctgagccagagcagccctgtgtcctccttccccagcagcaccagcagcagcctgagcaagagcagccctgagagccccctgcagagccctgtgatctccttcagcagcagcaccagcctgagccccttcagcgaggagagcagcagccctgtggatgagtacaccagcagcagtgacaccctgctggagagtgacagcctgacagacagcgagagcctcatcgagagcgagcccctcttcacctacaccctggatgagaaggtggatgagctggcccgcttcctgctgctgaagtaccaggtgaagcagcccatcaccaaggccgagatgctgaccaacgtcatcagccgctacacaggctacttccctgtgatcttcaggaaggcccgggagttcatcgagatcctgtttggcatcagcctgcgggaggtggaccctgatgacagctatgtgtttgtgaacaccctggacctgaccagcgagggctgcctgagtgatgagcagggcatgagccagaaccggctgctgatcctgatcctgagcatcatcttcatcaagggcacctacgccagcgaggaggtgatctgggatgtgctgagcggcatcggcgtgcgggccggccgggagcactttgcctttggagagccccgggagctgctgaccaaggtgtgggtgcaggagcactacctggagtaccgggaggtgcccaacagcagcccccccaggtatgagttcctgtggggcccccgggcccacagcgaggtgatcaagaggaaggtggtggagttcctggccatgctgaagaacacagtgcccatcaccttccccagcagctacaaggatgccctgaaggatgtggaggagcgggcccaggccatcatcgacaccacagatgacagcacagccacagaaagtgccagcagctctgtgatgagccccagcttcagcagcgagtag

SEQ ID NO: 159285 - DNA, 354 bp, Artificial Sequence
  Description of Artificial Sequence: Synthetic coding sequence
ggggacaaggacatgcccacagctggcatgcccagcctgctgcagagcagcagcgagagcccccagagctgcccagagggggaggacagccagagccccctgcagatccctgtgagccccagcagcagcagcaccctgctgagcctcttccagagcttcagcgagaggacccagagcacctttgagggctttgcccagagcagcctgcagatccctgtgagccccagcttcagcagcaccctggtgtccctcttccagagcagccctgagaggacccagagcacctttgagggcttcccccagagccccctgcagatccctgtgagcagcagcagcagcagcaccctgctgtag

SEQ ID NO: 159286 - DNA, 357 bp, Artificial Sequence
  Description of Artificial Sequence: Synthetic coding sequence
atgggagacaaggacatgcccacagctggcatgcccagcctgctgcagagcagcagcgagagcccccagagctgcccagaaggagaggacagccagagccccctgcagatccctgtgagccccagcagcagcagcaccctgctgagcctcttccagagcttcagcgagaggacccagagcacctttgagggctttgcccagagcagcctgcagatccctgtgagccccagcttcagcagcaccctggtgtccctcttccagagcagccctgagaggacccagagcacctttgagggcttcccccagagccccctgcagatccctgtgagcagcagcagcagcagcaccctgctgtag

SEQ ID NO: 159287 - DNA, 630 bp, Artificial Sequence
  Description of Artificial Sequence: Synthetic coding sequence
atgctgaccaacgtcatcagccgctacacaggctacttccctgtgatcttcaggaaggcccgggagttcatcgagatcctgtttggcatcagcctgcgggaggtggaccctgatgacagctatgtgtttgtgaacaccctggacctgaccagcgagggctgcctgagtgatgagcagggcatgagccagaaccggctgctgatcctgatcctgagcatcatcttcatcaagggcacctacgccagcgaggaggtgatctgggatgtgctgtctggaattggagtgcgggccggccgggagcactttgccttcggggagccccgggagctgctgaccaaggtgtgggtgcaggagcactacctggagtaccgggaggtgcccaacagcagccccccaagatatgagttcctgtggggcccccgggcccacagcgaggtgatcaagaggaaggtggtggagttcctggccatgctgaagaacacagtgcccatcaccttccccagcagctacaaggatgccctgaaggatgtggaggagcgggcccaggccatcatcgacaccacagatgacagcacagccacagagagcgccagcagctctgtgatgagccccagcttcagcagcgagtag

SEQ ID NO: 159288 - DNA, 1122 bp, Artificial Sequence
  Description of Artificial Sequence: Synthetic coding sequence
atgcctcctgtgcctggggtgcccttcagaaatgtggacaatgacagccccacctctgtggagctggaggactgggtggatgcccagcaccccacagatgaggaggaggaggaggccagcagcgccagcagcaccctgtacctggtgttcagccccagcagcttcagcaccagcagcagcctcatcctgggcggccctgaggaggaggaggtgcccagcggggtcatccccaacctgacagagagcatccccagcagccccccccagggccccccccagggccccagccagagccccctgagcagctgctgcagcagcttctcctggagcagcttcagcgaggagagcagcagccagaagggggaggacaccggcacctgccagggcctgcctgattctgagagcagcttcacctacaccctggatgagaaggtggccgagctggtggagttcctgctgctgaagtatgaggccgaggagcctgtgacagaagctgagatgctgatgatcgtcatcaagtacaaggactacttccctgtgatcctgaagagggcccgggagttcatggagctgctgtttggcctggccctgattgaggtgggccctgaccacttctgtgtgtttgccaacacagtgggcctgacagatgagggcagtgatgatgagggcatgcctgagaacagcctgctgatcatcatcctgagcgtcatcttcatcaagggcaactgtgccagcgaggaggtgatctgggaggtgctgaatgctgtgggcgtgtatgccggccgggagcactttgtgtatggagagccccgggagctgctgaccaaggtgtgggtgcagggccactacctggagtaccgggaggtgccccacagcagccccccctactatgagttcctgtggggcccccgggcccacagcgagagcatcaagaagaaggtgctggagttcctggccaagctgaacaacacagtgcccagcagcttccccagctggtacaaggatgccctgaaggatgtggaggagcgggtgcaggccaccatcgacacagcagatgatgccaccgtgatggccagcgagagcctgtctgtgatgagcagcaatgtgtccttcagcgagtag

SEQ ID NO: 159289 - DNA, 1932 bp, Artificial Sequence
  Description of Artificial Sequence: Synthetic coding sequence
atgctgctgccctgccactgggtgctggatgccaccttcagtgatggcagcctgggccagtgggtgaagaacacctgtgccacctacgccctgagccctgtggtgctgcccccccagccccagcccaggaagaaggccacagacaaggactacagcgccttccacctgggccacctgcgggaggtgcggctcttcctgcggggcggcaccagtgaccagaggatggacagcctggtgctgtgccccacctacttcaagctgtggaggaccctgagcggcagccctggcctgcagctgagtgacctgcacttcggcagccagcctgagggcaagttcagcctgcggcgggctgtgtctgtgaagcagcgggaggagccccaggactggcccctgaatgagaagaggaccctgtggaaggacagcgacctgcccacctggaggcggggcaccggctacaccctgagcctgcctgctgtgtccccaggcaagaggctgtggggcgagaaggccggcagcctgcctgagagcgagcccctcttcacctacaccctggatgagaaggtggacaagctggtgcagttcctgctgctgaagtaccaggccaaggagcccctgaccagggctgagatgcagatgaatgtcatcaacacctacacaggctacttccccatgatcttcaggaaggcccgggagttcatcgagatcctgtttggcatcagcctgacagaggtggaccctgaccacttctacgtgtttgtgaacaccctggacctgacctgtgagggcagcctgagtgatgagcagggcatgccccagaaccggctgctgatcctgatcctgagcgtcatcttcatcaagggcaactgtgccagcgaggaggtgatctgggaggtgctgaatgccatcggcccctggagcgccctggccggctttgctgatgtgctgagccggctggccctgtgggagagcgagggccctgaggccttctgtgaggagagcggcctgcggtctgctgagggctctgtgctggacctggccaacccccagggcctggccggccaccggcaggaggatggccggcggggcctgacagaggccagcccccagcagaagaagggaggagaagatgaggacatgcctgctgctggcatgccacccctgccccagagccccccagagatccccccccagggcccccccaagatcagcccccagggccccccccagagccccccccagagccccctggacagctgcagcagccccctgctgtggacccggctggatgaggagagcagcagcgaggaggaggacacagccacctggcacgccctgcctgagagcgagagcctgcccaggtatgccctggatgagaaggtggccgagctggtgcagttcctgctgctgaagtaccagaccaaggagcctgtgaccaaggccgagatgctgaccaccgtcatcaagaagtacaaggactacttccccatgatctttgggaaggcccacgagttcatcgagctgatctttggaattgccctgacagacatggaccctgacaaccacagctacttctttgaggacaccctggacctgacctatgagggcagcctgattgatgaccagggcatgcccaagaactgcctgctgatcctgatcctgtccatgatcttcatcaagggcagctgtgtgcctgaggaggtgatctgggaggtgctgagcgccatcggccccatccagaggcctgcccgggaggtgctggagttcctgagcaagctgagcagcatcatccccagcgccttccccagctggtacatggatgccctgaaggacatggaggaccgggcccaggccatcatcgacaccacagatgatgccacagccatggccagcgccagccccagcgtgatgagcaccaacttctgcccagagtag

SEQ ID NO: 159290 - DNA, 801 bp, Artificial Sequence
  Description of Artificial Sequence: Synthetic coding sequence
atgcctgctgctggcatgccacccctgccccagagccccccagagatccccccccagggcccccccaagatcagcccccagggccccccccagagccccccccagagccccctggacagctgcagcagccccctgctgtggacccggctggatgaggagagcagcagcgaggaggaggacacagccacctggcacgccctgcctgagagcgagagcctgcccaggtatgccctggatgagaaggtggccgagctggtgcagttcctgctgctgaagtaccagaccaaggagcctgtgaccaaggccgagatgctgaccaccgtcatcaagaagtacaaggactacttccccatgatctttgggaaggcccacgagttcatcgagctgatctttggaattgccctgacagacatggaccctgacaaccacagctacttctttgaggacaccctggacctgacctatgagggcagcctgattgatgaccagggcatgcccaagaactgcctgctgatcctgatcctgtccatgatcttcatcaagggcagctgtgtgcctgaggaggtgatctgggaggtgctgagcgccatcggcgtgtgtgccggccgggagcacttcatctacggggaccccaggaagctgctgaccatccactgggtgcagaggaagtacctggagtaccgggaggtgcccaacagcgccccacccaggtatgagttcctgtggggcccccgggcccacagcgaggccagcaagaggagcctgcgggtcttcatccaggccatccagtaccacccctag

SEQ ID NO: 159291 - DNA, 381 bp, Artificial Sequence
  Description of Artificial Sequence: Synthetic coding sequence
atggacaccggccagctgcagctgagccgggagaggagccctggggccggccagcaggcccggcgggagctgtgtggccgcatcgccatcagccagcacggcggcaaggcccaggccagccccagccacagcctgctgagccccctggacaagacagatggagagccctggagcgccctggccggctttgctgatgtgctgagccggctggccctgtgggagagcgagggccctgaggccttctgtgaggagagcggcctgcggtctgctgagggctctgtgctggacctggccaacccccagggcaagggccccaagggggagctgcgggactttgcccccaggacagaggaggcccctgtgtgcccagccctgccctag

SEQ ID NO: 159292 - DNA, 1041 bp, Artificial Sequence
  Description of Artificial Sequence: Synthetic coding sequence
atgcccctcttccccaacctgccccggctgagctttgaggaggacttccagaaccccagcgtgacagaggacctggtggatgcccaggacagcattgatgaggaggaggaggatgccagcagcaccagcagcagcagcttccacttcctgttccccagcagcagcagcctgagcagcagcagccccctgagcagccccctgcccagcaccctcatcctgggcgtgcctgaagatgaggacatgcctgctgctggcatgccacccctgccccagagccccccagagatccccccccagggcccccccaagatcagcccccagggccccccccagagccccccccagagccccctggacagctgcagcagccccctgctgtggacccggctggatgaggagagcagcagcgaggaggaggacacagccacctggcacgccctgcctgagagcgagagcctgcccaggtatgccctggatgagaaggtggccgagctggtgcagttcctgctgctgaagtaccagaccaaggagcctgtgaccaaggccgagatgctgaccaccgtcatcaagaagtacaaggactacttccccatgatctttgggaaggcccacgagttcatcgagctgatctttggaattgccctgacagacatggaccctgacaaccacagctacttctttgaggacaccctggacctgacctatgagggcagcctgattgatgaccagggcatgcccaagaactgcctgctgatcctgatcctgtccatgatcttcatcaagggcagctgtgtgcctgaggaggtgatctgggaggtgctgagcgccatcggcgtgtgtgccggccgggagcacttcatctacggggaccccaggaagctgctgaccatccactgggtgcagaggaagtacctggagtaccgggaggtgcccaacagcgccccacccaggtatgagttcctgtggggcccccgggcccacagcgaggccagcaagaggagcctgcgggtcttcatccaggccatccagtaccacccctag

SEQ ID NO: 159293 - DNA, 1041 bp, Artificial Sequence; identical to SEQ ID NO: 159292
  Description of Artificial Sequence: Synthetic coding sequence

SEQ ID NO: 159294 - DNA, 2337 bp, Artificial Sequence
  Description of Artificial Sequence: Synthetic coding sequence
atggcccagaagatggactgtggggccggcctgctgggcttccaggccgaggcctctgtggaggacagcgccctgctgatgcagaccctgatggaggccatccagatcagcgaggccccacccaccaaccaggccacagctgctgccagcccccagagcagccagcccccaacagccaatgagatggctgacatccaggtgtctgctgctgctgcccggcccaagagcgccttcaaggtgcagaatgccaccaccaagggccccaatggagtgtatgacttcagccaggcccacaatgccaaggatgtgcccaacacccagcccaaggccgccttcaagagccagaatgccacccccaagggccccaatgctgcctatgacttcagccaggccgccaccaccggggagctggccgccaacaagtctgagatggccttcaaggcccagaatgccaccaccaaggtgggccccaatgccacctacaacttcagccagagcctgaatgccaatgacctggccaacagccggcccaagacccccttcaaggcctggaatgacaccaccaaggcccccacagctgacacccagacccagaatgtgaaccaggccaagatggccaccagccaggccgacatcgagacagaccccggcatcagcgagccagatggagccacagcccagaccagcgcagatggcagccaggcccagaacctggagagcaggaccatcatccggggcaagaggaccaggaagatcaacaacctgaatgtggaggagaacagcagcggggaccagaggcgggcccccctggccgccggcacctggaggtctgcccctgtgcctgtgaccacccagaaccccccaggggcccccccaaatgtgctgtggcagacccccctggcctggcagaaccccagcggctggcagaaccagacagcccggcagaccccaccagcccggcagagccccccagcccggcagaccccaccagcctggcagaaccctgtggcctggcagaaccctgtgatctggcccaaccctgtgatctggcagaaccctgtgatctggcccaaccccatcgtgtggccaggccctgtggtgtggcccaaccccctggcctggcagaaccccccaggctggcagaccccacctggctggcagaccccacctggctggcagggccccccagactggcagggccccccagactggcccctgcccccagactggcccctgcccccagactggcccctgcccacagactggcccctgcccccagactggatcccagctgactggcccatccccccagactggcagaacctgcggcccagccccaacctgcggcccagccccaacagccgggccagccagaaccctggggccgcccagcccagagatgtggccctgctgcaggagcgggccaacaagctggtgaagtacctgatgctgaaggactacaccaaggtgcccatcaagaggtctgagatgctgcgggacatcatccgggagtacacagatgtgtacccagagatcatcgagcgggcctgctttgtgctggagaagaagtttggcatccagctgaaggagattgacaaggaggagcacctgtacatcctgatcagcaccccagagagcctggccggcatcctgggcaccaccaaggacacccccaagctgggcctgctgctggtgatcctgggcgtcatcttcatgaatggaaacagagccagcgaggccgtgctgtgggaggccctgaggaagatgggcctgcggcctggggtgcgccaccccctgctgggggacctgaggaagctgctgacctatgaatttgtgaagcagaagtacctggactaccgccgggtgcccaacagcaaccccccagaatatgagttcctgtggggcctgcggagctaccacgagaccagcaagatgaaggtgctgcgcttcatcgccgaggtgcagaagagggacccccgggactggacagcccagttcatggaggccgcagatgaggccctggatgccctggatgctgctgctgctgaggccgaggcccgggcagaggcccggaccaggatgggcattggagatgaggccgtgtctggcccctggagctgggatgacatcgagtttgagctgctgacctgggatgaggagggggactttggagacccctggagccgcatccccttcaccttctgggcccgctaccaccagaatgcccggagccgcttcccccagacctttgctggccccatcatcggccctgggggcacagccagcgccaactttgctgccaactttggagccatcggcttcttctgggtggagtag

SEQ ID NO: 159295 - DNA, 2505 bp, Artificial Sequence
  Description of Artificial Sequence: Synthetic coding sequence
atggcccagaagatggactgtggggccggcctgctgggcttccagaacccagatgcctgcagagctgtgtgccaccccctgccccagcccccagccagcaccctgcccctgagcgccttccccaccctgtgtgaccccccctacagccagctgcgggaccccccagctgtgctgagctgctactgcacccccctgggcgccagccctgccccagctgaggcctctgtggaggacagcgccctgctgatgcagaccctgatggaggccatccagatcagcgaggccccacccaccaaccaggccacagctgctgccagcccccagagcagccagcccccaacagccaatgagatggctgacatccaggtgtctgctgctgctgcccggcccaagagcgccttcaaggtgcagaatgccaccaccaagggccccaatggagtgtatgacttcagccaggcccacaatgccaaggatgtgcccaacacccagcccaaggccgccttcaagagccagaatgccacccccaagggccccaatgctgcctatgacttcagccaggccgccaccaccggggagctggccgccaacaagtctgagatggccttcaaggcccagaatgccaccaccaaggtgggccccaatgccacctacaacttcagccagagcctgaatgccaatgacctggccaacagccggcccaagacccccttcaaggcctggaatgacaccaccaaggcccccacagctgacacccagacccagaatgtgaaccaggccaagatggccaccagccaggccgacatcgagacagaccccggcatcagcgagccagatggagccacagcccagaccagcgcagatggcagccaggcccagaacctggagagcaggaccatcatccggggcaagaggaccaggaagatcaacaacctgaatgtggaggagaacagcagcggggaccagaggcgggcccccctggccgccggcacctggaggtctgcccctgtgcctgtgaccacccagaaccccccaggggcccccccaaatgtgctgtggcagacccccctggcctggcagaaccccagcggctggcagaaccagacagcccggcagaccccaccagcccggcagagccccccagcccggcagaccccaccagcctggcagaaccctgtggcctggcagaaccctgtgatctggcccaaccctgtgatctggcagaaccctgtgatctggcccaaccccatcgtgtggccaggccctgtggtgtggcccaaccccctggcctggcagaaccccccaggctggcagaccccacctggctggcagaccccacctggctggcagggccccccagactggcagggccccccagactggcccctgcccccagactggcccctgcccccagactggcccctgcccacagactggcccctgcccccagactggatcccagctgactggcccatccccccagactggcagaacctgcggcccagccccaacctgcggcccagccccaacagccgggccagccagaaccctggggccgcccagcccagagatgtggccctgctgcaggagcgggccaacaagctggtgaagtacctgatgctgaaggactacaccaaggtgcccatcaagaggtctgagatgctgcgggacatcatccgggagtacacagatgtgtacccagagatcatcgagcgggcctgctttgtgctggagaagaagtttggcatccagctgaaggagattgacaaggaggagcacctgtacatcctgatcagcaccccagagagcctggccggcatcctgggcaccaccaaggacacccccaagctgggcctgctgctggtgatcctgggcgtcatcttcatgaatggaaacagagccagcgaggccgtgctgtgggaggccctgaggaagatgggcctgcggcctggggtgcgccaccccctgctgggggacctgaggaagctgctgacctatgaatttgtgaagcagaagtacctggactaccgccgggtgcccaacagcaaccccccagaatatgagttcctgtggggcctgcggagctaccacgagaccagcaagatgaaggtgctgcgcttcatcgccgaggtgcagaagagggacccccgggactggacagcccagttcatggaggccgcagatgaggccctggatgccctggatgctgctgctgctgaggccgaggcccgggcagaggcccggaccaggatgggcattggagatgaggccgtgtctggcccctggagctgggatgacatcgagtttgagctgctgacctgggatgaggagggggactttggagacccctggagccgcatccccttcaccttctgggcccgctaccaccagaatgcccggagccgcttcccccagacctttgctggccccatcatcggccctgggggcacagccagcgccaactttgctgccaactttggagccatcggcttcttctgggtggagtag

SEQ ID NO: 159296 - DNA, 2337 bp, Artificial Sequence; identical to SEQ ID NO: 159294
  Description of Artificial Sequence: Synthetic coding sequence

SEQ ID NO: 159297 - DNA, 2337 bp, Artificial Sequence; identical to SEQ ID NO: 159294
  Description of Artificial Sequence: Synthetic coding sequence

SEQ ID NO: 159298 - DNA, 414 bp, Artificial Sequence
  Description of Artificial Sequence: Synthetic coding sequence
atggcccagaagatggactgtggggccggcctgctgggcttccaggccgaggcctctgtggaggacagcgccctgctgatgcagaccctgatggaggccatccagatcagcgaggccccacccaccaaccaggccacagctgctgccagcccccagagcagccagcccccaacagccaatgagatggctgacatccaggtgtctgctgctgctgcccggcccaagagcgccttcaaggtgcagaatgccaccaccaagggccccaatggagtgtatgacttcagccagagcctgaatgccaatgacctggccaacagccggcccaagacccaggtgtccctgaacctgactgtgcagctgcaccgccaccagcagatggtgccccggctgcgcatctggagccctggccagtag

SEQ ID NO: 159299 - DNA, 3942 bp, Artificial Sequence
  Description of Artificial Sequence: Synthetic coding sequence
atgagcggctggagatacctgatctgtgtgtccttcctgctgaccatcctgctggagctgacctaccagggcccccctgtgcctgccagcagcagcaccaagctgctgatgaccagctacagcatgaggagcacagtggtgagccgctatgcccacaccctggtgacctctgtgctcttcaacccccacgccgaggcccacgaggccatctttgacctggacctgccccacctggccttcatcagcaacttcaccatgaccatcaacaacaaggtgtacatcgccgaggtgaaggagaagcaccaggccaagaagatctatgaggaggcccaccagcagggcaagacagctgcccacgtgggcatccgggaccgggagagcgagaagttccgcatcagcaccagcctggccgccggcacagaggtgaccttcagcctggcctatgaggagctgctgcagaggcaccagggccagtaccagctggtggtgtccctgcggcccggccagctggtgaagaggctgagcattgaggtgacagtgtctgagaggacaggcatctcctatgtgcacatcccccccctgaggacaggccgcctgcggaccaatgcccacgccagcgaggtggacagcccccccagcacccgcatcgagcggggggagacctgtgtgcgcatcacctactgccccaccctgcaggaccagagcagcatcagcggcagcggcatcatggctgacttcctggtgcagtatgatgtggtgatggaggacatcattggagatgtgcagatctatgatgactacttcatccactactttgccccccggggcctgccccccatggagaagaatgtggtgtttgtgattgatgtgagcagctccatgtttggcaccaagatggagcagaccaagacagccatgaatgtcatcctgagtgacctgcaggccaatgactacttcaacatcatctccttcagtgacacagtgaatgtgtggaaggccggcggcagcatccaggccaccatccagaatgtgcacagcgccaaggactacctgcactgcatggaggctgatggctggacagatgtgaacagcgccctgctggccgccgcctctgtgctgaaccacagcaaccaggagcccggccggggccccagcgtgggccgcatccccctcatcatcttcctgacagatggagagcccacagctggggtgaccacccccagcgtcatcctgagcaatgtgcggcaggccctgggccaccgggtgtccctcttcagcctggcctttggagatgatgctgacttcaccctgctgcggcggctgagcctggagaacagaggcatcgcccggcgcatctatgaggacacagatgctgccctgcagctgaagggcctgtatgaggagatctccatgcccctgctggctgatgtgcggctgaactacctgggcggcctggtgggcgccagcccctgggccgtgttccccaactactttggaggcagcgagctggtggtggccggccaggtgcagcccgggaagcaggagctgggcatccacctggccgcccggggccccaaggaccagctgctggtggcccaccacagcgagggcgccaccaacaacagccagaaggccttcggctgccctggagagcccgccccaaatgtggcccacttcatccggcggctgtgggcctacgtgaccatcggggagctgctggatgcccacttccaggcccgggacaccaccaccaggcacctgctggccgccaaggtgctgaacctgagcctggagtacaactttgtgacccccctgaccagcctggtgatggtgcagcccaagcaggccagcgaggagacccggcggcagaccagcaccagcgctggccctgacaccatcatgcccagcagcagcagcagacatggcctgggcgtgtccacagcccagcctgccctggtgcccaaggtgatcagccccaagagcaggcctgtgaagcccaagttctacctgagcagcaccaccacagccagcaccaagaagatgctgagcagcaaggagctggagcccctgggggagagcccccacaccctgtccatgcccacctaccccaaggccaagatcccagcccagcaggacagcggcaccctggcccagcccaccctgcggaccaagcccaccatcctggtgcccagcaacagcggcaccctgctgcccctgaagccaggcagcctgagccaccagaacccagacatcctgcccaccaacagcaggacccaggtgccccctgtgaagccaggcatcccagccagccccaaggctgacacagtgaagtgtgtgacccccctgcacagcaagccaggggcccccagccacccccagctgggcgccctgaccagccaggcccccaagggcctgccccagagcaggcctggggtgtccaccctgcaggtgcccaagtaccccctgcacacccggccccgggtgcctgcccccaagaccaggaacaacatgccccacctgggccctggcatcctgctgagcaagacccccaagatcctgctgagcctgaagcccagcgccccaccccaccagatcagcaccagcatcagcctgagcaagccagagacccccaacccccacatgccccagacccccctgccccccaggccagaccggcccaggcctcccctgcctgagagcctgagcaccttccccaacaccatcagcagcagcacaggccccagcagcaccaccaccacctctgtgctgggggagcccctgcccatgcccttcacccccaccctgcccccaggccgcttctggcaccagtatgacctgctgcccggcccccagaggacccggcaggtgctgggccccagcaggcctggggtgcccaccatgagcctgctgaacagcagccggcccaccccagagggcagcccccccaacctgcccatcctgctgcccagcagcatcctgcctgaggccatcagcctgctgctgctgcctgaggagctggagctgctgtctgagagcatggtggagagcaagtttgtggagagcctgaaccccccagccttctacaccttcctgaccccagatgaagatggcagccccaactgggatggcaacagcgaggagatcctgggcggggccggcggctccatggagagccagggcagctctgtgggcctggccaagggcaccctgcccagcatcttcaccttcagcagctctgtggatggagacccccacttcgtcatccagatcccccacagcgaggagaagatctgcttcaccctgaatggccaccctggggacctgctgcagctgattgaggaccccaaggccggcctgcacgtgtctgggaagctgctgggcgccccaccccggcccggccacaaggaccagaccaggacctacttccagatcatcaccgtgaccacagacaagccccgggcctacaccatcaccatcagccgcagcagcatcagcctgcggggggagggcaccctgcggctgtcctgggaccagcctgccctgctgaagaggccccagctggagctgtatgtggccgccgccgcccggctgaccctgcggctgggcccctacctggagttcctggtgctgcggcaccgctaccgccaccccagcaccctgcagctgccccacctgggcttctacgtggccaatggaagtggcctgagccccagcgcccggggcctgattggccagttccagcacgccgacatccggctggtgacaggccccatgggcccctgcctgcggcggcaccacggcccagatgtgcctgtgatcctgggcaagaggctgctgaaggacagcccccggctgctgccccgctgggccagctgctggctggtgaagaggagccacgtggagctgctgctgggccacccctacctgtcctatgtgctgtag

SEQ ID NO: 159300 - DNA, 1767 bp, Artificial Sequence
  Description of Artificial Sequence: Synthetic coding sequence
atgtctgacaccagcgagagcggggccggcctgacccgcttccaggccgaggccagcgagaaggacagcagctccatgatgcagaccctgctgactgtgacccagaatgtggaggtgcctgagacccccaaggccagcaaggccacagaggtgtccaagaccccagaggcccgggaggccccagccacccaggccagcagcaccacccagctgacagacacccaggtgctggccgctgagaacaagagcctggccgctgacaccaagaagcagaatgctgacccccaggccgtgaccatgcctgccacagagaccaagaaggtgagccacgtggccgacaccaaggtgaacaccaaggcccaggagacagaagctgcccccagccaggccccagcagatgagcctgagcctgagagcgctgctgcccagagccaggagaaccaggacacccggcccaaggtgaaggccaagaaggccaggaaggtgaagcacctggatggagaagaagatggcagcagtgaccagagccaggccagcggcaccaccggcggcagaagagtgtccaaggccctgatggcctccatggcccggcgggccagccggggccccatcgccttctgggcccggcgggccagcaggacccggctggccgcctgggcccggcgggccctgctgagcctgcggagccccaaggcccggcggggcaaggccaggagaagagctgccaagctgcagagcagccaggagcctgaggcccccccaccaagagatgtggccctgctgcagggccgggccaatgacctggtgaagtacctgctggccaaggaccagaccaagatccccatcaagagaagtgacatgctgaaggacatcatcaaggagtacacagatgtgtacccagagatcatcgagcgggccggctacagcctggagaaggtgtttggcatccagctgaaggagattgacaagaatgaccacctgtacatcctgctgagcaccctggagcccacagatgctggcatcctgggcaccaccaaggacagccccaagctgggcctgctgatggtgctgctgagcatcatcttcatgaatggaaacagaagcagcgaggccgtcatctgggaggtgctgaggaagctgggcctgcggcccggcatccaccacagcctgtttggagatgtgaagaagctgatcacagatgaatttgtgaagcagaagtacctggactatgcccgggtgcccaacagcaaccccccagaatatgagttcttctggggcctgcggagctactatgagaccagcaagatgaaggtgctgaagtttgcctgcaaggtgcagaagaaggaccccaaggagtgggccgcccagtaccgggaggccatggaggccgacctgaaggctgctgctgaggccgctgctgaggccaaggcccgggcagagatccgggccaggatgggcatcggcctgggctctgaaaatgctgctggcccctgcaactgggatgaagctgacatcggcccctgggccaaggcccgcatccaggccggggctgaggccaaggccaaggcccaggagagcggcagcgccagcactggagccagcaccagcaccaacaacagcgccagcgccagcgccagcaccagcggcggcttctctgctggggccagcctgacagccaccctgaccttcggcctgtttgctggcctgggcggggccggggccagcaccagcggcagcagcggggcctgtggcttctcctacaagtag

SEQ ID NO: 159301 - DNA, 1653 bp, Artificial Sequence
  Description of Artificial Sequence: Synthetic coding sequence
atgtggaggagccagaggcaccggcggccccagagggtgtccaagaccccagaggcccgggaggccccagccacccaggccagcagcaccacccagctgacagacacccaggtgctggccgctgagaacaagagcctggccgctgacaccaagaagcagaatgctgacccccaggccgtgaccatgcctgccacagagaccaagaaggtgagccacgtggccgacaccaaggtgaacaccaaggcccaggagacagaagctgcccccagccaggccccagcagatgagcctgagcctgagagcgctgctgcccagagccaggagaaccaggacacccggcccaaggtgaaggccaagaaggccaggaaggtgaagcacctggatggagaagaagatggcagcagtgaccagagccaggccagcggcaccaccggcggcagaagagtgtccaaggccctgatggcctccatggcccggcgggccagccggggccccatcgccttctgggcccggcgggccagcaggacccggctggccgcctgggcccggcgggccctgctgagcctgcggagccccaaggcccggcggggcaaggccaggagaagagctgccaagctgcagagcagccaggagcctgaggcccccccaccaagagatgtggccctgctgcagggccgggccaatgacctggtgaagtacctgctggccaaggaccagaccaagatccccatcaagagaagtgacatgctgaaggacatcatcaaggagtacacagatgtgtacccagagatcatcgagcgggccggctacagcctggagaaggtgtttggcatccagctgaaggagattgacaagaatgaccacctgtacatcctgctgagcaccctggagcccacagatgctggcatcctgggcaccaccaaggacagccccaagctgggcctgctgatggtgctgctgagcatcatcttcatgaatggaaacagaagcagcgaggccgtcatctgggaggtgctgaggaagctgggcctgcggcccggcatccaccacagcctgtttggagatgtgaagaagctgatcacagatgaatttgtgaagcagaagtacctggactatgcccgggtgcccaacagcaaccccccagaatatgagttcttctggggcctgcggagctactatgagaccagcaagatgaaggtgctgaagtttgcctgcaaggtgcagaagaaggaccccaaggagtgggccgcccagtaccgggaggccatggaggccgacctgaaggctgctgctgaggccgctgctgaggccaaggcccgggcagagatccgggccaggatgggcatcggcctgggctctgaaaatgctgctggcccctgcaactgggatgaagctgacatcggcccctgggccaaggcccgcatccaggccggggctgaggccaaggccaaggcccaggagagcggcagcgccagcactggagccagcaccagcaccaacaacagcgccagcgccagcgccagcaccagcggcggcttctctgctggggccagcctgacagccaccctgaccttcggcctgtttgctggcctgggcggggccggggccagcaccagcggcagcagcggggcctgtggcttctcctacaagtag

SEQ ID NO: 159302 - DNA, 1821 bp, Artificial Sequence
  Description of Artificial Sequence: Synthetic coding sequence
atgtctgacaccagcgagagcggggccggcctgacccgcttccaggccgaggccagcgagaaggacagcagctccatgatgcagaccctgctgactgtgacccagaatgtggaggtgcctgagacccccaaggccagcaaggccctggaggtgtctgaagatgtgaaggtgtccaaggccagcggcgtgtccaaggccacagaggtgtccaagaccccagaggcccgggaggccccagccacccaggccagcagcaccacccagctgacagacacccaggtgctggccgctgagaacaagagcctggccgctgacaccaagaagcagaatgctgacccccaggccgtgaccatgcctgccacagagaccaagaaggtgagccacgtggccgacaccaaggtgaacaccaaggcccaggagacagaagctgcccccagccaggccccagcagatgagcctgagcctgagagcgctgctgcccagagccaggagaaccaggacacccggcccaaggtgaaggccaagaaggccaggaaggtgaagcacctggatggagaagaagatggcagcagtgaccagagccaggccagcggcaccaccggcggcagaagagtgtccaaggccctgatggcctccatggcccggcgggccagccggggccccatcgccttctgggcccggcgggccagcaggacccggctggccgcctgggcccggcgggccctgctgagcctgcggagccccaaggcccggcggggcaaggccaggagaagagctgccaagctgcagagcagccaggagcctgaggcccccccaccaagagatgtggccctgctgcagggccgggccaatgacctggtgaagtacctgctggccaaggaccagaccaagatccccatcaagagaagtgacatgctgaaggacatcatcaaggagtacacagatgtgtacccagagatcatcgagcgggccggctacagcctggagaaggtgtttggcatccagctgaaggagattgacaagaatgaccacctgtacatcctgctgagcaccctggagcccacagatgctggcatcctgggcaccaccaaggacagccccaagctgggcctgctgatggtgctgctgagcatcatcttcatgaatggaaacagaagcagcgaggccgtcatctgggaggtgctgaggaagctgggcctgcggcccggcatccaccacagcctgtttggagatgtgaagaagctgatcacagatgaatttgtgaagcagaagtacctggactatgcccgggtgcccaacagcaaccccccagaatatgagttcttctggggcctgcggagctactatgagaccagcaagatgaaggtgctgaagtttgcctgcaaggtgcagaagaaggaccccaaggagtgggccgcccagtaccgggaggccatggaggccgacctgaaggctgctgctgaggccgctgctgaggccaaggcccgggcagagatccgggccaggatgggcatcggcctgggctctgaaaatgctgctggcccctgcaactgggatgaagctgacatcggcccctgggccaaggcccgcatccaggccggggctgaggccaaggccaaggcccaggagagcggcagcgccagcactggagccagcaccagcaccaacaacagcgccagcgccagcgccagcaccagcggcggcttctctgctggggccagcctgacagccaccctgaccttcggcctgtttgctggcctgggcggggccggggccagcaccagcggcagcagcggggcctgtggcttctcctacaagtag

SEQ ID NO: 159303 - DNA, 1821 bp, Artificial Sequence; identical to SEQ ID NO: 159302
  Description of Artificial Sequence: Synthetic coding sequence

SEQ ID NO: 159304 - DNA, 1566 bp, Artificial Sequence
  Description of Artificial Sequence: Synthetic coding sequence
atgtctgacaccagcgagagcggggccggcctgacccgcttccaggccgaggccagcgagaaggacagcagctccatgatgcagaccctgctgactgtgacccagaatgtggaggtgcctgagacccccaaggccagcagcaccacccagctgacagacacccaggtgctggccgctgagaacaagagcctggccgctgacaccaagaagcagaatgctgacccccaggccgtgaccatgcctgccacagagaccaagaaggtgagccacgtggccgacaccaaggtgaacaccaaggcccaggagacagaagctgcccccagccaggccccagcagatgagcctgagcctgagagcgctgctgcccagagccaggagaaccaggacacccggcccaaggtgaaggccaagaaggccaggaaggtgaagcacctggatggagaagaagatggcagcagtgaccagagccaggccagcggcaccaccggcggcagaagagtgtccaaggcccggcggcgggccgccaagctgcagagcagccaggagcctgaggcccccccaccaagagatgtggccctgctgcagggccgggccaatgacctggtgaagtacctgctggccaaggaccagaccaagatccccatcaagagaagtgacatgctgaaggacatcatcaaggagtacacagatgtgtacccagagatcatcgagagagctggctacagcctggagaaggtgtttggcatccagctgaaggagattgacaagaatgaccacctgtacatcctgctgagcaccctggagcccacagatgctggcatcctgggcaccaccaaggacagccccaagctgggcctgctgatggtgctgctgagcatcatcttcatgaatggaaacagaagcagcgaggccgtcatctgggaggtgctgaggaagctgggcctgcggcccggcatccaccacagcctgtttggagatgtgaagaagctgatcacagatgaatttgtgaagcagaagtacctggactatgcccgggtgcccaacagcaaccccccagaatatgagttcttctggggcctgcggagctactatgagaccagcaagatgaaggtgctgaagtttgcctgcaaggtgcagaagaaggaccccaaggagtgggccgcccagtaccgggaggccatggaggccgacctgaaggctgctgctgaggccgctgctgaggccaaggcccgggcagagatccgggccaggatgggcatcggcctgggctctgaaaatgctgctggcccctgcaactgggatgaggccgacatcggcccctgggccaaggcccgcatccaggccggggctgaggccaaggccaaggcccaggagagcggcagcgccagcactggagccagcaccagcaccaacaacagcgccagcgccagcgccagcaccagcggcggcttctctgctggggccagcctgacagccaccctgaccttcggcctgtttgctggcctgggcggggccggggccagcaccagcggcagcagcggggcctgtggcttctcctacaagtag

SEQ ID NO: 159305 - DNA, 1566 bp, Artificial Sequence; identical to SEQ ID NO: 159304
  Description of Artificial Sequence: Synthetic coding sequence

SEQ ID NO: 159306 - DNA, 1821 bp, Artificial Sequence; identical to SEQ ID NO: 159302
  Description of Artificial Sequence: Synthetic coding sequence

SEQ ID NO: 159307 - DNA, 1821 bp, Artificial Sequence; identical to SEQ ID NO: 159302
  Description of Artificial Sequence: Synthetic coding sequence

SEQ ID NO: 159308 - DNA, 2220 bp, Artificial Sequence
  Description of Artificial Sequence: Synthetic coding sequence
atggccgagggcagcttctctgtgcagagcgagagctacagcgtggaggacatggatgagggcagtgatgaggtgggggaggaggagatggtggagggcaatgactatgaggagtttggagccttcggcggctacggcaccctgaccagctttgacatccacatcctgcgggccttcggcagcctgggccctggcctgcgcatcctgagcaatgagccctgggagctggagaaccctgtgctggcccagaccctggtggaggccctgcagctggaccctgagaccctggccaatgaaacagctgcccgggccgccaacgtggcccgggctgctgccagcaacagagctgcccgggctgctgctgctgctgccaggacagccttcagccaggtggtggccagccaccgggtggccaccccccaggtgtctggagaggacacccagcccaccacctatgctgctgaggcccagggccccaccccagagccccccctggccagcccccagaccagccagatgctggtgaccagcaagatggccgcccctgaggccccagccaccagcgcccagagccagacaggcagccctgcccaggaggccgccacagagggccccagcagcgcctgtgccttcagccaggccccctgtgcccgggaggtggatgccaaccggcccagcacagccttcctgggccagaatgatgtgtttgacttcacccagcctgctggggtgtctggcatggccttcccccggcccaagaggcctgccccagcccaggaggccgccacagagggccccagcgctgccagcggcgtgccccagacaggccctggccgggaggtggccgccacccggcccaagaccaccaagagcggcaaggccctggccaagacccgctgggtggagccccagaatgtggtggccgctgctgctgccaaggccaagatggccaccagcatccctgagcctgagggcgctgctgctgccacagcccagcacagcgctgagccctgggccaggatgggcggcaagaggaccaagaagagcaagcacctggatgatgaatatgagagcagcgaggaggagcgggagaccccagctgtgccccccacctggagggccagccagcccagcctgactgtgcgggcccagctggcccccaggcctcccatggcccccaggagccagatccccagcagacatgtgctgtgcctgcccccaagaaatgtgaccctgctgcaggagcgggccaacaagctggtgaagtacctgatgatcaaggactacaagaagatccccatcaagagagctgacatgctgaaggatgtgatccgggagtatgatgagcacttccctgagatcatcgagcgggccacctacaccctggagaagaagtttggcatccacctgaaggagattgacaaggaggagcacctgtacatcctggtgtgcacccgggacagcagcgcccggctgctgggcaagaccaaggacaccccccggctgagcctgctgctggtgatcctgggcgtcatcttcatgaatggaaacagagccagcgaggccgtgctgtgggaggccctgaggaagatgggcctgcggcctggggtgcgccaccccttcctgggggacctgaggaagctgatcacagatgactttgtgaagcagaagtacctggagtacaagaagatccccaacagcaaccccccagaatatgagttcctgtggggcctgcgggcccggcatgagaccagcaagatgagggtgctgcgcttcatcgcccagaaccagaacagagacccccgggagtggaaggcccacttcctggaggccgtggatgatgccttcaagaccatggatgtggacatggccgaggagcacgcccgggcccagatgagggcccagatgaacattggagatgaggccctgattggccgctggagctgggatgacatccaggtggagctgctgacctgggatgaagatggagactttggagatgcctgggcccgcatcccctttgccttctgggcccgctaccaccagtacatcctgaacagcaacagagccaacagaagagccacctggagggctggggtgagcagcggcaccaatggaggagccagcacctctgtgctggatggccccagcaccagcagcaccatccgcaccagaaatgctgcccgggccggggccagcttcttctcctggatccagtag

SEQ ID NO: 159309 - DNA, 2274 bp, Artificial Sequence
  Description of Artificial Sequence: Synthetic coding sequence
atggccgagggcagcttctctgtgcagagcgagagctacagcgtggaggacatggatgagggcagtgatgaggtgggggaggaggagatggtggagggcaatgactatgaggagtttggagccttcggcggctacggcaccctgaccagctttgacatccacatcctgcgggccttcggcagcctgggccctggcctgcgcatcctgagcaatgagccctgggagctggagaaccctgtgctggcccagaccctggtggaggccctgcagctggaccctgagaccctggccaatgaaacagctgcccgggccgccaacgtggcccgggctgctgccagcaacagagctgcccgggctgctgctgctgctgccaggacagccttcagccaggtggtggccagccaccgggtggccaccccccaggtgtctggagaggacacccagcccaccacctatgctgctgaggcccagggccccaccccagagccccccctggccagcccccagaccagccagatgctggtgaccagcaagatggccgcccctgaggccccagccaccagcgcccagagccagacaggcagccctgcccaggaggccgccacagagggccccagcagcgcctgtgccttcagccaggccccctgtgcccgggaggtggatgccaaccggcccagcacagccttcctgggccagaatgatgtgtttgacttcacccagcctgctggggtgtctggcatggccttcccccggcccaagaggcctgccccagcccaggaggccgccacagagggccccagcgctgccagcggcgtgccccagacaggccctggccgggaggtggccgccacccggcccaagaccaccaagagcggcaaggccctggccaagacccgctgggtggagccccagaatgtggtggccgctgctgctgccaaggccaagatggccaccagcatccctgagcctgagggcgctgctgctgccacagcccagcacagcgctgagccctgggccaggatgggcggcaagaggaccaagaagagcaagcacctggatgatgaatatgagagcagcgaggaggagcgggagaccccagctgtgccccccacctggagggccagccagcccagcctgactgtgcgggcccagctggcccccaggcctcccatggcccccaggagccagatccccagcagacatgtgctgtgcctgcccccaagaaatgtgaccctgctgcaggagcgggccaacaagctggtgaagtacctgatgatcaaggactacaagaagatccccatcaagagagctgacatgctgaaggatgtgatccgggagtatgatgagcacttccctgagatcatcgagcgggccacctacaccctggagaagaagtttggcatccacctgaaggagattgacaaggaggagcacctgtacatcctggtgtgcacccgggacagcagcgcccggctgctgggcaagaccaaggacaccccccggctgagcctgctgctggtgatcctgggcgtcatcttcatgaatggaaacagagccagcgaggccgtgctgtgggaggccctgaggaagatgggcctgcggcctggggtgcgccaccccttcctgggggacctgaggaagctgatcacagatgactttgtgaagcagaagaaccctgagctgcgggaggagacccccctgtccatggcccccagctggtacctggagtacaagaagatccccaacagcaaccccccagaatatgagttcctgtggggcctgcgggcccggcatgagaccagcaagatgagggtgctgcgcttcatcgcccagaaccagaacagagacccccgggagtggaaggcccacttcctggaggccgtggatgatgccttcaagaccatggatgtggacatggccgaggagcacgcccgggcccagatgagggcccagatgaacattggagatgaggccctgattggccgctggagctgggatgacatccaggtggagctgctgacctgggatgaagatggagactttggagatgcctgggcccgcatcccctttgccttctgggcccgctaccaccagtacatcctgaacagcaacagagccaacagaagagccacctggagggctggggtgagcagcggcaccaatggaggagccagcacctctgtgctggatggccccagcaccagcagcaccatccgcaccagaaatgctgcccgggccggggccagcttcttctcctggatccagcacaggtag

SEQ ID NO: 159310 - DNA, 2226 bp, Artificial Sequence
  Description of Artificial Sequence: Synthetic coding sequence
atggccgagggcagcttctctgtgcagagcgagagctacagcgtggaggacatggatgagggcagtgatgaggtgggggaggaggagatggtggagggcaatgactatgaggagtttggagccttcggcggctacggcaccctgaccagctttgacatccacatcctgcgggccttcggcagcctgggccctggcctgcgcatcctgagcaatgagccctgggagctggagaaccctgtgctggcccagaccctggtggaggccctgcagctggaccctgagaccctggccaatgaaacagctgcccgggccgccaacgtggcccgggctgctgccagcaacagagctgcccgggctgctgctgctgctgccaggacagccttcagccaggtggtggccagccaccgggtggccaccccccaggtgtctggagaggacacccagcccaccacctatgctgctgaggcccagggccccaccccagagccccccctggccagcccccagaccagccagatgctggtgaccagcaagatggccgcccctgaggccccagccaccagcgcccagagccagacaggcagccctgcccaggaggccgccacagagggccccagcagcgcctgtgccttcagccaggccccctgtgcccgggaggtggatgccaaccggcccagcacagccttcctgggccagaatgatgtgtttgacttcacccagcctgctggggtgtctggcatggccttcccccggcccaagaggcctgccccagcccaggaggccgccacagagggccccagcgctgccagcggcgtgccccagacaggccctggccgggaggtggccgccacccggcccaagaccaccaagagcggcaaggccctggccaagacccgctgggtggagccccagaatgtggtggccgctgctgctgccaaggccaagatggccaccagcatccctgagcctgagggcgctgctgctgccacagcccagcacagcgctgagccctgggccaggatgggcggcaagaggaccaagaagagcaagcacctggatgatgaatatgagagcagcgaggaggagcgggagaccccagctgtgccccccacctggagggccagccagcccagcctgactgtgcgggcccagctggcccccaggcctcccatggcccccaggagccagatccccagcagacatgtgctgtgcctgcccccaagaaatgtgaccctgctgcaggagcgggccaacaagctggtgaagtacctgatgatcaaggactacaagaagatccccatcaagagagctgacatgctgaaggatgtgatccgggagtatgatgagcacttccctgagatcatcgagcgggccacctacaccctggagaagaagtttggcatccacctgaaggagattgacaaggaggagcacctgtacatcctggtgtgcacccgggacagcagcgcccggctgctgggcaagaccaaggacaccccccggctgagcctgctgctggtgatcctgggcgtcatcttcatgaatggaaacagagccagcgaggccgtgctgtgggaggccctgaggaagatgggcctgcggcctggggtgcgccaccccttcctgggggacctgaggaagctgatcacagatgactttgtgaagcagaagtacctggagtacaagaagatccccaacagcaaccccccagaatatgagttcctgtggggcctgcgggcccggcatgagaccagcaagatgagggtgctgcgcttcatcgcccagaaccagaacagagacccccgggagtggaaggcccacttcctggaggccgtggatgatgccttcaagaccatggatgtggacatggccgaggagcacgcccgggcccagatgagggcccagatgaacattggagatgaggccctgattggccgctggagctgggatgacatccaggtggagctgctgacctgggatgaagatggagactttggagatgcctgggcccgcatcccctttgccttctgggcccgctaccaccagtacatcctgaacagcaacagagccaacagaagagccacctggagggctggggtgagcagcggcaccaatggaggagccagcacctctgtgctggatggccccagcaccagcagcaccatccgcaccagaaatgctgcccgggccggggccagcttcttctcctggatccagcacaggtag

SEQ ID NO: 159311 - DNA, 2220 bp, Artificial Sequence; identical to SEQ ID NO: 159308
  Description of Artificial Sequence: Synthetic coding sequence

SEQ ID NO: 159312 - DNA, 2274 bp, Artificial Sequence; identical to SEQ ID NO: 159309
  Description of Artificial Sequence: Synthetic coding sequence

SEQ ID NO: 159313 - DNA, 2226 bp, Artificial Sequence; identical to SEQ ID NO: 159310
  Description of Artificial Sequence: Synthetic coding sequence

SEQ ID NO: 159314 - DNA, 2874 bp, Artificial Sequence
  Description of Artificial Sequence: Synthetic coding sequence
atgagcctggtgtcccagaacagcagaagaagaagaagaagagtggccaaggccacagcccacaacagctcctggggcgagatgcaggccccaaatgcccctggcctgcctgcagatgtgcccggcagtgatgtgccccagggccccagcgacagccagatcctgcagggcctgtgtgccagcgagggccccagcacctctgtgctgcccaccagcgctgagggccccagcacctttgtgccccccaccatcagcgaggccagcagcgccagcggccagcccaccatcagcgagggccctggcacctctgtgctgcccaccccatctgagggcctgagcaccagcggcccccccaccatcagcaagggcctgtgcacctctgtgaccctggccgccagcgagggcaggaacaccagcaggcctcccaccagcagcgaggagcccagcacctctgtgcccccaacagccagcgaggtgcccagcaccagcctgccccccaccccaggagagggcaccagcacctctgtgcccccaacagcctatgagggccccagcacctctgtggtgcccaccccagatgagggccccagcacctctgtgctgcccaccccaggagagggccctggcacctctgtgcccctggccgccacagagggcctgagcacctctgtgcaggccaccccagatgagggccccagcacctctgtgcccccaacagccacagagggcctgagcacccctgtgccccccaccagagatgagggccccagcacctctgtgcctgccaccccaggagagggccccagcacctctgtgctgcctgctgccagtgatggccagagcatcagcctggtgcccacccggggcaagggcagcagcacctctgtgcccccaacagccacagagggcctgagcacctctgtgcagcccacagctggggagggcagcagcacctctgtgccccccacccctgggggcggcctgagcacctctgtgcccccaacagccacagaggagctgagcacctctgtgccccccaccccaggagagggccccagcacctctgtgctgcccatccctggagagggcctgagcacctctgtgcccccaacagccagtgatggcagtgacacctctgtgccccccaccccaggagagggcgccagcaccctggtgcagcccacagccccagatggccctggcagctctgtgctgcccaaccctggagagggccccagcaccctcttcagcagcagcgcctctgtggacaggaaccccagcaagtgcagcctggtgctgcccagcccccgggtgaccaaggcctctgtggacagcgacagcgagggccccaagggagctgagggccccattgaatttgaggtgctgcgggactgtgagagccccaacagcatcagcatcatgggcctgaacaccagccgggtggccatcaccctgaagccccaggaccccatggagcagaatgtggccgagctgctgcagttcctgctggtgaaggaccagagcaagtaccccatccgggagagcgagatgagggagtacatcgtgaaggagtacagaaaccagtttcctgagatcctgcggcgggctgctgcccacctggagtgcatcttccgctttgagctgcgggagctggaccctgaggcccacacctacatcctgctgaacaagctgggccctgtgccctttgagggcctggaggagagccccaacggccccaagatgggcctgctgatgatgatcctgggccagatcttcctgaatggaaaccaggccaaggaggccgagatctgggagatgctgtggaggatgggcgtgcagcgggagcggcggctgagcatctttggaaaccccaagaggctgctgtctgtggagtttgtgtggcagcgctacctggactacagacctgtgacagactgcaagcctgtggagtatgagttcttctggggccccaggagccacctggagaccaccaagatgaagatcctgaagttcatggccaagatctacaacaaggaccccatggactggccagagaagtacaatgaggccctggaggaggatgctgcccgggcctttgctgagggctggcaggccctgccccacttccggcggcccttctttgaggaggccgctgctgaggtgcccagcccagacagcgaggtgagcagctacagcagcaaatatgccccccacagctggccagagagccggctggagagcaaggccaggaagctggtgcagctgttcctgctgatggacagcaccaagctgcccatccccaagaagggcatcctgtactacatcggccgggagtgcagcaaggtgtttcctgacctgctgaacagagctgcccggaccctgaaccacgtgtatggaacagagctggtggtgctggaccccaggaaccacagctacaccctgtacaacagaagagagatggaggagacagaggagatcgtggacagccccaacagacctggcaacaacttcctgatgcaggtgctgtccttcatcttcatcatgggcaaccacgcccgggagagcgctgtgtgggccttcctgcggggcctgggcgtgcaggccggcaggaagcacgtgatcacctgccgctacctgagccagcgctacatcgacagcctgcgggtgcctgacagcgaccctgtgcagtatgaatttgtgtggggcccccgggcccggctggagaccagcaagatgaaggccctgcgctacgtggcccgcatccacaggaaggagccccaggactggccccagcagtaccgggaggccatggaggatgaggccaacagagcagatgtgggccaccggcagatctttgtgcacaacttcagatag

SEQ ID NO: 159315 - DNA, 1572 bp, Artificial Sequence
  Description of Artificial Sequence: Synthetic coding sequence
atgagcctggtgtcccagaatgcccggcactgcagcgctgagatcacagctgactatggagatggccgcggggagatccaggccaccaatgccagcggcagccccacctccatgctggtggtggatgccccccagtgcccccaggcccccatcaacagccagtgtgtgaacaccagccaggccgtgcaggaccccaatgacctggaggtgctgattgatgagcagagccggcggctgggcgccctgcgggtgcatgaccccctggaggacaggagcatcgccctggtgaacttcatgaggatgaagagccagacagagggcagcatccagcagagcgagatgctggagttcctgcgggagtacagcgaccagtttcctgagatcctgcggcgggccagcgcccacctggaccaggtgtttggcctgaacctgcgggtgattgacccccaggccgacacctacaacctggtgtccaagaggggcttccagatcacagacagaattgctgagagcctggacatgcccaaggccagcctgctggccctggtgctgggccacatcctgctgaatggaaacagagcccgggaggccagcatctgggacctgctgctgaaggtggacatgtgggacaagccccagaggatcaacaacctgtttggaaacaccaggaacctgctgaccacagactttgtgtgcatgaggttcctggagtactggcctgtgtatggcaccaaccccctggagtttgagttcctgtggggcagccgggcccaccgggagatcaccaagatggaggccctgaagtttgtgtctgatgcccatgatgaggagccctggagctggccagaggagtacaacaaggccctggagggggacaagaccaaggagaggagcctgacagctggcctggagttctggagcgaggacaccatgaatgacaaggccaatgacctggtgcagctggccatctctgtgacagaggagatgctgcccatccaccaggatgagctgctggcccacacaggcaaggagtttgaagatgtgttccccaacatcctgaacagagccaccctcatcctggacatgttctacggcctgagcctgattgaggtggacaccagcgagcacatctacctgctggtgcagcagcctgagagcgaggaggagcaggtgatgctggagagcctgggccggcccacccaggagtatgtgatgcccatcctgggcctcatcttcctgatgggcaacagagtgaaggaggccaacgtgtggaacctgctgcggcgcttctctgtggatgtgggcaggaagcacagcatcaccaggaagctgatgaggcagcgctacctggagtgccggcccctgagctacagcaaccctgtggagtatgagctgctgtggggcccccgggcccaccacgagaccatcaagatgaaggtgctggagtacatggcccggctgtacaggaagaggccccagaactggccagagcagtaccgggaggccgtggaggatgaggaggcccgggccaagtctgaggccaccatcatgttcttcctggaccccacctag

SEQ ID NO: 159316 - DNA, 924 bp, Artificial Sequence
  Description of Artificial Sequence: Synthetic coding sequence
atgctgcagaccccagagagccggggcctgcctgtgccccaggccgagggggagaaggatggcggccatgatggagagacccgggcccccacagccagccaggagcggcccaaggaggagctgggcgccggccgggaggagggcgctgctgagcccgccctgaccaggaaaggagcccgggccctggccgccaaggccctggcccggcggcgggcctaccgccgcctgaacagaacagtggccgagctggtgcagttcctgctggtgaaggacaagaagaagagccccatcaccaggtctgagatggtgaagtatgtgattggagacctgaagatcctcttcccagacatcatcgcccgggctgctgagcacctgcgctacgtgtttggatttgagctgaagcagtttgacaggaagcaccacacctacatcctgatcaacaagctgaagcccctggaggaggaggaggaggaggacctgggcggagatggcccccggctgggcctgctgatgatgatcctgggcctcatctacatgaggggcaacagcgcccgggaggcccaggtgtgggagatgctgcggcggctgggcgtgcagcccagcaagtaccacttcctgtttggctaccccaagaggctcatcatggaggactttgtgcagcagcgctacctgagctacagaagagtgccccacaccaaccccccagaatatgagttctcctggggccccaggagcaacctggagatcagcaagatggaggtgctgggctttgtggccaagctgcacaagaaggagccccagcactggcctgtgcagtaccgggaggccctggctgatgaagctgaccgggcccgggccaaggcccgggcagaggcctccatgagggcccgggccagcgcccgggccggcatccacctgtggtag

SEQ ID NO: 159317 - DNA, 396 bp, Artificial Sequence
  Description of Artificial Sequence: Synthetic coding sequence
atggcccggagcctggtgtgcctgggcgtcatcatcctgctgagcgccttcagcggccctggggtgcggggcggccccatgcccaagctggccgacaggaagctgtgtgccgaccaggagtgcagccaccccatctccatggctgtggccctgcaggactacatggccccagactgccgcttcctgaccatccaccggggccaggtggtgtatgtgttcagcaagctgaagggccggggccgcctcttctggggcggctctgtgcagggcgactactatggagacctggccgcccggctgggctacttccccagcagcatcgtgcgggaggaccagaccctgaagccaggcaaggtggatgtgaagacagacaagtgggacttctactgccagtag

SEQ ID NO: 159318 - DNA, 642 bp, Artificial Sequence
  Description of Artificial Sequence: Synthetic coding sequence
atggccgagacctatgacttcctgttcaagttcctggtgattggcagcgctggcaccgggaagagctgcctgctgcaccagttcatcgagaacaagttcaagcaggacagcaaccacaccatcggcgtggagtttggcagccgggtggtgaatgtgggcggcaagacagtgaagctgcagatctgggacacagctggccaggagcgcttccgctctgtgaccaggagctactacagaggagctgctggggccctgctggtgtatgacatcaccagccgggagacctacaacagcctggccgcctggctgacagatgcccggaccctggccagccccaacatcgtggtgatcctgtgtggcaacaagaaggacctggaccctgagcgggaggtgaccttcctggaggccagcagatttgcccaggagaatgagctgatgttcctggagaccagcgccctgaccggggagaatgtggaggaggccttcctgaagtgtgcccggaccatcctgaacaagattgattctggagagctggaccctgagaggatgggcagcggcatccagtatggagatgccagcctgcggcagctgcggcagcccaggtctgcccaggccgtggccccccagccctgtggctgctag

SEQ ID NO: 159319 - DNA, 366 bp, Artificial Sequence
  Description of Artificial Sequence: Synthetic coding sequence
atggccgagacctatgacttcctgttcaagttcctggtgattggcagcgctggcaccgggaagagctgcctgctgcaccagttcatcgagaacaagttcaagcaggacagcaaccacaccatcggcgtggagtttggcagccgggtggtgaatgtgggcggcaagacagtgaagctgcagatctgggacacagctggccaggagcgcttccgctctgtgaccaggagctactacagaggagctgctggggccctgctggtgtatgacatcaccagggcagatgtgcctggggaccagaggagccacagaagagagcggggcggcggcgtgccccaggtgtgcccccactacccccagcaggactag

SEQ ID NO: 159320 - DNA, 396 bp, Artificial Sequence
  Description of Artificial Sequence: Synthetic coding sequence
atggcccggagcctggtgtgcctgggcgtcatcatcctgctgagcgccttcagcggccctggggtgcggggcggccccatgcccaagctggccgacaggaagctgtgtgccgaccaggagtgcagccaccccatctccatggctgtggccctgcaggactacatggccccagactgccgcttcctgaccatccaccggggccaggtggtgtatgtgttcagcaagctgaagggccggggccgcctcttctggggcggctctgtgcagggcgactactatggagacctggccgcccggctgggctacttccccagcagcatcgtgcgggaggaccagaccctgaagccaggcaaggtggatgtgaagacagacaccagcagcagcaacagctggtag

SEQ ID NO: 159321 - DNA, 2358 bp, Artificial Sequence
  Description of Artificial Sequence: Synthetic coding sequence
atggattctgtgcctgccaccgtgcccagcattgctgccacccctggggaccctgagctggtgggccccctgtctgtgctgtatgctgccttcatcgccaagctgctggagctggtggccaccctgcctgatgatgtgcagcccggccctgacttctacggcctgccctggaagcctgtgttcatcacagccttcctgggcatcgccagctttgccatcttcctgtggaggacagtgctggtggtgacagacaccctggtgtctgtgacagagcagcagatcagcgagaagctgaagaccatcatgaaggagaacacagagctggtgcagaagctgagcaactatgagcagaagatcaaggagagcaagaagcacgtgcaggagaccaggaagcagaacatgatcctgagtgatgaggccatcaagtacaaggacaagatcaagaccctggagaagaaccaggagatcctggatgacacagccaagaacctgcgggtgatgctggagagcgagcgggagcagaatgtgaagaaccaggacctgatcagcgagaacaagaagagcattgagaagctgaaggatgtgatctccatgaatgccagcgagttcagcgaggtgcagatcgccctgaatgaggccaagctgtctgaggagaaggtgaagtctgagtgccaccgggtgcaggaggagaatgcccggctgaagaagaagaaggagcagctgcagcaggagattgaggactggagcaagctgcatgctgagctgtctgagcagatcaagagctttgagaagagccagaaggacctggaggtggccctgacccacaaggatgacaacatcaatgccctgaccaactgcatcacccagctgaacctgctggagtgtgagagcgagagcgagggccagaacaagggcggcaatgacagtgatgagctggccaacggggaggtgggcggggacagaaatgagaagatgaagaaccagatcaagcagatgatggatgtgtccaggacccagacagccatctctgtggtggaggaggacctgaagctgctgcagctgaagctgcgggcctctgtgtccaccaagtgcaacctggaggaccaggtgaagaagctggaggatgacaggaacagcctgcaggccgccaaggccggcctggaggatgagtgcaagaccctgcggcagaaggtggagatcctgaatgagctgtaccagcagaaggagatggccctgcagaagaagctgagccaggaggagtatgagcggcaggagcgggagcaccggctgtctgctgctgatgagaaggctgtgtctgctgctgaggaggtgaagacctacaagagaagaattgaggagatggaggatgagctgcagaagacagagaggagcttcaagaaccagatcgccacccatgagaagaaggcccacgagaactggctgaaggcccgggctgctgagcgggccatcgccgaggagaagcgggaggccgccaacctgcggcacaagctgctggagctgacccagaagatggccatgctgcaggaggagcccgtcatcgtgaagcccatgcctgggaagcccaacacccagaaccccccaagaagaggccccctgagccagaatggcagctttggccccagccctgtgtctggaggagagtgcagcccccccctgactgtggagccccctgtgcggcccctgagcgccaccctgaacagaagagacatgcccaggagtgaatttggatctgtggatggccccctgccccacccccgctggagcgctgaggccagcggcaagcccagccccagcgaccccggcagcggcacagccaccatgatgaacagcagcagccggggcagcagccccaccagggtgctggatgagggcaaggtgaacatggcccccaagggccccccacccttccctggggtgcccctgatgagcacccccatgggcggccctgtgcccccacccatccgctatggccccccaccccagctgtgtggccccttcggcccccggcccctgcccccacccttcggccctggcatgaggcctcccctgggcctgcgggagtttgcccctggggtgcccccaggaagaagagacctgcccctgcacccccggggcttcctgcccggccacgcccccttccggcccctgggcagcctgggcccccgggagtacttcatccctggcacccggctgcccccacccacccacggcccccaggagtacccacctcctcctgctgtgcgggacctgctgcccagcggcagcagagatgagcccccaccagccagccagagcaccagccaggactgcagccaggccctgaagcagagcccctag

SEQ ID NO: 159322 - DNA, 5547 bp, Artificial Sequence
  Description of Artificial Sequence: Synthetic coding sequence
atggctgctgcccctggcctgctggtgtggctgctggtgctgcggctgccctggagggtgcccggccagctggaccccagcacaggccgccgcttcagcgagcacaagctgtgtgctgatgatgagtgcagcatgctgatgtacagaggagaggccctggaggacttcaccggccctgactgccgctttgtgaacttcaagaagggggaccctgtgtatgtgtactacaagctggcccggggctggccagaggtgtgggccggctctgtgggccgcaccttcggctacttccccaaggacctgatccaggtggtgcatgagtacaccaaggaggagctgcaggtgcccacagatgaaacagactttgtgtgctttgatggcggcagagatgacttccacaactacaacgtggaggagctgctgggcttcctggagctgtacaacagcgctgccacagacagcgagaaggctgtggagaagaccctgcaggacatggagaagaaccctgagctgagcaaggagcgggagcctgagcctgagcctgtggaggccaacagcgaggagagtgacagcgtcttctctgaaaatacagaggacctgcaggagcagttcaccacccagaagcaccacagccacgccaacagccaggccaaccacgcccagggcgagcaggccagctttgagagctttgaggagatgctgcaggacaagctgaaggtgcctgagagcgagaacaacaagaccagcaacagcagccaggtgtccaatgagcaggacaagattgatgcctacaagctgctgaagaaggagatgaccctggacctgaagaccaagtttggcagcacagcagatgccctggtgtctgatgatgagaccacccggctggtgaccagcctggaggatgactttgatgaggagctggacacagagtactatgctgtgggcaaggaggatgaggagaaccaggaggactttgatgagctgcccctgctgaccttcacagatggagaggacatgaagaccccagccaagtctggagtggagaagtaccccacagacaaggagcagaacagcaatgaggaggacaaggtgcagctgactgtgcccccaggcatcaagaatgatgacaagaacatcctgaccacctggggagacaccatcttcagcatcgtgactggaggagaggagacccgggacaccatggacctggagagcagcagcagcgaggaggagaaggaggatgatgatgatgccctggtgcctgacagcaagcagggcaagccccagagcgccacagactacagcgaccctgacaacgtggatgatggcctcttcatcgtggacatccccaagaccaacaatgacaaggaggtgaatgctgagcaccacatcaagggcaagggccggggcgtgcaggagagcaagaggggcctggtgcaggacaagacagagctggaggatgagaaccaggagggcatgacagtgcacagctctgtgcacagcaacaacctgaacagcatgcctgctgctgagaagggcaaggacaccctgaagagcgcctatgatgacacagaaaatgacctgaagggagctgccatccacatcagcaagggcatgctgcacgaggagaagccaggagagcagatcctggagggcggcagcgagagcgagagcgcccagaaggctgctggcaaccagatgaatgacaggaagatccagcaggagagcctgggcagcgcccccctgatgggagatgaccaccccaatgccagccgggacagcgtggagggagatgccctggtgaatggagccaagctgcacaccctgtctgtggagcaccagcgggaggagctgaaggaggagctggtgctgaagacccagaaccagccccgcttcagcagcccagatgaaattgacctgccccgggagctggaggatgaggtgcccatcctgggcaggaacctgccctggcagcaggagagagatgtggccgccacagccagcaagcagatgtctgagaagatccggctgtctgagggggaggccaaggaggacagcctggatgaggagttcttccaccacaaggccatgcagggcacagaggtgggccagacagaccagacagacagcactggaggccctgccttcctgagcaaggtggaggaggatgactaccccagcgaggagctgctggaggatgaaaatgccatcaatgccaagaggagcaaggagaagaaccctggcaaccagggccggcagtttgatgtgaacctgcaggtgcctgacagagctgtgctgggcaccatccacccagaccctgagattgaggagagcaagcaggagacctccatgatcctggacagcgagaagaccagcgagacagctgccaagggcgtgaacacaggaggccgggagcccaacaccatggtggagaaggagcggcccctggccgacaagaaggcccagaggccctttgagaggagtgacttcagtgacagcatcaagatccagaccccagagctgggggaggtgttccagaacaaggacagcgactacctgaagaatgacaaccctgaggagcacctgaagaccagcggcctggccggggagcctgagggggagctgagcaaggaggaccatgaaaatacagagaagtacatgggcacagagagccagggcagcgctgctgctgagccagaagatgacagcttccactggaccccccacacctctgtggagcccggccacagcgacaagcgggaggacctgctgatcatcagcagcttcttcaaggagcagcagagcctgcagcgcttccagaagtacttcaacgtgcatgagctggaggccctgctgcaggagatgagcagcaagctgaagagcgcccagcaggagagcctgccctacaacatggagaaggtgctggacaaggtgttccgggccagcgagagccagatcctgagcattgctgagaagatgctggacaccagggtggccgagaacagagacctgggcatgaatgaaaacaacatctttgaggaggccgctgtgctggatgacatccaggacctgatctactttgtgcgctacaagcacagcacagctgaggagacagccaccctggtgatggccccacccctggaggagggcctgggcggggccatggaggagatgcagcccctgcacgaggacaacttcagccgggagaagacagctgagctgaatgtgcaggtgcctgaggagcccacccacctggaccagagggtcatcggggacacccacgccagcgaggtgtcccagaagcccaacacagagaaggacctggaccccggccctgtgaccacagaggacacccccatggatgccattgatgccaacaagcagcctgagacagctgctgaggagcccgcctctgtgacccccctggagaatgccatcctgctgatctacagcttcatgttctacctgaccaagagcctggtggccaccctgcctgatgatgtgcagcccggccctgacttctacggcctgccctggaagcctgtgttcatcacagccttcctgggcatcgccagctttgccatcttcctgtggaggacagtgctggtggtgagcaacacagtgtactacgtgacagagcagcagatcagcgagaagctgaagaccatcatgaaggagaacacagagctggtgcagaagctgagcaactatgagcagaagatcaaggagagcaagaagcacgtgcaggagaccaggaagcagaacatgatcctgagtgatgaggccatcaagtacaaggacaagatcaagaccctggagaagaaccaggagatcctggatgacacagccaagaacctgcgggtgatgctggagagcgagcgggagcagaatgtgaagaaccaggacctgctgcagcaggagattgaggactggagcaagctgcacgccgagctgtctgagcagatcaagagctttgagaagagccagaaggacctggaggtggccctgacccacaaggatgacaacatcaatgccctgaccaactgcatcacccagctgaacctgctggagtgtgagagcgagagcgagggccagaacaagggcggcaatgacagtgatgagctggccaatggagaggtgggcggggacagaaatgagaagatgaagaaccagatcaagcagatgatggatgtgtccaggacccagacagccatctctgtggtggaggaggacctgaagctgctgcagctgaagctgcgggcctctgtgtccaccaagtgcaacctggaggaccaggtgaagaagctggaggatgacaggaacagcctgcaggccgccaaggccggcctggaggatgagtgcaagaccctgcggcagaaggtggagatcctgaatgagctgtaccagcagaaggagatggccctgcagaagaagctgagccaggaggagtatgaaaggcaggagcgggagcaccggctgtctgctgctgatgagaaggctgtgtctgctgctgaggaggtgaagacctacaagaggcgcatcgaggagatggaggatgagctgcagaagacagagaggagcttcaagaaccagatcgccacccatgagaagaaggcccacgagaactggctgaaggcccgggctgctgagcgggccatcgccgaggagaagcgggaggccgccaacctgcggcacaagctgctggagctgacccagaagatggccatgctgcaggaggagcctgtgattgtgaagcccatgcctgggaagcccaacacccagaaccccccccggcggggccccctgagccagaatggcagctttggccccagccctgtgtctggaggagaatgtagcccccccctgactgtggagccccctgtgcggcccctgagcgccaccctgaacagaagagacatgcccaggagtgaatttggatctgtggatggccccctgccccacccccgctggagcgctgaggccagcggcaagcccagccccagcgaccccggcagcggcacagccaccatgatgaacagcagcagccggggcagcagccccaccagggtgctggatgagggcaaggtgaacatggcccccaagggccccccacccttccctggggtgcccctgatgagcacccccatgggcggccctgtgcccccacccatccgctatggccccccaccccagctgtgtggccccttcggcccccggcccctgcccccaccatttggacctggcatgaggcctcccctgggcctgcgggagtttgcccctggggtgcccccaggccggcgggacctgcccctgcacccccggggcttcctgcccggccacgcccccttccggcccctgggcagcctgggcccccgggagtacttcatccctggcacccggctgcccccacccacccacggcccccaggagtacccacctcctcctgctgtgcgggacctgctgcccagcggcagcagagatgagcccccaccagccagccagagcaccagccaggactgcagccaggccctgaagcagagcccctag

SEQ ID NO: 159323 - DNA, 2358 bp, Artificial Sequence
  Description of Artificial Sequence: Synthetic coding sequence
atggattctgtgcctgccaccgtgcccagcattgctgccacccctggggaccctgagctggtgggccccctgtctgtgctgtatgctgccttcatcgccaagctgctggagctggtggccaccctgcctgatgatgtgcagcccggccctgacttctacggcctgccctggaagcctgtgttcatcacagccttcctgggcatcgccagctttgccatcttcctgtggaggacagtgctggtggtgaaggacagagtgtaccaggtgacagagcagcagatcagcgagaagctgaagaccatcatgaaggagaacacagagctggtgcagaagctgagcaactatgagcagaagatcaaggagagcaagaagcacgtgcaggagaccaggaagcagaacatgatcctgagtgatgaggccatcaagtacaaggacaagatcaagaccctggagaagaaccaggagatcctggatgacacagccaagaacctgcgggtgatgctggagagcgagcgggagcagaatgtgaagaaccaggacctgatcagcgagaacaagaagagcattgagaagctgaaggatgtgatctccatgaatgccagcgagttcagcgaggtgcagatcgccctgaatgaggccaagctgtctgaggagaaggtgaagtctgagtgccaccgggtgcaggaggagaatgcccggctgaagaagaagaaggagcagctgcagcaggagattgaggactggagcaagctgcatgctgagctgtctgagcagatcaagagctttgagaagagccagaaggacctggaggtggccctgacccacaaggatgacaacatcaatgccctgaccaactgcatcacccagctgaacctgctggagtgtgagagcgagagcgagggccagaacaagggcggcaatgacagtgatgagctggccaacggggaggtgggcggggacagaaatgagaagatgaagaaccagatcaagcagatgatggatgtgtccaggacccagacagccatctctgtggtggaggaggacctgaagctgctgcagctgaagctgcgggcctctgtgtccaccaagtgcaacctggaggaccaggtgaagaagctggaggatgacaggaacagcctgcaggccgccaaggccggcctggaggatgagtgcaagaccctgcggcagaaggtggagatcctgaatgagctgtaccagcagaaggagatggccctgcagaagaagctgagccaggaggagtatgagcggcaggagcgggagcaccggctgtctgctgctgatgagaaggctgtgtctgctgctgaggaggtgaagacctacaagagaagaattgaggagatggaggatgagctgcagaagacagagaggagcttcaagaaccagatcgccacccatgagaagaaggcccacgagaactggctgaaggcccgggctgctgagcgggccatcgccgaggagaagcgggaggccgccaacctgcggcacaagctgctggagctgacccagaagatggccatgctgcaggaggagcccgtcatcgtgaagcccatgcctgggaagcccaacacccagaaccccccaagaagaggccccctgagccagaatggcagctttggccccagccctgtgtctggaggagagtgcagcccccccctgactgtggagccccctgtgcggcccctgagcgccaccctgaacagaagagacatgcccaggagtgaatttggatctgtggatggccccctgccccacccccgctggagcgctgaggccagcggcaagcccagccccagcgaccccggcagcggcacagccaccatgatgaacagcagcagccggggcagcagccccaccagggtgctggatgagggcaaggtgaacatggcccccaagggccccccacccttccctggggtgcccctgatgagcacccccatgggcggccctgtgcccccacccatccgctatggccccccaccccagctgtgtggccccttcggcccccggcccctgcccccacccttcggccctggcatgaggcctcccctgggcctgcgggagtttgcccctggggtgcccccaggaagaagagacctgcccctgcacccccggggcttcctgcccggccacgcccccttccggcccctgggcagcctgggcccccgggagtacttcatccctggcacccggctgcccccacccacccacggcccccaggagtacccacctcctcctgctgtgcgggacctgctgcccagcggcagcagagatgagcccccaccagccagccagagcaccagccaggactgcagccaggccctgaagcagagcccctag

SEQ ID NO: 159324 - DNA, 5724 bp, Artificial Sequence
  Description of Artificial Sequence: Synthetic coding sequence
atggctgctgcccctggcctgctggtgtggctgctggtgctgcggctgccctggagggtgcccggccagctggaccccagcacaggccgccgcttcagcgagcacaagctgtgtgctgatgatgagtgcagcatgctgatgtacagaggagaggccctggaggacttcaccggccctgactgccgctttgtgaacttcaagaagggggaccctgtgtatgtgtactacaagctggcccggggctggccagaggtgtgggccggctctgtgggccgcaccttcggctacttccccaaggacctgatccaggtggtgcatgagtacaccaaggaggagctgcaggtgcccacagatgaaacagactttgtgtgctttgatggcggcagagatgacttccacaactacaacgtggaggagctgctgggcttcctggagctgtacaacagcgctgccacagacagcgagaaggctgtggagaagaccctgcaggacatggagaagaaccctgagctgagcaaggagcgggagcctgagcctgagcctgtggaggccaacagcgaggagagtgacagcgtcttctctgaaaatacagaggacctgcaggagcagttcaccacccagaagcaccacagccacgccaacagccaggccaaccacgcccagggcgagcaggccagctttgagagctttgaggagatgctgcaggacaagctgaaggtgcctgagagcgagaacaacaagaccagcaacagcagccaggtgtccaatgagcaggacaagattgatgcctacaagctgctgaagaaggagatgaccctggacctgaagaccaagtttggcagcacagcagatgccctggtgtctgatgatgagaccacccggctggtgaccagcctggaggatgactttgatgaggagctggacacagagtactatgctgtgggcaaggaggatgaggagaaccaggaggactttgatgagctgcccctgctgaccttcacagatggagaggacatgaagaccccagccaagtctggagtggagaagtaccccacagacaaggagcagaacagcaatgaggaggacaaggtgcagctgactgtgcccccaggcatcaagaatgatgacaagaacatcctgaccacctggggagacaccatcttcagcatcgtgactggaggagaggagacccgggacaccatggacctggagagcagcagcagcgaggaggagaaggaggatgatgatgatgccctggtgcctgacagcaagcagggcaagccccagagcgccacagactacagcgaccctgacaacgtggatgatggcctcttcatcgtggacatccccaagaccaacaatgacaaggaggtgaatgctgagcaccacatcaagggcaagggccggggcgtgcaggagagcaagaggggcctggtgcaggacaagacagagctggaggatgagaaccaggagggcatgacagtgcacagctctgtgcacagcaacaacctgaacagcatgcctgctgctgagaagggcaaggacaccctgaagagcgcctatgatgacacagaaaatgacctgaagggagctgccatccacatcagcaagggcatgctgcacgaggagaagccaggagagcagatcctggagggcggcagcgagagcgagagcgcccagaaggctgctggcaaccagatgaatgacaggaagatccagcaggagagcctgggcagcgcccccctgatgggagatgaccaccccaatgccagccgggacagcgtggagggagatgccctggtgaatggagccaagctgcacaccctgtctgtggagcaccagcgggaggagctgaaggaggagctggtgctgaagacccagaaccagccccgcttcagcagcccagatgaaattgacctgccccgggagctggaggatgaggtgcccatcctgggcaggaacctgccctggcagcaggagagagatgtggccgccacagccagcaagcagatgtctgagaagatccggctgtctgagggggaggccaaggaggacagcctggatgaggagttcttccaccacaaggccatgcagggcacagaggtgggccagacagaccagacagacagcactggaggccctgccttcctgagcaaggtggaggaggatgactaccccagcgaggagctgctggaggatgaaaatgccatcaatgccaagaggagcaaggagaagaaccctggcaaccagggccggcagtttgatgtgaacctgcaggtgcctgacagagctgtgctgggcaccatccacccagaccctgagattgaggagagcaagcaggagacctccatgatcctggacagcgagaagaccagcgagacagctgccaagggcgtgaacacaggaggccgggagcccaacaccatggtggagaaggagcggcccctggccgacaagaaggcccagaggccctttgagaggagtgacttcagtgacagcatcaagatccagaccccagagctgggggaggtgttccagaacaaggacagcgactacctgaagaatgacaaccctgaggagcacctgaagaccagcggcctggccggggagcctgagggggagctgagcaaggaggaccatgaaaatacagagaagtacatgggcacagagagccagggcagcgctgctgctgagccagaagatgacagcttccactggaccccccacacctctgtggagcccggccacagcgacaagcgggaggacctgctgatcatcagcagcttcttcaaggagcagcagagcctgcagcgcttccagaagtacttcaacgtgcatgagctggaggccctgctgcaggagatgagcagcaagctgaagagcgcccagcaggagagcctgccctacaacatggagaaggtgctggacaaggtgttccgggccagcgagagccagatcctgagcattgctgagaagatgctggacaccagggtggccgagaacagagacctgggcatgaatgaaaacaacatctttgaggaggccgctgtgctggatgacatccaggacctgatctactttgtgcgctacaagcacagcacagctgaggagacagccaccctggtgatggccccacccctggaggagggcctgggcggggccatggaggagatgcagcccctgcacgaggacaacttcagccgggagaagacagctgagctgaatgtgcaggtgcctgaggagcccacccacctggaccagagggtcatcggggacacccacgccagcgaggtgtcccagaagcccaacacagagaaggacctggaccccggccctgtgaccacagaggacacccccatggatgccattgatgccaacaagcagcctgagacagctgctgaggagcccgcctctgtgacccccctggagaatgccatcctgctgatctacagcttcatgttctacctgaccaagagcctggtggccaccctgcctgatgatgtgcagcccggccctgacttctacggcctgccctggaagcctgtgttcatcacagccttcctgggcatcgccagctttgccatcttcctgtggaggacagtgctggtggtgagcaacacagtgtactacgtgacagagcagcagatcagcgagaagctgaagaccatcatgaaggagaacacagagctggtgcagaagctgagcaactatgagcagaagatcaaggagagcaagaagcacgtgcaggagaccaggaagcagaacatgatcctgagtgatgaggccatcaagtacaaggacaagatcaagaccctggagaagaaccaggagatcctggatgacacagccaagaacctgcgggtgatgctggagagcgagcgggagcagaatgtgaagaaccaggacctgatcagcgagaacaagaagagcattgagaagctgaaggatgtgatctccatgaatgccagcgagttcagcgaggtgcagatcgccctgaatgaggccaagctgtctgaggagaaggtgaagtctgagtgccaccgggtgcaggaggagaatgcccggctgaagaagaagaaggagcagctgcagcaggagattgaggactggagcaagctgcatgctgagctgtctgagcagatcaagagctttgagaagagccagaaggacctggaggtggccctgacccacaaggatgacaacatcaatgccctgaccaactgcatcacccagctgaacctgctggagtgtgagagcgagagcgagggccagaacaagggcggcaatgacagtgatgagctggccaacggggaggtgggcggggacagaaatgagaagatgaagaaccagatcaagcagatgatggatgtgtccaggacccagacagccatctctgtggtggaggaggacctgaagctgctgcagctgaagctgcgggcctctgtgtccaccaagtgcaacctggaggaccaggtgaagaagctggaggatgacaggaacagcctgcaggccgccaaggccggcctggaggatgagtgcaagaccctgcggcagaaggtggagatcctgaatgagctgtaccagcagaaggagatggccctgcagaagaagctgagccaggaggagtatgagcggcaggagcgggagcaccggctgtctgctgctgatgagaaggctgtgtctgctgctgaggaggtgaagacctacaagagaagaattgaggagatggaggatgagctgcagaagacagagaggagcttcaagaaccagatcgccacccatgagaagaaggcccacgagaactggctgaaggcccgggctgctgagcgggccatcgccgaggagaagcgggaggccgccaacctgcggcacaagctgctggagctgacccagaagatggccatgctgcaggaggagcccgtcatcgtgaagcccatgcctgggaagcccaacacccagaaccccccaagaagaggccccctgagccagaatggcagctttggccccagccctgtgtctggaggagagtgcagcccccccctgactgtggagccccctgtgcggcccctgagcgccaccctgaacagaagagacatgcccaggagtgaatttggatctgtggatggccccctgccccacccccgctggagcgctgaggccagcggcaagcccagccccagcgaccccggcagcggcacagccaccatgatgaacagcagcagccggggcagcagccccaccagggtgctggatgagggcaaggtgaacatggcccccaagggccccccacccttccctggggtgcccctgatgagcacccccatgggcggccctgtgcccccacccatccgctatggccccccaccccagctgtgtggccccttcggcccccggcccctgcccccacccttcggccctggcatgaggcctcccctgggcctgcgggagtttgcccctggggtgcccccaggaagaagagacctgcccctgcacccccggggcttcctgcccggccacgcccccttccggcccctgggcagcctgggcccccgggagtacttcatccctggcacccggctgcccccacccacccacggcccccaggagtacccacctcctcctgctgtgcgggacctgctgcccagcggcagcagagatgagcccccaccagccagccagagcaccagccaggactgcagccaggccctgaagcagagcccctag

SEQ ID NO: 159325 - DNA, 1503 bp, Artificial Sequence
  Description of Artificial Sequence: Synthetic coding sequence
atggctgctgcccctggcctgctggtgtggctgctggtgctgcggctgccctggagggtgcccggccagctggaccccagcacaggccgccgcttcagcgagcacaagctgtgtgctgatgatgagtgcagcatgctgatgtacagaggagaggccctggaggacttcaccggccctgactgccgctttgtgaacttcaagaagggggaccctgtgtatgtgtactacaagctggcccggggctggccagaggtgtgggccggctctgtgggccgcaccttcggctacttccccaaggacctgatccaggtggtgcatgagtacaccaaggaggagctgcaggtgcccacagatgaaacagactttgtgtgctttgatggcggcagagatgacttccacaactacaacgtggaggagctgctgggcttcctggagctgtacaacagcgctgccacagacagcgagaaggctgtggagaagaccctgcaggacatggagaagaaccctgagctgagcaaggagcgggagcctgagcctgagcctgtggaggccaacagcgaggagagtgacagcgtcttctctgaaaatacagaggacctgcaggagcagttcaccacccagaagcaccacagccacgccaacagccaggccaaccacgcccagggcgagcaggccagctttgagagctttgaggagatgctgcaggacaagctgaaggtgcctgagagcgagaacaacaagaccagcaacagcagccaggtgtccaatgagcaggacaagattgatgcctacaagctgctgaagaaggagatgaccctggacctgaagaccaagtttggcagcacagcagatgccctggtgtctgatgatgagaccacccggctggtgaccagcctggaggatgactttgatgaggagctggacacagagtactatgctgtgggcaaggaggatgaggagaaccaggaggactttgatgagctgcccctgctgaccttcacagatggagaggacatgaagaccccagccaagtctggagtggagaagtaccccacagacaaggagcagaacagcaatgaggaggacaaggtgcagctgactgtgcccccaggcatcaagaatgatgacaagaacatcctgaccacctggggagacaccatcttcagcatcgtgactggaggagaggagacccgggacaccatggacctggagagcagcagcagcgaggaggagaaggaggatgatgatgatgccctggtgcctgacagcaagcagggcaagccccagagcgccacagactacagcgaccctgacaacgtggatgatggcctcttcatcgtggacatccccaagaccaacaatgacaaggaggtgaatgctgagcaccacatcaagggcaagggccggggcgtgcaggagagcaagaggggcctggtgcaggacaagacagagctggaggatgagaaccaggagggcttcaagacagagcccatcaagctgtag

SEQ ID NO: 159326 - DNA, 5724 bp, Artificial Sequence
  Description of Artificial Sequence: Synthetic coding sequence
atggctgctgcccctggcctgctggtgtggctgctggtgctgcggctgccctggagggtgcccggccagctggaccccagcacaggccgccgcttcagcgagcacaagctgtgtgctgatgatgagtgcagcatgctgatgtacagaggagaggccctggaggacttcaccggccctgactgccgctttgtgaacttcaagaagggggaccctgtgtatgtgtactacaagctggcccggggctggccagaggtgtgggccggctctgtgggccgcaccttcggctacttccccaaggacctgatccaggtggtgcatgagtacaccaaggaggagctgcaggtgcccacagatgaaacagactttgtgtgctttgatggcggcagagatgacttccacaactacaacgtggaggagctgctgggcttcctggagctgtacaacagcgctgccacagacagcgagaaggctgtggagaagaccctgcaggacatggagaagaaccctgagctgagcaaggagcgggagcctgagcctgagcctgtggaggccaacagcgaggagagtgacagcgtcttctctgaaaatacagaggacctgcaggagcagttcaccacccagaagcaccacagccacgccaacagccaggccaaccacgcccagggcgagcaggccagctttgagagctttgaggagatgctgcaggacaagctgaaggtgcctgagagcgagaacaacaagaccagcaacagcagccaggtgtccaatgagcaggacaagattgatgcctacaagctgctgaagaaggagatgaccctggacctgaagaccaagtttggcagcacagcagatgccctggtgtctgatgatgagaccacccggctggtgaccagcctggaggatgactttgatgaggagctggacacagagtactatgctgtgggcaaggaggatgaggagaaccaggaggactttgatgagctgcccctgctgaccttcacagatggagaggacatgaagaccccagccaagtctggagtggagaagtaccccacagacaaggagcagaacagcaatgaggaggacaaggtgcagctgactgtgcccccaggcatcaagaatgatgacaagaacatcctgaccacctggggagacaccatcttcagcatcgtgactggaggagaggagacccgggacaccatggacctggagagcagcagcagcgaggaggagaaggaggatgatgatgatgccctggtgcctgacagcaagcagggcaagccccagagcgccacagactacagcgaccctgacaacgtggatgatggcctcttcatcgtggacatccccaagaccaacaatgacaaggaggtgaatgctgagcaccacatcaagggcaagggccggggcgtgcaggagagcaagaggggcctggtgcaggacaagacagagctggaggatgagaaccaggagggcatgacagtgcacagctctgtgcacagcaacaacctgaacagcatgcctgctgctgagaagggcaaggacaccctgaagagcgcctatgatgacacagaaaatgacctgaagggagctgccatccacatcagcaagggcatgctgcacgaggagaagccaggagagcagatcctggagggcggcagcgagagcgagagcgcccagaaggctgctggcaaccagatgaatgacaggaagatccagcaggagagcctgggcagcgcccccctgatgggagatgaccaccccaatgccagccgggacagcgtggagggagatgccctggtgaatggagccaagctgcacaccctgtctgtggagcaccagcgggaggagctgaaggaggagctggtgctgaagacccagaaccagccccgcttcagcagcccagatgaaattgacctgccccgggagctggaggatgaggtgcccatcctgggcaggaacctgccctggcagcaggagagagatgtggccgccacagccagcaagcagatgtctgagaagatccggctgtctgagggggaggccaaggaggacagcctggatgaggagttcttccaccacaaggccatgcagggcacagaggtgggccagacagaccagacagacagcactggaggccctgccttcctgagcaaggtggaggaggatgactaccccagcgaggagctgctggaggatgaaaatgccatcaatgccaagaggagcaaggagaagaaccctggcaaccagggccggcagtttgatgtgaacctgcaggtgcctgacagagctgtgctgggcaccatccacccagaccctgagattgaggagagcaagcaggagacctccatgatcctggacagcgagaagaccagcgagacagctgccaagggcgtgaacacaggaggccgggagcccaacaccatggtggagaaggagcggcccctggccgacaagaaggcccagaggccctttgagaggagtgacttcagtgacagcatcaagatccagaccccagagctgggggaggtgttccagaacaaggacagcgactacctgaagaatgacaaccctgaggagcacctgaagaccagcggcctggccggggagcctgagggggagctgagcaaggaggaccatgaaaatacagagaagtacatgggcacagagagccagggcagcgctgctgctgagccagaagatgacagcttccactggaccccccacacctctgtggagcccggccacagcgacaagcgggaggacctgctgatcatcagcagcttcttcaaggagcagcagagcctgcagcgcttccagaagtacttcaacgtgcatgagctggaggccctgctgcaggagatgagcagcaagctgaagagcgcccagcaggagagcctgccctacaacatggagaaggtgctggacaaggtgttccgggccagcgagagccagatcctgagcattgctgagaagatgctggacaccagggtggccgagaacagagacctgggcatgaatgaaaacaacatctttgaggaggccgctgtgctggatgacatccaggacctgatctactttgtgcgctacaagcacagcacagctgaggagacagccaccctggtgatggccccacccctggaggagggcctgggcggggccatggaggagatgcagcccctgcacgaggacaacttcagccgggagaagacagctgagctgaatgtgcaggtgcctgaggagcccacccacctggaccagagggtcatcggggacacccacgccagcgaggtgtcccagaagcccaacacagagaaggacctggaccccggccctgtgaccacagaggacacccccatggatgccattgatgccaacaagcagcctgagacagctgctgaggagcccgcctctgtgacccccctggagaatgccatcctgctgatctacagcttcatgttctacctgaccaagagcctggtggccaccctgcctgatgatgtgcagcccggccctgacttctacggcctgccctggaagcctgtgttcatcacagccttcctgggcatcgccagctttgccatcttcctgtggaggacagtgctggtggtgaaggacagagtgtaccaggtgacagagcagcagatcagcgagaagctgaagaccatcatgaaggagaacacagagctggtgcagaagctgagcaactatgagcagaagatcaaggagagcaagaagcacgtgcaggagaccaggaagcagaacatgatcctgagtgatgaggccatcaagtacaaggacaagatcaagaccctggagaagaaccaggagatcctggatgacacagccaagaacctgcgggtgatgctggagagcgagcgggagcagaatgtgaagaaccaggacctgatcagcgagaacaagaagagcattgagaagctgaaggatgtgatctccatgaatgccagcgagttcagcgaggtgcagatcgccctgaatgaggccaagctgtctgaggagaaggtgaagtctgagtgccaccgggtgcaggaggagaatgcccggctgaagaagaagaaggagcagctgcagcaggagattgaggactggagcaagctgcatgctgagctgtctgagcagatcaagagctttgagaagagccagaaggacctggaggtggccctgacccacaaggatgacaacatcaatgccctgaccaactgcatcacccagctgaacctgctggagtgtgagagcgagagcgagggccagaacaagggcggcaatgacagtgatgagctggccaacggggaggtgggcggggacagaaatgagaagatgaagaaccagatcaagcagatgatggatgtgtccaggacccagacagccatctctgtggtggaggaggacctgaagctgctgcagctgaagctgcgggcctctgtgtccaccaagtgcaacctggaggaccaggtgaagaagctggaggatgacaggaacagcctgcaggccgccaaggccggcctggaggatgagtgcaagaccctgcggcagaaggtggagatcctgaatgagctgtaccagcagaaggagatggccctgcagaagaagctgagccaggaggagtatgagcggcaggagcgggagcaccggctgtctgctgctgatgagaaggctgtgtctgctgctgaggaggtgaagacctacaagagaagaattgaggagatggaggatgagctgcagaagacagagaggagcttcaagaaccagatcgccacccatgagaagaaggcccacgagaactggctgaaggcccgggctgctgagcgggccatcgccgaggagaagcgggaggccgccaacctgcggcacaagctgctggagctgacccagaagatggccatgctgcaggaggagcccgtcatcgtgaagcccatgcctgggaagcccaacacccagaaccccccaagaagaggccccctgagccagaatggcagctttggccccagccctgtgtctggaggagagtgcagcccccccctgactgtggagccccctgtgcggcccctgagcgccaccctgaacagaagagacatgcccaggagtgaatttggatctgtggatggccccctgccccacccccgctggagcgctgaggccagcggcaagcccagccccagcgaccccggcagcggcacagccaccatgatgaacagcagcagccggggcagcagccccaccagggtgctggatgagggcaaggtgaacatggcccccaagggccccccacccttccctggggtgcccctgatgagcacccccatgggcggccctgtgcccccacccatccgctatggccccccaccccagctgtgtggccccttcggcccccggcccctgcccccacccttcggccctggcatgaggcctcccctgggcctgcgggagtttgcccctggggtgcccccaggaagaagagacctgcccctgcacccccggggcttcctgcccggccacgcccccttccggcccctgggcagcctgggcccccgggagtacttcatccctggcacccggctgcccccacccacccacggcccccaggagtacccacctcctcctgctgtgcgggacctgctgcccagcggcagcagagatgagcccccaccagccagccagagcaccagccaggactgcagccaggccctgaagcagagcccctag

SEQ ID NO: 159327 - DNA, 3051 bp, Artificial Sequence
  Description of Artificial Sequence: Synthetic coding sequence
tgactggtgcctgacagcaagcagggcaagccccagagcgccacagactacagcgaccctgacaacgtggatgatggcctcttcatcgtggacatccccaagaccaacaatgacaaggaggtgaatgctgagcaccacatcaagggcaagggccggggcgtgcaggagagcaagaggggcctggtgcaggacaagacagagctggaggatgagaaccaggagggcatgacagtgcacagctctgtgcacagcaacaacctgaacagcatgcctgctgctgagaagggcaaggacaccctgaagagcgcctatgatgacacagaaaatgacctgaagggggccgccatccacatcagcaagggcatgctgcacgaggagaagccaggagagcagatcctggagggcggcagcgagagcgagagcgcccagaaggccgccggcaaccagatgaatgacaggaagatccagcaggagagcctgggcagcgcccccctgatgggagatgaccaccccaatgccagccgggacagcgtggagggagatgccctggtgaatggagccaagctgcacaccctgtctgtggagcaccagcgggaggagctgaaggaggagctggtgctgaagacccagaaccagccccgcttcagcagcccagatgaaattgacctgccccgggagctggaggatgaggtgcccatcctgggcaggaacctgccctggcagcaggagagagatgtggccgccacagccagcaagcagatgtctgagaagatccggctgtctgagggggaggccaaggaggacagcctggatgaggagttcttccaccacaaggccatgcagggcacagaggtgggccagacagaccagacagacagcactggaggccctgccttcctgagcaaggtggaggaggatgactaccccagcgaggagctgctggaggatgaaaatgccatcaatgccaagaggagcaaggagaagaaccctggcaaccagggccggcagtttgatgtgaacctgcaggtgcctgacagagctgtgctgggcaccatccacccagaccctgagattgaggagagcaagcaggagacctccatgatcctggacagcgagaagaccagcgagacagctgccaagggcgtgaacacaggaggccgggagcccaacaccatggtggagaaggagcggcccctggccgacaagaaggcccagaggccctttgagaggagtgacttcagtgacagcatcaagatccagaccccagagctgggggaggtgttccagaacaaggacagcgactacctgaagaatgacaaccctgaggagcacctgaagaccagcggcctggccggggagcctgagggggagctgagcaaagaagatcatgagaacacagagaagtacatgggcacagagagccagggcagcgctgctgctgagccagaagatgacagcttccactggaccccccacacctctgtggagcccggccacagcgacaagcgggaggacctgctgatcatcagcagcttcttcaaggagcagcagagcctgcagcgcttccagaagtacttcaacgtgcatgagctggaggccctgctgcaggagatgagcagcaagctgaagagcgcccagcaggagagcctgccctacaacatggagaaggtgctggacaaggtgttccgggccagcgagagccagatcctgagcattgctgagaagatgctggacaccagggtggctgaaaatagagacctgggcatgaatgaaaacaacatctttgaggaggccgctgtgctggatgacatccaggacctgatctactttgtgcgctacaagcacagcacagctgaggagacagccaccctggtgatggccccacccctggaggagggcctgggcggggccatggaggagatgcagcccctgcacgaggacaacttcagccgggagaagacagctgagctgaatgtgcaggtgcctgaggagcccacccacctggaccagagggtgattggagacacccacgccagcgaggtgtcccagaagcccaacacagagaaggacctggaccccggccctgtgaccacagaggacacccccatggatgccattgatgccaacaagcagcctgagacagctgctgaggagcccgcctctgtgacccccctggagaatgccatcctgctgatctacagcttcatgttctacctgaccaagagcctggtggccaccctgcctgatgatgtgcagcccggccctgacttctacggcctgccctggaagcctgtgttcatcacagccttcctgggcatcgccagctttgccatcttcctgtggaggacagtgctggtggtgaaggacagagtgtaccaggtgacagagcagcagatcagcgagaagctgaagaccatcatgaaggaaaatacagagctggtgcagaagctgagcaactatgagcagaagatcaaggagagcaagaagcacgtgcaggagaccaggaagcagaacatgatcctgagtgatgaggccatcaagtacaaggacaagatcaagaccctggagaagaaccaggagatcctggatgacacagccaagaacctgcgggtgatgctggagagcgagcgggagcagaatgtgaagaaccaggacctgctgcagcaggagattgaggactggagcaagctgcatgctgagctgtctgagcagatcaagagctttgagaagagccagaaggacctggaggtggccctgacccacaaggatgacaacatcaatgccctgaccaactgcatcacccagctgaacctgctggagtgtgagagcgagagcgagggccagaacaagggcggcaatgacagtgatgagctggccaacggggaggtgggcggggacagaaatgagaagatgaagaaccagatcaagcagatgatggatgtgtccaggacccagacagccatctctgtggtggaggaggacctgaagctgctgcagctgaagctgcgggcctctgtgtccaccaagtgcaacctggaggaccaggtgtag

SEQ ID NO: 159328 - DNA, 324 bp, Artificial Sequence
  Description of Artificial Sequence: Synthetic coding sequence
tgaagtgctgaggccagcggcaagcccagccccagcgaccccggcagcggcacagccaccatgatgaacagcagcagccggggcagcagccccaccagggtgctggatgagggcaaggtgaacatggcccccaagggccccccacccttccctggggtgcccctgatgagcacccccatgggcggccctgtgcccccacccatccgctatggccccccaccccagctgtgtggccccttcggcccccggcccctgcccccaccatttgacaaggatggccggcccggcaccgtggcccacgcctgcaaccccagcaccctgtag

SEQ ID NO: 159329 - DNA, 1803 bp, Artificial Sequence
  Description of Artificial Sequence: Synthetic coding sequence
atgggcaagaagctggacctgagcaagctgacagatgaggaggcccagcacgtgctggaggtggtgcagagggactttgacctgcggaggaaggaggaggagcggctggaggccctgaagggcaagatcaagaaggagagcagcaagcgggagctgctgagtgacacagcccacctgaatgagacccactgtgcccgctgcctgcagccctaccagctgctggtgaacagcaagaggcagtgcctggagtgtggcctcttcacctgcaagagctgtggccgggtgcaccctgaggagcagggctggatctgtgacccctgccacctggcccgggtggtgaagattggcagcctggagtggtactatgagcacgtgaaggcccgcttcaagcgcttcggcagcgccaaggtgatccgcagcctgcacggccgcctgcagggcggggccggccctgagctgatcagcgaggagaggtctggggacagcgaccagacagatgaagatggagagcccggcagcgaggcccaggcccaggcccagcccttcggcagcaagaagaagaggctgctgtctgtgcatgactttgattttgaaggagacagtgatgacagcacccagccccagggccacagcctgcacctgagctctgtgcctgaggcccgggacagcccccagagcctgacagatgagagctgcagcgagaaggccgccccccacaaggccgagggcctggaggaggccgacacaggagccagcggctgccacagccaccctgaggagcagcccaccagcatcagccccagccgccacggggccctggccgagctgtgccccccaggcggcagccacaggatggccctgggcacagctgctgccctgggcagcaatgtcatcagaaatgagcagctgcccctgcagtacctggctgatgtggacaccagtgatgaggagagcatccgggcccacgtgatggccagccaccacagcaagagaagaggccgggccagcagcgagagccagatctttgagctgaacaagcacatctctgctgtggagtgcctgctgacctacctggagaacacagtggtgccccccctggccaagggcctgggcgctggggtgaggacagaagcagatgtggaggaggaggccctgcggaggaagctggaggagctgaccagcaatgtgtctgaccaggagaccagcagcgaggaggaggaggccaaggatgagaaggccgagcccaacagagacaagtctgtgggccccctgccccaggccgaccctgaggtgggcacagctgcccaccagaccaaccggcaggagaagagcccccaggaccccggggaccctgtgcagtacaacagaaccacagatgaggagctgtctgagctggaggacagagtggccgtgacagccagcgaggtgcagcaggccgagagcgaggtgtctgacatcgagagcagaattgctgccctgcgggccgccggcctgactgtgaagcccagcggcaagcccaggaggaagagcaacctgcccatcttcctgccccgggtggccggcaagctgggcaagaggcctgaggaccccaatgctgaccccagcagcgaggccaaggccatggctgtgccctacctgctgcggaggaagttcagcaacagcctgaagagccagggcaaggatgatgacagctttgacaggaagtctgtgtaccggggcagcctgacccagaggaaccccaatgccaggaagggcatggccagccacacctttgccaagcctgtggtggcccaccagagctag

SEQ ID NO: 159330 - DNA, 1719 bp, Artificial Sequence
  Description of Artificial Sequence: Synthetic coding sequence
atgggcaagaagctggacctgagcaagctgacagatgaggaggcccagcacgtgctggaggtggtgcagagggactttgacctgcggaggaaggaggaggagcggctggaggccctgaagggcaagatcaagaaggagagcagcaagcgggagctgctgagtgacacagcccacctgaatgagacccactgtgcccgctgcctgcagccctaccagctgctggtgaacagcaagaggcagtgcctggagtgtggcctcttcacctgcaagagctgtggccgggtgcaccctgaggagcagggctggatctgtgacccctgccacctggcccgggtggtgaagattggcagcctggagtggtactatgagcacgtgaaggcccgcttcaagcgcttcggcagcgccaaggtgatccgcagcctgcacggccgcctgcagggcggggccggccctgagctgatcagcgaggagaggtctggggacagcgaccagacagatgaagatggagagcccggcagcgaggcccaggcccaggcccagcccttcggcagcaagaagaagaggctgctgtctgtgcatgactttgattttgaaggagacagtgatgacagcacccagccccagggccacagcctgcacctgagctctgtgcctgaggcccgggacagcccccagagcctgacagatgagagctgcagcgagaaggccgccccccacaaggccgagggcctggaggaggccgacacaggagccagcggctgccacagccaccctgaggagcagcccaccagcatcagccccagccgccacggggccctggccgagctgtgccccccaggcggcagccacaggatggccctgggcacagctgctgccctgggcagcaatgtcatcagaaatgagcagctgcccctgcagtacctggctgatgtggacaccagtgatgaggagagcatccgggcccacgtgatggccagccaccacagcaagagaagaggccgggccagcagcgagagccagggcctgggcgctggggtgaggacagaagcagatgtggaggaggaggccctgcggaggaagctggaggagctgaccagcaatgtgtctgaccaggagaccagcagcgaggaggaggaggccaaggatgagaaggccgagcccaacagagacaagtctgtgggccccctgccccaggccgaccctgaggtgggcacagctgcccaccagaccaaccggcaggagaagagcccccaggaccccggggaccctgtgcagtacaacagaaccacagatgaggagctgtctgagctggaggacagagtggccgtgacagccagcgaggtgcagcaggccgagagcgaggtgtctgacatcgagagcagaattgctgccctgcgggccgccggcctgactgtgaagcccagcggcaagcccaggaggaagagcaacctgcccatcttcctgccccgggtggccggcaagctgggcaagaggcctgaggaccccaatgctgaccccagcagcgaggccaaggccatggctgtgccctacctgctgcggaggaagttcagcaacagcctgaagagccagggcaaggatgatgacagctttgacaggaagtctgtgtaccggggcagcctgacccagaggaaccccaatgccaggaagggcatggccagccacacctttgccaagcctgtggtggcccaccagagctag

SEQ ID NO: 159331 - DNA, 396 bp, Artificial Sequence
  Description of Artificial Sequence: Synthetic coding sequence
atgggcaagaagctggacctgagcaagctgacagatgaggaggcccagcacgtgctggaggtggtgcagagggactttgacctgcggaggaaggaggaggagcggctggaggccctgaagggcaagatcaagaaggagagcagcaagcgggagctgctgagtgacacagcccacctgaatgagacccactgtgcccgctgcctgcagccctaccagctgctggtgaacagcaagaggcagtgcctggagtgtggcctcttcacctgcaagagctgtggccgggtgcaccctgaggagcagggctggatctgtgacccctgccacctggcccgggtggtgaagattggcagcctggagtggtactatgagcacgtgaaggcccgcttcaagaggtag

SEQ ID NO: 159332 - DNA, 213 bp, Artificial Sequence
  Description of Artificial Sequence: Synthetic coding sequence
atgggcaagaagctggacctgagcaagctgacagatgaggaggcccagcacgtgctggaggtggtgcagagggactttgacctgcggaggaaggaggaggagcggctggaggccctgaagggcaagatcaagaaggagagcagcaagcgggagctgctgagtgacacagcccacctgaatgagacccactgtgcccgctgcctgcagccctag

SEQ ID NO: 159333 - DNA, 1656 bp, Artificial Sequence
  Description of Artificial Sequence: Synthetic coding sequence
atgggcaagaagctggacctgagcaagctgacagatgaggaggcccagcacgtgctggaggtggtgcagagggactttgacctgcggaggaaggaggaggagcggctggaggccctgaagggcaagatcaagaaggagagcagcaagcgggagctgctgagtgacacagcccacctgaatgagacccactgtgcccgctgcctgcagccctaccagctgctggtgaacagcaagaggcagtgcctggagtgtggcctcttcacctgcaagagctgtggccgggtgcaccctgaggagcagggctggatctgtgacccctgccacctggcccgggtggtgaagattggcagcctggagtggtactatgagcacgtgaaggcccgcttcaagcgcttcggcagcgccaaggtgatccgcagcctgcacggccgcctgcagggcggggccggccctgagctgatcagcgaggagaggtctggggacagcgaccagacagatgaagatggagagcccggcagcgaggcccaggcccaggcccagcccttcggcagcaagaagaagaggctgctgtctgtgcatgactttgattttgaaggagacagtgatgacagcacccagccccagggccacagcctgcacctgagctctgtgcctgaggcccgggacagcccccagagcctgacagatgagagctgcagcgagaaggccgccccccacaaggccgagggcctggaggaggccgacacaggagccagcggctgccacagccaccctgaggagcagcccaccagcatcagccccagccgccacggggccctggccgagctgtgccccccaggcggcagccacaggatggccctgggcacagctgctgccctgggcagcaatgtcatcagaaatgagcagctgcccctgcagtacctggctgatgtggacaccagtgatgaggagagcatccgggcccacgtgatggccagccaccacagcaagagaagaggccgggccagcagcgagagccagatctttgagctgaacaagcacatctctgctgtggagtgcctgctgacctacctggagaacacagtggtgccccccctggccaagggcctgggcgctggggtgaggacagaagcagatgtggaggaggaggccctgcggaggaagctggaggagctgaccagcaatgtgtctgaccaggagaccagcagcgaggaggaggaggccaaggatgagaaggccgagcccaacagagacaagtctgtgggccccctgccccaggccgaccctgaggtgggcacagctgcccaccagaccaaccggcaggagaagagcccccaggaccccggggaccctgtgcagtacaacagaaccacagatgaggagctgtctgagctggaggacagagtggccgtgacagccagcgaggtgcagcaggccgagagcgaggtgtctgacatcgagagcagaattgctgccctgcgggccgccggcctgactgtgaagcccagcggcaagcccaggaggaagagcaacctgcctgccctgtatgagggcaccctgagcctgtgcagcgaggacctgaagcacacccacccagacagcgtgaagagcaagaggagccggctgaaccacgtggccagctgtggcaacccctag

SEQ ID NO: 159334 - DNA, 675 bp, Artificial Sequence
  Description of Artificial Sequence: Synthetic coding sequence
atgggcctgcgggactggctgaggacagtgtgctgctgctgcggctgtgaatgtctggaggagcgggccctgcctgagaaggagcccctggtgtctgacaacaacccctacagcagctttggagccaccctggtgagagatgatgagaagaacctgtggagcatgcctcatgatgtgagccacacagaagcagatgatgacaggaccctgtacaacctgattgtcatccggaaccagcaggccaaggacagcgaggagtggcagaagctgaactatgacatccacaccctgcggcaggtgagaagagaggtgaggaaccgctggaagtgcatcctggaggacctgggcttccagaaggaggccgacagcctgctgtctgtgaccaagctgagcaccatcagtgacagcaagaacaccaggaaggcccgggagatgctgctgaagctggccgaggagaccaacatcttccccacctcctgggagctgtctgagcgctacctgtttgtggtggacaggctcatcgccctggatgctgctgaggagttcttcaagctggcccggaggacctaccccaagaagccaggagtgccctgcctggctgatggccagaaggagctgcacctgtggggagacctgagctgccgcctggcccacatgcagggcgtgctgcactag

SEQ ID NO: 159335 - DNA, 645 bp, Artificial Sequence
  Description of Artificial Sequence: Synthetic coding sequence
atgggcctgcgggactggctgaggacagtgtgctgctgctgcggctgtgaatgtctggaggagcgggccctgcctgagaaggagcccctggtgtctgacaacaacccctacagcagctttggagccaccctggtgagagatgatgagaagaacctgtggagcatgcctcatgatgtgagccacacagaagcagatgatgacaggaccctgtacaacctgattgtcatccggaaccagcaggccaaggacagcgaggagtggcagaagctgaactatgacatccacaccctgcggcaggtgagaagagaggtgaggaaccgctggaagtgcatcctggaggacctgggcttccagaaggaggccgacagcctgctgtctgtgaccaagctgagcaccatcagtgacagcaagaacaccaggaaggcccgggagatgctgctgaagctggccgaggagaccaacatcttccccacctcctgggagctgtctgagcgctacctgtttgtggtggacaggctcatcgccctggatgctgctgaggagttcttcaagctggcccggaggacctaccccaagaagccaggagtgccctgcctggctgatggccagaaggagctgcactacctgcccttccccagcccctag

SEQ ID NO: 159336 - DNA, 645 bp, Artificial Sequence; identical to SEQ ID NO: 159335
  Description of Artificial Sequence: Synthetic coding sequence

SEQ ID NO: 159337 - DNA, 1053 bp, Artificial Sequence
  Description of Artificial Sequence: Synthetic coding sequence
atgcagggcaatggcagcgccctgcccaatgccagccagcctgtgctgcggggagatggagcccggcccagctggctggccagcgccctggcctgtgtgctgatcttcaccatcgtggtggacatcctgggcaacctgctggtgatcctgtctgtgtacagaaacaagaagctgagaaatgccggcaacatctttgtggtgtccctggccgtggccgacctggtggtggccatctacccctaccccctggtgctgatgagcatcttcaacaacggctggaacctgggctacctgcactgccaggtgtctggcttcctgatgggcctgagcgtcatcggcagcatcttcaacatcactggaattgccatcaaccgctactgctacatctgccacagcctgaagtatgacaagctgtacagcagcaagaacagcctgtgctacgtgctgctgatctggctgctgaccctggccgctgtgctgcccaacctgcgggccggcaccctgcagtatgacccccgcatctacagctgcacctttgcccagagcgtgtcctctgcctacaccatcgctgtggtggtgttccacttcctggtgcccatgatcatcgtcatcttctgctacctgcgcatctggatcctggtgctgcaggtgcggcagagggtgaagccagacaggaagcccaagctgaagccccaggacttcaggaactttgtgaccatgtttgtggtgtttgtgctgtttgccatctgctgggcccccctgaacttcatcggcctggccgtggccagtgaccctgcctccatggtgccccgcatccctgagtggctgtttgtggccagctactacatggcctacttcaacagctgcctgaatgccatcatctacggcctgctgaaccagaacttcaggaaggagtaccgccgcatcatcgtgtccctgtgcacagcccgggtcttctttgtggacagcagcaatgatgtggccgacagagtgaagtggaagcccagccccctgatgaccaacaacaacgtggtgaaggtggacagcgtgtag

SEQ ID NO: 159338 - DNA, 1089 bp, Artificial Sequence
  Description of Artificial Sequence: Synthetic coding sequence
atgtctgaaaatggcagctttgccaactgctgtgaggccggcggctgggccgtgcggcccggctggagcggggccggcagcgcccggcccagcaggaccccccggcccccctgggtggccccagccctgtctgctgtgctgattgtgaccacagctgtggatgtggtgggcaacctgctggtgatcctgtctgtgctgaggaacaggaagctgagaaatgccggcaacctcttcctggtgtccctggccctggccgacctggtggtggccttctacccctaccccctcatcctggtggccatcttctatgatggctgggccctgggggaggagcactgcaaggccagcgcctttgtgatgggcctgtctgtgattggctctgtgttcaacatcacagccatcgccatcaaccgctactgctacatctgccacagcatggcctaccaccgcatctaccgccgctggcacacccccctgcacatctgcctgatctggctgctgactgtggtggccctgctgcccaacttctttgtgggcagcctggagtatgacccccgcatctacagctgcaccttcatccagacagccagcacccagtacacagctgctgtggtggtgatccacttcctgctgcccatcgctgtggtgtccttctgctacctgcgcatctgggtgctggtgctgcaggcccggaggaaggccaagccagagagccggctgtgcctgaagcccagcgacctgcgctccttcctgaccatgtttgtggtgtttgtgatctttgccatctgctgggcccccctgaactgcatcggcctggccgtggccatcaacccccaggagatggccccccagatccctgagggcctgtttgtgaccagctacctgctggcctacttcaacagctgcctgaatgccatcgtgtatggcctgctgaaccagaacttccggcgggagtacaagaggatcctgctggccctgtggaaccccaggcactgcatccaggatgccagcaagggcagccacgccgagggcctgcagagccctgccccacccatcattggagtgcagcaccaggctgatgccctgtag

SEQ ID NO: 159339 - DNA, 3864 bp, Artificial Sequence
  Description of Artificial Sequence: Synthetic coding sequence
atgagcaaggtgatccagaagaagaaccactggaccagccgggtgcatgaatgtactgtgaagaggggcccccagggcgagctgggcgtgacagtgctgggcggcgctgagcacggggagttcccctacgtgggcgctgtggccgctgtggaggccgccggcctgcccggcggcggggagggcccccggctgggggagggggagctgctgctggaggtgcagggcgtgcgggtgtctggcctgcccaggtatgatgtgctgggcgtcatcgacagctgcaaggaggccgtgaccttcaaggctgtgcggcagggcggccgcctgaacaaggacctgcggcacttcctgaaccagcgcttccagaagggcagcccagaccacgagctgcagcagaccatccgggacaacctgtacagacatgctgtgccctgcaccaccaggagcccccgggagggggaggtgcctggggtggactacaacttcctgactgtgaaggagttcctggacctggagcagagcggcaccctgctggaggtgggcacctatgagggcaactactacggcacccccaagccacccagccagcctgtgtctgggaaggtgatcaccacagatgccctgcacagcctgcagagcggcagcaagcagagcacccccaagaggaccaagagctacaatgacatgcagaatgccggcatcgtgcatgctgaaaatgaggaggaggatgatgtgcctgagatgaacagcagcttcaccgctgacagcggggagcaggaggagcacaccctgcaggagacagccctgccccctgtgaacagcagcatcatcgccgcccccatcacagaccccagccagaagttcccccagtacctgcccctgtctgctgaggacaacctgggccccctgcctgagaactgggagatggcctacacagaaaatggagaggtgtacttcatcgaccacaacaccaagaccacctcctggctggacccccgctgcctgaacaagcagcagaagcccctggaggagtgtgaagatgatgaaggagtgcacacagaggagctggacagcgagctggagctgcctgctggctgggagaagattgaagatcctgtgtatggcatctactacgtggaccacatcaacaggaagacccagtatgagaaccctgtgctggaggccaagaggaagaagcagctggagcagcagcagcagcagcagcagcagcagcagcagcagcagcagcagcagcagcagcagcagacagaggagtggacagaggaccacagcgccctggtgccccctgtgatccccaaccacccccccagcaaccctgagcccgcccgggaggtgcccctgcagggcaagcccttcttcaccaggaaccccagcgagctgaagggcaagttcatccacaccaagctgaggaagagcagccggggcttcggcttcaccgtggtgggcggagatgagccagatgagttcctgcagatcaagagcctggtgctggatggccctgctgccctggatggcaagatggagactggagatgtgattgtgtctgtgaatgacacctgtgtgctgggccacacccacgcccaggtggtgaagatcttccagagcatccccatcggggcctctgtggacctggagctgtgccggggctaccccctgccctttgatcctgatgaccccaacaccagcctggtgacctctgtggccatcctggacaaggagcccatcatcgtgaatggccaggagacctatgacagccctgccagccacagcagcaagacaggcaaggtgaatggcatgaaggatgcccggcccagcagccctgcagatgtggccagcaacagcagccacggctacccaaatgacacagtgtccctggccagcagcatcgccacccagcctgagctgatcaccgtgcacatcgtgaagggccccatgggcttcggcttcaccatcgctgacagccctgggggcggcggccagagggtgaagcagatcgtggacagcccccgctgccggggcctgaaggagggggacctgattgtggaggtgaacaagaagaatgtgcaggccctgacccacaaccaggtggtggacatgctggtggagtgccccaagggcagcgaggtgaccctgctggtgcagaggggcggcctgcctgtgcccaagaagagccccaagagccagcccctggagaggaaggacagccagaacagcagccagcacagcgtgagcagccacaggagcctgcacacagccagccccagccacagcacccaggtgctgcctgagttccccccagctgaggcccaggccccagaccagacagacagcagcggccagaagaagccagaccccttcaagatctgggcccagagccgctccatgtatgaaaatcggcccatgagccccagccctgccagcggcctgagcaaaggagagcgggagcgggagatcaacagcaccaactttggagaatgtcccatcccagactaccaggagcaggacatcttcctgtggaggaaggagactggatttggcttccgcatcctgggcggcaatgaacctggagagcccatctacatcggccacatcgtgcccctgggcgctgctgacacagatggccgcctgcggtctggagatgagctgatctgtgtggatggcacccctgtgattggcaagagccaccagctggtggtgcagctgatgcagcaggccgccaagcagggccacgtgaacctgactgtgcggaggaaggtggtgtttgctgtgcccaagacagaaaatgaggtgcccagccctgccagcagccaccacagcagcaaccagcctgccagcctgacagaggagaagaggaccccccagggcagccagaacagcctgaacacagtgagcagcggcagcggcagcaccagcggcatcggcagcggcggcggcggcggcagcggcgtggtgtccacagtggtgcagccctatgatgtggagatcagaagaggagaaaatgaaggatttggatttgtgattgtgtcctctgtgtccaggcctgaggccggcaccacctttggaaatgcctgtgtggccatgccccacaagattggccgcatcatcgagggcagccctgctgacagatgtgggaagctgaaggtgggggaccgcatcctggccgtgaatggctgcagcatcaccaacaagagccacagcgacatcgtgaacctgatcaaggaggccggcaacacagtgaccctgcgcatcatccctggagatgagagcagcaatgccaccctgctgaccaatgctgagaagatcgccaccatcaccaccacccacacccccagccagcagggcacccaggagaccaggaacaccaccaagcccaagcaggagagccagtttgagttcaaggccccccaggccacccaggagcaggacttctacacagtggagctggagcggggggccaagggcttcggcttcagcctgcggggcggccgggagtacaacatggacctgtatgtgctgcggctggccgaggatggccctgctgagcgctgtgggaagatgagaattggagatgagatcctggagatcaacggggagaccaccaagaacatgaagcacagccgggccatcgagctgatcaagaatggaggaagaagagtgcggctcttcctgaagagaggagatggctctgtgcctgaatatgccatgatcccccccaacattgctgcctgcatgagaaatgagaagctgggggaggcctgcttctacctgatgggccacaaccagaccaccaccccagctgccacagccacagcccctcctcctgtgcacaaggtgttcaggaagtag

SEQ ID NO: 159340 - DNA, 4389 bp, Artificial Sequence
  Description of Artificial Sequence: Synthetic coding sequence
atgagcaaggtgatccagaagaagaaccactggaccagccgggtgcatgaatgtactgtgaagaggggcccccagggcgagctgggcgtgacagtgctgggcggcgctgagcacggggagttcccctacgtgggcgctgtggccgctgtggaggccgccggcctgcccggcggcggggagggcccccggctgggggagggggagctgctgctggaggtgcagggcgtgcgggtgtctggcctgcccaggtatgatgtgctgggcgtcatcgacagctgcaaggaggccgtgaccttcaaggctgtgcggcagggcggccgcctgaacaaggacctgcggcacttcctgaaccagcgcttccagaagggcagcccagaccacgagctgcagcagaccatccgggacaacctgtacagacatgctgtgccctgcaccaccaggagcccccgggagggggaggtgcctggggtggactacaacttcctgactgtgaaggagttcctggacctggagcagagcggcaccctgctggaggtgggcacctatgagggcaactactacggcacccccaagccacccagccagcctgtgtctgggaaggtgatcaccacagatgccctgcacagcctgcagagcggcagcaagcagagcacccccaagaggaccaagagctacaatgacatgcagaatgccggcatcgtgcatgctgaaaatgaggaggaggatgatgtgcctgagatgaacagcagcttcaccgctgacagcggggagcaggaggagcacaccctgcaggagacagccctgccccctgtgaacagcagcatcatcgccgcccccatcacagaccccagccagaagttcccccagtacctgcccctgtctgctgaggacaacctgggccccctgcctgagaactgggagatggcctacacagaaaatggagaggtgtacttcatcgaccacaacaccaagaccacctcctggctggacccccgctgcctgaacaagcagcagaagcccctggaggagtgtgaagatgatgaaggagtgcacacagaggagctggacagcgagctggagctgcctgctggctgggagaagattgaagatcctgtgtatggcatctactacgtggaccacatcaacaggaagacccagtatgagaaccctgtgctggaggccaagaggaagaagcagctggagcagcagcagcagcagcagcagcagcagcagcagcagcagcagcagcagcagcagcagcagacagaggagtggacagaggaccacagcgccctggtgccccctgtgatccccaaccacccccccagcaaccctgagcccgcccgggaggtgcccctgcagggcaagcccttcttcaccaggaaccccagcgagctgaagggcaagttcatccacaccaagctgaggaagagcagccggggcttcggcttcaccgtggtgggcggagatgagccagatgagttcctgcagatcaagagcctggtgctggatggccctgctgccctggatggcaagatggagactggagatgtgattgtgtctgtgaatgacacctgtgtgctgggccacacccacgcccaggtggtgaagatcttccagagcatccccatcggggcctctgtggacctggagctgtgccggggctaccccctgccctttgatcctgatgaccccaacaccagcctggtgacctctgtggccatcctggacaaggagcccatcatcgtgaatggccaggagacctatgacagccctgccagccacagcagcaagacaggcaaggtgaatggcatgaaggatgcccggcccagcagccctgcagatgtggccagcaacagcagccacggctacccaaatgacacagtgtccctggccagcagcatcgccacccagcctgagctgatcaccgtgcacatcgtgaagggccccatgggcttcggcttcaccatcgctgacagccctgggggcggcggccagagggtgaagcagatcgtggacagcccccgctgccggggcctgaaggagggggacctgattgtggaggtgaacaagaagaatgtgcaggccctgacccacaaccaggtggtggacatgctggtggagtgccccaagggcagcgaggtgaccctgctggtgcagaggggcggcctgcctgtgcccaagaagagccccaagagccagcccctggagaggaaggacagccagaacagcagccagcacagcgtgagcagccacaggagcctgcacacagccagccccagccacagcacccaggtgctgcctgagttccccccagctgaggcccaggccccagaccagacagacagcagcggccagaagaagccagaccccttcaagatctgggcccagagccgctccatgtatgaaaatcggctgcctgactaccaggagcaggacatcttcctgtggaggaaggagactggatttggcttccgcatcctgggcggcaatgaacctggagagcccatctacatcggccacatcgtgcccctgggcgctgctgacacagatggccgcctgcggtctggagatgagctgatctgtgtggatggcacccctgtgattggcaagagccaccagctggtggtgcagctgatgcagcaggccgccaagcagggccacgtgaacctgactgtgcggaggaaggtggtgtttgctgtgcccaagacagaaaatgaggtgcccagccctgccagcagccaccacagcagcaaccagcctgccagcctgacagaggagaagaggaccccccagggcagccagaacagcctgaacacagtgagcagcggcagcggcagcaccagcggcatcggcagcggcggcggcggcggcagcggcgtggtgtccacagtggtgcagccctatgatgtggagatcagaagaggagaaaatgaaggatttggatttgtgattgtgtcctctgtgtccaggcctgaggccggcaccacctttggaaatgcctgtgtggccatgccccacaagattggccgcatcatcgagggcagccctgctgacagatgtgggaagctgaaggtgggggaccgcatcctggccgtgaatggctgcagcatcaccaacaagagccacagcgacatcgtgaacctgatcaaggaggccggcaacacagtgaccctgcgcatcatccctggagatgagagcagcaatgccaccctgctgaccaatgctgagaagatcgccaccatcaccaccacccacacccccagccagcagggcacccaggagaccaggaacaccaccaagcccaagcaggagagccagtttgagttcaaggccccccaggccacccaggagcaggacttctacacagtggagctggagcggggggccaagggcttcggcttcagcctgcggggcggccgggagtacaacatggacctgtatgtgctgcggctggccgaggatggccctgctgagcgctgtgggaagatgagaattggagatgagatcctggagatcaacggggagaccaccaagaacatgaagcacagccgggccatcgagctgatcaagaatggaggaagaagagtgcggctcttcctgaagagaggagatggctctgtgcctgaatatgaccccagcagtgacagacatggccctgccaccggcccccagggcgtgcctgaggtgcgggccggccctgaccggcggcagcaccccagcctggagagcagctaccccccagacctgcacaagagcagcccccacggggagaagagggcccacgcccgggaccccaagggcagccgggagtacagccggcagcccaatgagcaccacacctggaatggcaccagcaggaagccagattctggggcctgccggcccaaggaccgggcccctgagggcagaagagatgcccaggccgagagagctgctgctgccaacggccccaagaggaggagccctgagaagaggcgggagggcaccaggtctgctgacaacaccctggagcggcgggagaagcatgagaagagaagagatgtgtccccagagcggcggcgggagaggagccccaccaggagaagagatggcagccccagcagaagaagaagaagcctggagcggctgctggagcagaggaggagccctgagaggagaagaggaggcagccctgagcggcgggccaagagcacagacagaagaagagcccggagccctgagcggcggcgggagaggagcctggacaagaggaacagagaagatcgggccagccaccgggagcgggaggaggccaacctgaagcaggatgctggccgcagcagccgccaccccccagagcagaggcggcggccctacaaggaatgttccacagacctgagcatctag

SEQ ID NO: 159341 - DNA, 3552 bp, Artificial Sequence
  Description of Artificial Sequence: Synthetic coding sequence
gggggccgcctgaacaaggacctgcggcacttcctgaaccagcgcttccagaagggcagcccagaccacgagctgcagcagaccatccgggacaacctgtacagacatgctgtgccctgcaccaccaggagcccccgggagggggaggtgcctggggtggactacaacttcctgactgtgaaggagttcctggacctggagcagagcggcaccctgctggaggtgggcacctatgagggcaactactacggcacccccaagccacccagccagcctgtgtctgggaaggtgatcaccacagatgccctgcacagcctgcagagcggcagcaagcagagcacccccaagaggaccaagagctacaatgacatgcagaatgccggcatcgtgcatgctgaaaatgaggaggaggatgatgtgcctgagatgaacagcagcttcaccgctgacagcggggagcaggaggagcacaccctgcaggagacagccctgccccctgtgaacagcagcatcatcgccgcccccatcacagaccccagccagaagttcccccagtacctgcccctgtctgctgaggacaacctgggccccctgcctgagaactgggagatggcctacacagaaaatggagaggtgtacttcatcgaccacaacaccaagaccacctcctggctggacccccgctgcctgaacaagcagcagaagcccctggaggagtgtgaagatgatgaaggagtgcacacagaggagctggacagcgagctggagctgcctgctggctgggagaagattgaagatcctgtgtatggcatctactacgtggaccacatcaacaggaagacccagtatgagaaccctgtgctggaggccaagaggaagaagcagctggagcagcagcagcagcagcagcagcagcagcagcagcagcagcagcagcagcagcagcagcagacagaggagtggacagaggaccacagcgccctggtgccccctgtgatccccaaccacccccccagcaaccctgagcccgcccgggaggtgcccctgcagggcaagcccttcttcaccaggaaccccagcgagctgaagggcaagttcatccacaccaagctgaggaagagcagccggggcttcggcttcaccgtggtgggcggagatgagccagatgagttcctgcagatcaagagcctggtgctggatggccctgctgccctggatggcaagatggagactggagatgtgattgtgtctgtgaatgacacctgtgtgctgggccacacccacgcccaggtggtgaagatcttccagagcatccccatcggggcctctgtggacctggagctgtgccggggctaccccctgccctttgatcctgatgaccccaacaccagcctggtgacctctgtggccatcctggacaaggagcccatcatcgtgaatggccaggagacctatgacagccctgccagccacagcagcaagacaggcaaggtgaatggcatgaaggatgcccggcccagcagccctgcagatgtggccagcaacagcagccacggctacccaaatgacacagtgtccctggccagcagcatcgccacccagcctgagctgatcaccgtgcacatcgtgaagggccccatgggcttcggcttcaccatcgctgacagccctgggggcggcggccagagggtgaagcagatcgtggacagcccccgctgccggggcctgaaggagggggacctgattgtggaggtgaacaagaagaatgtgcaggccctgacccacaaccaggtggtggacatgctggtggagtgccccaagggcagcgaggtgaccctgctggtgcagaggggcggcctgcctgtgcccaagaagagccccaagagccagcccctggagaggaaggacagccagaacagcagccagcacagcgtgagcagccacaggagcctgcacacagccagccccagccacagcacccaggtgctgcctgagttccccccagctgaggcccaggccccagaccagacagacagcagcggccagaagaagccagaccccttcaagatctgggcccagagccgctccatgtatgaaaatcggcccatgagccccagccctgccagcggcctgagcaaaggagagcgggagcgggagatcaacagcaccaactttggagaatgtcccatcccagactaccaggagcaggacatcttcctgtggaggaaggagactggatttggcttccgcatcctgggcggcaatgaacctggagagcccatctacatcggccacatcgtgcccctgggcgctgctgacacagatggccgcctgcggtctggagatgagctgatctgtgtggatggcacccctgtgattggcaagagccaccagctggtggtgcagctgatgcagcaggccgccaagcagggccacgtgaacctgactgtgcggaggaaggtggtgtttgctgtgcccaagacagaaaatgaggtgcccagccctgccagcagccaccacagcagcaaccagcctgccagcctgacagaggagaagaggaccccccagggcagccagaacagcctgaacacagtgagcagcggcagcggcagcaccagcggcatcggcagcggcggcggcggcggcagcggcgtggtgtccacagtggtgcagccctatgatgtggagatcagaagaggagaaaatgaaggatttggatttgtgattgtgtcctctgtgtccaggcctgaggccggcaccacctttggaaatgcctgtgtggccatgccccacaagattggccgcatcatcgagggcagccctgctgacagatgtgggaagctgaaggtgggggaccgcatcctggccgtgaatggctgcagcatcaccaacaagagccacagcgacatcgtgaacctgatcaaggaggccggcaacacagtgaccctgcgcatcatccctggagatgagagcagcaatgccaccctgctgaccaatgctgagaagatcgccaccatcaccaccacccacacccccagccagcagggcacccaggagaccaggaacaccaccaagcccaagcaggagagccagtttgagttcaaggccccccaggccacccaggagcaggacttctacacagtggagctggagcggggggccaagggcttcggcttcagcctgcggggcggccgggagtacaacatggacctgtatgtgctgcggctggccgaggatggccctgctgagcgctgtgggaagatgagaattggagatgagatcctggagatcaacggggagaccaccaagaacatgaagcacagccgggccatcgagctgatcaagaatggaggaagaagagtgcggctcttcctgaagagaggagatggctctgtgcctgaatatgccatgatcccccccaacattgctgcctgcatgagaaatgagaagctgggggaggcctgcttctacctgatgggccacaaccagaccaccaccccagctgccacagccacagcccctcctcctgtgcacaaggtgttcaggaagtag

SEQ ID NO: 159342 - DNA, 3771 bp, Artificial Sequence
  Description of Artificial Sequence: Synthetic coding sequence
atgagcaaggtgatccagaagaagaaccactggaccagccgggtgcatgaatgtactgtgaagaggggcccccagggcgagctgggcgtgacagtgctgggcggcgctgagcacggggagttcccctacgtgggcgctgtggccgctgtggaggccgccggcctgcccggcggcggggagggcccccggctgggggagggggagctgctgctggaggtgcagggcgtgcgggtgtctggcctgcccaggtatgatgtgctgggcgtcatcgacagctgcaaggaggccgtgaccttcaaggctgtgcggcagggcggccgcctgaacaaggacctgcggcacttcctgaaccagcgcttccagaagggcagcccagaccacgagctgcagcagaccatccgggacaacctgtacagacatgctgtgccctgcaccaccaggagcccccgggagggggaggtgcctggggtggactacaacttcctgactgtgaaggagttcctggacctggagcagagcggcaccctgctggaggtgggcacctatgagggcaactactacggcacccccaagccacccagccagcctgtgtctgggaaggtgatcaccacagatgccctgcacagcctgcagagcggcagcaagcagagcacccccaagaggaccaagagctacaatgacatgcagaatgccggcatcgtgcatgctgaaaatgaggaggaggatgatgtgcctgagatgaacagcagcttcaccgctgacagcggggagcaggaggagcacaccctgcaggagacagccctgccccctgtgaacagcagcatcatcgccgcccccatcacagaccccagccagaagttcccccagtacctgcccctgtctgctgaggacaacctgggccccctgcctgagaactgggagatggcctacacagaaaatggagaggtgtacttcatcgaccacaacaccaagaccacctcctggctggacccccgctgcctgaacaagcagcagaagcccctggaggagtgtgaagatgatgaaggagtgcacacagaggagctggacagcgagctggagctgcctgctggctgggagaagattgaagatcctgtgtatggcatctactacgtggaccacatcaacaggaagacccagtatgagaaccctgtgctggaggccaagaggaagaagcagctggagcagcagcagcagcagcagcagcagcagcagcagcagcagcagcagcagcagcagcagcagacagaggagtggacagaggaccacagcgccctggtgccccctgtgatccccaaccacccccccagcaaccctgagcccgcccgggaggtgcccctgcagggcaagcccttcttcaccaggaaccccagcgagctgaagggcaagttcatccacaccaagctgaggaagagcagccggggcttcggcttcaccgtggtgggcggagatgagccagatgagttcctgcagatcaagagcctggtgctggatggccctgctgccctggatggcaagatggagactggagatgtgattgtgtctgtgaatgacacctgtgtgctgggccacacccacgcccaggtggtgaagatcttccagagcatccccatcggggcctctgtggacctggagctgtgccggggctaccccctgccctttgatcctgatgaccccaacaccagcctggtgacctctgtggccatcctggacaaggagcccatcatcgtgaatggccaggagacctatgacagccctgccagccacagcagcaagacaggcaaggtgaatggcatgaaggatgcccggcccagcagccctgcagatgtggccagcaacagcagccacggctacccaaatgacacagtgtccctggccagcagcatcgccacccagcctgagctgatcaccgtgcacatcgtgaagggccccatgggcttcggcttcaccatcgctgacagccctgggggcggcggccagagggtgaagcagatcgtggacagcccccgctgccggggcctgaaggagggggacctgattgtggaggtgaacaagaagaatgtgcaggccctgacccacaaccaggtggtggacatgctggtggagtgccccaagggcagcgaggtgaccctgctggtgcagaggggcggcctgcctgtgcccaagaagagccccaagagccagcccctggagaggaaggacagccagaacagcagccagcacagcgtgagcagccacaggagcctgcacacagccagccccagccacagcacccaggtgctgcctgagttccccccagctgaggcccaggccccagaccagacagacagcagcggccagaagaagccagaccccttcaagatctgggcccagagccgctccatgtatgaaaatcggcccatgagccccagccctgccagcggcctgagcaaaggagagcgggagcgggagatcaacagcaccaactttggagaatgtcccatcccagactaccaggagcaggacatcttcctgtggaggaaggagactggatttggcttccgcatcctgggcggcaatgaacctggagagcccatctacatcggccacatcgtgcccctgggcgctgctgacacagatggccgcctgcggtctggagatgagctgatctgtgtggatggcacccctgtgattggcaagagccaccagctggtggtgcagctgatgcagcaggccgccaagcagggccacgtgaacctgactgtgcggaggaaggtggtgtttgctgtgcccaagacagaaaatgaggtgcccagccctgccagcagccaccacagcagcaaccagcctgccagcctgacagaggagaagaggaccccccagggcagccagaacagcctgaacacagtgagcagcggcagcggcagcaccagcggcatcggcagcggcggcggcggcggcagcggcgtggtgtccacagtggtgcagccctatgatgtggagatcagaagaggagaaaatgaaggatttggatttgtgattgtgtcctctgtgtccaggcctgaggccggcaccacctttgctggaaatgcctgtgtggccatgccccacaagattggccgcatcatcgagggcagccctgctgacagatgtgggaagctgaaggtgggggaccgcatcctggccgtgaatggctgcagcatcaccaacaagagccacagcgacatcgtgaacctgatcaaggaggccggcaacacagtgaccctgcgcatcatccctggagatgagagcagcaatgccaccctgctgaccaatgctgagaagatcgccaccatcaccaccacccacacccccagccagcagggcacccaggagaccaggaacaccaccaagcccaagcaggagagccagtttgagttcaaggccccccaggccacccaggagcaggacttctacacagtggagctggagcggggggccaagggcttcggcttcagcctgcggggcggccgggagtacaacatggacctgtatgtgctgcggctggctgaagatggccctgctgagcgctgtgggaagatgagaattggagatgagatcctggagatcaatggagagaccaccaagaacatgaagcacagccgggccatcgagctgatcaagaatggaggccggcgggtgcggctcttcctgaagagaggagatggctctgtgcctgaatatggaggcagcaactatgagaacatccccagcttccctggcatgaccccctag

SEQ ID NO: 159343 - DNA, 1488 bp, Artificial Sequence
  Description of Artificial Sequence: Synthetic coding sequence
atggctgctgagccccagcccagcagcctgagctaccgcaccaccggcagcacctacctgcaccccctgtctgagctgctgggcatccccctggaccaggtgaactttgtggtgtgccagctggtggccctgtttgctgccttctggttccgcatctacctgcggcccggcaccaccagcagtgatgtgagacatgctgtggccaccatcttcggcatctactttgtgatcttctgcttcggctggtacagcgtgcacctgtttgtgctggtgctgatgtgctacgccatcatggtgacagcctctgtgagcaacatccaccgctacagcttctttgtggccatgggctacctgaccatctgccacatcagccgcatctacatcttccactacggcatcctgaccacagacttcagcggccccctgatgattgtgacccagaagatcaccaccctggccttccaggtgcatgatggcctgggccggcgggcagaggacctgtctgctgagcagcaccggctggccatcaaggtgaagcccagcttcctggagtacctgagctacctgctgaacttcatgtctgtgattgctggcccctgcaacaacttcaaggactacatcgccttcatcgagggcaagcacatccacatgaagctgctggaggtgaactggaagaggaagggcttccacagcctgcctgagcccagccccaccggggccgtcatccacaagctgggcatcaccctggtgtccctgctgctcttcctgaccctgaccaagaccttccctgtgacctgcctggtggatgactggtttgtgcacaaggccagcttccctgcccggctgtgctacctgtatgtggtgatgcaggccagcaagcccaagtactactttgcctggaccctggctgatgctgtgaacaatgctgctggcttcggcttctctggagtggacaagaatggaaacttctgctgggacctgctgagcaacctgaacatctggaagattgaaacagccaccagcttcaagatgtacctggagaactggaacatccagacagccacctggctgaagtgtgtgtgctaccagagggtgccctggtaccccaccgtgctgaccttcatcctgagcgccctgtggcatggagtgtacccaggctactacttcaccttcctgaccggcatcctggtgaccctggccgcccgggctgtgaggaacaactaccgccactacttcctgagcagccgggccctgaaggctgtgtatgatgctggcacctgggccgtgacccagctggccgtgtcctacacagtggccccctttgtgatgctggccgtggagcccaccatcagcctgtacaagtccatgtacttctacctgcacatcatcagcctgctgatcatcctcttcctgcccatgaagccccaggcccacacccagaggcggccccagaccctgaacagcatcaacaagaggaagacagactag

SEQ ID NO: 159344 - DNA, 726 bp, Artificial Sequence
  Description of Artificial Sequence: Synthetic coding sequence
atggctgctgagccccagcccagcagcctgagctaccgcaccaccggcagcacctacctgcaccccctgtctgagctgctgggcatccccctggaccaggtgaactttgtggtgtgccagctggtggccctgtttgctgccttctggttccgcatctacctgcggcccggcaccaccagcagtgatgtgagacatgctgtggccaccatcttcggcatctactttgtgatcttctgcttcggctggtacagcgtgcacctgtttgtgctggtgctgatgtgctacgccatcatggtgacagcctctgtgagcaacatccaccgctacagcttctttgtggccatgggctacctgaccatctgccacatcagccgcatctacatcttccactacggcatcctgaccacagacttcagcggccccctgatgattgtgacccagaagatcaccaccctggccttccaggtgcatgatggcctgggccggcgggcagaggacctgtctgctgagcagcaccggctggccatcaaggtgaagcccagcttcctggagtacctgagctacctgctgaacttcatgtctgtgattgctggcccctgcaacaacttcaaggactacatcgccttcatcgagggcaagcacatccacatgaagctgctggaggtgaactggaagaggaagggcttccacagcctgcctgagcccagccccaccggccacctgtag

SEQ ID NO: 159345 - DNA, 1041 bp, Artificial Sequence
  Description of Artificial Sequence: Synthetic coding sequence
atggagttcagcctgcgcatcttcctgggcctgggcagaagagctgaggacctgtctgctgagcagcaccggctggccatcaaggtgaagcccagcttcctggagtacctgagctacctgctgaacttcatgtctgtgattgctggcccctgcaacaacttcaaggactacatcgccttcatcgagggcaagcacatccacatgaagctgctggaggtgaactggaagaggaagggcttccacagcctgcctgagcccagccccactggagctgtgatccacaagctgggcatcaccctggtgtccctgctgctcttcctgaccctgaccaagaccttccctgtgacctgcctggtggatgactggtttgtgcacaaggccagcttccctgcccggctgtgctacctgtatgtggtgatgcaggccagcaagcccaagtactactttgcctggaccctggctgatgctgtgaacaatgctgctggcttcggcttcagcggcgtggacaagaatggaaacttctgctgggacctgctgagcaacctgaacatctggaagattgaaacagccaccagcttcaagatgtacctggagaactggaacatccagacagccacctggctgaagtgtgtgtgctaccagagggtgccctggtaccccaccgtgctgaccttcatcctgagcgccctgtggcacggcgtgtacccaggctactacttcaccttcctgaccggcatcctggtgaccctggccgcccgggctgtgaggaacaactaccgccactacttcctgagcagccgggccctgaaggctgtgtatgatgctggcacctgggccgtgacccagctggccgtgtcctacacagtggccccctttgtgatgctggccgtggagcccaccatcagcctgtacaagtccatgtacttctacctgcacatcatcagcctgctgatcatcctcttcctgcccatgaagccccaggcccacacccagaggcggccccagaccctgaacagcatcaacaagaggaagacagactag

SEQ ID NO: 159346 - DNA, 1563 bp, Artificial Sequence
  Description of Artificial Sequence: Synthetic coding sequence
atggccaccaccagcaccaccggcagcaccctgctgcagcccctgagcaatgctgtgcagctgcccatcgaccaggtgaactttgtggtgtgccagctgtttgccctgctggccgccatctggttccgcacctacctgcacagcagcaagaccagcagcttcatcagacatgtggtggccaccctgctgggcctgtacctggccctcttctgcttcggctggtacgccctgcacttcctggtgcagagcggcatctcctactgcatcatgatcatcattggagtggagaacatgcacaactactgctttgtgtttgccctgggctacctgactgtgtgccaggtgaccagggtgtacatctttgattatggccagtacagcgctgacttcagcggccccatgatgatcatcacccagaagatcaccagcctggcctgtgagatccatgatggcatgttcaggaaggatgaggagctgaccagcagccagagggacctggccgtgcggaggatgcccagcctgctggagtacctgagctacaactgcaacttcatgggcatcctggccggccccctgtgcagctacaaggactacatcaccttcatcgagggccgcagctaccacatcacccagagcggggagaatggcaaggaggagacccagtatgaaagaacagagcccagccccaacacagctgtggtgcagaagctgctggtgtgtggcctgagcctgctcttccacctgaccatctgcaccaccctgcctgtggagtacaacattgatgagcacttccaggccacagcctcctggcccaccaagatcatctacctgtacatcagcctgctggccgcccggcccaagtactactttgcctggaccctggctgatgccatcaacaatgctgctggcttcggcttccggggctatgatgaaaatggagctgcccgctgggacctgatcagcaacctgcgcatccagcagatcgagatgagcaccagcttcaagatgttcctggacaactggaacatccagacagccctgtggctgaagagggtgtgctatgaaagaaccagcttcagccccaccatccagaccttcatcctgagcgccatctggcatggagtgtacccaggctactacctgaccttcctgactggagtgctgatgaccctggccgcccgggccatgaggaacaacttccgccactacttcatcgagcccagccagctgaagctgttctatgatgtgatcacctggatcgtgacccaggtggccatctcctacacagtggtgccctttgtgctgctgagcatcaagcccagcctgaccttctacagctcctggtactactgcctgcacatcctgggcatcctggtgctgctgctgctgcctgtgaagaagacccagaggaggaagaacacccatgagaacatccagctgagccagagcaagaagtttgatgaaggagagaacagcctgggccagaacagcttcagcaccaccaacaacgtgtgcaaccagaaccaggagatcgccagccgccacagcagcctgaagcagtag

SEQ ID NO: 159347 - DNA, 1308 bp, Artificial Sequence
  Description of Artificial Sequence: Synthetic coding sequence
atggagtggctgtggctgttcttcctgcaccccatctccttctaccagggcgccgccttcccctttgccctgctcttcaactacctgtgcatcatggacagcttcagcacccgggcccgctacctgttcctgctgaccggcggcggggccctggccgtggccgccatgggcagctatgctgtgctggtgttcaccccagctgtgtgtgctgtggccctgctgtgcagcctggccccccagcaggtgcaccgctggaccttctgcttccagatgtcctggcagaccctgtgccacctgggcctgcactacacagagtactacctgcacgagcccccatctgtgcgcttctgcatcaccctgagcagcctgatgctgctgacccagagggtgaccagcctgagcctggacatctgtgagggcaaggtgaaggccgccagcggcggcttccgcagccgcagcagcctgtctgagcacgtgtgcaaggccctgccctacttctcctacctgctcttcttccctgccctgctgggcggcagcctgtgcagcttccagcgcttccaggcccgggtgcagggcagcagcgccctgcaccccaggcacagcttctgggccctgtcctggaggggcctgcagatcctgggcctggagtgcctgaatgtggccgtgtcccgggtggtggatgctggggccggcctgacagactgccagcagtttgagtgcatctacgtggtgtggaccacagctggcctcttcaagctgacctactacagccactggatcctggatgacagcctgctgcacgccgccggctttggacctgagctgggccagagccctggagaggagggctacgtgcctgatgctgacatctggaccctggagaggacccaccgcatcagcgtcttcagcaggaagtggaaccagagcacagcccgctggctgcggcggctggtgttccagcacagccgggcctggcccctgctgcagacctttgccttcagcgcctggtggcacggcctgcaccctggccaggtgtttggatttgtgtgctgggccgtgatggtggaggccgactacctgatccacagctttgccaatgagttcatccgctcctggcccatgaggctcttctaccgcaccctgacctgggcccacacccagctgatcatcgcctacatcatgctggccgtggaggtgcgcagcctgagcagcctgtggctgctgtgcaacagctacaacagcgtcttccccatggtgtactgcatcctgctgctgctgctggccaagaggaagcacaagtgcaactag

SEQ ID NO: 159348 - DNA, 1341 bp, Artificial Sequence
  Description of Artificial Sequence: Synthetic coding sequence
atgaccctgaaggccagcgagggggagagcggcggctccatgcacacagccctgagtgacctgtacctggagcacctgctgcagaagaggagcaggcctgaggccgtgagccaccccctgaacacagtgacagaggacatgtacaccaacggcagccctgcccctggcagccctgcccaggtgaagggccaggaggtgaggaaggtgcggctcatccagtttgagaaggtgacagaggagcccatgggcatcaccctgaagctgaatgagaagcagagctgcaccgtggcccgcatcctgcatggaggcatgatccaccggcagggcagcctgcacgtgggagatgagatcctggagatcaatggcaccaacgtgaccaaccacagcgtggaccagctgcagaaggccatgaaggagaccaagggcatgatcagcctgaaggtgatccccaaccagcagagccggctgcctgccctgcaggaggccggcctgaagtttgccaccggggacatcatccagatcatcaacaaggatgacagcaactggtggcagggccgggtggagggcagcagcaaggagagcgctggcctcatccccagccctgagctgcaggagtggagggtggcctccatggcccagagcgcccccagcgaggcccccagctgcagcccctttgggaagaagaagaagtacaaggacaagtacctggccaagcacagcagcatctttgaccagctggatgtggtgtcctatgaggaggtggtgcggctgcctgccttcaagaggaagaccctggtgctgattggagccagcggcgtgggccgcagccacatcaagaatgccctgctgagccagaaccctgagaagtttgtgtaccctgtgccctacaccacccggccccccaggaagtctgaggaggatggcaaggagtaccacttcatcagcacagaggagatgaccaggaacatcagcgccaatgagttcctggagtttggcagctaccagggcaacatgtttggcaccaagtttgaaacagtgcaccagatccacaagcagaacaagatcgccatcctggacatcgagccccagaccctgaagatcgtgaggacagctgagctgagccccttcatcgtgttcatcgcccccacagaccagggcacccagacagaggccctgcagcagctgcagaaggacagcgaggccatccgcagccagtatgcccactactttgacctgagcctggtgaacaatggagtggatgagaccctgaagaagctgcaggaggcctttgaccaggcctgcagcagcccccagtgggtgcctgtgtcctgggtgtactag

SEQ ID NO: 159349 - DNA, 1401 bp, Artificial Sequence
  Description of Artificial Sequence: Synthetic coding sequence
atgaccctgaaggccagcgagggggagagcggcggctccatgcacacagccctgagtgacctgtacctggagcacctgctgcagaagaggagcaggcctgaggccgtgagccaccccctgaacacagtgacagaggacatgtacaccaacggcagccctgcccctggcagccctgcccaggtgaagggccaggaggtgaggaaggtgcggctcatccagtttgagaaggtgacagaggagcccatgggcatcaccctgaagctgaatgagaagcagagctgcaccgtggcccgcatcctgcatggaggcatgatccaccggcagggcagcctgcacgtgggagatgagatcctggagatcaatggcaccaacgtgaccaaccacagcgtggaccagctgcagaaggccatgaaggagaccaagggcatgatcagcctgaaggtgatccccaaccagcagagccggctgcctgccctgcagatgttcatgagggcccagtttgattatgaccccaagaaggacaacctgatcccctgcaaggaggccggcctgaagtttgccaccggggacatcatccagatcatcaacaaggatgacagcaactggtggcagggccgggtggagggcagcagcaaggagagcgctggcctcatccccagccctgagctgcaggagtggagggtggcctccatggcccagagcgcccccagcgaggcccccagctgcagcccctttgggaagaagaagaagtacaaggacaagtacctggccaagcacagcagcatctttgaccagctggatgtggtgtcctatgaggaggtggtgcggctgcctgccttcaagaggaagaccctggtgctgattggagccagcggcgtgggccgcagccacatcaagaatgccctgctgagccagaaccctgagaagtttgtgtaccctgtgccctacaccacccggccccccaggaagtctgaggaggatggcaaggagtaccacttcatcagcacagaggagatgaccaggaacatcagcgccaatgagttcctggagtttggcagctaccagggcaacatgtttggcaccaagtttgaaacagtgcaccagatccacaagcagaacaagatcgccatcctggacatcgagccccagaccctgaagatcgtgaggacagctgagctgagccccttcatcgtgttcatcgcccccacagaccagggcacccagacagaggccctgcagcagctgcagaaggacagcgaggccatccgcagccagtatgcccactactttgacctgagcctggtgaacaatggagtggatgagaccctgaagaagctgcaggaggcctttgaccaggcctgcagcagcccccagtgggtgcctgtgtcctgggtgtactag

SEQ ID NO: 159350 - DNA, 1311 bp, Artificial Sequence
  Description of Artificial Sequence: Synthetic coding sequence
atggagagctgggccgtgagccaccccctgaacacagtgacagaggacatgtacaccaacggcagccctgcccctggcagccctgcccaggtgaagggccaggaggtgaggaaggtgcggctcatccagtttgagaaggtgacagaggagcccatgggcatcaccctgaagctgaatgagaagcagagctgcaccgtggcccgcatcctgcatggaggcatgatccaccggcagggcagcctgcacgtgggagatgagatcctggagatcaatggcaccaacgtgaccaaccacagcgtggaccagctgcagaaggccatgaaggagaccaagggcatgatcagcctgaaggtgatccccaaccagcagagccggctgcctgccctgcagatgttcatgagggcccagtttgattatgaccccaagaaggacaacctgatcccctgcaaggaggccggcctgaagtttgccaccggggacatcatccagatcatcaacaaggatgacagcaactggtggcagggccgggtggagggcagcagcaaggagagcgctggcctcatccccagccctgagctgcaggagtggagggtggcctccatggcccagagcgcccccagcgaggcccccagctgcagcccctttgggaagaagaagaagtacaaggacaagtacctggccaagcacagcagcatctttgaccagctggatgtggtgtcctatgaggaggtggtgcggctgcctgccttcaagaggaagaccctggtgctgattggagccagcggcgtgggccgcagccacatcaagaatgccctgctgagccagaaccctgagaagtttgtgtaccctgtgccctacaccacccggccccccaggaagtctgaggaggatggcaaggagtaccacttcatcagcacagaggagatgaccaggaacatcagcgccaatgagttcctggagtttggcagctaccagggcaacatgtttggcaccaagtttgaaacagtgcaccagatccacaagcagaacaagatcgccatcctggacatcgagccccagaccctgaagatcgtgaggacagctgagctgagccccttcatcgtgttcatcgcccccacagaccagggcacccagacagaggccctgcagcagctgcagaaggacagcgaggccatccgcagccagtatgcccactactttgacctgagcctggtgaacaatggagtggatgagaccctgaagaagctgcaggaggcctttgaccaggcctgcagcagcccccagtgggtgcctgtgtcctgggtgtactag

SEQ ID NO: 159351 - DNA, 1659 bp, Artificial Sequence
  Description of Artificial Sequence: Synthetic coding sequence
atgcctgtggccgccaccaacagcgagacagccatgcagcaggtgctggacaacctgggcagcctgcccagcgccaccggggctgctgagctggacctgatcttcctgcggggcatcatggagagccccatcgtgcgcagcctggccaaggcccacgagcggctggaggagaccaagctggaggccgtgcgggacaacaacctggagctggtgcaggagatcctgcgggacctggcccacgtggccgagcagagcagcacagctgctgagctggcccacatcctgcaggagccccacttccagagcctgctggagacccatgattctgtggccagcaagacctatgagaccccaccacccagccctggcctggaccccaccttcagcaaccagcctgtgcccccagatgctgtgaggatggtgggcatcaggaagacagctggggagcacctgggcgtgaccttccgggtggagggcggggagctggtgattgcccgcatcctgcatggaggcatggtggcccagcagggcctgctgcacgtgggggacatcatcaaggaggtgaatggccagcctgtgggcagtgacccccgggccctgcaggagctgctgagaaatgccagcggcagcgtcatcctgaagatcctgcccagctaccaggagccccacctgccccggcaggtgtttgtgaagtgccactttgattatgaccctgcccgggacagcctcatcccctgcaaggaggccggcctgcgcttcaatgctggggacctgctgcagatcgtgaaccaggatgatgccaactggtggcaggcctgccacgtggagggcggcagcgctggcctcatccccagccagctgctggaggagaagaggaaggcctttgtgaagagggacctggagctgacccccaacagcggcaccctgtgtggcagcctgagcggcaagaagaagaagaggatgatgtacctgaccaccaagaatgctgagtttgacagacatgagctgctgatctatgaggaggtggccaggatgccacccttccggaggaagaccctggtgctgattggagcccagggcgtgggcagaagaagcctgaagaacaagctgatcatgtgggaccctgacagatatggcaccaccgtgccctacaccagcagaagacccaaggacagcgagcgggagggccagggctacagctttgtgtccagaggagagatggaggctgatgtgcgggccggccgctacctggagcacggggagtatgagggcaacctgtatggcaccagaattgacagcatccggggcgtggtggccgccggcaaggtgtgtgtgctggatgtgaacccccaggccgtgaaggtgctgaggacagctgagtttgtgccctacgtggtgttcatcgaggccccagactttgagaccctgcgggccatgaacagagctgccctggagagcggcatcagcaccaagcagctgacagaggccgacctgcggaggacagtggaggagagcagccgcatccagaggggctacggccactactttgacctgtgcctggtgaacagcaacctggagaggaccttccgggagctgcagacagccatggagaagctgaggacagagccccagtgggtgcctgtgtcctgggtgtactag

SEQ ID NO: 159352 - DNA, 1731 bp, Artificial Sequence
  Description of Artificial Sequence: Synthetic coding sequence
atgcctgtggccgccaccaacagcgagacagccatgcagcaggtgctggacaacctgggcagcctgcccagcgccaccggggctgctgagctggacctgatcttcctgcggggcatcatggagagccccatcgtgcgcagcctggccaaggtgatcatggtgctgtggttcatgcagcagaatgtgtttgtgcccatgaagtacatgctgaagtactttggagcccacgagcggctggaggagaccaagctggaggccgtgcgggacaacaacctggagctggtgcaggagatcctgcgggacctggcccacgtggccgagcagagcagcacagctgctgagctggcccacatcctgcaggagccccacttccagagcctgctggagacccatgattctgtggccagcaagacctatgagaccccaccacccagccctggcctggaccccaccttcagcaaccagcctgtgcccccagatgctgtgaggatggtgggcatcaggaagacagctggggagcacctgggcgtgaccttccgggtggagggcggggagctggtgattgcccgcatcctgcatggaggcatggtggcccagcagggcctgctgcacgtgggggacatcatcaaggaggtgaatggccagcctgtgggcagtgacccccgggccctgcaggagctgctgagaaatgccagcggcagcgtcatcctgaagatcctgcccagctaccaggagccccacctgccccggcaggtgtttgtgaagtgccactttgattatgaccctgcccgggacagcctcatcccctgcaaggaggccggcctgcgcttcaatgctggggacctgctgcagatcgtgaaccaggatgatgccaactggtggcaggcctgccacgtggagggcggcagcgctggcctcatccccagccagctgctggaggagaagaggaaggcctttgtgaagagggacctggagctgacccccaacagcggcaccctgtgtggcagcctgagcggcaagaagaagaagaggatgatgtacctgaccaccaagaatgctgagtttgacagacatgagctgctgatctatgaggaggtggccaggatgccacccttccggaggaagaccctggtgctgattggagcccagggcgtgggcagaagaagcctgaagaacaagctgatcatgtgggaccctgacagatatggcaccaccgtgccctacaccagcagaagacccaaggacagcgagcgggagggccagggctacagctttgtgtccagaggagagatggaggctgatgtgcgggccggccgctacctggagcacggggagtatgagggcaacctgtatggcaccagaattgacagcatccggggcgtggtggccgccggcaaggtgtgtgtgctggatgtgaacccccaggccgtgaaggtgctgaggacagctgagtttgtgccctacgtggtgttcatcgaggccccagactttgagaccctgcgggccatgaacagagctgccctggagagcggcatcagcaccaagcagctgacagaggccgacctgcggaggacagtggaggagagcagccgcatccagaggggctacggccactactttgacctgtgcctggtgaacagcaacctggagaggaccttccgggagctgcagacagccatggagaagctgaggacagagccccagtgggtgcctgtgtcctgggtgtactag

SEQ ID NO: 159353 - DNA, 96 bp, Artificial Sequence
  Description of Artificial Sequence: Synthetic coding sequence
atgcctgtggccgccaccaacagcgagacagccatgcagcaggtgctggacaacctgggcagcctgcccagcgccaccggggctgctgagctgtag

SEQ ID NO: 159354 - DNA, 456 bp, Artificial Sequence
  Description of Artificial Sequence: Synthetic coding sequence
atgcctgtggccgccaccaacagcgagacagccatgcagcaggtgctggacaacctgggcagcctgcccagcgccaccggggctgctgagctggacctgatcttcctgcggggcatcatggagagccccatcgtgcgcagcctggccaaggcccacgagcggctggaggagaccaagctggaggccgtgcgggacaacaacctggagctggtgcaggagatcctgcgggacctggcccacgtggccgagcagagcagcacagctgctgagctggcccacatcctgcaggagccccacttccagagcctgctggagacccatgattctgtggccagcaagacctatgagaccccaccacccagccctggcctggaccccaccttcagcaaccagcctgtgcccccagatgctgtgaggatggtgggcatcaggaagacagctggggagcacctgtag

SEQ ID NO: 159355 - DNA, 381 bp, Artificial Sequence
  Description of Artificial Sequence: Synthetic coding sequence
atgcctgtggccgccaccaacagcgagacagccatgcagcaggtgctggacaacctgggcagcctgcccagcgccaccggggctgctgagctggacctgatcttcctgcggggcatcatggagagccccatcgtgcgcagcctggccaaggcccacgagcggctggaggagaccaagctggaggccgtgcgggacaacaacctggagctggtgcaggagatcctgcgggacctggcccacgtggccgagcagagcagcacagctgctgagctggcccacatcctgcaggagccccacttccagagcctgctggagacccatgattctgtggccagcaagacctatgagaccccaccacccagccctggcctggacccctag

SEQ ID NO: 159356 - DNA, 222 bp, Artificial Sequence
  Description of Artificial Sequence: Synthetic coding sequence
atgcctgtggccgccaccaacagcgagacagccatgcagcaggtgctggacaacctgggcagcctgcccagcgccaccggggctgctgagctggacctgatcttcctgcggggcatcatggagagccccatcgtgcgcagcctggccaaggcccacgagcggctggaggagaccaagctggaggccgtgcgggacaacaacctggagctggtgcaggagtag

SEQ ID NO: 159357 - DNA, 447 bp, Artificial Sequence
  Description of Artificial Sequence: Synthetic coding sequence
atgcctgtggccgccaccaacagcgagacagccatgcagcaggtgctggacaacctgggcagcctgcccagcgccaccggggctgctgagctggacctgatcttcctgcggggcatcatggagagccccatcgtgcgcagcctggccaaggcccacgagcggctggaggagaccaagctggaggccgtgcgggacaacaacctggagctggtgcaggagatcctgcgggacctggcccacgtggccgagcagagcagcacagctgctgagctggcccacatcctgcaggagccccacttccagagcctgctggagacccatgattctgtggccagcaagacctatgagaccccaccacccagccctggcctggaccccaccttcagcaaccagcctgtgcccccagatgctgtgaggatggtgggcatcaggaagacagctggatag

SEQ ID NO: 159358 - DNA, 1626 bp, Artificial Sequence
  Description of Artificial Sequence: Synthetic coding sequence
atgcagcaggtgctggacaacctgggcagcctgcccagcgccactggagctgctgagctggacctgatcttcctgcggggcatcatggagagccccatcgtgcgcagcctggccaaggcccacgagcggctggaggagaccaagctggaggccgtgcgggacaacaacctggagctggtgcaggagatcctgcgggacctggcccacgtggccgagcagagcagcacagctgctgagctggcccacatcctgcaggagccccacttccagagcctgctggagacccatgacagcgtggccagcaagacctatgagaccccaccacccagccctggcctggaccccaccttcagcaaccagcctgtgcccccagatgctgtgaggatggtgggcatcaggaagacagctggggagcacctgggcgtgaccttccgggtggagggcggggagctggtgattgcccgcatcctgcacggcggcatggtggcccagcagggcctgctgcacgtgggggacatcatcaaggaggtgaatggccagcctgtgggcagtgacccccgggccctgcaggagctgctgagaaatgccagcggcagcgtcatcctgaagatcctgcccagctaccaggagccccacctgccccggcaggtgtttgtgaagtgccactttgattatgaccctgcccgggacagcctcatcccctgcaaggaggccggcctgcgcttcaatgctggggacctgctgcagatcgtgaaccaggatgatgccaactggtggcaggcctgccacgtggagggcggcagcgctggcctcatccccagccagctgctggaggagaagaggaaggcctttgtgaagagggacctggagctgacccccaacagcggcaccctgtgtggcagcctgagcggcaagaagaagaagaggatgatgtacctgaccaccaagaatgctgagtttgacagacatgagctgctgatctatgaggaggtggccaggatgccacccttccggaggaagaccctggtgctgattggagcccagggcgtgggccgccgcagcctgaagaacaagctgatcatgtgggaccctgacagatatggcaccaccgtgccctacaccagccggcggcccaaggacagcgagcgggagggccagggctacagctttgtgtccagaggagagatggaggctgatgtgcgggccggccgctacctggagcacggggagtatgagggcaacctgtatggcaccagaattgacagcatccggggcgtggtggccgccggcaaggtgtgtgtgctggatgtgaacccccaggccgtgaaggtgctgaggacagctgagtttgtgccctacgtggtgttcatcgaggccccagactttgagaccctgcgggccatgaacagagctgccctggagagcggcatcagcaccaagcagctgacagaagctgacctgcggaggacagtggaggagagcagccgcatccagaggggctacggccactactttgacctgtgcctggtgaacagcaacctggagaggaccttccgggagctgcagacagccatggagaagctgaggacagagccccagtgggtgcctgtgtcctgggtgtactag

SEQ ID NO: 159359 - DNA, 1167 bp, Artificial Sequence
  Description of Artificial Sequence: Synthetic coding sequence
atggagctgcagtacccacctcctccacccagcccccgcatctgccgggagaggtctggaggagacaatgcctccatgcctgtgctgtctgaagattctggcctgcacgagaccctggccctgctgaccagccagctgcggccagacagcaaccacaaggaggagatgggcttcctgagagatgtgttcagcgagaagagcctgagctacctgatgaagatccacgagaagctgcgctactatgagcggcagagccccacccctgtgctgcacagcgctgtggccctggccgaggatgtgatggaggagctgcaggccgcctctgtgcacagtgatgagcgggagctgctgcagctgctgagcaccccccacctgcgggctgtgctgatggtgcatgacacagtggcccagaagaactttgatcctgtgctgccccccctgcctgacaacattgatgaagattttgatgaggagagcgtgaagatcgtgcggctggtgaagaacaaggagcccctgggcgccaccatcagaagagatgagcacagcggggctgtggtggtggcccgcatcatgagaggaggagctgctgacagaagtggcctggtgcacgtgggagatgagctgcgggaggtgaatggaattgctgtgctgcacaagaggccagatgagatcagccagatcctggcccagagccagggcagcatcaccctgaagatcatcccagccacccaggaggaggaccggctgaaggagagcaaggtgttcatgagggccctcttccactacaacccccgggaggaccgggccatcccctgccaggaggccggcctgcccttccagaggcggcaggtgctggaggtggtgtcccaggatgaccccacctggtggcaggccaagagggtgggggacaccaacctgcgggccggcctcatccccagcaagggcttccaggagcggcggctgagctaccgccgggcctacggcacccccatcagcccccagttcagccagcccaagcaggagctgagcctgcccaggcactgggcccccacccagctgctgcccagctgtggggcccactgccctgggggcaagggcacccacacccccaccctcatccccatcctgctgagccccagcctgcagctggagttcatccagtactag

SEQ ID NO: 159360 - DNA, 1758 bp, Artificial Sequence
  Description of Artificial Sequence: Synthetic coding sequence
atgcctgtgctgtctgaggacagcggcctgcacgagaccctggccctgctgaccagccagctgcggccagacagcaaccacaaggaggagatgggcttcctgagagatgtgttttctgagaagagcctgagctacctgatgaagatccacgagaagctgcgctactatgaaaggcagagccccacccctgtgctgcacagcgctgtggccctggctgaagatgtgatggaggagctgcaggccgcctctgtgcacagtgatgagcgggagctgctgcagctgctgagcaccccccacctgcgggctgtgctgatggtgcatgacacagtggcccagaagaactttgatcctgtgctgccccccctgcctgacaacattgatgaggactttgatgaggagagcgtgaagatcgtgcggctggtgaagaacaaggagcccctgggcgccaccatcagaagagatgagcacagcggggctgtggtggtggcccgcatcatgaggggcggcgctgctgacaggagcggcctggtgcacgtgggagatgagctgcgggaggtgaatggaattgctgtgctgcacaagaggccagatgagatcagccagatcctggcccagagccagggcagcatcaccctgaagatcatcccagccacccaggaggaggaccggctgaaggagagcaaggtgttcatgagggccctcttccactacaaccccagagaagatcgggccatcccctgccaggaggccggcctgcccttccagaggcggcaggtgctggaggtggtgtcccaggatgaccccacctggtggcaggccaagagggtgggggacaccaacctgcgggccggcctcatccccagcaagggcttccaggagcggcggctgagctacagaagagctgctggcaccctgcccagcccccagagcctgaggaagccaccctatgaccagccctgtgacaaggagacctgtgactgtgagggctacctgaagggccactacgtggccggcctgcggcgctccttccggctgggctgccgggagcggctgggcggcagccaggagggcaagatgagcagtggagctgagagccctgagctgctgacctatgaggaggtggcccgctaccagcaccagcctggagagcggccccggctggtggtgctgattggcagcctgggcgcccggctgcacgagctgaagcagaaggtggtggccgagaacccccagcactttggagtggccgtgccccacaccacccggcccaggaagagccatgagaaggagggcgtggagtaccactttgtgtccaagcaggcctttgaggccgacctgcaccacaacaagttcctggagcacggggagtacaaggagaacctgtatggcaccagcctggaggccatccaggccgtgatggccaagaacaaggtgtgcctggtggatgtggagcctgaggccctgaagcagctgcggaccagcgagttcaagccctacatcatctttgtgaagccagccatccaggagaagaggaagaccccacccatgagccctgcctgtgaggacacagctgccccctttgatgagcagcagcaggagatggccgccagcgctgccttcatcgacagacactacggccacctggtggatgctgtgctggtgaaggaggacctgcagggcgcctacagccagctgaaggtggtgctggagaagctgagcaaggacacccactgggtgcctgtgtcctgggtgaggtag

SEQ ID NO: 159361 - DNA, 1833 bp, Artificial Sequence
  Description of Artificial Sequence: Synthetic coding sequence
atggagctgcagtacccacctcctccacccagcccccgcatctgccgggagaggtctggaggagacaatgcctccatgcctgtgctgtctgaagattctggcctgcacgagaccctggccctgctgaccagccagctgcggccagacagcaaccacaaggaggagatgggcttcctgagagatgtgttcagcgagaagagcctgagctacctgatgaagatccacgagaagctgcgctactatgagcggcagagccccacccctgtgctgcacagcgctgtggccctggccgaggatgtgatggaggagctgcaggccgcctctgtgcacagtgatgagcgggagctgctgcagctgctgagcaccccccacctgcgggctgtgctgatggtgcatgacacagtggcccagaagaactttgatcctgtgctgccccccctgcctgacaacattgatgaagattttgatgaggagagcgtgaagatcgtgcggctggtgaagaacaaggagcccctgggcgccaccatcagaagagatgagcacagcggggctgtggtggtggcccgcatcatgagaggaggagctgctgacagaagtggcctggtgcacgtgggagatgagctgcgggaggtgaatggaattgctgtgctgcacaagaggccagatgagatcagccagatcctggcccagagccagggcagcatcaccctgaagatcatcccagccacccaggaggaggaccggctgaaggagagcaaggtgttcatgagggccctcttccactacaacccccgggaggaccgggccatcccctgccaggaggccggcctgcccttccagaggcggcaggtgctggaggtggtgtcccaggatgaccccacctggtggcaggccaagagggtgggggacaccaacctgcgggccggcctcatccccagcaagggcttccaggagcggcggctgagctaccgccgggctgctggcaccctgcccagcccccagagcctgaggaagccaccctatgaccagccctgtgacaaggagacctgtgactgtgagggctacctgaagggccactacgtggccggcctgcggcgctccttccggctgggctgccgggagcggctgggcggcagccaggagggcaagatgagcagcggggctgagagccctgagctgctgacctatgaggaggtggcccgctaccagcaccagcccggggagcggccccggctggtggtgctgattggcagcctgggcgcccggctgcacgagctgaagcagaaggtggtggccgagaacccccagcactttggagtggccgtgccccacaccacccggcccaggaagagccatgagaaggagggcgtggagtaccactttgtgtccaagcaggcctttgaagctgacctgcaccacaacaagttcctggagcacggggagtacaaggagaacctgtatggcaccagcctggaggccatccaggccgtgatggccaagaacaaggtgtgcctggtggatgtggagcctgaggccctgaagcagctgcggaccagcgagttcaagccctacatcatctttgtgaagccagccatccaggagaagaggaagaccccacccatgagccctgcctgtgaggacacagctgccccctttgatgagcagcagcaggagatggccgccagcgctgccttcatcgacagacactacggccacctggtggatgctgtgctggtgaaggaggacctgcagggcgcctacagccagctgaaggtggtgctggagaagctgagcaaggacacccactgggtgcctgtgtcctgggtgaggtag

SEQ ID NO: 159362 - DNA, 1782 bp, Artificial Sequence
  Description of Artificial Sequence: Synthetic coding sequence
atgatccagagcgacaagggagctgaccccccagacaagaaggacatgaagctgagcacagccaccaacccccagaatggcctgagccagatcctgcggctggtgctgcaggagctgagcctcttctacggcagagatgtgaatggagtgtgcctgctgtatgacctgctgcacagcccctggctgcaggccctgctgaagatctatgactgcctgcaggagttcaaggagaagaagctggtgcctgccaccccccacgcccaggtgctgtcctatgaggtggtggagctgctgcgggagacccccaccagccctgagatccaggagctgcggcagatgctgcaggccccccacttcaaggccctgctgagcgcccatgacaccatcgcccagaaggactttgagcccctgctgccccccctgcctgacaacatccctgagagcgaggaggccatgagaattgtgtgcctggtgaagaaccagcagcccctgggcgccaccatcaagagacatgagatgaccggggacatcctggtggcccgcatcatccacggcggcctggccgagaggagcggcctgctgtatgctggggacaagctggtggaggtgaatggagtgtctgtggagggcctggaccctgagcaggtgatccacatcctggccatgagccggggcaccatcatgttcaaggtggtgcctgtgtctgacccccctgtgaacagccagcagatggaccctgacatcccctgcatggatgctggcctgcccttccagaagggggacatcctgcagatcgtggaccagaatgatgccctgtggtggcaggccaggaagatcagtgaccctgccacctgtgccggcctggtgcccagcaaccacctgctgaagaggaagcagcgggagttctggtggagccagccctaccagccccacacctgcctgaagagcaccctgtacaaggaggagtttgtgggctacggccagaagttcttcatcgccggcttccgccgctccatgaggctgtgcaggaggaagagccacctgagccccctgcacgcctctgtgtgctgcaccggcagctgctacagcgctgtgggcgccccctatgaggaggtggtgcgctaccagaggcggcccagcgacaagtaccgcctcatcgtgctgatgggccccagcggcgtgggcgtgaatgagctgcggcggcagctgattgagttcaaccccagccacttccagagcgctgtgccccacaccaccaggaccaagaagagctatgagatgaatggccgggagtaccactacgtgtccaaggagacctttgaaaatctcatctacagccacaggatgctggagtatggagagtacaagggccacctgtatggcacctctgtggatgctgtgcagacagtgctggtggagggcaagatctgtgtgatggacctggagccccaggacatccagggcgtgaggacccatgagctgaagccctacgtgatcttcatcaagcccagcaacatgcgctgcatgaagcagagcaggaagaatgccaaggtgatcacagactactacgtggacatgaagttcaaggatgaggacctgcaggagatggagaacctggcccagaggatggagacccagtttggccagttctttgaccacgtgattgtgaatgacagcctgcatgatgcctgtgcccagctgctgagcgccatccagaaggcccaggaggagccccagtgggtgcctgccacctggatcagcagtgacacagagagccagtag

SEQ ID NO: 159363 - DNA, 1809 bp, Artificial Sequence
  Description of Artificial Sequence: Synthetic coding sequence
atgatccagagcgacaagggagctgaccccccagacaagaaggacatgaagctgagcacagccaccaacccccagaatggcctgagccagatcctgcggctggtgctgcaggagctgagcctcttctacggcagagatgtgaatggagtgtgcctgctgtatgacctgctgcacagcccctggctgcaggccctgctgaagatctatgactgcctgcaggagttcaaggagaagaagctggtgcctgccaccccccacgcccaggtgctgtcctatgaggtggtggagctgctgcgggagacccccaccagccctgagatccaggagctgcggcagatgctgcaggccccccacttcaagggggccaccatcaagagacatgagatgaccggggacatcctggtggcccgcatcatccacggcggcctggccgagaggagcggcctgctgtatgctggggacaagctggtggaggtgaatggagtgtctgtggagggcctggaccctgagcaggtgatccacatcctggccatgagccggggcaccatcatgttcaaggtggtgcctgtgtctgacccccctgtgaacagccagcagatggtgtatgtgcgggccatgacagagtactggccccaggaggaccctgacatcccctgcatggatgctggcctgcccttccagaagggggacatcctgcagatcgtggaccagaatgatgccctgtggtggcaggccaggaagatcagtgaccctgccacctgtgccggcctggtgcccagcaaccacctgctgaagcgctggagctttgccctggtggcccaggccggcgtgcagtggcactacctggacagcctgcagcccctgcccccaggcttcaagcgcttcagctgcctgagcctgcccaggtcctgggactacattgaagatgacatgaagattgatgagaagtgtgtggaggccgagaaggagagcattgaaacagacaaggaggagtttgtgggctacggccagaagttcttcatcgccggcttcagaagatccatgaggctgtgcaggaggaagagccacctgagccccctgcacgcctctgtgtgctgcaccggcagctgctacagcgctgtgggcgccccctatgaggaggtggtgcgctaccagaggcggcccagcgacaagtaccgcctgattgtgctgatgggccccagcggcgtgggcgtgaatgagctgcggcggcagctgattgagttcaaccccagccacttccagagcgctgtgccccacaccaccaggaccaagaagagctatgagatgaatggccgggagtaccactacgtgtccaaggagacctttgagaacctgatctacagccacaggatgctggagtatggagagtacaagggccacctgtatggcacctctgtggatgctgtgcagacagtgctggtggagggcaagatctgtgtgatggacctggagccccaggacatccagggcgtgaggacccatgagctgaagccctacgtgatcttcatcaagcccagcaacatgcgctgcatgaagcagagcaggaagaatgccaaggtgatcacagactactacgtggacatgaagttcaaggatgaggacctgcaggagatggagaacctggcccagaggatggagacccagtttggccagttctttgaccacgtgattgtgaatgacagcctgcatgatgcctgtgcccagctgctgagcgccatccagaaggcccaggaggagccccagtgggtgcctgccacctggatcagcagtgacacagagagccagtag

SEQ ID NO: 159364 - DNA, 1914 bp, Artificial Sequence
  Description of Artificial Sequence: Synthetic coding sequence
atgatccagagcgacaagggagctgaccccccagacaagaaggacatgaagctgagcacagccaccaacccccagaatggcctgagccagatcctgcggctggtgctgcaggagctgagcctcttctacggcagagatgtgaatggagtgtgcctgctgtatgacctgctgcacagcccctggctgcaggccctgctgaagatctatgactgcctgcaggagttcaaggagaagaagctggtgcctgccaccccccacgcccaggtgctgtcctatgaggtggtggagctgctgcgggagacccccaccagccctgagatccaggagctgcggcagatgctgcaggccccccacttcaaggccctgctgagcgcccatgacaccatcgcccagaaggactttgagcccctgctgccccccctgcctgacaacatccctgagagcgaggaggccatgagaattgtgtgcctggtgaagaaccagcagcccctgggcgccaccatcaagagacatgagatgaccggggacatcctggtggcccgcatcatccacggcggcctggccgagaggagcggcctgctgtatgctggggacaagctggtggaggtgaatggagtgtctgtggagggcctggaccctgagcaggtgatccacatcctggccatgagccggggcaccatcatgttcaaggtggtgcctgtgtctgacccccctgtgaacagccagcagatggtgtatgtgcgggccatgacagagtactggccccaggaggaccctgacatcccctgcatggatgctggcctgcccttccagaagggggacatcctgcagatcgtggaccagaatgatgccctgtggtggcaggccaggaagatcagtgaccctgccacctgtgccggcctggtgcccagcaaccacctgctgaagaggaagcagcgggagttctggtggagccagccctaccagccccacacctgcctgaagagcaccctgagcatcagcctgaagggggaggatgacatgaagattgatgagaagtgtgtggaggccgagaacagcacagctgagagcgaggagctgaacagcgacaaggaggagtttgtgggctacggccagaagttcttcatcgccggcttccgccgctccatgaggctgtgcaggaggaagagccacctgagccccctgcacgcctctgtgtgctgcaccggcagctgctacagcgctgtgggcgccccctatgaggaggtggtgcgctaccagaggcggcccagcgacaagtaccgcctcatcgtgctgatgggccccagcggcgtgggcgtgaatgagctgcggcggcagctgattgagttcaaccccagccacttccagagcgctgtgccccacaccaccaggaccaagaagagctatgagatgaatggccgggagtaccactacgtgtccaaggagacctttgaaaatctcatctacagccacaggatgctggagtatggagagtacaagggccacctgtatggcacctctgtggatgctgtgcagacagtgctggtggagggcaagatctgtgtgatggacctggagccccaggacatccagggcgtgaggacccatgagctgaagccctacgtgatcttcatcaagcccagcaacatgcgctgcatgaagcagagcaggaagaatgccaaggtgatcacagactactacgtggacatgaagttcaaggatgaggacctgcaggagatggagaacctggcccagaggatggagacccagtttggccagttctttgaccacgtgattgtgaatgacagcctgcatgatgcctgtgcccagctgctgagcgccatccagaaggcccaggaggagccccagtgggtgcctgccacctggatcagcagtgacacagagagccagtag

SEQ ID NO: 159365 - DNA, 1701 bp, Artificial Sequence
  Description of Artificial Sequence: Synthetic coding sequence
atgatccagagcgacaagggagctgaccccccagacaagaaggacatgaagctgagcacagccaccaacccccagaatggcctgagccagatcctgcggctggtgctgcaggagctgagcctcttctacggcagagatgtgaatggagtgtgcctgctgtatgacctgctgcacagcccctggctgcaggccctgctgaagatctatgactgcctgcaggagttcaaggagaagaagctggtgcctgccaccccccacgcccaggtgctgtcctatgagggcgccaccatcaagagacatgagatgactggagacatcctggtggcccgcatcatccatggaggcctggccgagaggagcggcctgctgtatgctggggacaagctggtggaggtgaatggagtgtctgtggagggcctggaccctgagcaggtgatccacatcctggccatgagccggggcaccatcatgttcaaggtggtgcctgtgtctgacccccctgtgaacagccagcagatggtgtatgtgcgggccatgacagagtactggccccaggaggaccctgacatcccctgcatggatgctggcctgcccttccagaagggggacatcctgcagatcgtggaccagaatgatgccctgtggtggcaggccaggaagatcagtgaccctgccacctgtgccggcctggtgcccagcaaccacctgctgaagaggaagcagcgggagttctggtggagccagccctaccagccccacacctgcctgaagagcaccctgagcatcagcctgaagggagaagatgacatgaagattgatgagaagtgtgtggaggccgagaacagcacagctgagagcgaggagctgaacagcgacaaggaggagtttgtgggctacggccagaagttcttcatcgccggcttcagaagatccatgaggctgtgcaggaggaagagccacctgagccccctgcacgcctctgtgtgctgcaccggcagctgctacagcgctgtgggcgccccctatgaggaggtggtgcgctaccagaggcggcccagcgacaagtaccgcctgattgtgctgatgggccccagcggcgtgggcgtgaatgagctgcggcggcagctgattgagttcaaccccagccacttccagagcgctgtgccccacaccaccaggaccaagaagagctatgagatgaatggccgggagtaccactacgtgtccaaggagacctttgagaacctgatctacagccacaggatgctggagtatggagagtacaagggccacctgtatggcacctctgtggatgctgtgcagacagtgctggtggagggcaagatctgtgtgatggacctggagccccaggacatccagggcgtgaggacccatgagctgaagccctacgtgatcttcatcaagcccagcaacatgcgctgcatgaagcagagcaggaagaatgccaaggtgatcacagactactacgtggacatgaagttcaaggatgaggacctgcaggagatggagaacctggcccagaggatggagacccagtttggccagttctttgaccacgtgattgtgaatgacagcctgcatgatgcctgtgcccagctgctgagcgccatccagaaggcccaggaggagccccagtgggtgcctgccacctggatcagcagtgacacagagagccagtag

SEQ ID NO: 159366 - DNA, 1914 bp, Artificial Sequence
  Description of Artificial Sequence: Synthetic coding sequence
atgatccagagcgacaagggagctgaccccccagacaagaaggacatgaagctgagcacagccaccaacccccagaatggcctgagccagatcctgcggctggtgctgcaggagctgagcctcttctacggcagagatgtgaatggagtgtgcctgctgtatgacctgctgcacagcccctggctgcaggccctgctgaagatctatgactgcctgcaggagttcaaggagaagaagctggtgcctgccaccccccacgcccaggtgctgtcctatgaggtggtggagctgctgcgggagacccccaccagccctgagatccaggagctgcggcagatgctgcaggccccccacttcaaggccctgctgagcgcccatgacaccatcgcccagaaggactttgagcccctgctgccccccctgcctgacaacatccctgagagcgaggaggccatgagaattgtgtgcctggtgaagaaccagcagcccctgggcgccaccatcaagagacatgagatgaccggggacatcctggtggcccgcatcatccacggcggcctggccgagaggagcggcctgctgtatgctggggacaagctggtggaggtgaatggagtgtctgtggagggcctggaccctgagcaggtgatccacatcctggccatgagccggggcaccatcatgttcaaggtggtgcctgtgtctgacccccctgtgaacagccagcagatggtgtatgtgcgggccatgacagagtactggccccaggaggaccctgacatcccctgcatggatgctggcctgcccttccagaagggggacatcctgcagatcgtggaccagaatgatgccctgtggtggcaggccaggaagatcagtgaccctgccacctgtgccggcctggtgcccagcaaccacctgctgaagaggaagcagcgggagttctggtggagccagccctaccagccccacacctgcctgaagagcaccctgagcatctccatggaggaggaggatgacatgaagattgatgagaagtgtgtggaggctgatgaggagacctttgaaagtgaggagctgtctgaggacaaggaggagtttgtgggctacggccagaagttcttcatcgccggcttccgccgctccatgaggctgtgcaggaggaagagccacctgagccccctgcacgcctctgtgtgctgcaccggcagctgctacagcgctgtgggcgccccctatgaggaggtggtgcgctaccagaggcggcccagcgacaagtaccgcctcatcgtgctgatgggccccagcggcgtgggcgtgaatgagctgcggcggcagctgattgagttcaaccccagccacttccagagcgctgtgccccacaccaccaggaccaagaagagctatgagatgaatggccgggagtaccactacgtgtccaaggagacctttgaaaatctcatctacagccacaggatgctggagtatggagagtacaagggccacctgtatggcacctctgtggatgctgtgcagacagtgctggtggagggcaagatctgtgtgatggacctggagccccaggacatccagggcgtgaggacccatgagctgaagccctacgtgatcttcatcaagcccagcaacatgcgctgcatgaagcagagcaggaagaatgccaaggtgatcacagactactacgtggacatgaagttcaaggatgaggacctgcaggagatggagaacctggcccagaggatggagacccagtttggccagttctttgaccacgtgattgtgaatgacagcctgcatgatgcctgtgcccagctgctgagcgccatccagaaggcccaggaggagccccagtgggtgcctgccacctggatcagcagtgacacagagagccagtag

SEQ ID NO: 159367 - DNA, 2028 bp, Artificial Sequence
  Description of Artificial Sequence: Synthetic coding sequence
atgaccaccagccacatgaatggacatgtgacagaggagagtgacagcgaggtgaagaatgtggacctggccagccctgaggagcaccagaagcaccgggagatggctgtggactgccctggggacctgggcaccaggatgatgcccatcagaagaagtgcccagctggagcgcatccggcagcagcaggaggacatgagaagaagaagagaggaggagggcaagaagcaggagctggacctgaacagctccatgaggctgaagaagctggcccagatcccccccaagacaggaattgacaaccccatgtttgacacagaggagggcatcgtgctggagagcccccactatgctgtgaagatcctggagattgaagatctcttcagcagcctgaagcacatccagcacaccctggtggacagccagagccaggaggacatcagcctgctgctgcagctggtgcagaacaaggacttccagaatgccttcaagatccacaatgccatcaccgtgcacatgaacaaggccagcccccccttccccctcatcagcaatgcccaggacctggcccaggaggtgcagacagtgctgaagcctgtgcaccacaaggagggccaggagctgacagccctgctgaacaccccccacatccaggccctgctgctggcccatgacaaggtggccgagcaggagatgcagctggagcccatcacagatgagcgggtgtatgagagcatcggccagtatggaggagaaacagtgaagatcgtgagaattgagaaggcccgggacatccccctgggcgccaccgtgagaaatgagatggattctgtcatcatcagcagaattgtgaagggcggcgctgctgagaagagcggcctgctgcacgagggagatgaggtgctggagatcaatggaattgagatccggggcaaggatgtgaatgaggtgtttgacctgctgagtgacatgcacggcaccctgacctttgtgctgatccccagccagcagatcaagcccccaccagccaaggagaccgtcatccacgtgaaggcccactttgattatgaccccagtgatgacccctacgtgccctgccgggagctgggcctgtccttccagaagggggacatcctgcacgtgatcagccaggaggaccccaactggtggcaggcctaccgggagggagatgaggacaaccagcccctggccggcctggtgcctgggaagagcttccagcagcagcgggaggccatgaagcagaccatcgaggaggacaaggagcctgagaagagcggcaagctgtggtgtgccaagaagaacaagaagaagaggaagaaggtgctgtacaatgccaacaagaatgatgattatgacaatgaggagatcctgacctatgaggagatgagcctgtaccaccagcctgccaacaggaagaggcccatcatcctgattggcccccagaactgtggccagaatgagctgcggcagaggctgatgaacaaggagaaggacagatttgccagcgctgtgccccacaccaccaggagccggcgggaccaggaggtggccggccgggactaccactttgtgtcccggcaggcctttgaggccgacattgctgctgggaagttcatcgagcacggggagtttgagaagaacctgtatggcaccagcattgacagcgtgcggcaggtgatcaacagcggcaagatctgcctgctgagcctgcggacccagagcctgaagaccctgaggaacagcgacctgaagccctacatcatcttcatcgccccacccagccaggagcggctgcgggccctgctggccaaggagggcaagaaccccaagccagaggagctgcgggagatcatcgagaagacccgggagatggagcagaacaacggccactactttgacacagccatcgtgaacagcgacctggacaaggcctaccaggagctgctgcggctcatcaacaagctggacacagagccccagtgggtgcccagcacctggctgaggtag

SEQ ID NO: 159368 - DNA, 1926 bp, Artificial Sequence
  Description of Artificial Sequence: Synthetic coding sequence
atggctgtggactgccctggggacctgggcaccaggatgatgcccatcagaagaagtgcccagctggagcgcatccggcagcagcaggaggacatgagaagaagaagagaggaggagggcaagaagcaggagctggacctgaacagctccatgaggctgaagaagctggcccagatcccccccaagacaggaattgacaaccccatgtttgacacagaggagggcatcgtgctggagagcccccactatgctgtgaagatcctggagattgaagatctcttcagcagcctgaagcacatccagcacaccctggtggacagccagagccaggaggacatcagcctgctgctgcagctggtgcagaacaaggacttccagaatgccttcaagatccacaatgccatcaccgtgcacatgaacaaggccagcccccccttccccctcatcagcaatgcccaggacctggcccaggaggtgcagacagtgctgaagcctgtgcaccacaaggagggccaggagctgacagccctgctgaacaccccccacatccaggccctgctgctggcccatgacaaggtggccgagcaggagatgcagctggagcccatcacagatgagcgggtgtatgagagcatcggccagtatggaggagaaacagtgaagatcgtgagaattgagaaggcccgggacatccccctgggcgccaccgtgagaaatgagatggattctgtcatcatcagcagaattgtgaagggcggcgctgctgagaagagcggcctgctgcacgagggagatgaggtgctggagatcaatggaattgagatccggggcaaggatgtgaatgaggtgtttgacctgctgagtgacatgcacggcaccctgacctttgtgctgatccccagccagcagatcaagcccccaccagccaaggagaccgtcatccacgtgaaggcccactttgattatgaccccagtgatgacccctacgtgccctgccgggagctgggcctgtccttccagaagggggacatcctgcacgtgatcagccaggaggaccccaactggtggcaggcctaccgggagggagatgaggacaaccagcccctggccggcctggtgcctgggaagagcttccagcagcagcgggaggccatgaagcagaccatcgaggaggacaaggagcctgagaagagcggcaagctgtggtgtgccaagaagaacaagaagaagaggaagaaggtgctgtacaatgccaacaagaatgatgattatgacaatgaggagatcctgacctatgaggagatgagcctgtaccaccagcctgccaacaggaagaggcccatcatcctgattggcccccagaactgtggccagaatgagctgcggcagaggctgatgaacaaggagaaggacagatttgccagcgctgtgccccacaccaccaggagccggcgggaccaggaggtggccggccgggactaccactttgtgtcccggcaggcctttgaggccgacattgctgctgggaagttcatcgagcacggggagtttgagaagaacctgtatggcaccagcattgacagcgtgcggcaggtgatcaacagcggcaagatctgcctgctgagcctgcggacccagagcctgaagaccctgaggaacagcgacctgaagccctacatcatcttcatcgccccacccagccaggagcggctgcgggccctgctggccaaggagggcaagaaccccaagccagaggagctgcgggagatcatcgagaagacccgggagatggagcagaacaacggccactactttgacacagccatcgtgaacagcgacctggacaaggcctaccaggagctgctgcggctcatcaacaagctggacacagagccccagtgggtgcccagcacctggctgaggtag

SEQ ID NO: 159369 - DNA, 15 bp, Artificial Sequence
  Description of Artificial Sequence: Synthetic coding sequence
atggctgtggactag

SEQ ID NO: 159370 - DNA, 450 bp, Artificial Sequence
  Description of Artificial Sequence: Synthetic coding sequence
atggctgtggactgccctggggacctgggcaccaggatgatgcccatcagaagaagtgcccagctggagcgcatccggcagcagcaggaggacatgagaagaagaagagaggaggagggcaagaagcaggagctggacctgaacagctccatgaggctgaagaagctggcccagatcccccccaagacaggaattgacaaccccatgtttgacacagaggagggcatcgtgctggagagcccccactatgctgtgaagatcctggagattgaagatctcttcagcagcctgaagcacatccagcacaccctggtggacagccagagccaggaggacatcagcctgctgctgcagctggtgcagaacaaggacttccagaatgccttcaagatccacaatgccatcaccgtgcacatgaacaaggccagcccccccttccccctcatctag

SEQ ID NO: 159371 - DNA, 870 bp, Artificial Sequence
  Description of Artificial Sequence: Synthetic coding sequence
atgactggagtgtttgacagaagagtgcccagcatccgcagcggggacttccaggcccccttccagaccagcgctgccatgcaccaccccagccaggagagccccaccctgcctgagagcagcgccacagacagcgactactacagccccactggaggagccccccacggctactgcagccccaccagcgccagctatggcaaggccctgaacccctaccagtaccagtaccacggcgtgaatggatctgctggcagctacccagccaaggcctatgctgactacagctatgccagcagctaccaccagtatggaggagcctacaacagagtgcccagcgccaccaaccagcctgagaaggaggtgacagagcctgaggtgaggatggtgaatggcaagcccaagaaggtgaggaagcccaggaccatctacagcagcttccagctggccgccctgcagaggcgcttccagaagacccagtacctggccctgcctgagcgggcagagctggccgccagcctgggcctgacccagacccaggtgaagatctggttccagaacaagaggagcaagatcaagaagatcatgaagaatggagagatgcctcctgagcacagccccagcagcagtgaccccatggcctgcaacagcccccagagccctgctgtgtgggagccccagggcagcagccgcagcctgagccaccacccccacgcccacccccccaccagcaaccagagccctgccagcagctacctggagaacagcgcctcctggtacaccagcgctgccagcagcatcaacagccacctgcccccacctggcagcctgcagcaccccctggccctggccagcggcaccctgtactag

SEQ ID NO: 159372 - DNA, 1623 bp, Artificial Sequence
  Description of Artificial Sequence: Synthetic coding sequence
atgcagcaggtgctggagaacctgacagagctgcccagcagcactggagctgaggagattgacctgatcttcctgaagggcatcatggagaaccccatcgtgaagagcctggccaaggcccacgagcggctggaggacagcaagctggaggccgtgtctgacaacaacctggagctggtgaatgagatcctggaggacatcacccccctcatcaacgtggatgaaaatgtggccgagctggtgggcatcctgaaggagccccacttccagagcctgctggaggcccatgacatcgtggccagcaagtgctatgacagcccccccagcagccctgagatgaacaacagcagcatcaacaaccagctgctgcctgtggatgccatccgcatcctgggcatccacaagagagctggggagcccctgggcgtgaccttccgggtggagaacaatgacctggtgattgcccgcatcctgcatggaggcatgattgaccggcagggcctgctgcacgtgggggacatcatcaaggaggtgaatggacatgaggtgggcaacaaccccaaggagctgcaggagctgctgaagaacatcagcggctctgtgaccctgaagatcctgcccagctacagagacaccatcaccccccagcaggtgtttgtgaagtgccactttgactacaacccctacaatgacaacctgatcccctgcaaggaggccggcctgaagttcagcaaaggagagatcctgcagatcgtgaaccgggaggaccccaactggtggcaggccagccacgtgaaggagggcggcagcgctggcctcatccccagccagttcctggaggagaagaggaaggcctttgtgcggcgggactgggacaacagcggccccttctgtggcaccatcagcagcaagaagaagaagaagatgatgtacctgaccaccagaaatgctgagtttgacagacatgagatccagatctatgaggaggtggccaagatgccacccttccagaggaagaccctggtgctgattggagcccagggcgtgggcagaagaagcctgaagaaccgcttcatcgtgctgaaccccacccgcttcggcaccaccgtgcccttcaccagcaggaagcccagagaagatgagaaggatggccaggcctacaagtttgtgagccgctctgagatggaggccgacatcaaggccggcaagtacctggagcacggggagtatgagggcaacctgtatggcaccaagattgacagcatcctggaggtggtgcagacaggccgcacctgcatcctggatgtgaacccccaggccctgaaggtgctgcggaccagcgagttcatgccctacgtggtgttcatcgccgcccctgagctggagaccctgcgggccatgcacaaggctgtggtggatgctggcatcaccaccaagctgctgacagacagcgacctgaagaagacagtggatgaaagtgcccgcatccagagggcctacaaccactactttgacctgatcatcatcaatgacaacctggacaaggcctttgagaagctgcagacagccatcgagaagctgaggatggagccccagtgggtgcccatctcctgggtgtactag

SEQ ID NO: 159373 - DNA, 1287 bp, Artificial Sequence
  Description of Artificial Sequence: Synthetic coding sequence
atgaacaacagcagcatcaacaaccagctgctgcctgtggatgccatccgcatcctgggcatccacaagagagctggggagcccctgggcgtgaccttccgggtggagaacaatgacctggtgattgcccgcatcctgcatggaggcatgattgaccggcagggcctgctgcacgtgggggacatcatcaaggaggtgaatggacatgaggtgggcaacaaccccaaggagctgcaggagctgctgaagaacatcagcggctctgtgaccctgaagatcctgcccagctacagagacaccatcaccccccagcaggtgtttgtgaagtgccactttgactacaacccctacaatgacaacctgatcccctgcaaggaggccggcctgaagttcagcaaaggagagatcctgcagatcgtgaaccgggaggaccccaactggtggcaggccagccacgtgaaggagggcggcagcgctggcctcatccccagccagttcctggaggagaagaggaaggcctttgtgcggcgggactgggacaacagcggccccttctgtggcaccatcagcagcaagaagaagaagaagatgatgtacctgaccaccagaaatgctgagtttgacagacatgagatccagatctatgaggaggtggccaagatgccacccttccagaggaagaccctggtgctgattggagcccagggcgtgggcagaagaagcctgaagaaccgcttcatcgtgctgaaccccacccgcttcggcaccaccgtgcccttcaccagcaggaagcccagagaagatgagaaggatggccaggcctacaagtttgtgagccgctctgagatggaggccgacatcaaggccggcaagtacctggagcacggggagtatgagggcaacctgtatggcaccaagattgacagcatcctggaggtggtgcagacaggccgcacctgcatcctggatgtgaacccccaggccctgaaggtgctgcggaccagcgagttcatgccctacgtggtgttcatcgccgcccctgagctggagaccctgcgggccatgcacaaggctgtggtggatgctggcatcaccaccaagctgctgacagacagcgacctgaagaagacagtggatgaaagtgcccgcatccagagggcctacaaccactactttgacctgatcatcatcaatgacaacctggacaaggcctttgagaagctgcagacagccatcgagaagctgaggatggagccccagtgggtgcccatctcctgggtgtactag

SEQ ID NO: 159374 - DNA, 924 bp, Artificial Sequence
  Description of Artificial Sequence: Synthetic coding sequence
atgcagcaggtgctggagaacctgacagagctgcccagcagcactggagctgaggagattgacctgatcttcctgaagggcatcatggagaaccccatcgtgaagagcctggccaaggcccacgagcggctggaggacagcaagctggaggccgtgtctgacaacaacctggagctggtgaatgagatcctggaggacatcacccccctcatcaacgtggatgaaaatgtggccgagctggtgggcatcctgaaggagccccacttccagagcctgctggaggcccatgacatcgtggccagcaagtgctatgacagcccccccagcagccctgagatgaacaacagcagcatcaacaaccagctgctgcctgtggatgccatccgcatcctgggcatccacaagagagctggggagcccctgggcgtgaccttccgggtggagaacaatgacctggtgattgcccgcatcctgcatggaggcatgattgaccggcagggcctgctgcacgtgggggacatcatcaaggaggtgaatggacatgaggtgggcaacaaccccaaggagctgcaggagctgctgaagaacatcagcggctctgtgaccctgaagatcctgcccagctacagagacaccatcaccccccagcaggtgtttgtgaagtgccactttgactacaacccctacaatgacaacctgatcccctgcaaggaggccggcctgaagttcagcaaaggagagatcctgcagatcgtgaaccgggaggaccccaactggtggcaggccagccacgtgaaggagggcggcagcgctggcctcatccccagccagttcctggaggagaagaggaaggcctttgtgcggcgggactgggacaacagcggccccttctgtggcaccatcagcagcaagaagaagaagtag

SEQ ID NO: 159375 - DNA, 654 bp, Artificial Sequence
  Description of Artificial Sequence: Synthetic coding sequence
atgcagcaggtgctggagaacctgacagagctgcccagcagcactggagctgaggagattgacctgatcttcctgaagggcatcatggagaaccccatcgtgaagagcctggccaaggcccacgagcggctggaggacagcaagctggaggccgtgtctgacaacaacctggagctggtgaatgagatcctggaggacatcacccccctcatcaacgtggatgaaaatgtggccgagctggtgggcatcctgaaggagccccacttccagagcctgctggaggcccatgacatcgtggccagcaagtgctatgacagcccccccagcagccctgagatgaacaacagcagcatcaacaaccagctgctgcctgtggatgccatccgcatcctgggcatccacaagagagctggggagcccctgggcgtgaccttccgggtggagaacaatgacctggtgattgcccgcatcctgcatggaggcatgattgaccggcagggcctgctgcacgtgggggacatcatcaaggaggtgaatggacatgaggtgggcaacaaccccaaggagctgcaggagctgctgaagaacatcagcggctctgtgaccctgaagatcctgcccagctacagagacaccatcaccccccagcagtag

SEQ ID NO: 159376 - DNA, 1731 bp, Artificial Sequence
  Description of Artificial Sequence: Synthetic coding sequence
atgcctgccctgagcacaggcagcggcagtgacaccggcctgtatgagctgctggccgccctgcctgcccagctgcagccccacgtggacagccaggaggacctgaccttcctgtgggacatgtttggagagaagagcctgcacagcctggtgaagatccacgagaagctgcactactatgagaagcagagccctgtgcccatcctgcacggggctgctgccctggctgatgacctggccgaggagctgcagaacaagcccctgaacagcgagatccgggagctgctgaagctgctgagcaagcccaacgtgaaggccctgctgtctgtgcatgacacagtggcccagaagaactatgaccctgtgctgccccccatgcctgaggacattgatgatgaggaggacagcgtgaagatcatccggctggtgaagaaccgggagcccctgggcgccaccatcaagaaggatgagcagacaggagccatcatcgtggcccgcatcatgaggggcggcgctgctgacaggagcggcctcatccacgtgggagatgagctgcgggaggtgaatggcatccctgtggaggacaagaggcctgaggagatcatccagatcctggcccagagccagggcgccatcaccttcaagatcatccctggcagcaaggaggagacccccagcaaggagggcaagatgttcatcaaggccctgtttgactacaaccccaatgaagacaaggccatcccctgcaaggaggccggcctgtccttcaagaagggggacatcctgcagatcatgagccaggatgatgccacctggtggcaggccaagcatgaagcagatgccaaccccagggctggcctcatccccagcaagcacttccaggagcggcggctggccctgcggcggcctgagatcctggtgcagcccctgaaggtgagcaacaggaagagcagcggcttcaggaagagcttccggctgagcaggaaggacaagaagaccaacaagtccatgtatgagtgcaagaagagtgaccagtatgacacagcagatgtgcccacctatgaggaggtgaccccctaccgccggcagaccaatgagaagtaccgcctggtggtgctggtgggccctgtgggcgtgggcctgaatgagctgaagaggaagctgctgatcagtgacacccagcactacggcgtgacagtgccccacaccacccgggcccggcgcagccaggagagtgatggagtggagtacatcttcatcagcaagcacctgtttgaaacagatgtgcagaacaacaagttcattgaatatggagagtacaagaacaactactacggcaccagcattgattctgtgcgctctgtgctggccaagaacaaggtgtgcctgctggatgtgcagccccacacagtgaagcacctgcggaccctggagttcaagccctacgtgatcttcatcaagccacccagcattgagcggctgcgggagaccaggaagaatgccaagatcatcagcagcagagatgaccagggcgccgccaagcccttcacagaggaggacttccaggagatgatcaagagcgcccagatcatggagagccagtatggccacctgtttgacaagatcatcatcaatgatgacctgactgtggccttcaatgagctgaagaccacctttgacaagctggagacagagacccactgggtgcctgtgtcctggctgcacagctag

SEQ ID NO: 159377 - DNA, 1731 bp, Artificial Sequence; identical to SEQ ID NO: 159376
  Description of Artificial Sequence: Synthetic coding sequence

SEQ ID NO: 159378 - DNA, 1731 bp, Artificial Sequence; identical to SEQ ID NO: 159376
  Description of Artificial Sequence: Synthetic coding sequence

SEQ ID NO: 159379 - DNA, 939 bp, Artificial Sequence
  Description of Artificial Sequence: Synthetic coding sequence
atgcctgccctgagcacaggcagcggcagtgacaccggcctgtatgagctgctggccgccctgcctgcccagctgcagccccacgtggacagccaggaggacctgaccttcctgtgggacatgtttggagagaagagcctgcacagcctggtgaagcacttccaggagcggcggctggccctgcggcggcctgagatcctggtgcagcccctgaaggtgagcaacaggaagagcagcggcttcaggaagagcttccggctgagcaggaaggacaagaagaccaacaagtccatgtatgagtgcaagaagagtgaccagtatgacacagcagatgtgcccacctatgaggaggtgaccccctaccgccggcagaccaatgagaagtaccgcctggtggtgctggtgggccctgtgggcgtgggcctgaatgagctgaagaggaagctgctgatcagtgacacccagcactatggagtgacagtgccccacaccacccgggcccggcgcagccaggagagtgatggagtggagtacatcttcatcagcaagcacctgtttgaaacagatgtgcagaacaacaagttcatcgagtatggagagtacaagaacaactactacggcaccagcattgacagcgtgcgctctgtgctggccaagaacaaggtgtgcctgctggatgtgcagccccacacagtgaagcacctgcggaccctggagttcaagccctacgtgatcttcatcaagcccccatccattgaaaggctgcgggagaccaggaagaatgccaagatcatcagcagcagagatgaccagggcgccgccaagcccttcacagaggaggacttccaggagatgatcaagagcgcccagatcatggagagccagtatggccacctgtttgacaagatcatcatcaatgatgacctgactgtggcctag

SEQ ID NO: 159380 - DNA, 1125 bp, Artificial Sequence
  Description of Artificial Sequence: Synthetic coding sequence
atgccagaagatattgatgatgaagaagattctgtgaagatcatccggctggtgaagaaccgggagcccctgggcgccaccatcaagaaggatgagcagacaggagccatcatcgtggcccgcatcatgagaggaggagctgctgacagaagtggcctcatccacgtgggagatgagctgcgggaggtgaatggcatccctgtggaggacaagaggcctgaggagatcatccagatcctggcccagagccagggcgccatcaccttcaagatcatccctggcagcaaggaggagacccccagcaaggagggcaagatgttcatcaaggccctgtttgactacaaccccaatgaagacaaggccatcccctgcaaggaggccggcctgtccttcaagaagggggacatcctgcagatcatgagccaggatgatgccacctggtggcaggccaagcatgaagcagatgccaacccccgggccggcctcatccccagcaagcacttccaggagcggcggctggccctgcggcggcctgagatcctggtgcagcccctgaaggtgagcaacaggaagagcagcggcttcaggaagagcttccggctgagcaggaaggacaagaagaccaacaagtccatgtatgagtgcaagaagagtgaccagtatgacacagcagatgtgcccacctatgaggaggtgaccccctaccgccggcagaccaatgagaagtaccgcctggtggtgctggtgggccctgtgggcgtgggcctgaatgagctgaagaggaagctgctgatcagtgacacccagcactatggagtgacagtgccccacaccacccgggcccggcgcagccaggagagtgatggagtggagtacatcttcatcagcaagcacctgtttgaaacagatgtgcagaacaacaagttcatcgagtatggagagtacaagaacaactactacggcaccagcattgacagcgtgcgctctgtgctggccaagaacaaggtgtgcctgctggatgtgcagccccacggcccctggttcctgctgcccctgatggctgtgccctggggcgccaagcccccaaatgccaggatgacctgtggcagccccctggacctgtag

SEQ ID NO: 159381 - DNA, 1731 bp, Artificial Sequence; identical to SEQ ID NO: 159376
  Description of Artificial Sequence: Synthetic coding sequence

SEQ ID NO: 159382 - DNA, 870 bp, Artificial Sequence
  Description of Artificial Sequence: Synthetic coding sequence
atgctgggctggtgtgaggccatcgccaggaacccccaccgcatccccaacaacaccaggaccccagagatcagcggggacctggctgatgccagccagaccagcaccctgaatgagaagagccctggccgcagcgccagccgcagcagcaacatcagcaaggccagcagccccaccaccggcacagcccccaggagccagagccggctgtctgtgtgccccagcacccaggacatctgccgcatctgccactgtgaaggagatgaggagagccccctcatcaccccctgccgctgcaccggcaccctgcgctttgtgcaccagagctgcctgcaccagtggatcaagagcagtgacacccgctgctgtgagctgtgcaagtatgacttcatcatggagaccaagctgaagcccctgaggaagtgggagaagctgcagatgaccaccagcgagaggaggaagatcttctgcagcgtgaccttccacgtgattgccatcacctgtgtggtgtggagcctgtatgtgctgattgacagaacagctgaggagatcaagcagggcaatgacaacggggtgctggagtggcccttctggaccaagctggtggtggtggccatcggcttcaccggcggcctggtgttcatgtatgtgcagtgcaaggtgtatgtgcagctgtggaggcggctgaaggcctacaacagagtcatctttgtgcagaactgcccagacacagccaagaagctggagaagaacttcagctgcaatgtgaacacagacatcaaggatgctgtggtggtgcctgtgccccagacaggagccaacagcctgcccagcgctgagggcggccccccagaggtggtgtctgtgtag

SEQ ID NO: 159383 - DNA, 819 bp, Artificial Sequence
  Description of Artificial Sequence: Synthetic coding sequence
atgaccagcagccacgtgtgctgcaacttcctgaacatgtggaagaagagcaagatcagcaccatgtactacctgaaccaggatgccaagctgagcaacctcttcctgcaggccagcagccccaccactggaacagcccccaggagccagagccggctgtctgtgtgccccagcacccaggacatctgccgcatctgccactgtgaaggagatgaggagagccccctcatcaccccctgccgctgcaccggcaccctgcgctttgtgcaccagagctgcctgcaccagtggatcaagagcagtgacacccgctgctgtgagctgtgcaagtatgacttcatcatggagaccaagctgaagcccctgaggaagtgggagaagctgcagatgaccaccagcgagaggaggaagatcttctgcagcgtgaccttccacgtgattgccatcacctgtgtggtgtggagcctgtatgtgctgattgacagaacagctgaggagatcaagcagggcaatgacaatggagtgctggagtggcccttctggaccaagctggtggtggtggccatcggcttcaccggcggcctggtgttcatgtatgtgcagtgcaaggtgtatgtgcagctgtggaggcggctgaaggcctacaacagagtcatctttgtgcagaactgcccagacacagccaagaagctggagaagaacttcagctgcaatgtgaacacagacatcaaggatgctgtggtggtgcctgtgccccagacaggagccaacagcctgcccagcgctgagggcggccccccagaggtggtgtctgtgtag

SEQ ID NO: 159384 - DNA, 870 bp, Artificial Sequence; identical to SEQ ID NO: 159382
  Description of Artificial Sequence: Synthetic coding sequence

SEQ ID NO: 159385 - DNA, 426 bp, Artificial Sequence
  Description of Artificial Sequence: Synthetic coding sequence
atgctgggctggtgtgaggccatcgccaggaacccccaccgcatccccaacaacaccaggaccccagagatcagcggggacctggctgatgccagccagaccagcaccctgaatgagaagagccctggccgcagcgccagccgcagcagcaacatcagcaaggccagcagccccaccaccggcacagcccccaggagccagagccggctgtctgtgtgccccagcacccaggacatctgccgcatctgccactgtgaaggagatgaggagagccccctcatcaccccctgccgctgcaccggcaccctgcgctttgtgcaccagagctgcctgcaccagtggatcaagagcagtgacacccgctgctgtgagctgtgcaagtatgacttcatcatggagaccaagctgaagcccctgaggaagtag

SEQ ID NO: 159386 - DNA, 2427 bp, Artificial Sequence
  Description of Artificial Sequence: Synthetic coding sequence
atgctgcatgatgcccgggaccggcagaagttcttcagtgatgtgcagtacctgcgggacatgcagcacaaggtggacagcgagtaccaggcctgcctgcggcggcaggagtacagaagagaccccaatgagaagaagagggaccagttctggggccaggagaccagctttgagaggagccgcttcagcagccgcagcagcagcaagcagagcagcagtgaagaagatgccctgacagagcccaggagcagcatcaagatcagcgccttcaagtgtgacagcaagctgcctgccatcgaccagacctctgtgaagcagaagcacaagagcaccatgacagtgaggaaggccgagaaggtggaccccagcgagcccagccctgctgaccaggcccccatggtgctgctgaggaagaggaagcccaacctgcggcgcttcaccgtgtccccagagagccacagcccccgggccagcggggacaggagccggcagaagcagcagtggccagccaaggtgcctgtgcccagaggagctgaccaggtggtgcagcaggagggcctgatgtgcaacaccaagctgaagaggcccaaccaggagaggaggaacctggtgcccagcagccagcccatgacagaaaatgccccagaccgggccaagaagggggaccccagcgcccccagccagagcgagctgcacccagccctgagccaggccttccagggcaagaacagcccccaggtgctgtctgagttcagcggcccccccctgacccccaccaccgtgggcggccccaggaaggccagcttccgcttcagagatgaggacttctacagcatcctgagcctgaacagcagaagagaaagtgatgacacagaggaggagacccagagtgaagaatgtctgtgggtgggcgtgcgcagcccctgcagccccagccaccacaagaggagcagatttggaggcaccagcaccccccaggccaagaacaagaactttgaggagaatgctgagaactgccggggccacagcagcagaagaagtgagcccagccacggcagcctgcgcatcagcaatgccatggagcccgccacagagcggcccagcgctggccagaggctgagccaggaccccggcctgcctgaccgggagagcgccacagagaaggacagaggaggctctgaaaatgccaagaagagccccctgtcctgggacaccaagtctgagccccggcaggaggtgggcgtgaatgcagaaaatgtgtggagcgactgcatctctgtggagcacaggcctggcacccatgacagcgagggctactggaaggactacctgaacagcagccagaacagcctggactacttcatcagcggccggcccatcagccccaggagctctgtgaacagcagctacaaccccccagccagcttcatgcacagcgccctgagagatgacatccctgtggacctgtccatgagcagcacctctgtgcacagcagtgacagcgagggcaacagcggcttccacgtgtgccagcccctgagccccatccggaacagaacaccatttgccagcgctgagaaccacaactacttccctgtgaacagcgcccatgaatttgctgtgcgggaggccgaggacaccaccctgaccagccagccccagggcgcccccctgtacacagacctgctgctgaacccccagggcaacctgagcctggtggacagcagcagcagcagccccagcaggatgaacagcgagggccacctgcacgtgtctggcagcctgcaggagaacacccccttcaccttctttgctgtgagccacttccccaaccagaatgacaatggcagcaggatggccgccagcggcttcacagatgagaaggagaccagcaagatcaaggctgaccctgagaagctgaagaagctgcaggagagcctgctggaggaggacagcgaggaggagggggacctgtgccgcatctgccagattgctgggggcagccccagcaaccccctgctggagccctgtggctgtgtgggcagcctgcagtttgtgcaccaggagtgcctgaagaagtggctgaaggtgaagatcaccagcggggctgacctgggcgctgtgaagacctgtgagatgtgcaagcagggcctgctggtggacctgggggacttcaacatgattgagttctaccagaagcaccagcagagccaggcccagaatgagctgatgaacagcggcctgtacctggtgctgctgctgcacctgtatgagcagagatttgctgagctgatgaggctgaaccacaaccaggtggagcgggagcggctgagcaggaactacccccagcccaggacagaggagaatgaaaacagcgagctgggagatggaaatgaaggcagcatcagccagagccaggtggtgtag

SEQ ID NO: 159387 - DNA, 2427 bp, Artificial Sequence; identical to SEQ ID NO: 159386
  Description of Artificial Sequence: Synthetic coding sequence

SEQ ID NO: 159388 - DNA, 2400 bp, Artificial Sequence
  Description of Artificial Sequence: Synthetic coding sequence
atgctgcatgatgcccgggaccggcagaagttcttcagtgatgtgcagtacctgcgggacatgcagcacaaggtggacagcgagtaccaggcctgcctgcggcggcaggagtacagaagagaccccaatgagaagaagagggaccagttctggggccaggagaccagctttgagaggagccgcttcagcagccgcagcagcagcaagcagagcagcagtgaagaagatgccctgacagagcccaggagcagcatcaagatcagcgccttcaagtgtgacagcaagctgcctgccatcgaccagacctctgtgaagcagaagcacaagagcaccatgacagtgaggaaggccgagaaggtggaccccagcgagcccagcccagaccaggcccccatggtgctgctgaggaagaggaagcccaacctgcggcgcttcaccgtgtccccagagagccacagcccccgggccagcggggacaggagccggcagaagcagcagtggccagccaaggtgcctgtgcccagaggagctgaccaggtggtgcagcaggagggcctgatgtgcaacaccaagctgaagaggcccaaccaggagaggaggaacctggtgcccagcagccagcccatgacagaaaatgccccagaccgggccaagaagggggaccccagcgcccccagccagagcgagctgcacccagccctgagccaggccttccagggcaagaacagcccccaggtgctgtctgagttcagcggcccccccctgacccccaccaccgtgggcggccccaggaaggccagcttccgcttcagagatgaggacttctacagcatcctgagcctgaacagccggcgggagagtgatgacacagaggaggagacccagagcgaggagtgcctgtgggtgggcgtgcgcagcccctgcagccccagccaccacaagaggagcagatttggaggcaccagcaccccccaggccaagaacaagaactttgaagaaaatgctgagaactgccggggccacagcagccgccgctctgagcccagccacggcagcctgcgcatcagcaatgccatggagcccgccacagagcggcccagcgctggccagaggctgagccaggaccccggcctgcctgaccgggagagcgccacagagaaggaccggggcggctctgaaaatgccaagaagagccccctgtcctgggacaccaagtctgagccccggcaggaggtgggcgtgaatgcagaaaatgtgtggagcgactgcatctctgtggagcaccggcccggcacccatgattctgagggctactggaaggactacctgaacagcagccagaacagcctggactacttcatcagcggccggcccatcagccccaggagctctgtgaacagcagctacaaccccccagccagcttcatgcacagcgccctgagagatgacatccctgtggacctgtccatgagcagcacctctgtgcacagcagtgacagcgagggcaacagcggcttccacgtgtgccagcccctgagccccatccggaacagaacaccatttgccagcgctgagaaccacaactacttccctgtgaacagcgcccacgagtttgctgtgcgggaggccgaggacaccaccctgaccagccagccccagggcgcccccctgtacacagacctgctgctgaacccccagggcaacctgagcctggtggacagcagcagcagcagccccagcaggatgaacagcgagggccacctgcacgtgtctggcagcctgcaggagaacacccccttcaccttctttgctgtgagccacttccccaaccagaatgacaatggcagcaggatggccgccagcggcttcacagatgagaaggagaccagcaagatcaaggctgaccctgagaagctgaagaagctgcaggagagcctgctggaggaggacagcgaggaggagggggacctgtgccgcatctgccagattgctgggggcagccccagcaaccccctgctggagccctgtggctgtgtgggcagcctgcagtttgtgcaccaggagtgcctgaagaagtggctgaaggtgaagatcaccagcggggctgacctgggcgctgtgaagacctgtgagatgtgcaagcagggcctgctggtggacctgggggacttcaacatgattgagttctaccagaagcaccagcagagccaggcccagaatgagctgatgaacagcggcctgtacctggtgctgctgctgcacctgtatgagcagagatttgctgagctgatgaggctgaaccacaaccaggtggagcgggagcggctgagcaggaactacccccagcccaggacagaagaaaatgaaagccgcttctggggccctgtgctgcccttctag

SEQ ID NO: 159389 - DNA, 1209 bp, Artificial Sequence
  Description of Artificial Sequence: Synthetic coding sequence
atgagctttgaaggaggccatggaggcagccgctgcagaggagctgagagcggagatgctgagcccccaccccagcccccacctcctcctccacccaccccacctcctggagagcccgcccctgtgcctgctgccccccgctacctgccccccctgcctgccagccctgagaccccagagagagctgctggccccagcgagcccctgggggaggtggccccccgctgcagaggagcagatgagctgcccccaccacccctgcccctgcagcctgctggccaggaggtggccgctgctggggacagcggggagggcccccggcggctgcctgaggccgccgccgccaagggcggccctggagagagcgaggccggggccggcggggagcgggagaggagaggagctggggaccagcctgagaccaggtctgtgtgcagcagccgcagcagcagcagcggcggcggggaccagagagctggccaccagcaccagcaccaccagcccatctgcaagatctgcttccagggcgctgagcagggcgagctgctgaacccctgccgctgtgatggctctgtgcgctacacccaccagctgtgcctgctgaagtggatcagcgagcggggctcctggacctgtgagctgtgctgctaccgctaccacgtgattgccatcaagatgaagcagccctgccagtggcagagcatcagcatcaccctggtggagaaggtgcagatgattgctgtgatcctgggcagcctcttcctgattgcctctgtgacctggctgctgtggagcgccttcagcccctatgctgtgtggcagaggaaggacatcctcttccagatctgctacggcatgtatggcttcatggacctggtgtgcatcggcctcatcgtgcatgagggcgctgctgtgtacagagtcttcaagcgctggagggctgtgaacctgcactgggatgtgctgaactatgacaaggccacagacatcgaggagagcagcagaggagagagcagcaccagcaggaccctgtggctgcccctgacagccctgaggaacagaaacctggtgcaccccacccagctgaccagcccccgcttccagtgtggctacgtgctgctgcacctgttcaacaggatgaggcctcatgaggacctgtctgaggacaacagcagcggggaggtggtgatgagggtgacctctgtgtag

SEQ ID NO: 159390 - DNA, 1818 bp, Artificial Sequence
  Description of Artificial Sequence: Synthetic coding sequence
atggccctgaggaaaggaggcctggccctggccctgctgctgctgtcctgggtggccctgggccccaggagcctggagggcgctgaccccggcaccccaggagaggccgagggccctgcctgcccagctgcctgtgtgtgcagctatgatgatgatgctgatgagctgtctgtgttctgcagcagcaggaacctgacccggctgcctgatggagtgcctgggggcacccaggccctgtggctggatggcaacaacctgagctctgtgcccccagctgccttccagaacctgagcagcctgggcttcctgaacctgcagggcggccagctgggcagcctggagccccaggccctgctgggcctggagaacctgtgccacctgcacctggagaggaaccagctgcggagcctggccctgggcacctttgcccacaccccagccctggccagcctgggcctgagcaacaaccggctgagccggctggaggatggcctgtttgagggcctgggcagcctgtgggacctgaacctgggctggaacagcctggccgtgctgcctgatgctgccttccggggcctgggcagcctgcgggagctggtgctggccggcaaccggctggcctacctgcagcctgccctcttcagcggcctggccgagctgcgggagctggacctgagcagaaatgccctgcgggccatcaaggccaacgtgtttgtgcagctgccccggctgcagaagctgtacctggacaggaacctgattgctgctgtggcccctggggccttcctgggcctgaaggccctgcgctggctggacctgagccacaacagagtggccggcctgctggaggacaccttccctggcctgctgggcctgcgggtgctgcggctgagccacaatgccatcgccagcctgcggcccaggaccttcaaggacctgcacttcctggaggagctgcagctgggccacaaccgcatccggcagctggccgagaggagctttgagggcctgggccagctggaggtgctgaccctggaccacaaccagctgcaggaggtgaaggccggggccttcctgggcctgaccaacgtggccgtgatgaacctgagcggcaactgcctgaggaacctgcctgagcaggtgttccggggcctgggcaagctgcacagcctgcacctggagggcagctgcctgggccgcatccggccccacaccttcaccggcctgagcggcctgcggcggctcttcctgaaggacaatggcctggtgggcatcgaggagcagagcctgtggggcctggccgagctgctggagctggacctgaccagcaaccagctgacccacctgccccacaggctcttccagggcctgggcaagctggagtacctgctgctgagcaggaaccggctggccgagctgcctgcagatgccctgggccccctgcagagggccttctggctggatgtgagccacaaccggctggaggccctgcccaacagcctgctggcccccctgggccgcctgcgctacctgagcctgaggaacaacagcctgcggaccttcaccccccagcccccaggcctggagcggctgtggctggagggcaacccctgggactgtggctgccccctgaaggccctgcgggactttgccctgcagaaccccagcgctgtgcccaggtttgtgcaggccatctgtgaaggagatgactgccagcccccagcctacacctacaacaacatcacctgtgccagccccccagaggtggtgggcctggacctgcgggacctgtctgaggcccactttgccccctgctag

SEQ ID NO: 159391 - DNA, 531 bp, Artificial Sequence
  Description of Artificial Sequence: Synthetic coding sequence
atgaccactggagactgctgccacctgcccggcagcctgtgtgactgcagcggcagccctgccttcagcaaggtggtggaggccaccggcctgggccccccccagtatgtggcccaggtgaccagcagagatggccgcctgctgagcaccgtcatccgggccctggacacccccagtgatggccccttctgccgcatctgccacgagggcgccaacggggagtgcctgctgagcccctgtggctgcaccggcaccctgggcgctgtgcacaagagctgcctggagaagtggctgagcagcagcaacaccagctactgtgagctgtgccacacagaatttgctgtggagaagaggccccggcccctgacagaggtgtccttccgctaccactgccagctgtacagcgagtggaggaagaccaaccagaaggtgcggctgaagatccgggaggccgacagccctgagggcccccagcacagccccctggccgccggcctgctgaagaaggtggccgaggagacccctgtgtag

SEQ ID NO: 159392 - DNA, 741 bp, Artificial Sequence
  Description of Artificial Sequence: Synthetic coding sequence
atgaccactggagactgctgccacctgcccggcagcctgtgtgactgcagcggcagccctgccttcagcaaggtggtggaggccaccggcctgggccccccccagtatgtggcccaggtgaccagcagagatggccgcctgctgagcaccgtcatccgggccctggacacccccagtgatggccccttctgccgcatctgccacgagggcgccaacggggagtgcctgctgagcccctgtggctgcaccggcaccctgggcgctgtgcacaagagctgcctggagaagtggctgagcagcagcaacaccagctactgtgagctgtgccacacagaatttgctgtggagaagaggccccggcccctgacagagtggctgaaggaccccggccccaggacagagaagaggaccctgtgctgtgacatggtgtgcttcctgttcatcacccccctggccgccatcagcggctggctgtgcctgcggggggcccaggaccacctgcggctgcacagccagctggaggccgtgggcctgattgccctgaccatcgccctcttcaccatctacgtgctgtggaccctggtgtccttccgctaccactgccagctgtacagcgagtggaggaagaccaaccagaaggtgcggctgaagatccgggaggccgacagccctgagggcccccagcacagccccctggccgccggcctgctgaagaaggtggccgaggagacccctgtgtag

SEQ ID NO: 159393 - DNA, 762 bp, Artificial Sequence
  Description of Artificial Sequence: Synthetic coding sequence
atgaccaccagccgctgcagccacctgcctgaggtgctgcctgactgcaccagcagcgctgcccctgtggtgaagacagtggaggactgtggcagcctggtgaatggccagccccagtatgtgatgcaggtgtctgccaaggatggccagctgctgagcacagtggtgaggaccctggccacccagagccccttcaatgaccggcccatgtgccgcatctgccacgagggcagcagccaggaggacctgctgagcccctgtgagtgcaccggcaccctgggcaccatccacaggagctgcctggagcactggctgagcagcagcaacaccagctactgtgagctgtgccacttccgctttgctgtggagaggaagccccggcccctggtggagtggctgaggaaccctggcccccagcacgagaagaggaccctgtttggagacatggtgtgcttcctgttcatcacccccctggccaccatcagcggctggctgtgcctgcggggagctgtggaccacctgcacttcagcagccggctggaggccgtgggcctcatcgccctgactgtggccctcttcaccatctacctgttctggaccctggtgtccttccgctaccactgccgcctgtacaatgagtggaggaggaccaaccagagggtcatcctgctgatccccaagtctgtgaatgtgcccagcaaccagcccagcctgctgggcctgcacagcgtgaagaggaacagcaaggagaccgtggtgtag

SEQ ID NO: 159394 - DNA, 1233 bp, Artificial Sequence
  Description of Artificial Sequence: Synthetic coding sequence
atgctgatgcccctgtgtggcctgctgtggtggtggtggtgctgctgcagcggctggtactgctacggcctgtgtgccccagccccccagatgctgcggcaccagggcctgctgaagtgccgctgcaggatgctgttcaatgacctgaaggtgttcctgctgcggcggcccccccaggcccccctgcccatgcatggagacccccagcccccaggcctggccgccaacaacaccctgcctgccctgggcgctgggggctgggccggctggaggggcccccgggaggtggtgggccgggagcccccacctgtgcccccacctccacccctgccccccagctctgtggaggatgactggggcggccctgccacagagcccccagccagcctgctgagcagcgccagcagtgatgacttctgcaaggagaagacagaagatcgctacagcctgggcagcagcctggacagcggcatgaggacccccctgtgccgcatctgcttccagggccctgagcagggcgagctgctgagcccctgccgctgtgatggctctgtgaagtgcacccaccagccctgcctgatcaagtggatcagcgagcggggctgctggagctgtgagctgtgctactacaagtaccacgtgattgccatcagcaccaagaaccccctgcagtggcaggccatcagcctgactgtgattgagaaggtgcaggtggccgccgccatcctgggcagcctcttcctgattgccagcatctcctggctgatctggagcaccttcagccccagcgcccgctggcagaggcaggacctgctcttccagatctgctacggcatgtatggcttcatggatgtggtgtgcatcggcctcatcatccacgagggccccagcgtgtaccgcatcttcaagcgctggcaggccgtgaaccagcagtggaaggtgctgaactatgacaagaccaaggacctggaggaccagaaggccggcggccgcaccaaccccaggaccagcagcagcacccaggccaacatccccagcagcgaggaggagacagctggcaccccagcccctgagcagggccctgcccaggccgccggccaccccagcggccccctgagccaccaccactgtgcctacaccatcctgcacatcctgagccacctgcggccccatgagcagaggagccccccaggcagcagccgggagctggtgatgagggtgaccaccgtgtag

SEQ ID NO: 159395 - DNA, 837 bp, Artificial Sequence
  Description of Artificial Sequence: Synthetic coding sequence
atgccagaccaggccctgcagcagatgctggacaggagctgctgggtgtgctttgccacagatgaagatgacagaacagctgagtgggtgcggccctgccgctgccggggcagcaccaagtgggtgcaccaggcctgcctgcagcgctgggtggatgagaagcagaggggcaacagcacagcccgggtggcctgcccccagtgcaatgctgagtacctgattgtgttccccaagctgggccctgtggtgtatgtgctggacctggccgacaggctcatcagcaaggcctgcccctttgctgctgctggcatcatggtgggcagcatctactggacagctgtgacctacggggctgtgacagtgatgcaggtggtgggccacaaggagggcctggatgtgatggagagagctgaccccctcttcctgctgattggcctgcccaccatccctgtgatgctgatcctgggcaagatgatccgctgggaggactatgtgctgcggctgtggaggaagtacagcaacaagctgcagatcctgaacagcatcttccctggcatcggctgccctgtgccccgcatcccagctgaggccaaccccctggccgaccacgtgtctgccacccgcatcctgtgtggggccctggtgttccccaccatcgccaccatcgtgggcaagctgatgttcagctctgtgaacagcaacctgcagaggaccatcctgggcggcatcgcctttgtggccatcaagggggccttcaaggtgtacttcaagcagcagcagtacctgcggcaggcccacaggaagatcctgaactacccagagcaggaggaggcctag

SEQ ID NO: 159396 - DNA, 2733 bp, Artificial Sequence
  Description of Artificial Sequence: Synthetic coding sequence
atggacacagctgaggaggacatctgccgggtgtgccgctctgagggcaccccagagaagcccctgtaccacccctgtgtgtgcaccggcagcatcaagttcatccaccaggagtgcctggtgcagtggctgaagcacagcaggaaggagtactgtgagctgtgcaagcacagatttgccttcacccccatctacagcccagacatgcccagccggctgcccatccaggacatctttgctggcctggtgaccagcatcggcacagccatccgctactggttccactacaccctggtggcctttgcctggctgggcgtggtgcccctgacagcctgccgcatctacaagtgcctcttcaccggctctgtgagcagcctgctgaccctgcccctggacatgctgagcacagagaacctgctggccgactgcctgcagggctgctttgtggtgacctgcaccctgtgtgccttcatcagcctggtgtggctgcgggagcagatcgtgcatggaggagcccccatctggctggagcacgccgccccacccttcaatgctgctggccaccaccagaatgaggccccagctggaggaaatggagcagaaaatgtggccgctgaccagcctgccaaccccccagcagaaaatgctgtggtgggggagaacccagatgcccaggatgaccaggccgaggaggaggaggaggacaatgaggaggaggatgatgctggggtggaggatgctgctgatgccaacaacggggcccaggatgacatgaactggaatgccctggagtgggacagagctgctgaggagctgacctgggagaggatgctgggcctggatggcagcctggtgttcctggagcacgtgttctgggtggtgtccctgaacaccctcttcatcctggtgtttgccttctgcccctaccacatcggccacttcagcctggtgggcctgggctttgaggagcacgtgcaggccagccactttgagggcctcatcaccaccatcgtgggctacatcctgctggccatcaccctcatcatctgccacggcctggccaccctggtgaagttccacaggagccggcggctgctgggcgtgtgctacatcgtggtgaaggtgtccctgctggtggtggtggagattggagtcttccccctcatctgtggctggtggctggacatctgcagcctggagatgtttgatgccaccctgaaggaccgggagctgtccttccagagcgcccctggcaccaccatgttcctgcactggctggtgggcatggtgtatgtgttctactttgccagcttcatcctgctgctgcgggaggtgctgcggcctggggtgctgtggttcctgaggaacctgaatgaccctgacttcaaccctgtgcaggagatgatccacctgcccatctaccgccacctgcggcgcttcatcctgtctgtgattgtgtttggcagcatcgtgctgctgatgctgtggctgcccatccgcatcatcaagtctgtgctgcccaacttcctgccctacaacgtgatgctgtacagtgatgcccctgtgtctgagctgagcctggagctgctgctgctgcaggtggtgctgcctgccctgctggagcagggccacacccggcagtggctgaagggcctggtgcgggcctggacagtgacagctggctacctgctggacctgcacagctacctgctgggggaccaggaggagaatgaaaacagcgccaaccagcaggtgaacaacaaccagcacgccaggaacaacaatgccatccctgtggtgggggagggcctgcacgccgcccaccaggccatcctgcagcagggcggccctgtgggcttccagccctaccgccggcccctgaacttccccctgcgcatcttcctgctgattgtgttcatgtgcatcaccctgctgattgccagcctcatctgcctgaccctgcctgtgtttgctggccgctggctgatgtccttctggacaggaacagccaagatccacgagctgtacacagctgcctgtggcctgtatgtgtgctggctgaccatccgggctgtgacagtgatggtggcctggatgccccagggcagaagagtcatcttccagaaggtgaaggagtggagcctgatgatcatgaagaccctcatcgtggccgtgctgctggccggcgtggtgcccctgctgctgggcctgctgtttgagctggtgattgtggcccccctgcgggtgcccctggaccagacccccctcttctacccctggcaggactgggccctgggcgtgctgcacgccaagatcatcgccgccatcaccctgatgggcccccagtggtggctgaagacagtgattgagcaggtgtatgccaacggcatccggaacatcgacctgcactacatcgtgaggaagctggccgcccctgtgatctctgtgctgctgctgagcctgtgtgtgccctacgtgattgccagcggcgtggtgcccctgctgggcgtgacagctgagatgcagaacctggtgcaccggcgcatctaccccttcctgctgatggtggtggtgctgatggccatcctgtccttccaggtgcggcagttcaagaggctgtatgagcacatcaagaatgacaagtacctggtgggccagaggctggtgaactatgaaaggaagagcggcaagcagggcagcagccccccaccaccccagagcagccaggagtag

SEQ ID NO: 159397 - DNA, 2115 bp, Artificial Sequence
  Description of Artificial Sequence: Synthetic coding sequence
atggagagcaagcccagccgcatcccccggcgcatctctgtgcagcccagcagcagcctgagcgccaggatgatgagcggcagccggggcagcagcctgaatgacacctaccacagccgggacagcagcttccggctggacagcgagtaccagagcaccagcgccagcgccagcgccagccccttccagagcgcctggtacagcgagagcgagatcacccagggcgcccggagccgcagccagaaccagcagagggaccatgacagcaagaggcccaagctgagctgcaccaactgcaccaccagcgctggaagaaatgtgggcaatggcctgaacaccctgagtgacagctcctggaggcacagccaggtgcccaggagcagctccatggtgctgggcagctttggaacagacctgatgagggagcggcgggacctggagaggagaacagacagcagcatcagcaacctgatggactacagccacaggtctggggacttcaccaccagcagctatgtgcaggacagagtgcccagctacagccagggcgcccggcccaaggagaacagcatgagcaccctgcagctgaacaccagcagcaccaaccaccagctgcccagcgagcaccagaccatcctgagcagccgggacagcaggaacagcctgcggagcaacttcagcagccgggagagcgagagcagccgcagcaacacccagcccggcttctcctacagcagcagcagagatgaggcccccatcatcagcaacagcgagcgggtggtgagcagccagaggcccttccaggagagcagtgacaatgaaggccgccgcaccacccggcggctgctgagccgcatcgccagctccatgagcagcaccttcttcagcagaagaagcagccaggacagcctgaacaccaggagcctgaacagcgagaacagctatgtgagcccccgcatcctgacagccagccagagccgcagcaatgtgcccagcgccagcgaggtgcctgacaacagagccagcgaggccagccagggcttccgcttcctgcggcggcgctggggcctgagcagcctgagccacaaccacagcagcgagagtgacagcgagaacttcaaccaggagagcgagggcaggaacacaggcccctggctgagcagcagcctgaggaaccgctgcacccccctcttcagcagaagaagaagagagggcagagatgagagcagccgcatccccaccagtgacaccagcagccgcagccacatcttcagaagagagagcaatgaggtggtgcacctggaggcccagaatgaccccctgggcgccgccgccaaccggccccaggccagcgctgccagcagcagcgccaccactggaggcagcaccagtgacagcgcccagggcggcaggaacacaggcatcagcggcatcctgcccggcagcctcttccgctttgctgtgcccccagccctgggcagcaacctgacagacaacgtgatgatcaccgtggacatcatccccagcggctggaacagcgcagatggcaagagtgacaagaccaagagcgcccccagccgggaccctgagcggctgcagaagatcaaggagagcctgctgctggaggacagcgaggaggaggagggggacctgtgccgcatctgccagatggctgctgccagcagcagcaacctgctgattgagccctgcaagtgcaccggcagcctgcagtatgtgcaccaggactgcatgaagaagtggctgcaggccaagatcaacagcggcagcagcctggaggccgtgaccacctgtgagctgtgcaaggagaagctggagctgaacctggaggactttgacatccacgagctgcaccgggcccacgccaatgagcaggccgagtatgagttcatcagcagcggcctgtacctggtggtgctgctgcacctgtgtgagcagagcttcagtgacatgatgggcaacaccaatgagcccagcaccagggtgcgcttcatcaacctggcccggaccctgcaggcccacatggaggacctggagaccagtgaagatgattctgaagaagatggagaccacaacagaacatttgatattgcctag

SEQ ID NO: 159398 - DNA, 2115 bp, Artificial Sequence; identical to SEQ ID NO: 159397
  Description of Artificial Sequence: Synthetic coding sequence

SEQ ID NO: 159399 - DNA, 306 bp, Artificial Sequence
  Description of Artificial Sequence: Synthetic coding sequence
atggagagcaagcccagccgcatcccccggcgcatctctgtgcagcccagcagcagcctgagcgccaggatgatgagcggcagccggggcagcagcctgaatgacacctaccacagccgggacagcagcttccggctggacagcgagtaccagagcaccagcgccagcgccagcgccagccccttccagagcgcctggtacagcgagagcgagatcacccagggcgcccggagccgcagccagaaccagcagagggaccatgacagcaagaggcccaagctgagctgcaccaactgcaccacctag

SEQ ID NO: 159400 - DNA, 1908 bp, Artificial Sequence
  Description of Artificial Sequence: Synthetic coding sequence
atggagagcaagcccagccgcatcccccggcgcatctctgtgcagcccagcagcagcctgagcgccaggatgatgagcggcagccggggcagcagcctgaatgacacctaccacagccgggacagcagcttccggctggacagcgagtaccagagcaccagcgccagcgccagcgccagccccttccagagcgcctggtacagcgagagcgagatcacccagggcgcccggagccgcagccagaaccagcagagggaccatgacagcaagaggcccaagctgagctgcaccaactgcaccaccagcgctggaagaaatgtgggcaatggcctgaacaccctgagtgatgtgcaggacagagtgcccagctacagccagggcgcccggcccaaggagaacagcatgagcaccctgcagctgaacaccagcagcaccaaccaccagctgcccagcgagcaccagaccatcctgagcagccgggacagcaggaacagcctgcggagcaacttcagcagccgggagagcgagagcagccgcagcaacacccagcccggcttctcctacagcagcagcagagatgaggcccccatcatcagcaacagcgagcgggtggtgagcagccagaggcccttccaggagagcagtgacaatgaaggccgccgcaccacccggcggctgctgagccgcatcgccagctccatgagcagcaccttcttcagcagaagaagcagccaggacagcctgaacaccaggagcctgaacagcgagaacagctatgtgagcccccgcatcctgacagccagccagagccgcagcaatgtgcccagcgccagcgaggtgcctgacaacagagccagcgaggccagccagggcttccgcttcctgcggcggcgctggggcctgagcagcctgagccacaaccacagcagcgagagtgacagcgagaacttcaaccaggagagcgagggcaggaacacaggcccctggctgagcagcagcctgaggaaccgctgcacccccctcttcagcagaagaagaagagagggcagagatgagagcagccgcatccccaccagtgacaccagcagccgcagccacatcttcagaagagagagcaatgaggtggtgcacctggaggcccagaatgaccccctgggcgccgccgccaaccggccccaggccagcgctgccagcagcagcgccaccactggaggcagcaccagtgacagcgcccagggcggcaggaacacaggcatcagcggcatcctgcccggcagcctcttccgctttgctgtgcccccagccctgggcagcaacctgacagacaacgtgatgatcaccgtggacatcatccccagcggctggaacagcgcagatggcaagagtgacaagaccaagagcgcccccagccgggaccctgagcggctgcagaagatcaaggagagcctgctgctggaggacagcgaggaggaggagggggacctgtgccgcatctgccagatggctgctgccagcagcagcaacctgctgattgagccctgcaagtgcaccggcagcctgcagtatgtgcaccaggactgcatgaagaagtggctgcaggccaagatcaacagcggcagcagcctggaggccgtgaccacctgtgagctgtgcaaggagaagctggagctgaacctggaggactttgacatccacgagctgcaccgggcccacgccaatgagcaggccgagtatgagttcatcagcagcggcctgtacctggtggtgctgctgcacctgtgtgagcagagcttcagtgacatgatgggcaacaccaatgagcccagcaccagggtgcggctgcagaggatgatccccaagaagacagagaccatcaccggccacctgatcctgcccaacttcatctag

SEQ ID NO: 159401 - DNA, 876 bp, Artificial Sequence
  Description of Artificial Sequence: Synthetic coding sequence
atgtccatgcccctgcaccagatcagcgccatccccagccaggatgccatcagcgcccgggtgtaccgcagcaagaccaaggagaaggagcgggaggagcagaatgagaagaccctgggccacttcatgagccacagcagcaacatcagcaaggccggcagccccccatctgccagcgccccagcccctgtgagcagcttcagcaggaccagcatcacccccagcagccaggacatctgccgcatctgccactgtgaaggagatgatgagagccccctcatcaccccctgccactgcaccggcagcctgcactttgtgcaccaggcctgcctgcagcagtggatcaagagcagtgacacccgctgctgtgagctgtgcaagtatgagttcatcatggagaccaagctgaagcccctgaggaagtgggagaagctgcagatgaccagcagcgagaggaggaagatcatgtgcagcgtgaccttccacgtgattgccatcacctgtgtggtgtggagcctgtatgtgctgattgacagaacagctgaggagatcaagcagggccaggccaccggcatcctggagtggcccttctggaccaagctggtggtggtggccatcggcttcaccggcggcctgctcttcatgtatgtgcagtgcaaggtgtatgtgcagctgtggaagaggctgaaggcctacaacagagtcatctacgtgcagaactgcccagagaccagcaagaagaacatctttgagaagagccccctgacagagcccaactttgagaacaagcacggctacggcatctgccacagcgacaccaacagcagctgctgcacagagcctgaggacaccggggctgagatcatccacgtgtag

SEQ ID NO: 159402 - DNA, 876 bp, Artificial Sequence; identical to SEQ ID NO: 159401
  Description of Artificial Sequence: Synthetic coding sequence

SEQ ID NO: 159403 - DNA, 876 bp, Artificial Sequence; identical to SEQ ID NO: 159401
  Description of Artificial Sequence: Synthetic coding sequence

SEQ ID NO: 159404 - DNA, 1371 bp, Artificial Sequence
  Description of Artificial Sequence: Synthetic coding sequence
tgaatctgcaaggacaccctgcaggccagcaagaggaacagctttggaagtgagtgggcccaggccctgaagccagccaagaacaccaaggcccggaggaccctgaagttcagccgcagcctgaatgatgtgggggagaaggcccaggacaccagcgagagctttgcctacgtggagaggacctgcagcgagggcaagctgatcctgccccaggacacctgcctgcggaccaaccgcttccaccacaaggagaagaggaccctgaaccacaagcccctgggcaacagcaagcacagctgtgtgtcctgcctgtctgctggccgcagcacagccagcgaggtggaggccggcaagggcggccggcccggcctgctgctggaggagaaggcagatggagaggccaccagccgcagccggcagctgctgcagtacctgttcagcctgagccacggcctgagcgccagcagcctgcaccgcttccacgagctggagagctgtgccgcccggctgcacacagccaagagcagcagcggcctggccggctccatgggcttctgcagtgatgagatgggagatgatgatgtgtttgaggacagcaccagcgccaagctgaagagccgggtgctgcgggcccccctgtgcagcacagagaaggacagcgacctggactgccccagccccttcagcgagaagctgccccccatcagccctgtgtccaccagcggagatgtgtgccgcatctgccactgtgaaggagatgatgagagccccctcatcaccccctgccactgcaccggcagcctgcactttgtgcaccaggcctgcctgcagcagtggatcaagagcagtgacacccgctgctgtgagctgtgcaagtatgagttcatcatggagaccaagctgaagcccctgaggaagtgggagaagctgcagatgaccagcagcgagaggaggaagatcatgtgcagcgtgaccttccacgtgattgccatcacctgtgtggtgtggagcctgtatgtgctgattgacagaacagctgaggagatcaagcagggccaggccaccggcatcctggagtggcccttctggaccaagctggtggtggtggccatcggcttcaccggcggcctgctcttcatgtatgtgcagtgcaaggtgtatgtgcagctgtggaagaggctgaaggcctacaacagagtcatctacgtgcagaactgcccagagaccagcaagaagaacatctttgagaagagccccctgacagagcccaactttgagaacaagcacggctacggcatctgccacagcgacaccaacagcagctgctgcacagagccagaagatactggagctgagatcatccacgtgtag

SEQ ID NO: 159405 - DNA, 270 bp, Artificial Sequence
  Description of Artificial Sequence: Synthetic coding sequence
atgtccatgcccctgcaccagatcagcgccatccccagccaggatgccatcagcgcccgggtgtaccgcagcaagaccaaggagaaggagcgggaggagcagaatgagaagaccctgggccacttcatgagccacagcagcaacatcagcaaggccggcagccccccatctgccagcgccccagcccctgtgagcagcttcagcaggaccagcatcacccccagcagccaggacatctgccgcatctgccactgtgaaggagatgactag

SEQ ID NO: 159406 - DNA, 1041 bp, Artificial Sequence
  Description of Artificial Sequence: Synthetic coding sequence
atgctgaagagccggctgaggatgttcctgaatgagctgaagctgctggtgctgactggaggcggccggcccagggctgagccccagccccggggcggccggggcggcggctgcggctgggccccctttgctggctgcagcaccagagatggagatggagatgaggaggagtactacggcagcgagccccgggcccggggcctggccggggacaaggagccccgggccggccccctgcccccaccagccccacccctgcccccacctggggccctggatgccctgagcctgagcagcagcctggacagcggcctgcggaccccccagtgccgcatctgcttccagggccctgagcagggcgagctgctgagcccctgccgctgtgatggctctgtgcgctgcacccaccagccctgcctgatccgctggatcagcgagcggggctcctggagctgtgagctgtgctacttcaagtaccaggtgctggccatcagcaccaagaaccccctgcagtggcaggccatcagcctgaccgtcatcgagaaggtgcagattgctgccatcgtgctgggcagcctcttcctggtggccagcatctcctggctgatctggagcagcctgagccccagcgccaagtggcagaggcaggacctgctcttccagatctgctacggcatgtatggcttcatggatgtggtgtgcatcggcctcatcatccacgagggcagctctgtgtaccgcatcttcaagcgctggcaggccgtgaaccagcagtggaaggtgctgaactatgacaagaccaaggacattggaggagatgctgggggcggcacagctgggaagagcggccccaggaacagcaggacaggccccaccagcggggccaccagcaggcctcctgctgcccagaggatgaggaccctgctgccccagagatgtggctacaccatcctgcacctgctgggccagctgcggcccccagatgcccggagcagcagccacagcggccgggaggtggtgatgagggtgaccaccgtgtag

SEQ ID NO: 159407 - DNA, 702 bp, Artificial Sequence
  Description of Artificial Sequence: Synthetic coding sequence
atggtgtctgacaagtgccacatcctggacctgatcaaggcccagaggcggcagatgctgatcctgcctgagggcttccgggagggctcctggagcaccctgctcttccgggccacccaccacctggccctgcaccccttcctgggcctgtttggagccctgagccccacccagtggcaggccatcagcctgactgtgattgagaaggtgcagattgctgccatcgtgctgggcagcctcttcctggtggccagcatctcctggctgatctggagcagcctgagccccagcgccaagtggcagaggcaggacctgctcttccagatctgctacggcatgtatggcttcatggatgtggtgtgcatcggcctcatcatccacgagggcagctctgtgtaccgcatcttcaagcgctggcaggccgtgaaccagcagtggaaggtgctgaactatgacaagaccaaggacattggaggagatgctgggggcggcacagctgggaagagcggccccaggaacagcaggacaggccccaccagcggggccaccagccggcccccagctgcccagaggatgaggaccctgctgccccagagatgtggctacaccatcctgcacctgctgggccagctgcggcccccagatgcccggagcagcagccacagcggccgggaggtggtgatgagggtgaccaccgtgtag

SEQ ID NO: 159408 - DNA, 3159 bp, Artificial Sequence
  Description of Artificial Sequence: Synthetic coding sequence
atgaagctggtgaacatctggctgctgctgctggtggtgctgctgtgtgggaagaagcacctgggggaccggctggagaagaagagctttgagaaggccccctgccccggctgcagccacctgaccctgaaggtggagttcagcagcacagtggtggagtatgagtacatcgtggccttcaacggctacttcaccgccaaggccagaaattccttcatcagcagcgccctgaagagcagcgaggtggacaactggaggatcatccccaggaacaaccccagcagtgactaccccagcgactttgaagtcatccagatcaaggagaagcagaaggccggcctgctgaccctggaggaccaccccaacatcaagagggtgaccccccagaggaaggtgttccgcagcctgaagtatgcagagagtgaccccaccgtgccctgcaatgagacccgctggagccagaagtggcagagcagccggcccctgcggcgggccagcctgagcctgggcagcggcttctggcacgccaccggccgccacagcagccggcggctgctgcgggccatcccccggcaggtggcccagaccctgcaggctgatgtgctgtggcagatgggctacaccggggccaacgtgcgggtggccgtgtttgacaccggcctgtctgagaagcacccccacttcaagaatgtgaaggagaggaccaactggaccaatgaaagaaccctggatgatggcctgggccacggcacctttgtggccggcgtgattgcctccatgagggagtgccagggctttgccccagatgctgagctgcacatcttccgggtcttcaccaacaaccaggtgtcctacacctcctggttcctggatgccttcaactatgccatcctgaagaagattgatgtgctgaacctgagcatcggcggccctgacttcatggaccacccctttgtggacaaggtgtgggagctgacagccaacaacgtcatcatggtgtctgccatcggaaatgatggccccctgtatggcaccctgaacaacccagctgaccagatggatgtgattggagtgggcggcatcgactttgaggacaacatcgcccgcttcagcagccggggcatgaccacctgggagctgcccggcggctacggccgcatgaagccagacatcgtgacctacggggccggcgtgcggggcagcggcgtgaagggcggctgccgggccctgagcggcacctctgtggccagccctgtggtggccggggctgtgaccctgctggtgtccacagtgcagaagcgggagctggtgaacccagcctccatgaagcaggccctgattgccagcgcccggcggctgcccggggtgaacatgtttgagcagggccacggcaagctggacctgctgcgggcctaccagatcctgaacagctacaagccccaggccagcctgagccccagctacatcgacctgacagaatgtccctacatgtggccctactgcagccagcccatctactatggaggcatgcccaccgtggtgaatgtgaccatcctgaatggcatgggcgtgacaggccgcatcgtggacaagccagactggcagccctacctgccccagaatggagacaacatcgaggtggccttctcctacagctctgtgctgtggccctggagcggctacctggccatcagcatctctgtgaccaagaaggccgcctcctgggagggcatcgcccagggccacgtgatgatcaccgtggccagccctgctgagacagagagcaagaatggagctgagcagaccagcacagtgaagctgcccatcaaggtgaagatcatccccaccccacccaggagcaagagggtgctgtgggaccagtaccacaacctgcgctacccacctggctacttcccccgggacaacctgaggatgaagaatgaccccctggactggaatggagaccacatccacaccaacttccgggacatgtaccagcacctgcgctccatgggctactttgtggaggtgctgggcgcccccttcacctgctttgatgccagccagtatggcaccctgctgatggtggacagcgaggaggagtacttccctgaggagatcgccaagctgcggagagatgtggacaatggcctgagcctggtgatcttcagtgactggtacaacacctctgtgatgaggaaggtgaagttctatgatgagaacacccggcagtggtggatgccagacaccggcggggccaacatcccagccctgaatgagctgctgtctgtgtggaacatgggcttcagtgatggcctgtatgaaggagagttcaccctggccaaccacgacatgtactatgccagcggctgcagcatcgccaagtttcctgaagatggagtggtgatcacccagaccttcaaggaccagggcctggaggtgctgaagcaggagacagctgtggtggagaatgtgcccatcctgggcctgtaccagatcccagctgagggcggcggcagaattgtgctgtatggagacagcaactgcctggatgacagccaccggcagaaggactgcttctggctgctggatgccctgctgcagtacaccagctatggagtgaccccacccagcctgagccacagcggcaaccggcagaggcctcccagcggggccggctctgtgaccccagagaggatggagggcaaccacctgcaccgctacagcaaggtgctggaggcccacctgggggaccccaagccccggcccctgcctgcctgcccccggctgtcctgggccaagccccagcccctgaatgaaacagcccccagcaacctgtggaagcaccagaagctgctgagcattgacctggacaaggtggtgctgcccaacttccgcagcaaccggccccaggtgcggcccctgagccctggagagagcggggcctgggacatccctgggggcatcatgcctggccgctacaaccaggaggtgggccagaccatccctgtgtttgccttcctgggcgccatggtggtgctggccttctttgtggtgcagatcaacaaggccaagagccggcccaagaggaggaagccccgggtgaagaggccccagctgatgcagcaggtgcacccccccaagaccccatctgtgtag

SEQ ID NO: 159409 - DNA, 1494 bp, Artificial Sequence
  Description of Artificial Sequence: Synthetic coding sequence
atggccctggtgggcctgcccggccacctgcacttctgtgaccaggagagcggcttcctgggccgccactgcagcggcccctgccacgaccactgcggcttccccagccgggacagagtgaagaagtggtgcaggacagacttcaacagcaagctgcccatcaaggtgaagatcatccccaccccacccaggagcaagagggtgctgtgggaccagtaccacaacctgcgctacccacctggctacttcccccgggacaacctgaggatgaagaatgaccccctggactggaatggagaccacatccacaccaacttccgggacatgtaccagcacctgcgctccatgggctactttgtggaggtgctgggcgcccccttcacctgctttgatgccagccagtatggcaccctgctgatggtggacagcgaggaggagtacttccctgaggagatcgccaagctgcggagagatgtggacaatggcctgagcctggtgatcttcagtgactggtacaacacctctgtgatgaggaaggtgaagttctatgatgagaacacccggcagtggtggatgccagacacaggaggagccaacatcccagccctgaatgagctgctgtctgtgtggaacatgggcttcagtgatggcctgtatgaaggagagttcaccctggccaaccacgacatgtactatgccagcggctgcagcatcgccaagttcccagaagatggagtggtgatcacccagaccttcaaggaccagggcctggaggtgctgaagcaggagacagctgtggtggagaatgtgcccatcctgggcctgtaccagatcccagctgagggcggcggccgcatcgtgctgtatggagacagcaactgcctggatgacagccaccggcagaaggactgcttctggctgctggatgccctgctgcagtacaccagctatggagtgaccccacccagcctgagccacagcggcaaccggcagaggcctccttctggagctggctctgtgaccccagagaggatggagggcaaccacctgcaccgctacagcaaggtgctggaggcccacctgggggaccccaagccccggcccctgcctgcctgcccccggctgtcctgggccaagccccagcccctgaatgaaacagcccccagcaacctgtggaagcaccagaagctgctgagcattgacctggacaaggtggtgctgcccaacttccgcagcaaccggccccaggtgcggcccctgagccctggagagagcggggcctgggacatccctgggggcatcatgcctggccgctacaaccaggaggtgggccagaccatccctgtgtttgccttcctgggcgccatggtggtgctggccttctttgtggtgcagatcaacaaggccaagagccggcccaagaggaggaagccccgggtgaagaggccccagctgatgcagcaggtgcacccccccaagacccccagcgtgtag

SEQ ID NO: 159410 - DNA, 993 bp, Artificial Sequence
  Description of Artificial Sequence: Synthetic coding sequence
atgatccctgtgtccctggtggtggtggtggtgggcggctggacagtggtgtacctgacagacctggtgctgaagagctctgtgtacttcaagcacagctatgaggactggctggagaacaacggcctgagcatcagccccttccacatccgctggcagacagctgtgttcaacagagccttctacagctggggccgcaggaaggccaggatgctgtaccagtggttcaactttggcatggtgtttggagtgattgccatgttcagcagcttcttcctgctgggcaagaccctgatgcagaccctggcccagatgatggctgacagccccagcagctacagcagcagcagcagcagcagcagcagcagcagcagcagcagcagcagcagcagcagcagcagcagcagcctgcacaatgagcaggtgctgcaggtggtggtgcccggcatcaacctgcctgtgaaccagctgacctacttcttcaccgctgtgctgatctctggagtggtgcatgaaattggacatggaattgctgccatccgggagcaggtgcgcttcaatggatttggcatcttcctgttcatcatctacccaggggcctttgtggacctcttcaccacccacctgcagctgatcagccctgtgcagcagctgcgcatcttctgtgccggcatctggcacaactttgtgctggccctgctgggcatcctggccctggtgctgctgcctgtgatcctgctgcccttctactacacaggagtgggcgtgctgatcacagaggtggccgaggacagccctgccatcggcccccggggcctgtttgtgggggacctggtgacccacctgcaggactgccctgtgaccaacgtgcaggactggaatgaatgtctggacaccatcgcctatgagccccagatcggctactgcatcagcgccagcaccctgcagcagctgtccttccctgtgcggggcgtgtacatcagcagcatctag

SEQ ID NO: 159411 - DNA, 1560 bp, Artificial Sequence
  Description of Artificial Sequence: Synthetic coding sequence
atgatccctgtgtccctggtggtggtggtggtgggcggctggacagtggtgtacctgacagacctggtgctgaagagctctgtgtacttcaagcacagctatgaggactggctggagaacaacggcctgagcatcagccccttccacatccgctggcagacagctgtgttcaacagagccttctacagctggggccgcaggaaggccaggatgctgtaccagtggttcaactttggcatggtgtttggagtgattgccatgttcagcagcttcttcctgctgggcaagaccctgatgcagaccctggcccagatgatggctgacagccccagcagctacagcagcagcagcagcagcagcagcagcagcagcagcagcagcagcagcagcagcagcagcagcagcagcctgcacaatgagcaggtgctgcaggtggtggtgcccggcatcaacctgcctgtgaaccagctgacctacttcttcaccgctgtgctgatctctggagtggtgcatgaaattggacatggaattgctgccatccgggagcaggtgcgcttcaatggatttggcatcttcctgttcatcatctacccaggggcctttgtggacctcttcaccacccacctgcagctgatcagccctgtgcagcagctgcgcatcttctgtgccggcatctggcacaactttgtgctggccctgctgggcatcctggccctggtgctgctgcctgtgatcctgctgcccttctactacacaggagtgggcgtgctgatcacagaggtggccgaggacagccctgccatcggcccccggggcctgtttgtgggggacctggtgacccacctgcaggactgccctgtgaccaacgtgcaggactggaatgaatgtctggacaccatcgcctatgagccccagatcggctactgcatcagcgccagcaccctgcagcagctgtccttccctgtgcgggcctacaagaggctggatggcagcacagagtgctgcaacaaccacagcctgacagatgtgtgcttctcctacagaaacaacttcaacaagaggctgcacacctgcctgcctgccaggaaggctgtggaggccacccaggtgtgcaggaccaacaaggactgcaagaagagcagcagcagcagcttctgcatcatccccagcctggagacccacaccaggctcatcaaggtgaagcaccccccccagattgacatgctgtatgtgggccaccccctgcacctgcactacacagtgtccatcaccagcttcatcccccgcttcaacttcctgagcattgacctgcctgtggtggtggagacctttgtgaagtacctgatcagcctgagcggggccctggccatcgtgaatgctgtgccctgctttgccctggatggccagtggatcctgaacagcttcctggatgccaccctgaccagcgtcatcggggacaatgatgtgaaggacctgattggcttcttcatcctgctgggcggctctgtgctgctggccgccaacgtgaccctgggcctgtggatggtgacagccaggtag

SEQ ID NO: 159412 - DNA, 207 bp, Artificial Sequence
  Description of Artificial Sequence: Synthetic coding sequence
atgcaccagacctacagccgccactgcaggcctgaggagcgctggagccaggagggctggaacatcccagccaacggcttcaacatctgccgctgcctgaacatcggcatgaagctgcggctgtggaacaacctgaacaagagcaacatcctgggcgccctgaagatcaagaggcgggagatccgggcccccttcctgctgccctag

SEQ ID NO: 159413 - DNA, 762 bp, Artificial Sequence
  Description of Artificial Sequence: Synthetic coding sequence
atggtgctgctgaagctgctggaggtgtacaggaagggcagcgctggcaccttccacaagagcaccatcttcggcaacaccatcatgaccagccagcctgtgcccaatgagaccatcatcgtgctgcccagcaatgtcatcaacttcagccaggccgagaagccagagcccaccaaccagggccaggacagcctgaagaagcacctgcatgctgagatcaaggtgattggcaccatccagatcctgtgtggcatgatggtgctgagcctgggcatcatcctggccagcgccagcttcagccccaacttcacccaggtgaccagcaccctgctgaacagcgcctaccccttcatcggccccttcttcttcatcatcagcggcagcctgagcatcgccacagagaagaggctgaccaagctgctggtgcacagcagcctggtgggcagcatcctgagcgccctgagcgccctggtgggcttcatcatcctgtctgtgaagcaggccaccctgaacccagccagcctgcagtgtgagctggacaagaacaacatccccaccaggagctatgtgtcctacttctaccatgacagcctgtacaccacagactgctacacagccaaggccagcctggccggcaccctgagcctgatgctgatctgcaccctgctggagttctgcctggccgtgctgacagctgtgctgcgctggaagcaggcctacagcgacttccctggggtgtctgtgctggccggcttcacctag

SEQ ID NO: 159414 - DNA, 804 bp, Artificial Sequence
  Description of Artificial Sequence: Synthetic coding sequence
atgaaggccgaggccaccgtcatccccagccgctgtgcccggggcctgcccagctggcaggtgctgagccctgtgcagccctggcagaccagcgccccccagaacaccacccagcccaagctgctggccccccaccagcacgagaagagccagaagaagagcagcctgctgaaggagctgggcgccttccacatcaccatcgccctgctgcacctggtgtttggaggctacctggccagcatcgtgaagaacctgcacctggtggtgctgaagtcctggtaccccttctggggcgccgccagcttcctgatcagcggcatcctggccatcaccatgaagaccttcagcaagacctacctgaagatgctgtgcctgatgaccaacctgatcagcctcttctgtgtgctgagcggcctcttcgtcatcagcaaggacctcttcctggagagcccctttgagagccccatctggaggatgtaccccaacagcacagtgcacatccagaggctggagctggccctgctgtgcttcaccgtgctggagctgttcctgcctgtgcccacagctgtgacagcctggaggggggactgccccagcgccaagaatgatgatgcctgcctggtgcccaacacccccctgcacctgaagggcctgcctgtggagcccccacccagctaccagagcgtcatccagggagatgcccagcacaagcagcaccagaggctgcgggaggtgaagcaggtggccccagacacctggatcgtgacagatggagctgccatctggacccagacagccaactag

SEQ ID NO: 159415 - DNA, 804 bp, Artificial Sequence
  Description of Artificial Sequence: Synthetic coding sequence
atgatgagcagcaagcccaccagccacgccgaggtgaatgagaccatccccaacccctacccacccagcagcttcatggcccctggcttccagcagcccctgggcagcatcaacctggagaaccaggcccagggcgcccagagggcccagccctacggcatcaccagccctggcatctttgccagcagccagcccggccagggcaacatccagatgatcaaccccagcgtgggcacagctgtgatgaacttcaaggaggaggccaaggccctgggcgtcatccagatcatggtgggcctgatgcacatcggctttggaattgtgctgtgcctgatctccttctccttccgggaggtgctgggctttgccagcacagctgtgattggaggctaccccttctggggcggcctgtccttcatcatcagcggcagcctgtctgtgtctgccagcaaggagctgagccgctgcctggtgaagggcagcctgggcatgaacatcgtgagcagcatcctggccttcatcggggtcatcctgctgctggtggacatgtgcatcaacggggtggccggccaggactactgggccgtgctgagcggcaagggcatcagcgccaccctgatgatcttcagcctgctggagttctttgtggcctgtgccacagcccactttgccaaccaggccaacaccaccaccaacatgtctgtgctggtgatccccaacatgtatgagagcaaccctgtgaccccagccagcagcagcgccccaccccgctgcaacaactacagcgccaatgcccccaagtag

SEQ ID NO: 159416 - DNA, 345 bp, Artificial Sequence
  Description of Artificial Sequence: Synthetic coding sequence
atgatgagcagcaagcccaccagccacgccgaggtgaatgagaccatccccaacccctacccacccagcagcttcatggcccctggcttccagcagcccctgggcagcatcaacctggagaaccaggcccagggcgcccagagggcccagccctacggcatcaccagccctggcatctttgccagcagccagcccggccagggcaacatccagatgatcaaccccagcgtgggcacagctgtgatgaacttcaaggaggaggccaaggccctgggcgtcatccagatcatggtgggcctgatgcacatcggctttggaattgtgctgtgcctgatctccttctag

SEQ ID NO: 159417 - DNA, 666 bp, Artificial Sequence
  Description of Artificial Sequence: Synthetic coding sequence
atgatgagcagcaagcccaccagccacgccgaggtgaatgagaccatccccaacccctacccacccagcagcttcatggcccctggcttccagcagcccctgggcagcatcaacctggagaaccaggcccagggcgcccagagggcccagccctacggcatcaccagccctggcatctttgccagcagccagcccggccagggcaacatccagatgatcaaccccagcgtgggcacagctgtgatgaacttcaaggaggaggccaaggccctgggcttcatcatcagcggcagcctgtctgtgtctgccagcaaggagctgagccgctgcctggtgaagggcagcctgggcatgaacatcgtgagcagcatcctggccttcatcggggtcatcctgctgctggtggacatgtgcatcaacggggtggccggccaggactactgggccgtgctgagcggcaagggcatcagcgccaccctgatgatcttcagcctgctggagttctttgtggcctgtgccacagcccactttgccaaccaggccaacaccaccaccaacatgtctgtgctggtgatccccaacatgtatgagagcaaccctgtgaccccagccagcagcagcgccccaccccgctgcaacaactacagcgccaatgcccccaagtag

SEQ ID NO: 159418 - DNA, 972 bp, Artificial Sequence
  Description of Artificial Sequence: Synthetic coding sequence
atgacagagcaggtgattggagccaacagcgtgcccggcatcatcgccccagacaacgtgcacgtgatccagcccagcaaccctgtggccagcggcaaccacctgcagcccagcgaggtgaccacctaccccatcagccccaaggtgatccactgtgacaccggccgggccaacctgcagaacctgctggtggtgaaccagaacagcgctgctggggtgcagagccagcccatcggctaccagaggcagtaccctgtgggcacagccagcctgcagacagtgcctggggtcatccagtacacccagggcaccaccaacctgcagacctggccaggggacctgcagaaccccctgaatgccaaccctggcctgacccacaccagcaacagcagccagtggaacaccagctttgccagcttcaccagcttcaaccccaagaagttcatcaatgaggaggtgaggaccctgggcgccatccagatcctgattggcctgacccacatcttcagcgccatcaaccctgtgctgtactactacccctttgtgacctggctgagcggctaccccctgtggggcggcctgagctacatcgtgtctggcagcctgtctgtgtgggccgccaaggaccccagcccctgtgtggtgaacagcagcatctccttcaacatcatcagcgccctgtttgcctttgctggcatcttcatcatcatcacagacctgagcctgtactacgtgaccacctacagcaaggctgtgtctgggggcctgctgccctttgccctgctggagttcatcctgacctgtgtggtgagccacttcggctgccaggccacctgctgccggcagtttgaaaatgtggccgtcatccccaccgtcttctccttcaacccagccaacaccaccaccagccctgtgaatgccaccactggacctgtgaatgctgccaccggccctgtgtctgccaccaactag

SEQ ID NO: 159419 - DNA, 735 bp, Artificial Sequence
  Description of Artificial Sequence: Synthetic coding sequence
atggacacagagagcaacagaagagccaacctggccctgccccaggagcccagctctgtgcctgcctttgaggtgctggagatcagcccccaggaggtgagcagcggccgcctgctgaagagcgccagcagcccccccctgcacacctggctgactgtgctgaagaaggagcaggagttcctgggcgtgacccagatcctgacagccatgatctgcctgtgctttggaacagtggtgtgcagcgtgctggacatcagccacatcgagggggacatcttcagcagcttcaaggccggctaccccttctggggcgccatcttcttcagcatcagcggcatgctgagcatcatcagcgagaggagaaatgccacctacctggtgcggggcagcctgggcgccaacacagccagcagcattgctgggggcaccggcatcaccatcctgatcatcaacctgaagaagagcctggcctacatccacatccacagctgccagaagttctttgagaccaagtgcttcatggccagcttcagcacagaaattgtggtgatgatgctgttcctgaccatcctgggcctgggcagcgctgtgtccctgaccatctgtggggccggggaggagctgaagggcaacaaggtgcctgaagatagagtgtatgaggagctgaacatctacagcgccacctacagcgagctggaggaccctggagagatgagcccccccatcgacctgtag

SEQ ID NO: 159420 - DNA, 126 bp, Artificial Sequence
  Description of Artificial Sequence: Synthetic coding sequence
atggacacagagagcaacagaagagccaacctggccctgccccaggagcccagctctgtgcctgcctttgaggtgctggagatcagcccccaggaggtgagcagcggccgcctgctgaagagctag

SEQ ID NO: 159421 - DNA, 645 bp, Artificial Sequence
  Description of Artificial Sequence: Synthetic coding sequence
atggccagccatgaggtggacaatgctgagctgggcagcgccagcgcccacggcaccccaggcagcgaggccggccctgaggagctgaacacctctgtgtaccagcccattgatggcagcccagactaccagaaggccaagctgcaggtgctgggcgccatccagatcctgaatgctgccatgatcctggccctgggcgtcttcctgggcagcctgcagtacccctaccacttccagaagcacttcttcttcttcaccttctacacaggctaccccatctggggcgctgtgttcttctgcagcagcggcaccctgtctgtggtggccggcatcaagcccaccaggacctggatccagaacagctttggcatgaacatcgccagcgccaccatcgccctggtgggcacagccttcctgagcctgaacattgctgtgaacatccagagcctgcggagctgccacagcagcagcgagagcccagacctgtgcaactacatgggcagcatcagcaatggcatggtgtccctgctgctgatcctgaccctgctggagctgtgtgtgaccatcagcaccatcgccatgtggtgcaatgccaactgctgcaacagccgggaggagatcagcagcccccccaacagcgtgtag

SEQ ID NO: 159422 - DNA, 507 bp, Artificial Sequence
  Description of Artificial Sequence: Synthetic coding sequence
atggccagccatgaggtggacaatgctgagctgggcagcgccagcgcccacggcaccccaggcagcgaggccggccctgaggagctgaacacctctgtgtaccagcccattgatggcagcccagactaccagaaggccaagctgcaggtgctgggcttctgcagcagcggcaccctgtctgtggtggccggcatcaagcccaccaggacctggatccagaacagctttggcatgaacatcgccagcgccaccatcgccctggtgggcacagccttcctgagcctgaacattgctgtgaacatccagagcctgcggagctgccacagcagcagcgagagcccagacctgtgcaactacatgggcagcatcagcaatggcatggtgtccctgctgctgatcctgaccctgctggagctgtgtgtgaccatcagcaccatcgccatgtggtgcaatgccaactgctgcaacagccgggaggagatcagcagcccccccaacagcgtgtag

SEQ ID NO: 159423 - DNA, 276 bp, Artificial Sequence
  Description of Artificial Sequence: Synthetic coding sequence
atgaacatcgccagcgccaccatcgccctggtgggcacagccttcctgagcctgaacattgctgtgaacatccagagcctgcggagctgccacagcagcagcgagagcccagacctgtgcaactacatgggcagcatcagcaatggcatggtgtccctgctgctgatcctgaccctgctggagctgtgtgtgaccatcagcaccatcgccatgtggtgcaatgccaactgctgcaacagccgggaggagatcagcagcccccccaacagcgtgtag

SEQ ID NO: 159424 - DNA, 507 bp, Artificial Sequence; identical to SEQ ID NO: 159422
  Description of Artificial Sequence: Synthetic coding sequence

SEQ ID NO: 159425 - DNA, 720 bp, Artificial Sequence
  Description of Artificial Sequence: Synthetic coding sequence
atgcaccagacctacagccgccactgcaggcctgaggagagcaccttctctgctgccatgaccaccatgcagggcatggagcaggccatgcctggagctggccctggggtgccccagctgggcaacatggccgtcatccacagccacctgtggaagggcctgcaggagaagttcctgaagggggagcccaaggtgctgggcgtggtgcagatcctgacagccctgatgagcctgtccatgggcatcaccatgatgtgcatggccagcaacacctacggcagcaaccccatctctgtgtacatcggctacaccatctggggctctgtgatgttcatcatcagcggcagcctgagcattgctgctggcatccgcaccaccaagggcctggtgcggggcagcctgggcatgaacatcaccagctctgtgctggccgccagcggcatcctgatcaacaccttcagcctggccttctacagcttccaccacccctactgcaactactacggcaacagcaacaactgccacggcaccatgagcatcctgatgggcctggatggcatggtgctgctgctgtctgtgctggagttctgcatcgctgtgtccctgagcgccttcggctgcaaggtgctgtgctgcacccctgggggcgtggtgctgatcctgcccagccacagccacatggccgagacagccagccccacccccctgaatgaggtgtag

SEQ ID NO: 159426 - DNA, 663 bp, Artificial Sequence
  Description of Artificial Sequence: Synthetic coding sequence
atgaccaccatgcagggcatggagcaggccatgcctggggccggccctggggtgccccagctgggcaacatggctgtgatccacagccacctgtggaagggcctgcaggagaagttcctgaagggggagcccaaggtgctgggcgtggtgcagatcctgacagccctgatgagcctgtccatgggcatcaccatgatgtgcatggccagcaacacctacggcagcaaccccatctctgtgtacatcggctacaccatctggggctctgtgatgttcatcatcagcggcagcctgagcattgctgctggcatccgcaccaccaagggcctggtgcggggcagcctgggcatgaacatcaccagctctgtgctggccgccagcggcatcctgatcaacaccttcagcctggccttctacagcttccaccacccctactgcaactactacggcaacagcaacaactgccacggcaccatgagcatcctgatgggcctggatggcatggtgctgctgctgtctgtgctggagttctgcatcgctgtgtccctgagcgccttcggctgcaaggtgctgtgctgcaccccaggaggagtggtgctgatcctgcccagccacagccacatggccgagacagccagccccacccccctgaatgaggtgtag

SEQ ID NO: 159427 - DNA, 663 bp, Artificial Sequence; identical to SEQ ID NO: 159426
  Description of Artificial Sequence: Synthetic coding sequence

SEQ ID NO: 159428 - DNA, 561 bp, Artificial Sequence
  Description of Artificial Sequence: Synthetic coding sequence
atgcaccagacctacagccgccactgcaggcctgaggagagcaccttctctgctgccatgaccaccatgcagggcatggagcaggccatgcctggagctggccctggggtgccccagctgggcaacatggccgtcatccacagccacctgtggaagggcctgcaggagaagttcctgaagggggagcccaaggtgctgggcgtggtgcagatcctgacagccctgatgagcctgtccatgggcatcaccatgatgtgcatggccagcaacacctacggcagcaaccccatctctgtgtacatcggctacaccatctggggctctgtgatgttcatcatcagcggcagcctgagcattgctgctggcatccgcaccaccaagggcctgggcctggatggcatggtgctgctgctgtctgtgctggagttctgcatcgctgtgtccctgagcgccttcggctgcaaggtgctgtgctgcaccccaggaggagtggtgctgatcctgcccagccacagccacatggccgagacagccagccccacccccctgaatgaggtgtag

SEQ ID NO: 159429 - DNA, 399 bp, Artificial Sequence
  Description of Artificial Sequence: Synthetic coding sequence
atgaccaccatgcagggcatggagcagaccacccctggggccggcccagatgtgccccagctgggcaacattgatgtgatccacagctacctgtgcaagggcctgcaggagaagttcttcaagaggaagcccaaggtgctgggcgtggtgcgcatcctgattgccctgatgagcctgtccatgggcatcatcatgatgtgtgtggccttcagcagctatgaggagcaccccatctttgtgtatgtggcctacaccatctggggctctgtgatgtacccctaccagctgcagcaggagctggagcagcagaaggtgtggaactacctgaagaacctgtcctggaggatcatgggcagctacctgtgctttggagagaggtctgagctgaagcccctgtag

SEQ ID NO: 159430 - DNA, 333 bp, Artificial Sequence
  Description of Artificial Sequence: Synthetic coding sequence
atgaccaccatgcagggcatggagcagaccacccctggggccggcccagatgtgccccagctgggcaacattgatgtgatccacagctacctgtgcaagggcctgcaggagaagttcttcaagaggaagcccaaggtgctgggcgtgctgtgtggccacaagttcagcacccacagcgtgtccctgtctgtggccgccggcatccgcaccaccaagggcctggagctgtctgaggagttcaagctggagaacaacggcatcatctttgtgttctggagggagatccgggtggagaccaccatccggcggcaggtgcggcggctgctgaagtag

SEQ ID NO: 159431 - DNA, 615 bp, Artificial Sequence
  Description of Artificial Sequence: Synthetic coding sequence
atgagctacatccacatctgtgtgaaggactgcaagaggagcagcagccggggcaaccccaagagcctgggcttctgtgtggacatctccttccagctgatccgggtggtgcgcatcctgattgccctgatgagcctgtccatgggcatcatcatgatgtgtgtggccttcagcagctatgaggagcaccccatctttgtgtatgtggcctacaccatctggggctctgtgatgtacccctaccagctgcagcaggagctggagcagcagaaggtgtgcatctacagagtgctgaatggagcccaggccggcgtgcagtggagggacctgggcagcctgcagcccccaccacccagccggctgccctggccacccaaggtgccccgggtgcagcccctgcccggccgccaccctgtgtgggaggtgcgctctgtgtctgcctggccacccatcgtgtgggatgtgcgcagccccagcgcctggctgcccagcctggagagcgaggagcggctgtgcccagctgccatccccagcaggaagtggggcgcccccctgcccggccaccaccccatctgggaggtgcgctctgtgtctgcccggccccccatcttctag

SEQ ID NO: 159432 - DNA, 399 bp, Artificial Sequence; identical to SEQ ID NO: 159429
  Description of Artificial Sequence: Synthetic coding sequence

SEQ ID NO: 159433 - DNA, 603 bp, Artificial Sequence
  Description of Artificial Sequence: Synthetic coding sequence
atggacagcagcacagcccacagccctgtgttcctggtgtttcctcctgagatcacagcctctgaatatgagagcacagagctgagcgccaccaccttcagcacccagagccccctgcagaagctgtttgccaggaagatgaagatcctgggcaccatccagatcctgtttggcatcatgaccttctcctttggagtcatcttcctgttcaccctgctgaagccctacccccgcttccccttcatcttcctgagcggctaccccttctggggctctgtgctcttcatcaacagcggggccttcctgattgctgtgaagaggaagaccacagagaccctcatcatcctgagccgcatcatgaacttcctgagcgccctgggcgccatcgccggcatcatcctgctgaccttcggcttcatcctggaccagaactacatctgtggctacagccaccagaacagccagtgcaaggctgtgacagtgctcttcctgggcatcctgatcaccctgatgaccttcagcatcatcgagctgttcatcagcctgcccttcagcatcctgggctgccacagcgaggactgtgactgtgagcagtgctgctag

SEQ ID NO: 159434 - DNA, 747 bp, Artificial Sequence
  Description of Artificial Sequence: Synthetic coding sequence
atgaccagccagcctgtgcccaatgagaccatcatcgtgctgcccagcaatgtcatcaacttcagccaggccgagaagccagagcccaccaaccagggccaggacagcctgaagaagcacctgcatgctgagatcaaggtgattggcaccatccagatcctgtgtggcatgatggtgctgagcctgggcatcatcctggccagcgccagcttcagccccaacttcacccaggtgaccagcaccctgctgaacagcgcctaccccttcatcggccccttcttcttcatcatcagcggcagcctgagcatcgccacagagaagaggctgaccaagctgctggtgcacagcagcctggtgggcagcatcctgagcgccctgagcgccctggtgggcttcatcatcctgtctgtgaagcaggccaccctgaacccagccagcctgcagtgtgagctggacaagaacaacatccccaccaggagctatgtgtcctacttctaccatgacagcctgtacaccacagactgctacacagccaaggccagcctggccggcaccctgagcctgatgctgatctgcaccctgctggagttctgcctggccgtgctgacagctgtgctgcgctggaagcaggcctacagcgacttccctggctctgtgctcttcctgccccacagctacatcggcaacagcggcatgagcagcaagatgacccatgactgtggctatgaggagctgctgaccagctag

SEQ ID NO: 159435 - DNA, 537 bp, Artificial Sequence
  Description of Artificial Sequence: Synthetic coding sequence
atgaccagccagcctgtgcccaatgagaccatcatcgtgctgcccagcaatgtcatcaacttcagccaggccgagaagccagagcccaccaaccagggccaggacagcctgaagaagcacctgcatgctgagatcaaggtgattggcaccatccagatcctgtgtggcatgatggtgctgagcctgggcatcatcctggccagcgccagcttcagccccaacttcacccaggtgaccagcaccctgctgaacagcgcctaccccttcatcggccccttcttcttcatcatcagcggcagcctgagcatcgccacagagaagaggctgaccaagctgctggtgcacagcagcctggtgggcagcatcctgagcgccctgagcgccctggtgggcttcatcatcctgtctgtgaagcaggccaccctgaacccagccagcctgcagtggaacagcctgagtgatgctgacctgcacagcgctggcatcctgcccagctgtgcccactgctgtgccgctgtggagaccggcctgctgtag

SEQ ID NO: 159436 - DNA, 543 bp, Artificial Sequence
  Description of Artificial Sequence: Synthetic coding sequence
atgaccagccagcctgtgcccaatgagaccatcatcgtgctgcccagcaatgtcatcaacttcagccaggccgagaagccagagcccaccaaccagggccaggacagcctgaagaagcacctgcatgctgagatcaaggtgattggcttcatcatcagcggcagcctgagcatcgccacagagaagaggctgaccaagctgctggtgcacagcagcctggtgggcagcatcctgagcgccctgagcgccctggtgggcttcatcatcctgtctgtgaagcaggccaccctgaacccagccagcctgcagtgtgagctggacaagaacaacatccccaccaggagctatgtgtcctacttctaccatgacagcctgtacaccacagactgctacacagccaaggccagcctggccggcaccctgagcctgatgctgatctgcaccctgctggagttctgcctggccgtgctgacagctgtgctgcgctggaagcaggcctacagcgacttccctggggtgtctgtgctggccggcttcacctag

SEQ ID NO: 159437 - DNA, 678 bp, Artificial Sequence
  Description of Artificial Sequence: Synthetic coding sequence
atgaccagccagcctgtgcccaatgagaccatcatcgtgctgcccagcaatgtcatcaacttcagccaggccgagaagccagagcccaccaaccagggccaggacagcctgaagaagcacctgcatgctgagatcaaggtgattggcaccatccagatcctgtgtggcatgatggtgctgagcctgggcatcatcctggccagcgccagcttcagccccaacttcacccaggtgaccagcaccctgctgaacagcgcctaccccttcatcggccccttcttcttcatcatcagcggcagcctgagcatcgccacagagaagaggctgaccaagctgctggtgcacagcagcctggtgggcagcatcctgagcgccctgagcgccctggtgggcttcatcatcctgtctgtgaagcaggccaccctgaacccagccagcctgcagtgtgagctggacaagaacaacatccccaccaggagctatgtgtcctacttctaccatgacagcctgtacaccacagactgctacacagccaaggccagcctggccggcaccctgagcctgatgctgatctgcaccctgctggagttctgcctggccgtgctgacagctgtgctgcgctggaagcaggcctacagcgacttccctggggtgtctgtgctggccggcttcacctag

SEQ ID NO: 159438 - DNA, 831 bp, Artificial Sequence
  Description of Artificial Sequence: Synthetic coding sequence
atggtgctgctgaagctgctggaggtgtacaggaagggcagcgctggcaccttccacaagagcaccatcttcggcaacaccatcatgaccagccagcctgtgcccaatgagaccatcatcgtgctgcccagcaatgtcatcaacttcagccaggccgagaagccagagcccaccaaccagggccaggacagcctgaagaagcacctgcatgctgagatcaaggtgattggcaccatccagatcctgtgtggcatgatggtgctgagcctgggcatcatcctggccagcgccagcttcagccccaacttcacccaggtgaccagcaccctgctgaacagcgcctaccccttcatcggccccttcttcttcatcatcagcggcagcctgagcatcgccacagagaagaggctgaccaagctgctggtgcacagcagcctggtgggcagcatcctgagcgccctgagcgccctggtgggcttcatcatcctgtctgtgaagcaggccaccctgaacccagccagcctgcagtgtgagctggacaagaacaacatccccaccaggagctatgtgtcctacttctaccatgacagcctgtacaccacagactgctacacagccaaggccagcctggccggcaccctgagcctgatgctgatctgcaccctgctggagttctgcctggccgtgctgacagctgtgctgcgctggaagcaggcctacagcgacttccctggctctgtgctcttcctgccccacagctacatcggcaacagcggcatgagcagcaagatgacccatgactgtggctatgaggagctgctgaccagctag

SEQ ID NO: 159439 - DNA, 747 bp, Artificial Sequence; identical to SEQ ID NO: 159434
  Description of Artificial Sequence: Synthetic coding sequence

SEQ ID NO: 159440 - DNA, 72 bp, Artificial Sequence
  Description of Artificial Sequence: Synthetic coding sequence
atgaccagccagcctgtgcccaatgagaccatcatcgtgctgcccagcaatgtcatcaacttcagccagtag

SEQ ID NO: 159441 - DNA, 444 bp, Artificial Sequence
  Description of Artificial Sequence: Synthetic coding sequence
atgaccagccagcccatcagcaatgagaccatcatcatgctgcccagcaatgtcatcaacttcagccaggccgagaagccagagcccaccaaccagggccaggacagcctgaagaagaggctgcaggccaaggtgaaggtgattggagtgcacagcagcctggccggcagcatcctgagcgccctgagcgccctggtgggcttcatcctgctgtctgtgaacccagctgccctgaacccagccagcctgcagtgcaagctggatgagaaggacatccccacccggctgctgctgtcctatgactaccacagcccctacaccatggactgccaccgggccaaggccagcctggccggcaccctgagcctgatgctggtgtccacagtgctggagttctgcctggccgtgctgacagctgtgctgcagtggaagcagacagtgtag

SEQ ID NO: 159442 - DNA, 723 bp, Artificial Sequence
  Description of Artificial Sequence: Synthetic coding sequence
atgctgctgcagagccagaccatgggcgtgagccacagcttcacccccaagggcatcaccatcccccagcgggagaagccaggccacatgtaccagaatgaagactacctgcagaatggcctgcccacagagaccaccgtgctgggcaccgtgcagatcctgtgctgcctgctgatcagcagcctgggcgccatcctggtgtttgccccctaccccagccacttcaacccagccatcagcaccaccctgatgagcggctaccccttcctgggcgccctgtgcttcggcatcaccggcagcctgagcatcatcagcggcaagcagagcaccaagccctttgacctgagcagcctgaccagcaatgctgtgtcctctgtgacagctggggccggcctcttcctgctggccgacagcatggtggccctgaggacagccagccagcactgcggcagcgagatggactacctgagcagcctgccctacagcgagtactactaccccatctatgagatcaaggactgcctgctgacctctgtgtccctgactggagtgctggtggtgatgctgatcttcaccgtgctggagctgctgctggccgcctacagctctgtgttctggtggaagcagctgtacagcaacaaccctggcagcagcttcagcagcacccagagccaggaccacatccagcaggtgaagaagagcagcagccgctcctggatctag

SEQ ID NO: 159443 - DNA, 588 bp, Artificial Sequence
  Description of Artificial Sequence: Synthetic coding sequence
atgctgctgcagagccagaccatgggcgtgagccacagcttcacccccaagggcatcaccatcccccagcgggagaagccaggccacatgtaccagaatgaagactacctgcagaatggcctgcccacagagaccaccgtgctgggcttcggcatcaccggcagcctgagcatcatcagcggcaagcagagcaccaagccctttgacctgagcagcctgaccagcaatgctgtgtcctctgtgacagctggagctggcctcttcctgctggccgacagcatggtggccctgaggacagccagccagcactgcggcagcgagatggactacctgagcagcctgccctacagcgagtactactaccccatctatgagatcaaggactgcctgctgacctctgtgtccctgactggagtgctggtggtgatgctgatcttcaccgtgctggagctgctgctggccgcctacagcagcgtcttctggtggaagcagctgtacagcaacaaccctggcagcagcttcagcagcacccagagccaggaccacatccagcaggtgaagaagagcagcagccgctcctggatctag

SEQ ID NO: 159444 - DNA, 510 bp, Artificial Sequence
  Description of Artificial Sequence: Synthetic coding sequence
atgctgctgcagagccagaccatgggcgtgagccacagcttcacccccaagggcatcaccatcccccagcgggagaagccaggccacatgtaccagaatgaagactacctgcagaatggcctgcccacagagaccaccgtgctgggcttcggcatcaccggcagcctgagcatcatcagcggcaagcagagcaccaagccctttgacctgagcagcctgaccagcaatgctgtgtcctctgtgacagctggagctggcctcttcctgctggccgacagcatggtggccctgaggacagccagccagcactgcggcagcgagatggactacctgagcagcctgccctacagcgagtactactaccccatctatgagatcaaggactgcctgctgacctctgtgtccctgactggagtgctggtggtgatgctgatcttcaccgtgctggagctgctgctggccgcctacagcagcgtcttctggtggaagcagctgtacagcaacaactag

SEQ ID NO: 159445 - DNA, 588 bp, Artificial Sequence; identical to SEQ ID NO: 159443
  Description of Artificial Sequence: Synthetic coding sequence

SEQ ID NO: 159446 - DNA, 753 bp, Artificial Sequence
  Description of Artificial Sequence: Synthetic coding sequence
atgaacagcatgaccagcgctgtgcctgtggccaacagcgtgctggtggtggccccccacaacggctaccctgtgaccccaggcatcatgagccacgtgcccctgtaccccaacagccagccccaggtgcacctggtgcccggcaacccccccagcctggtgtccaatgtgaatggccagcctgtgcagaaggccctgaaggagggcaagaccctgggcgccatccagatcatcatcggcctggcccacatcggcctgggcagcatcatggccaccgtgctggtgggggagtacctgagcatctccttctacggcggcttccccttctggggcggcctgtggttcatcatcagcggcagcctgtctgtggccgctgagaaccagccctacagctactgcctgctgagcggcagcctgggcctgaacatcgtgtctgccatctgcagcgctgtgggcgtcatcctcttcatcacagacctgagcatcccccacccctatgcctacccagactactacccctatgcctggggcgtgaaccctggcatggccatctctggagtgctgctggtgttctgcctgctggagtttggcatcgcctgtgccagcagccacttcggctgccagctggtgtgctgccagagcagcaatgtgtctgtcatctaccccaacatctatgctgccaaccctgtgatcaccccagagcctgtgaccagccccccatcctacagcagcgagatccaggccaacaagtag

SEQ ID NO: 159447 - DNA, 2550 bp, Artificial Sequence
  Description of Artificial Sequence: Synthetic coding sequence
atggtgcagaaggagagccaggccaccctggaggagcgggagagcgagctgagcagcaacccagctgccagcgctggggccagcctggagcccccagctgccccagcccctggagaggacaacccagctggagctggaggagctgctgtggccggggccgccggcggggcccggcgcttcctgtgtggggtggtggagggcttctacggccggccctgggtgatggagcagaggaaggagctgttccggcggctgcagaagtgggagctgaacacctacctgtatgcccccaaggatgactacaagcacaggatgttctggagggagatgtacagcgtggaggaggccgagcagctgatgaccctcatctctgctgcccgggagtatgaaattgagttcatctatgccatcagccctggcctggacatcaccttcagcaaccccaaggaggtgtccaccctgaagaggaagctggaccaggtgtcccagtttggctgccgcagctttgccctgctgtttgatgacatcgaccacaacatgtgtgccgctgacaaggaggtgttcagcagctttgcccacgcccaggtgtccatcaccaatgagatctaccagtacctgggggagcctgagaccttcctgttctgccccacagagtactgcggcaccttctgctacccaaatgtgtcccagagcccctacctgaggacagtgggggagaagctgctgcccggcatcgaggtgctgtggacaggccccaaggtggtgtccaaggagatccctgtggagagcattgaggaggtgtccaagatcatcaagagggcccctgtgatctgggacaacatccacgccaatgactatgaccagaagaggctcttcctgggcccctacaagggccgcagcacagagctgatcccccggctgaagggcgtgctgaccaaccccaactgtgaatttgaggccaactacgtggccatccacaccctggccacctggtacaagagcaacatgaatggagtgaggaaggatgtggtgatgagccggcaggtggcccacagcggggccaaggcctctgtggtggatggcacccccctggtggccgcccccagcctgaatgccaccaccgtggtgaccaccgtgtaccaggagcccatcatgagccagggcgccgccctgagcggggagcccaccaccctgaccaaggaggaggagaagaagcagccagatgaggagcccatggacatggtggtggagaagcaggaggagacagaccacaagaatgacaaccagatcctgtctgagatcgtggaggccaagatggccgaggagctgaagcccatggacacagacaaggagagcattgctgagagcaagagccctgagatgtccatgcaggaggactgcatcagtgacatcgcccccatgcagacagatgagcagaccaacaaggagcagtttgtgcccggccccaatgagaagcccctgtacacagctgagcctgtgaccctggaggacctgcagctgctggccgacctcttctacctgccctatgagcacggccccaagggggcccagatgctgcgggagttccagtggctgcgggccaacagctctgtggtgtctgtgaactgcaagggcaaggacagcgagaagattgaggagtggaggagccgggccgccaagtttgaggagatgtgtggcctggtgatgggcatgttcacccggctgagcaactgtgccaacagaaccatcctgtatgacatgtacagctatgtgtgggacatcaagagcatcatgtccatggtgaagagctttgtgcagtggctgggctgccgcagccacagcagcgcccagttcctgattggagaccaggagccctgggccttccggggcggcctggccggggagttccagcccccacccctgacccccaccagcaaggtgtacaccatccggccctacttccccaaggatgaggcctctgtgtacaagatctgccgggagatgtatgatgatggagtgggcctgcccttccagagccagcctgacctgattggagacaagctggtgggcggcctgctgagcctgagcctggactactgctttgtgctggaggatgaagatggcatctgtggctacgccctgggcaccgtggatgtgacccccttcatcaagaagtgcaagatctcctggatccccttcatgcaggagaagtacaccaagcccaacggggacaaggagctgtctgaggccgagaagatcatgctgtccttccacgaggagcaggaggtgctgcctgagaccttcctggccaacttccccagcctcatcaagatggacatccacaagaaggtgacagaccccagcgtggccaagtccatgatggcctgcctgctgagcagcctgaaggccaacggcagcagaggagccttctgtgaggtgcggccagatgacaagaggatcctggagttctacagcaagctgggctgctttgagatcgccaagatggagggcttccccaaggatgtggtgatcctgggccgcagcctgtag

SEQ ID NO: 159448 - DNA, 2751 bp, Artificial Sequence
  Description of Artificial Sequence: Synthetic coding sequence
atggtgcagaaggagagccaggccaccctggaggagcgggagagcgagctgagcagcaacccagctgccagcgctggggccagcctggagcccccagctgccccagcccctggagaggacaacccagctggagctggaggagctgctgtggccggggccgccggcggggcccggcgcttcctgtgtggggtggtggagggcttctacggccggccctgggtgatggagcagaggaaggagctgttccggcggctgcagaagtgggagctgaacacctacctgtatgcccccaaggatgactacaagcacaggatgttctggagggagatgtacagcgtggaggaggccgagcagctgatgaccctcatctctgctgcccgggagtatgaaattgagttcatctatgccatcagccctggcctggacatcaccttcagcaaccccaaggaggtgtccaccctgaagaggaagctggaccaggtgtcccagtttggctgccgcagctttgccctgctgtttgatgacatcgaccacaacatgtgtgccgctgacaaggaggtgttcagcagctttgcccacgcccaggtgtccatcaccaatgagatctaccagtacctgggggagcctgagaccttcctgttctgccccacagagtactgcggcaccttctgctacccaaatgtgtcccagagcccctacctgaggacagtgggggagaagctgctgcccggcatcgaggtgctgtggacaggccccaaggtggtgtccaaggagatccctgtggagagcattgaggaggtgtccaagatcatcaagagggcccctgtgatctgggacaacatccacgccaatgactatgaccagaagaggctcttcctgggcccctacaagggccgcagcacagagctgatcccccggctgaagggcgtgctgaccaaccccaactgtgaatttgaggccaactacgtggccatccacaccctggccacctggtacaagagcaacatgaatggagtgaggaaggatgtggtgatgacagacagcgaggacagcacagtgtccatccagatcaagctggagaatgaaggaagtgatgaggacatcgagacagatgtgctgtacagcccccagatggccctgaagctggccctgacagagtggctgcaggagtttggagtgccccaccagtacagcagccggcaggtggcccacagcggggccaaggcctctgtggtggatggcacccccctggtggccgcccccagcctgaatgccaccaccgtggtgaccaccgtgtaccaggagcccatcatgagccagggcgccgccctgtctggagagcccaccaccctgaccaaggaggaggagaagaagcagccagatgaggagcccatggacatggtggtggagaagcaggaggagacagaccacaagaatgacaaccagatcctgtctgaaattgtggaggccaagatggccgaggagctgaagcccatggacacagacaaggagagcattgctgagagcaagagccctgagatgtccatgcaggaggactgcatcagtgacatcgcccccatgcagacagatgagcagaccaacaaggagcagtttgtgcccggccccaatgagaagcccctgtacacagctgagcctgtgaccctggaggacctgcagctgctggccgacctcttctacctgccctatgaacatggccccaagggggcccagatgctgcgggagttccagtggctgcgggccaacagctctgtggtgtctgtgaactgcaagggcaaggacagcgagaagattgaggagtggaggagcagagctgccaagtttgaggagatgtgtggcctggtgatgggcatgttcacccggctgagcaactgtgccaacagaaccatcctgtatgacatgtacagctatgtgtgggacatcaagagcatcatgtccatggtgaagagctttgtgcagtggctgggctgccgcagccacagcagcgcccagttcctgattggagaccaggagccctgggccttccggggcggcctggccggggagttccagaggctgctgcccattgatggagccaatgacctcttcttccagcccccacccctgacccccaccagcaaggtgtacaccatccggccctacttccccaaggatgaggcctctgtgtacaagatctgccgggagatgtatgatgatggagtgggcctgcccttccagagccagcctgacctgattggagacaagctggtgggcggcctgctgagcctgagcctggactactgctttgtgctggaggatgaagatggcatctgtggctacgccctgggcaccgtggatgtgacccccttcatcaagaagtgcaagatctcctggatccccttcatgcaggagaagtacaccaagcccaatggagacaaggagctgtctgaggccgagaagatcatgctgtccttccacgaggagcaggaggtgctgcctgagaccttcctggccaacttccccagcctcatcaagatggacatccacaagaaggtgacagaccccagcgtggccaagtccatgatggcctgcctgctgagcagcctgaaggccaacggcagcagaggagccttctgtgaggtgcggccagatgacaagaggatcctggagttctacagcaagctgggctgctttgaaattgccaagatggagggcttccccaaggatgtggtgatcctgggccgcagcctgtag

SEQ ID NO: 159449 - DNA, 2034 bp, Artificial Sequence
  Description of Artificial Sequence: Synthetic coding sequence
atggtgcagaaggagagccaggccaccctggaggagcgggagagcgagctgagcagcaacccagctgccagcgctggggccagcctggagcccccagctgccccagcccctggagaggacaacccagctggagctggaggagctgctgtggccggggccgccggcggggcccggcgcttcctgtgtggggtggtggagggcttctacggccggccctgggtgatggagcagaggaaggagctgttccggcggctgcagaagtgggagctgaacacctacctgtatgcccccaaggatgactacaagcacaggatgttctggagggagatgtacagcgtggaggaggccgagcagctgatgaccctcatctctgctgcccgggagtatgaaattgagttcatctatgccatcagccctggcctggacatcaccttcagcaaccccaaggaggtgtccaccctgaagaggaagctggaccaggtgtcccagtttggctgccgcagctttgccctgctgtttgatgacatcgaccacaacatgtgtgccgctgacaaggaggtgttcagcagctttgcccacgcccaggtgtccatcaccaatgagatctaccagtacctgggggagcctgagaccttcctgttctgccccacagagtactgcggcaccttctgctacccaaatgtgtcccagagcccctacctgaggacagtgggggagaagctgctgcccggcatcgaggtgctgtggacaggccccaaggtggtgtccaaggagatccctgtggagagcattgaggaggtgtccaagatcatcaagagggcccctgtgatctgggacaacatccacgccaatgactatgaccagaagaggctcttcctgggcccctacaagggccgcagcacagagctgatcccccggctgaagggcgtgctgaccaaccccaactgtgaatttgaggccaactacgtggccatccacaccctggccacctggtacaagagcaacatgaatggagtgaggaaggatgtggtgatgacagacagcgaggacagcacagtgtccatccagatcaagctggagaatgaaggaagtgatgaggacatcgagacagatgtgctgtacagcccccagatggccctgaagctggccctgacagagtggctgcaggagtttggagtgccccaccagtacagcagccggcaggtggcccacagcggggccaaggcctctgtggtggatggcacccccctggtggccgcccccagcctgaatgccaccaccgtggtgaccaccgtgtaccaggagcccatcatgagccagggcgccgccctgtctggagagcccaccaccctgaccaaggaggaggagaagaagcagccagatgaggagcccatggacatggtggtggagaagcaggaggagacagaccacaagaatgacaaccagatcctgtctgaaattgtggaggccaagatggccgaggagctgaagcccatggacacagacaaggagagcattgctgagagcaagagccctgagatgtccatgcaggaggactgcatcagtgacatcgcccccatgcagacagatgagcagaccaacaaggagcagtttgtgcccggccccaatgagaagcccctgtacacagctgagcctgtgaccctggaggacctgcagctgctggccgacctcttctacctgccctatgaacatggccccaagggggcccagatgctgcgggagttccagtggctgcgggccaacagctctgtggtgtctgtgaactgcaagggcaaggacagcgagaagattgaggagtggaggagcagagctgccaagtttgaggagatgtgtggcctggtgatgggcatgttcacccggctgagcaactgtgccaacagaaccatcctgtatgacatgtacagctatgtgtgggacatcaagagcatcatgtccatggtgaagagctttgtgcagtggctgggccgctgcaccaggaacaacctcttcagcagcaacatcctgagcctgtag

SEQ ID NO: 159450 - DNA, 456 bp, Artificial Sequence
  Description of Artificial Sequence: Synthetic coding sequence
atggtgcagaaggagagccaggccaccctggaggagcgggagagcgagctgagcagcaacccagctgccagcgctggggccagcctggagcccccagctgccccagcccctggagaggacaacccagctggagctggaggagctgctgtggccggggccgccggcggggcccggcgcttcctgtgtggggtggtggagggcttctacggccggccctgggtgatggagcagaggaaggagctgttccggcggctgcagaagtgggagctgaacacctacctgtatgcccccaaggatgactacaagcacaggatgttctggagggagatgtacagcgtggaggaggccggcagcttcctgttcttctacctggtgaccatccagctggccgagattgaaagagtgctgtgtgccagcaaggtgatgaccatctgtgtgatctcctgggcctgctag

SEQ ID NO: 159451 - DNA, 771 bp, Artificial Sequence
  Description of Artificial Sequence: Synthetic coding sequence
gctgctgggggcgcccggcgcttcctgtgtggggtggtggagggcttctacggccggccctgggtgatggagcagaggaaggagctgttccggcggctgcagaagtgggagctgaacacctacctgtatgcccccaaggatgactacaagcacaggatgttctggagggagatgtacagcgtggaggaggccgagcagctgatgaccctcatctctgctgcccgggagtatgaaattgagttcatctatgccatcagccctggcctggacatcaccttcagcaaccccaaggaggtgtccaccctgaagaggaagctggaccaggtgtcccagtttggctgccgcagctttgccctgctgtttgatgacatcgaccacaacatgtgtgccgctgacaaggaggtgttcagcagctttgcccacgcccaggtgtccatcaccaatgagatctaccagtacctgggggagcctgagaccttcctgttctgccccaccggccccaaggtggtgtccaaggagatccctgtggagagcattgaggaggtgtccaagatcatcaagagggcccctgtgatctgggacaacatccacgccaatgactatgaccagaagaggctcttcctgggcccctacaagggccgcagcacagagctgatcccccggctgaagggcgtgctgaccaaccccaactgtgaatttgaggccaactacgtggccatccacaccctggccacctggtacaagagcaacatgaatggagtgaggaagtag

SEQ ID NO: 159452 - DNA, 2592 bp, Artificial Sequence
  Description of Artificial Sequence: Synthetic coding sequence
atggtgcagaaggagagccaggccaccctggaggagcgggagagcgagctgagcagcaacccagctgccagcgctggggccagcctggagcccccagctgccccagcccctggagaggacaacccagctggagctggaggagctgctgtggccggggccgccggcggggcccggcgcttcctgtgtggggtggtggagggcttctacggccggccctgggtgatggagcagaggaaggagctgttccggcggctgcagaagtgggagctgaacacctacctgtatgcccccaaggatgactacaagcacaggatgttctggagggagatgtacagcgtggaggaggccgagcagctgatgaccctcatctctgctgcccgggagtatgaaattgagttcatctatgccatcagccctggcctggacatcaccttcagcaaccccaaggaggtgtccaccctgaagaggaagctggaccaggtgtcccagtttggctgccgcagctttgccctgctgtttgatgacatcgaccacaacatgtgtgccgctgacaaggaggtgttcagcagctttgcccacgcccaggtgtccatcaccaatgagatctaccagtacctgggggagcctgagaccttcctgttctgccccacagagtactgcggcaccttctgctacccaaatgtgtcccagagcccctacctgaggacagtgggggagaagctgctgcccggcatcgaggtgctgtggacaggccccaaggtggtgtccaaggagatccctgtggagagcattgaggaggtgtccaagatcatcaagagggcccctgtgatctgggacaacatccacgccaatgactatgaccagaagaggctcttcctgggcccctacaagggccgcagcacagagctgatcccccggctgaagggcgtgctgaccaaccccaactgtgaatttgaggccaactacgtggccatccacaccctggccacctggtacaagagcaacatgaatggagtgaggaaggatgtggtgatgagccggcaggtggcccacagcggggccaaggcctctgtggtggatggcacccccctggtggccgcccccagcctgaatgccaccaccgtggtgaccaccgtgtaccaggagcccatcatgagccagggcgccgccctgagcggggagcccaccaccctgaccaaggaggaggagaagaagcagccagatgaggagcccatggacatggtggtggagaagcaggaggagacagaccacaagaatgacaaccagatcctgtctgagatcgtggaggccaagatggccgaggagctgaagcccatggacacagacaaggagagcattgctgagagcaagagccctgagatgtccatgcaggaggactgcatcagtgacatcgcccccatgcagacagatgagcagaccaacaaggagcagtttgtgcccggccccaatgagaagcccctgtacacagctgagcctgtgaccctggaggacctgcagctgctggccgacctcttctacctgccctatgagcacggccccaagggggcccagatgctgcgggagttccagtggctgcgggccaacagctctgtggtgtctgtgaactgcaagggcaaggacagcgagaagattgaggagtggaggagccgggccgccaagtttgaggagatgtgtggcctggtgatgggcatgttcacccggctgagcaactgtgccaacagaaccatcctgtatgacatgtacagctatgtgtgggacatcaagagcatcatgtccatggtgaagagctttgtgcagtggctgggctgccgcagccacagcagcgcccagttcctgattggagaccaggagccctgggccttccggggcggcctggccggggagttccagaggctgctgcccattgatggagccaatgacctcttcttccagcccccacccctgacccccaccagcaaggtgtacaccatccggccctacttccccaaggatgaggcctctgtgtacaagatctgccgggagatgtatgatgatggagtgggcctgcccttccagagccagcctgacctgattggagacaagctggtgggcggcctgctgagcctgagcctggactactgctttgtgctggaggatgaagatggcatctgtggctacgccctgggcaccgtggatgtgacccccttcatcaagaagtgcaagatctcctggatccccttcatgcaggagaagtacaccaagcccaacggggacaaggagctgtctgaggccgagaagatcatgctgtccttccacgaggagcaggaggtgctgcctgagaccttcctggccaacttccccagcctcatcaagatggacatccacaagaaggtgacagaccccagcgtggccaagtccatgatggcctgcctgctgagcagcctgaaggccaacggcagcagaggagccttctgtgaggtgcggccagatgacaagaggatcctggagttctacagcaagctgggctgctttgagatcgccaagatggagggcttccccaaggatgtggtgatcctgggccgcagcctgtag

SEQ ID NO: 159453 - DNA, 1545 bp, Artificial Sequence
  Description of Artificial Sequence: Synthetic coding sequence
atggctgtgtggctggcccagtggctgggccccctgctgctggtgtccctgtggggcctgctggccccagccagcctgctgcggcggctgggggagcacatccagcagttccaggagagcagcgcccagggcctgggcctgagcctgggccctggagctgctgccctgcccaaggtgggctggctggagcagctgctggaccccttcaacgtgtctgaccggcgctccttcctgcagcgctactgggtgaatgaccagcactgggtgggccaggacggccccatcttcctgcacctgggcggggagggcagcctgggccctggctctgtgatgaggggccaccctgctgccctggccccagcctggggcgccctggtgatcagcctggagcaccgcttctacggcctgagcatcccagctgggggcctggagatggcccagctgcgcttcctgagcagccggctggccctggctgatgtggtgtctgcccggctggccctgagccgcctcttcaacatcagcagcagcagcccctggatctgcttcggcggcagctatgccggcagcctggccgcctgggcccggctgaagttcccccacctgatctttgcctctgtggccagcagcgcccctgtgcgggctgtgctggacttcagcgagtacaatgatgtggtgagccgcagcctgatgagcacagccatcggcggcagcctggagtgcagagctgctgtgtctgtggcctttgctgaggtggagcggcggctgcggtctggaggagctgcccaggccgccctgaggacagagctgagcgcctgtggccccctgggccgggcagagaaccaggccgagctgctgggcgccctgcaggccctggtgggcggcgtggtgcagtatgatggccagacaggagcccccctgtctgtgcggcagctgtgtggcctgctgctgggcggcggcggcaacagaagccacagcaccccctactgcggcctgcggcgggctgtgcagatcgtgctgcacagcctgggccagaagtgcctgtccttcagcagagctgagaccgtggcccagctgcggagcacagagccccagctgagcggcgtgggggaccggcagtggctgtaccagacctgcacagaatttggcttctacgtgacctgtgagaacccccgctgccccttcagccagctgcctgccctgcccagccagctggacctgtgtgagcaggtgtttggcctgagcgccctgtctgtggcccaggccgtggcccagaccaacagctactatggaggccagacccctggggccaacaaggtgctgtttgtgaatggagacacagacccctggcacgtgctgtctgtgacccaggccctgggcagcagcgagagcaccctgctgatcagaacaggcagccactgcctggacatggcccctgagcggcccagcgacagccccagcctgcggctgggccggcagaacatcttccagcagctgcagacctggctgaagctggccaaggagagccagatcaagggggaggtgtag

SEQ ID NO: 159454 - DNA, 2106 bp, Artificial Sequence
  Description of Artificial Sequence: Synthetic coding sequence
atggacctgtggaacctgtcctggttcctgttcctggatgccctgctggtgatcagcggcctggccaccccagaaaattttgatgtggatggcggcatggaccaggacatctttgacatcaatgaaggcctgggcctggacctgtttgaaggagacatccggctggaccgggcccagatcagaaattccatcattggagagaagtaccgctggccccacaccatcccctacgtgctggaggacagcctggagatgaatgccaagggcgtcatcctgaatgcctttgagcgctaccgcctgaagacctgcatcgacttcaagccctgggccggggagaccaactacatctctgtgttcaagggcagcggctgctggagctctgtgggcaacagaagagtgggcaagcaggagctgagcatcggggccaactgtgacagaattgccaccgtgcagcacgagttcctgcacgccctgggcttctggcatgagcagagcagaagtgacagagatgattatgtgcgcatcatgtgggaccgcatcctgagcggccgggagcacaacttcaacacctacagtgatgacatcagtgacagcctgaatgtgccctatgactacacctctgtgatgcactacagcaagacagccttccagaatggaacagagcccaccatcgtgacccgcatcagtgactttgaagatgtgattggccagaggatggacttcagtgacagcgacctgctgaagctgaaccagctgtacaactgcagcagcagcctgtccttcatggacagctgcagctttgagctggagaatgtgtgtggcatgatccagagcagcggggacaatgctgactggcagagggtgtcccaggtgccccggggccctgagagtgaccacagcaacatgggccagtgccagggcagcggcttcttcatgcactttgacagcagctctgtgaatgtgggcgccacagctgtgctggagagcaggaccctgtaccccaagaggggcttccagtgcctgcagttctacctgtacaacagcggcagcgagagtgaccagctgaacatctacatccgggagtacagcgctgacaacgtggatggcaacctgaccctggtggaggagatcaaggagatccccaccggctcctggcagctgtaccacgtgaccctgaaggtgaccaagaagttccgggtggtgtttgagggcaggaagggcagcggggccagcctgggcggcctgagcattgatgacatcaacctgtctgagacccgctgcccccaccacatctggcacatccggaacttcacccagttcatcggcagccccaacggcaccctgtacagcccccccttctacagcagcaagggctacgccttccagatctacctgaacctggcccacgtgaccaatgccggcatctacttccacctgatcagcggggccaatgatgaccagctgcagtggccctgcccctggcagcaggccaccatgaccctgctggaccagaacccagacatccggcagaggatgagcaaccagaggagcatcaccacagaccccttcatgaccacagacaatggaaactacttctgggaccggcccagcaaggtgggcaccgtggccctcttcagcaatggcacccagttccggcggggcggcggctacggcaccagcgccttcatcacccatgagcggctgaagagccgggacttcatcaagggagatgatgtgtacatcctgctgactgtggaggacatcagccacctgaacagcacccagatccagctgaccccagcccccagcgtgcaggacctgtgcagcaagaccacctgcaagaatgatggagtgtgcaccgtgagagatggcaaggcagaatgtcgctgccagagcggggaggactggtggtacatgggagagcgctgtgagaagaggggcagcacccgggacaccatcgtgattgctgtgagcagcacagtggccgtgtttgccctgatgctgatcatcaccctggtgtctgtgtactgcaccaggaagaagtaccgggagaggatgagcagcaaccggcccaacctgaccccccagaaccagcacgccttctag

SEQ ID NO: 159455 - DNA, 894 bp, Artificial Sequence
  Description of Artificial Sequence: Synthetic coding sequence
atggccagcccccagctgtgccgggccctggtgtctgcccagtgggtggccgaggccctgcgggcccccagggctggccagcccctgcagctgctggatgcctcctggtacctgcccaagctgggcagagatgcccggcgggagtttgaggagcggcacatccctggagctgccttctttgacatcgaccagtgcagcgacaggaccagcccctatgaccacatgctgcctggagctgagcactttgctgaatatgccggccgcctgggcgtgggcgccgccacccacgtggtgatctatgatgccagtgaccagggcctgtacagcgccccccgggtgtggtggatgttccgggccttcggccaccacgctgtgtccctgctggatggcggcctgcggcactggctgcggcagaacctgcccctgagcagcggcaagagccagcctgccccagctgagttccgggcccagctggaccctgccttcatcaagacctatgaggacatcaaggagaacctggagagccgccgcttccaggtggtggacagccgggccaccggccgcttccggggcacagagcctgagcccagagatggcatcgagcccggccacatccctggcaccgtgaacatccccttcacagacttcctgagccaggagggcctggagaagagccctgaggagatccgccacctgttccaggagaagaaggtggacctgagcaagcccctggtggccacctgtggcagcggcgtgacagcctgccacgtggccctgggcgcctacctgtgtgggaagccagatgtgcccatctatgatggctcctgggtggagtggtacatgagggcccggccagaagatgtgatcagcgagggccggggcaagacccactag

SEQ ID NO: 159456 - DNA, 954 bp, Artificial Sequence
  Description of Artificial Sequence: Synthetic coding sequence
atggccgagcccggcagccgggagagcgagacccgggcccggagccccagcgtggccgccatggccagcccccagctgtgccgggccctggtgtctgcccagtgggtggccgaggccctgcgggcccccagggctggccagcccctgcagctgctggatgcctcctggtacctgcccaagctgggcagagatgcccggcgggagtttgaggagcggcacatccctggagctgccttctttgacatcgaccagtgcagcgacaggaccagcccctatgaccacatgctgcctggagctgagcactttgctgaatatgccggccgcctgggcgtgggcgccgccacccacgtggtgatctatgatgccagtgaccagggcctgtacagcgccccccgggtgtggtggatgttccgggccttcggccaccacgctgtgtccctgctggatggcggcctgcggcactggctgcggcagaacctgcccctgagcagcggcaagagccagcctgccccagctgagttccgggcccagctggaccctgccttcatcaagacctatgaggacatcaaggagaacctggagagccgccgcttccaggtggtggacagccgggccaccggccgcttccggggcacagagcctgagcccagagatggcatcgagcccggccacatccctggcaccgtgaacatccccttcacagacttcctgagccaggagggcctggagaagagccctgaggagatccgccacctgttccaggagaagaaggtggacctgagcaagcccctggtggccacctgtggcagcggcgtgacagcctgccacgtggccctgggcgcctacctgtgtgggaagccagatgtgcccatctatgatggctcctgggtggagtggtacatgagggcccggccagaagatgtgatcagcgagggccggggcaagacccactag

SEQ ID NO: 159457 - DNA, 894 bp, Artificial Sequence; identical to SEQ ID NO: 159455
  Description of Artificial Sequence: Synthetic coding sequence

SEQ ID NO: 159458 - DNA, 894 bp, Artificial Sequence; identical to SEQ ID NO: 159455
  Description of Artificial Sequence: Synthetic coding sequence

SEQ ID NO: 159459 - DNA, 894 bp, Artificial Sequence; identical to SEQ ID NO: 159455
  Description of Artificial Sequence: Synthetic coding sequence

SEQ ID NO: 159460 - DNA, 894 bp, Artificial Sequence; identical to SEQ ID NO: 159455
  Description of Artificial Sequence: Synthetic coding sequence

SEQ ID NO: 159461 - DNA, 738 bp, Artificial Sequence
  Description of Artificial Sequence: Synthetic coding sequence
atggccagcccccagctgtgccgggccctggtgtctgcccagtgggtggccgaggccctgcgggcccccagggctggccagcccctgcagctgctggatgcctcctggtacctgcccaagctgggcagagatgcccggcgggagtttgaggagcggcacatccctggagctgccttctttgacatcgaccagtgcagcgacaggaccagcccctatgaccacatgctgcctggagctgagcactttgctgaatatgccggccgcctgggcgtgggcgccgccacccacgtggtgatctatgatgccagtgaccagggcctgtacagcgccccccgggtgtggtggatgttccgggccttcggccaccacgctgtgtccctgctggatggcggcctgcggcactggctgcggcagaacctgcccctgagcagcggcaagagccagcctgccccagctgagttccgggcccagctggaccctgccttcatcaagacctatgaggacatcaaggagaacctggagagccgccgcttccaggtggtggacagccgggccaccggccgcttccggggcacagagcctgagcccccagctgtgggcatcgagcccggccacatccctggcaccgtgaacatccccttcacagacttcctgagccaggacggctcctgggtggagtggtacatgagggcccggccagaagatgtgatcagcgagggccggggcaagacccactag

SEQ ID NO: 159462 - DNA, 765 bp, Artificial Sequence
  Description of Artificial Sequence: Synthetic coding sequence
atggaccctgctgccagcagctgcatgaggagcctgcagcccccagcccctgtgtggggctgcctgaggaacccccacagcgagggcaatggagccagcggcctgccccactacccacccacccccttctccttccaccagaagccagacttcctggccacagccacagctgcctacccagacttcagcgccagctgcctggccgccaccccccacagcctgccccaggaggagcacatcttcacagagcagcacccagccttcccccagagccccaactggcacttccctgtgtctgatgccaggagaagacccaacagcggccctgctgggggcagcaaggagatgggcaccagcagcctgggcctggtggacaccactggaggccctggagatgattatggagtgctgggcagcacagccaatgaaacagagaagaagagcagcagaagaaggaaggagagcagtgacaaccaggagaacagaggcaagccagagggcagcagcaaggccaggaaggagaggacagccttcaccaaggagcagctgcgggagctggaggccgagtttgcccaccacaactacctgacccggctgcggcgctatgaaattgctgtgaacctggacctgtctgagcggcaggtgaaggtgtggttccagaacagaaggatgaagtggaagagggtgaagggcggccagcccatcagccccaacggccaggaccctgaagatggagacagcacagccagccccagcagcgagtag

SEQ ID NO: 159463 - DNA, 555 bp, Artificial Sequence
  Description of Artificial Sequence: Synthetic coding sequence
atggaccctgctgccagcagctgcatgaggagcctgcagcccccagcccctgtgtggggctgcctgaggaacccccacagcgagggcaatggagccagcggcctgccccactacccacccacccccttctccttccaccagaagccagacttcctggccacagccacagctgcctacccagacttcagcgccagctgcctggccgccaccccccacagcctgccccaggaggagcacatcttcacagagcagcacccagccttcccccagagccccaactggcacttccctgtgtctgatgccaggagaagacccaacagcggccctgctgggggcagcaaggagatgggcaccagcagcctgggcctggtggacaccactggaggccctggagatgattatggagtgctgggcagcacagccaatgaaacagagaagaagagcagcagaagaaggaaggagagcagcggccagagcgtggtgcctgagcccaaggatgaggtggaggcctgtgagggccgcagcgcccacctgccccagtgggccggcccctag

SEQ ID NO: 159464 - DNA, 420 bp, Artificial Sequence
  Description of Artificial Sequence: Synthetic coding sequence
atgggcaccagcagcctgggcctggtggacaccaccggcggccctggagatgattatggagtgctgggcagcacagccaatgaaacagagaagaagagcagcagaagaaggaaggagagcagtgacaaccaggagaacagaggcaagccagagggcagcagcaaggccaggaaggagaggacagccttcaccaaggagcagctgcgggagctggaggccgagtttgcccaccacaactacctgacccggctgcggcgctatgaaattgctgtgaacctggacctgtctgagcggcaggtgaaggtgtggttccagaacagaaggatgaagtggaagagggtgaagggcggccagcccatcagccccaacggccaggaccctgaagatggagacagcacagccagccccagcagcgagtag

SEQ ID NO: 159465 - DNA, 915 bp, Artificial Sequence
  Description of Artificial Sequence: Synthetic coding sequence
atggagcaccccctgtttggctgcctgcggagcccccacgccacagcccagggcctgcaccccttcagccagagcagcctggccctgcacggccgcagtgaccacatgagctacccagagctgagcaccagcagcagcagctgcatcatcgccggctacccaaatgaggagggcatgtttgccagccagcaccaccggggccaccaccaccaccaccaccaccaccaccaccaccaccaccagcagcagcagcaccaggccctgcagaccaactggcacctgccccagatgagcagcccccccagcgctgcccggcacagcctgtgcctgcagcctgacagcggcggccccccagagctgggcagcagcccccctgtgctgtgcagcaacagcagcagcctgggcagcagcacccccaccggggccgcctgtgcccctggggactatggccggcaggccctgagccctgctgaggccgagaagaggtctgggggcaagaggaagagtgacagcagtgacagccaggagggcaactacaagtctgaggtgaacagcaagcccaggaaggagaggacagccttcaccaaggagcagatccgggagctggaggccgagtttgcccaccacaactacctgacccggctgcggcgctatgaaattgctgtgaacctggacctgacagagcggcaggtgaaggtgtggttccagaacagaaggatgaagtggaagagggtgaagggcggccagcagggcgctgctgcccgggagaaggagctggtgaatgtgaagaagggcaccctgctgcccagcgagctgtctggaattggagctgccaccctgcagcagacaggagacagcatcgccaatgaagacagccatgacagcgaccacagcagcgagcacgcccacctgtag

SEQ ID NO: 159466 - DNA, 705 bp, Artificial Sequence
  Description of Artificial Sequence: Synthetic coding sequence
atggccgccagccgctgggccaggaaggctgtggtgctgctgtgtgccagtgacctgctgctgctgctgctgctgctgcccccacctggcagctgtgccgctgagggcagccctggcaccccagatgagagcaccccaccacccaggaagaagaagaaggacatccgggactacaatgatgctgacatggcccggctgctggagcagtgggagaaggatgatgacatcgaggagggggacctgcctgagcacaagaggcccagcgcccctgtggacttcagcaagattgaccccagcaagccagagagcatcctgaagatgaccaagaagggcaagaccctgatgatgtttgtgacagtgtctggcagccccacagagaaggagacagaggagatcaccagcctgtggcagggcagcctcttcaatgccaactatgatgtgcagcgcttcatcgtgggcagtgaccgggccatcttcatgctgagagatggcagctatgcctgggagatcaaggacttcctggtgggccaggacagatgtgctgatgtgaccctggagggccaggtgtacccaggaaaaggaggcggcagcaaggagaagaacaagaccaagcaggacaagggcaagaagaagaaggagggggacctgaagagccgcagcagcaaggaggagaacagagctggcaacaagcgggaggacctgtag

SEQ ID NO: 159467 - DNA, 705 bp, Artificial Sequence; identical to SEQ ID NO: 159466
  Description of Artificial Sequence: Synthetic coding sequence

SEQ ID NO: 159468 - DNA, 1194 bp, Artificial Sequence
  Description of Artificial Sequence: Synthetic coding sequence
atggcccagagccccccaccccagagcctgctgggccatgaccactggatctttgcccagggctggggctgggccggccactgggacagcaccagccctgccagcagcagtgacagcagcggcagctgcccctgtgatggagcccggggcctgccccagccccagccccccagctgcagcagcagagctgctgaggccgccgccaccaccccccggcgggccaggacaggccctgctgggggccagaggcagagcgccagcgagcgggagaagctgaggatgaggaccctggcccgggccctgcacgagctgcggcgcttcctgccccccagcctggccccagctggccagagcctgaccaagattgagaccctgcggctggccatccgctacatcggccacctgtctgctgtgctgggcctgtctgaggagagcctgcagtgcagaagacggcagagaggagatgctggcagcccctggggctgccccctgtgcccagaccggggccctgctgaggcccagacccaggccgagggccagggccagggccagggccagggccagggccagggccagggccagggccagggccagggccagggccagggccagggccggcggcccggcctggtgtctgctgtgctggccgaggcctcctggggcagccccagcgcctgccctggggcccaggccgcccctgagcggctgggccggggcgtgcatgacacagacccctgggccaccccaccctactgccccaagatccagagccccccctacagcagccagggcaccaccagtgatgccagcctgtggaccccaccccagggctgcccctggacccagagcagccctgagcccaggaacccccctgtgccctggacagctgccccagccaccctggagctggccgctgtgtaccagggcctgtctgtgtccccagagccctgcctgagcctgggcgcccccagcctgctgccccaccccagctgccagaggctgcagccccagaccccaggccgctgctggagccacagcgctgaggtggtgcccaacagcgaggaccagggccctggggccgccttccagctgtctgaggccagccccccccagagcagcggcctgcgcttcagcggctgcccagagctgtggcaggaggacctggagggcgcccggctgggcatcttctactag

SEQ ID NO: 159469 - DNA, 3510 bp, Artificial Sequence
  Description of Artificial Sequence: Synthetic coding sequence
atggagccccgggagagcggcaaggcccctgtgacctttgatgacatcaccgtgtacctgctgcaggaggagtgggtgctgctgagccagcagcagaaggagctgtgtggcagcaacaagctggtggcccccctgggccccaccgtggccaaccctgagctgttcaggaagtttggccggggccctgagccctggctgggctctgtgcagggccagaggagcctgctggagcaccaccctgggaagaagcagatgggctacatgggagagatggaggtgcagggccccacccgggagagcggccagagcctgcccccccagaagaaggcctacctgagccacctgagcactggaagtggccacatcgagggggactgggccggcaggaacaggaagctgctgaagcccaggagcatccagaagtcctggtttgtgcagttcccctggctgatcatgaatgaggagcagacagccctcttctgcagcgcctgccgggagtaccccagcatccgggacaagaggagccgcctcatcgagggctacacaggccccttcaaggtggagaccctgaagtaccacgccaagagcaaggcccacatgttctgtgtgaatgccctggccgcccgggaccccatctgggccgcccgcttccgcagcatccgggaccccccaggagatgtgctggccagccctgagcccctcttcaccgctgactgccccatcttctacccacctggccccctgggcggctttgacagcatggccgagctgctgcccagcagcagagctgagctggaggaccctggaggagatggagccatcccagccatgtacctggactgcatcagtgacctgcggcagaaggagatcacagatggcatccacagcagcagtgacatcaacatcctgtacaatgatgctgtggagagctgcatccaggaccccagcgctgagggcctgtctgaggaggtgcctgtggtgtttgaggagctgcctgtggtgtttgaagatgtggccgtgtacttcacccgggaggagtggggcatgctggacaagaggcagaaggagctgtacagagatgtgatgaggatgaactatgagctgctggccagcctgggccctgctgctgccaagccagacctgatcagcaagctggagaggagagctgccccctggatcaaggaccccaacggccccaagtggggcaagggccggcccccaggcaacaagaagatggtggccgtgcgggaggccgacacccaggccagcgctgctgacagcgccctgctgcccggcagccctgtggaggcccgggccagctgctgcagcagcagcatctgtgaggagggagatggcccccggcgcatcaagaggacctaccggcccaggagcatccagaggtcctggtttggccagttcccctggctggtgattgaccccaaggagaccaagctgttctgcagcgcctgcatcgagcggcccaacctgcatgacaagagcagccggctggtgcggggctacacaggccccttcaaggtggagaccctgaagtaccacgaggtgtccaaggcccaccggctgtgtgtgaacacagtggagatcaaggaggacaccccccacacagccctggtgcctgagatcagcagtgacctgatggccaacatggagcacttcttcaatgctgcctacagcatcgcctaccacagccggcccctgaatgactttgagaagatcctgcagctgctgcagagcactggaacagtcatcctgggcaagtacagaaacagaacagcctgcacccagttcatcaagtacatcagcgagaccctgaagcgggagatcctggaggatgtgaggaacagcccctgtgtgtctgtgctgctggacagcagcacagatgccagcgagcaggcctgtgtgggcatctacatccgctacttcaagcagatggaggtgaaggagagctacatcaccctggcccccctgtacagcgagacagcagatggctactttgagaccatcgtgtctgccctggatgagctggacatccccttcaggaagccaggctgggtggtgggcctgggcacagatggcagcgccatgctgagctgccggggcggcctggtggagaagttccaggaggtgatcccccagctgctgcctgtgcactgtgtggcccaccggctgcacctggccgtggtggatgcctgtggcagcattgacctggtgaagaagtgtgacagacacatccgcaccgtcttcaagttctaccagagcagcaacaagaggctgaatgagctgcaggagggcgccgcccccctggagcaggagatcatccggctgaaggacctgaatgctgtgcgctgggtggccagcagaagaaggaccctgcacgccctgctggtgtcctggccagccctggcccggcacctgcagagggtggccgaggccggcggccagatcggccaccgggccaagggcatgctgaagctgatgaggggcttccactttgtgaagttctgccacttcctgctggacttcctgagcatctaccggcccctgtctgaggtgtgccagaaggagatcgtgctgatcacagaggtgaatgccaccctgggccgggcctacgtggccctggagagcctgcggcaccaggccggccccaaggaggaggagttcaatgccagcttcaaggatggccgcctgcacggcatctgcctggacaagctggaggtggccgagcagcgcttccaggccgaccgggagaggacagtgctgactggaattgagtacctgcagcagagatttgatgctgacaggcctccccagctgaagaacatggaggtgtttgacaccatggcctggcccagcggcatcgagctggccagctttggaaatgatgacatcctgaacctggcccgctactttgaatgttccctgcccaccggctacagcgaggaggccctgctggaggagtggctgggcctgaagaccatcgcccagcacctgcccttctccatgctgtgcaagaatgccctggcccagcactgccgcttccccctgctgagcaagctgatggctgtggtggtgtgtgtgcccatcagcaccagctgctgtgagcggggcttcaaggccatgaaccgcatcagaacagatgagaggaccaagctgagcaatgaggtgctgaacatgctgatgatgacagctgtgaatggagtggccgtgacagaatatgacccccagcctgccatccagcactggtacctgaccagcagcggccgccgcttcagccacgtgtacacctgtgcccaggtgcctgcccggagccctgccagcgcccggctgaggaaggaggagatgggcgccctgtatgtggaggagcccaggacccagaagccacccatcctgcccagccgggaggccgctgaggtgctgaaggactgcatcatggagcccccagagcggctgctgtacccccacaccagccaggaggcccctggcatgtcctag

SEQ ID NO: 159470 - DNA, 981 bp, Artificial Sequence
  Description of Artificial Sequence: Synthetic coding sequence
atgagggagtggtgggtgcaggtgggcctgctggccgtgcccctgctggccgcctacctgcacatccccccaccccagctgagccctgccctgcacagctggaagagcagcggcaagttcttcacctacaagggcctgcgcatcttctaccaggacagcgtgggcgtggtgggcagccctgagatcgtggtgctgctgcacggcttccccaccagcagctatgactggtacaagatctgggagggcctgaccctgcgcttccaccgggtgattgccctggacttcctgggcttcggcttcagtgacaagccccggccccaccactacagcatctttgagcaggccagcatcgtggaggccctgctgcggcacctgggcctgcagaacagacgcatcaacctgctgagccatgactatggagacatcgtggcccaggagctgctgtaccgctacaagcagaacagaagtggccgcctgaccatcaagagcctgtgcctgagcaatggaggcatcttccctgagacccaccggcccctgctgctgcagaagctgctgaaggatggaggagtgctgagccccatcctgacccggctgatgaacttctttgtgttcagccggggcctgacccctgtgtttggcccctacacccggcccagcgagagcgagctgtgggacatgtgggccggcatcagaaataatgatggcaacctggtgattgacagcctgctgcagtacatcaaccagaggaagaagttcagaagacgctgggtgggcgccctggcctctgtgaccatccccatccacttcatctacggccccctggaccctgtgaacccctacccagagttcctggagctgtacaggaagaccctgcccaggagcacagtgtccatcctggatgaccacatcagccactacccccagctggaggaccccatgggcttcctgaatgcctacatgggcttcatcaacagcttctag

SEQ ID NO: 159471 - DNA, 981 bp, Artificial Sequence; identical to SEQ ID NO: 159470
  Description of Artificial Sequence: Synthetic coding sequence

SEQ ID NO: 159472 - DNA, 357 bp, Artificial Sequence
  Description of Artificial Sequence: Synthetic coding sequence
atgagggagtggtgggtgcaggtgggcctgctggccgtgcccctgctggccgcctacctgcacatccccccaccccagctgagccctgccctgcacagctggaagagcagcggcaagttcttcacctacaagggcctgcgcatcttctaccaggacagcgtgggcgtggtgggcagccctgagatcgtggtgctgctgcacggcttccccaccagcagctatgactggtacaagatctgggagggcctgaccctgcgcttccaccgggtgattgccctggacttcctgggcttcggcttcagtgacaagccccggccccaccactacagcatctttgagcaggccagcatcgtgtag

SEQ ID NO: 159473 - DNA, 624 bp, Artificial Sequence
  Description of Artificial Sequence: Synthetic coding sequence
atgagggagtggtgggtgcaggtgggcctgctggccgtgcccctgctggccgcctacctgcacatccccccaccccagctgagccctgccctgcacagctggaagagcagcggcaagttcttcacctacaagggcctgcgcatcttctaccaggacagcgtgggcgtggtgggcagccctgagatcgtggtgctgctgcacggcttccccaccagcagctatgactggtacaagatctgggagggcctgaccctgcgcttccaccgggtgattgccctggacttcctgggcttcggcttcagtgacaagccccggccccaccactacagcatctttgagcaggccagcatcgtggaggccctgctgcggcacctgggcctgcagaacagacgcatcaacctgctgagccatgactatggagacatcgtggcccaggagctgctgtaccgctacaagcagaacagaagtggccgcctgaccatcaagagcctgtgcctgagcaatggaggcatcttccctgagacccaccggcccctgctgctgcagaagctgctgaaggatggaggagtgctgagccccatcctgacccggctgatgaacttctttgtgttcagccggggctag

SEQ ID NO: 159474 - DNA, 483 bp, Artificial Sequence
  Description of Artificial Sequence: Synthetic coding sequence
atgagggagtggtgggtgcaggtgggcctgctggccgtgcccctgctggccgcctacctgcacatccccccaccccagctgagccctgccctgcacagctggaagagcagcggcaagttcttcacctacaagggcctgcgcatcttctaccaggacagcgtgggcgtggtgggcagccctgagatcgtggtgctgctgcacggcttccccaccagcagctatgactggtacaagatctgggagggcctgaccctgcgcttccaccgggtgattgccctggacttcctgggcttcggcttcagtgacaagccccggccccaccactacagcatctttgagcaggccagcatcgtggaggccctgctgcggcacctgggcctgcagaacagacgcatcaacctgctgagccatgactatggagacatcgtggcccaggagctgctgtaccgctacaagcagaacagaagtggccgcctgacctag

SEQ ID NO: 159475 - DNA, 384 bp, Artificial Sequence
  Description of Artificial Sequence: Synthetic coding sequence
atgagggagtggtgggtgcaggtgggcctgctggccgtgcccctgctggccgcctacctgcacatccccccaccccagctgagccctgccctgcacagctggaagagcagcggcaagttcttcacctacaagggcctgcgcatcttctaccaggacagcgtgggcgtggtgggcagccctgagatcgtggtgctgctgcacggcttccccaccagcagctatgactggtacaagatctgggagggcctgaccctgcgcttccaccgggtgattgccctggacttcctgggcttcggcttcagtgacaagccccggccccaccactacagcatctttgagcaggccagcatcgtggaggccctgctgcggcacctgggcctgtag

SEQ ID NO: 159476 - DNA, 522 bp, Artificial Sequence
  Description of Artificial Sequence: Synthetic coding sequence
atgagggagtggtgggtgcaggtgggcctgctggccgtgcccctgctggccgcctacctgcacatccccccaccccagctgagccctgccctgcacagctggaagagcagcggcaagttcttcacctacaagggcctgcgcatcttctaccaggacagcgtgggcgtggtgggcagccctgagatcgtggtgctgctgcacggcttccccaccagcagctatgactggtacaagatctgggagggcctgaccctgcgcttccaccgggtgattgccctggacttcctgggcttcggcttcagtgacaagccccggccccaccactacagcatctttgagcaggccagcatcgtggaggccctgctgcggcacctgggcctgcagaacagacgcatcaacctgctgagccatgactatggagacatcgtggcccaggagctgctgtaccgctacaagcagaacagaagtggccgcctgaccatcaagagcctgtgcctgagcaatggaggcaactgcctgtag

SEQ ID NO: 159477 - DNA, 879 bp, Artificial Sequence
  Description of Artificial Sequence: Synthetic coding sequence
atgagggagtggtgggtgcaggtgggcctgctggccgtgcccctgctggccgcctacctgcacatccccccaccccagctgagccctgccctgcacagctggaagagcagcggcaagttcttcacctacaagggcctgcgcatcttctaccaggacagcgtgggcgtggtgggcagccctgagatcgtggtgctgctgcacggcttccccaccagcagctatgactggtacaagatctgggagggcctgaccctgcgcttccaccgggtgattgccctggacttcctgggcttcggcttcagtgacaagccccggccccaccactacagcatctttgagcaggccagcatcgtggaggccctgctgcggcacctgggcctgcagaacagacgcatcaacctgctgagccatgactatggagacatcgtggcccaggagctgctgtaccgctacaagcagaacagaagtggccgcctgaccatcaagagcctgtgcctgagcaatggaggcatcttccctgagacccaccggcccctgctgctgcagaagctgctgaaggatggaggagtgctgagccccatcctgacccggctgatgaacttctttgtgttcagccggggcctgctgcagtacatcaaccagaggaagaagttcagaagacgctgggtgggcgccctggcctctgtgaccatccccatccacttcatctacggccccctggaccctgtgaacccctacccagagttcctggagctgtacaggaagaccctgcccaggagcacagtgtccatcctggatgaccacatcagccactacccccagctggaggaccccatgggcttcctgaatgcctacatgggcttcatcaacagcttctag

SEQ ID NO: 159478 - DNA, 879 bp, Artificial Sequence; identical to SEQ ID NO: 159477
  Description of Artificial Sequence: Synthetic coding sequence

SEQ ID NO: 159479 - DNA, 582 bp, Artificial Sequence
  Description of Artificial Sequence: Synthetic coding sequence
atggacaacctgcgggagaccttcctgagcctggaggatggcctgggcagcagtgacagccctggcctgctgagctcctgggactggaaggacagagctggcccctttgagctgaaccaggccagccccagccagagcctgagccctgcccccagcctggagagctacagcagcagcccctgcccagctgtggccggcctgccctgtgaacatggaggagccagcagcggcggcagcgagggctgcagcgtgggcggggccagcggcctggtggaggtggactacaacatgctggccttccagcccacccacctgcagggcggcggcggccccaaggcccagaagggcaccaaggtgaggatgtctgtgcagaggaggaggaaggccagcgagcgggagaagctgaggatgaggaccctggctgatgccctgcacaccctgaggaactacctgccccctgtgtacagccagaggggccagcccctgaccaagatccagaccctgaagtacaccatcaagtacatcggggagctgacagacctgctgaacagaggccgggagccccgggcccagagcgcctag

SEQ ID NO: 159480 - DNA, 1893 bp, Artificial Sequence
  Description of Artificial Sequence: Synthetic coding sequence
atggccctgcccacagcccggcccctgctgggcagctgtggcaccccagccctgggcagcctgctcttcctgctcttcagcctgggctgggtgcagcccagcaggaccctggccggggagaccggccaggaggccgcccccctggatggagtgctggccaacccccccaacatcagcagcctgagcccccggcagctgctgggcttcccctgtgccgaggtgtctggcctgagcacagagcgggtgcgggagctggccgtggccctggcccagaagaatgtgaagctgagcacagagcagctgcgctgcctggcccaccggctgtctgagcccccagaggacctggatgccctgcccctggacctgctgctcttcctgaacccagatgccttcagcggcccccaggcctgcacccgcttcttcagccgcatcaccaaggccaacgtggacctgctgcccaggggggcccctgagcggcagaggctgctgcctgctgccctggcctgctggggcgtgcggggcagcctgctgtctgaggctgatgtgcgggccctgggcggcctggcctgtgacctgcccggccgctttgtggccgagagcgctgaggtgctgctgccccggctggtgtcctgccccggccccctggaccaggaccagcaggaggccgcccgggccgccctgcagggcggcggccccccctacggcccccccagcacctggagcgtgtccaccatggatgccctgcggggcctgctgcctgtgctgggccagcccatcatccgcagcatcccccagggcatcgtggccgcctggaggcagaggagcagccgggaccccagctggaggcagcctgagaggaccatcctgcggccccgcttccggcgggaggtggagaagacagcctgccccagcggcaagaaggcccgggagattgatgagagcctcatcttctacaagaagtgggagctggaggcctgtgtggatgctgccctgctggccacccagatggacagagtgaatgccatccccttcacctatgagcagctggatgtgctgaagcacaagctggatgagctgtacccccagggctacccagagagcgtcatccagcacctgggctacctgttcctgaagatgagccctgaggacatcaggaagtggaatgtgaccagcctggagaccctgaaggccctgctggaggtgaacaagggccacgagatgagcccccaggccccccggcggcccctgccccaggtggccaccctgattgacagatttgtgaagggccggggccagctggacaaggacaccctggacaccctgacagccttctacccaggctacctgtgcagcctgagccctgaggagctgagctctgtgccccccagcagcatctgggccgtgcggccccaggacctggacacctgtgacccccggcagctggatgtgctgtaccccaaggcccggctggccttccagaacatgaatggcagcgagtactttgtgaagatccagagcttcctgggcggggcccccacagaggacctgaaggccctgagccagcagaatgtgtccatggacctggccaccttcatgaagctgaggacagatgctgtgctgcccctgactgtggccgaggtgcagaagctgctgggcccccacgtggagggcctgaaggccgaggagcggcacaggcctgtgcgggactggatcctgcggcagaggcaggatgacctggacaccctgggcctgggcctgcagggcggcatccccaacggctacctggtgctggacctgtccatgcaggaggccctgagcggcaccccctgcctgctgggccctggccctgtgctgactgtgctggccctgctgctggccagcaccctggcctag

SEQ ID NO: 159481 - DNA, 1869 bp, Artificial Sequence
  Description of Artificial Sequence: Synthetic coding sequence
atggccctgcccacagcccggcccctgctgggcagctgtggcaccccagccctgggcagcctgctcttcctgctcttcagcctgggctgggtgcagcccagcaggaccctggccggggagaccggccaggaggccgcccccctggatggagtgctggccaacccccccaacatcagcagcctgagcccccggcagctgctgggcttcccctgtgccgaggtgtctggcctgagcacagagcgggtgcgggagctggccgtggccctggcccagaagaatgtgaagctgagcacagagcagctgcgctgcctggcccaccggctgtctgagcccccagaggacctggatgccctgcccctggacctgctgctcttcctgaacccagatgccttcagcggcccccaggcctgcacccgcttcttcagccgcatcaccaaggccaacgtggacctgctgcccaggggggcccctgagcggcagaggctgctgcctgctgccctggcctgctggggcgtgcggggcagcctgctgtctgaggctgatgtgcgggccctgggcggcctggcctgtgacctgcccggccgctttgtggccgagagcgctgaggtgctgctgccccggctggtgtcctgccccggccccctggaccaggaccagcaggaggccgcccgggccgccctgcagggcggcggccccccctacggcccccccagcacctggagcgtgtccaccatggatgccctgcggggcctgctgcctgtgctgggccagcccatcatccgcagcatcccccagggcatcgtggccgcctggaggcagaggagcagccgggaccccagctggaggcagcctgagaggaccatcctgcggccccgcttccggcgggaggtggagaagacagcctgccccagcggcaagaaggcccgggagattgatgagagcctcatcttctacaagaagtgggagctggaggcctgtgtggatgctgccctgctggccacccagatggacagagtgaatgccatccccttcacctatgagcagctggatgtgctgaagcacaagctggatgagctgtacccccagggctacccagagagcgtcatccagcacctgggctacctgttcctgaagatgagccctgaggacatcaggaagtggaatgtgaccagcctggagaccctgaaggccctgctggaggtgaacaagggccacgagatgagcccccaggtggccaccctgattgacagatttgtgaagggccggggccagctggacaaggacaccctggacaccctgacagccttctacccaggctacctgtgcagcctgagccctgaggagctgagctctgtgccccccagcagcatctgggccgtgcggccccaggacctggacacctgtgacccccggcagctggatgtgctgtaccccaaggcccggctggccttccagaacatgaatggcagcgagtactttgtgaagatccagagcttcctgggcggggcccccacagaggacctgaaggccctgagccagcagaatgtgtccatggacctggccaccttcatgaagctgaggacagatgctgtgctgcccctgactgtggccgaggtgcagaagctgctgggcccccacgtggagggcctgaaggccgaggagcggcacaggcctgtgcgggactggatcctgcggcagaggcaggatgacctggacaccctgggcctgggcctgcagggcggcatccccaacggctacctggtgctggacctgtccatgcaggaggccctgagcggcaccccctgcctgctgggccctggccctgtgctgactgtgctggccctgctgctggccagcaccctggcctag

SEQ ID NO: 159482 - DNA, 1893 bp, Artificial Sequence; identical to SEQ ID NO: 159480
  Description of Artificial Sequence: Synthetic coding sequence

SEQ ID NO: 159483 - DNA, 1869 bp, Artificial Sequence; identical to SEQ ID NO: 159481
  Description of Artificial Sequence: Synthetic coding sequence

SEQ ID NO: 159484 - DNA, 1869 bp, Artificial Sequence; identical to SEQ ID NO: 159481
  Description of Artificial Sequence: Synthetic coding sequence

SEQ ID NO: 159485 - DNA, 1782 bp, Artificial Sequence
  Description of Artificial Sequence: Synthetic coding sequence
atgagggacagcactggagctggcaacagcctggtgcacaagaggagccccctgcggaggaaccagaagacccccaccagcctgaccaagctgagcctgcaggacggccacaaggccaagaagccagcctgcaagtttgaggagggccaggatgtgctggcccgctggagcgatggcctcttctacctgggcaccatcaagaagatcaacatcctgaagcagagctgcttcatcatctttgaggacagcagcaagtcctgggtgctgtggaaggacatccagacaggagccaccggcagcggggagatggtgtgcaccatctgccaggaggagtacagcgaggccccaaatgagatggtgatctgtgacaagtgtggccagggctaccaccagctgtgccacaccccccacatcgactgcagcgtgattgacagtgatgagaagtggctgtgccggcagtgtgtgtttgccaccaccaccaagagaggaggagccctgaagaagggccccaatgccaaggccctgcaggtgatgaagcagaccctgccctacagcgtggccgacctggagtgggatgctggccacaagaccaacgtgcagcagtgctactgctactgcggcggccctggggactggtacctgaagatgctgcagtgctgcaagtgcaagcagtggttccacgaggcctgtgtgcagtgcctgcagaagcccatgctgtttggagaccgcttctacaccttcatctgcagcgtgtgcagcagcggccctgagtacctgaagaggctgcccctgcagtgggtggacatcgcccacctgtgcctgtacaacctgagcgtcatccacaagaagaagtactttgacagcgagctggagctgatgacctacatcaatgaaaactgggaccggctgcaccctggagagctggccgacacccccaagtcagaaagatatgaacatgtgctggaggccctgaatgactacaagaccatgttcatgtctgggaaggagatcaagaagaagaagcacctgtttggcctgcgcatccgggtgccccctgtgccccccaacgtggccttcaaggccgagaaggagcctgagggcaccagccatgagttcaagatcaagggcaggaaggccagcaagcccatcagtgacagccgggaggtgtccaatggaattgagaagaagggcaagaagaagtctgtgggccggcccccaggcccctacaccaggaagatgatccagaagacagctgagcccctgctggacaaggagagcatcagcgagaaccccaccctggacctgccctgcagcattggaagaacagagggcacagcccacagcagcaacaccagtgatgtggacttcaccggggccagcagcgccaaggagaccaccagcagcagcatcagccgccactacggcctgagtgacagcaggaagaggaccaggacaggccgctcctggccagctgccatcccccacctgcggaggagaagaggccgcctgccccggcgggccctgcagacccagaacagcgagatcgtgaaggatgatgagggcaaggaggactaccagtttgatgagctgaacacagagatcctgaacaacctggccgaccaggagctgcagctgaaccacctgaagaacagcatcaccagctactttggagctgctggccgcatcgcctgtggggagaagtacagagtgctggcccggcgggtgaccctggatggcaaggtgcagtacctggtggagtgggagggcgccacagccagctag

SEQ ID NO: 159486 - DNA, 1611 bp, Artificial Sequence
  Description of Artificial Sequence: Synthetic coding sequence
atgagggacagcactggagctggcaacagcctggtgcacaagaggagccccctgcggaggaaccagaagacccccaccagcctgaccaagctgagcctgcaggacggccacaaggccaagaagccagcctgcaagtttgaggagggccaggatgtgctggcccgctggagcgatggcctcttctacctgggcaccatcaagaagatcaacatcctgaagcagagctgcttcatcatctttgaggacagcagcaagtcctgggtgctgtggaaggacatccagacaggagccaccggcagcggggagatggtgtgcaccatctgccaggaggagtacagcgaggccccaaatgagatggtgatctgtgacaagtgtggccagggctaccaccagctgtgccacaccccccacatcgactgcagcgtgattgacagtgatgagaagtggctgtgccggcagtgtgtgtttgccaccaccaccaagagaggaggagccctgaagaagggccccaatgccaaggccctgcaggtgatgaagcagaccctgccctacagcgtggccgacctggagtgggatgctggccacaagaccaacgtgcagcagtgctactgctactgcggcggccctggggactggtacctgaagatgctgcagtgctgcaagtgcaagcagtggttccacgaggcctgtgtgcagtgcctgcagaagcccatgctgtttggagaccgcttctacaccttcatctgcagcgtgtgcagcagcggccctgagtacctgaagaggctgcccctgcagtgggtggacatcgcccacctgtgcctgtacaacctgagcgtcatccacaagaagaagtactttgacagcgagctggagctgatgacctacatcaatgaaaactgggaccggctgcaccctggagagctggccgacacccccaagtcagaaagatatgaacatgtgctggaggccctgaatgactacaagaccatggaggtgtccaatggcatcgagaagaagggcaagaagaagtctgtgggccggcccccaggcccctacaccaggaagatgatccagaagacagctgagcccctgctggacaaggagagcatcagcgagaaccccaccctggacctgccctgcagcatcggccgcacagagggcacagcccacagcagcaacaccagtgatgtggacttcaccggggccagcagcgccaaggagaccaccagcagcagcatcagccgccactacggcctgagtgacagcaggaagaggaccaggacaggccgctcctggccagctgccatcccccacctgcggcggcggcggggccgcctgccccggcgggccctgcagacccagaacagcgagatcgtgaaggatgatgagggcaaggaggactaccagtttgatgagctgaacacagagatcctgaacaacctggccgaccaggagctgcagctgaaccacctgaagaacagcatcaccagctactttggagctgctggaagaattgcctgtggggagaagtacagagtgctggcccggcgggtgaccctggatggcaaggtgcagtacctggtggagtgggagggcgccacagccagctag

SEQ ID NO: 159487 - DNA, 861 bp, Artificial Sequence
  Description of Artificial Sequence: Synthetic coding sequence
atggtgtgcaccatctgccaggaggagtacagcgaggccccaaatgagatggtgatctgtgacaagtgtggccagggctaccaccagctgtgccacaccccccacatcgactgcagcgtgattgacagtgatgagaagtggctgtgccggcagtgtgtgtttgccaccaccaccaagagaggaggagccctgaagaagggccccaatgccaaggccctgcaggtgatgaagcagaccctgccctacagcgtggccgacctggagtgggatgctggccacaagaccaacgtgcagcagtgctactgctactgcggcggccctggggactggtacctgaagatgctgcagtgctgcaagtgcaagcagtggttccacgaggcctgtgtgcagtgcctgcagaagcccatgctgtttggagaccgcttctacaccttcatctgcagcgtgtgcagcagcggccctgagtacctgaagaggctgcccctgcagtgggtggacatcgcccacctgtgcctgtacaacctgagcgtcatccacaagaagaagtactttgacagcgagctggagctgatgacctacatcaatgaaaactgggaccggctgcaccctggagagctggccgacacccccaagtcagaaagatatgaacatgtgctggaggccctgaatgactacaagaccatgttcatgtctgggaaggagatcaagaagaagaagcacctgtttggcctgcgcatccgggtgccccctgtgccccccaacgtggccttcaaggccgagaaggagcctgagggcaccagccatgagttcaagctgaaggccgagcggcaccccaacctgtacctgatccagggcaagtag

SEQ ID NO: 159488 - DNA, 1476 bp, Artificial Sequence
  Description of Artificial Sequence: Synthetic coding sequence
atggtgtgcaccatctgccaggaggagtacagcgaggccccaaatgagatggtgatctgtgacaagtgtggccagggctaccaccagctgtgccacaccccccacatcgactgcagcgtgattgacagtgatgagaagtggctgtgccggcagtgtgtgtttgccaccaccaccaagagaggaggagccctgaagaagggccccaatgccaaggccctgcaggtgatgaagcagaccctgccctacagcgtggccgacctggagtgggatgctggccacaagaccaacgtgcagcagtgctactgctactgcggcggccctggggactggtacctgaagatgctgcagtgctgcaagtgcaagcagtggttccacgaggcctgtgtgcagtgcctgcagaagcccatgctgtttggagaccgcttctacaccttcatctgcagcgtgtgcagcagcggccctgagtacctgaagaggctgcccctgcagtgggtggacatcgcccacctgtgcctgtacaacctgagcgtcatccacaagaagaagtactttgacagcgagctggagctgatgacctacatcaatgaaaactgggaccggctgcaccctggagagctggccgacacccccaagtcagaaagatatgaacatgtgctggaggccctgaatgactacaagaccatgttcatgtctgggaaggagatcaagaagaagaagcacctgtttggcctgcgcatccgggtgccccctgtgccccccaacgtggccttcaaggccgagaaggagcctgagggcaccagccatgagttcaagatcaagggcaggaaggccagcaagcccatcagtgacagccgggaggtgtccaatggaattgagaagaagggcaagaagaagtctgtgggccggcccccaggcccctacaccaggaagatgatccagaagacagctgagcccctgctggacaaggagagcatcagcgagaaccccaccctggacctgccctgcagcattggaagaacagagggcacagcccacagcagcaacaccagtgatgtggacttcaccggggccagcagcgccaaggagaccaccagcagcagcatcagccgccactacggcctgagtgacagcaggaagaggaccaggacaggccgctcctggccagctgccatcccccacctgcggaggagaagaggccgcctgccccggcgggccctgcagacccagaacagcgagatcgtgaaggatgatgagggcaaggaggactaccagtttgatgagctgaacacagagatcctgaacaacctggccgaccaggagctgcagctgaaccacctgaagaacagcatcaccagctactttggagctgctggccgcatcgcctgtggggagaagtacagagtgctggcccggcgggtgaccctggatggcaaggtgcagtacctggtggagtgggagggcgccacagccagctag

SEQ ID NO: 159489 - DNA, 1476 bp, Artificial Sequence; identical to SEQ ID NO: 159488
  Description of Artificial Sequence: Synthetic coding sequence

SEQ ID NO: 159490 - DNA, 1191 bp, Artificial Sequence
  Description of Artificial Sequence: Synthetic coding sequence
atggccatgattgagctgggcttcggccggcagaacttccaccccctgaagaggaagagcagcctgctgctgaagctgattgctgtggtgtttgctgtgctgctcttctgtgagttcctgatctactacctggccatcttccagtgcaactggccagaggtgaagaccacagccagtgatggagagcagaccacccgggagcctgtgctgaaggccatgttcctggccgacacccacctgctgggggagttcctgggccactggctggacaagctgcggcgggagtggcagatggagcgggccttccagacagccctgtggctgctgcagcctgaggtggtgttcatcctgggggacatctttgatgagggcaagtggagcaccccagaggcctgggcagatgatgtggagcgcttccagaagatgttccgccaccccagccacgtgcagctgaaggtggtggccggcaaccacgacatcggcttccactatgagatgaacacctacaaggtggagagatttgagaaggtgttcagcagcgagcggctcttctcctggaagggcatcaactttgtgatggtgaacagcgtggccctgaatggagatggctgcggcatctgcagcgagacagaggccgagctgattgaggtgagccaccggctgaactgcagccgggaggcccggggcagcagccgctgtggccctggccccctgctgcccaccagcgcccctgtgctgctgcagcactaccccctgtaccgccgcagtgatgccaactgcagcggagaagatgctgccccagctgaggagcgggacatccccttcaaggaaaattatgatgtgctgagccgggaggccagccagaagctgctgtggtggctgcagccccggctggtgctgagcggccacacccacagcgcctgtgaggtgcaccacggcggccgggtgcctgagctgtctgtgcccagcttctcctggaggaacagaaacaaccccagcttcatcatgggcagcatcacccccacagactacaccctgagcaagtgctacctgccccgggaggatgtggtgctgatcatctactgcggcgtggtgggcttcctggtggtgctgaccctgacccacttcggcctgctggccagccccttcctgagcggcctgaacctgctgggcaagaggaagaccaggtag

SEQ ID NO: 159491 - DNA, 1002 bp, Artificial Sequence
  Description of Artificial Sequence: Synthetic coding sequence
atggccatgattgagctgggcttcggccggcagaacttccaccccctgaagaggaagagcagcctgctgctgaagctgattgctgtggtgtttgctgtgctgctcttctgtgagttcctgatctactacctggccatcttccagtgcaactggccagaggtgaagaccacagccagtgatggagagcagaccacccgggagcctgtgctgaaggccatgttcctggccgacacccacctgctgggggagttcctgggccactggctggacaagctgcggcgggagtggcagatggagcgggccttccagacagccctgtggctgctgcagcctgaggtggtgttcatcctgggggacatctttgatgagggcaagtggagcaccccagaggcctgggcagatgatgtggagcgcttccagaagatgttccgccaccccagccacgtgcagctgaaggtggtggccggcaaccacgacatcggcttccactatgagatgaacacctacaaggtggagagatttgagaaggtgttcagcagcgagcggctcttctcctggaagggcatcaactttgtgatggtgaacagcgtggccctgaatggagatggctgcggcatctgcagcgagacagaggccgagctgattgaggtgagccaccggctgaactgcagccgggagctgctgtggtggctgcagccccggctggtgctgagcggccacacccacagcgcctgtgaggtgcaccacggcggccgggtgcctgagctgtctgtgcccagcttctcctggaggaacagaaacaaccccagcttcatcatgggcagcatcacccccacagactacaccctgagcaagtgctacctgcccagagaagatgtggtgctgatcatctactgcggcgtggtgggcttcctggtggtgctgaccctgacccacttcggcctgctggccagccccttcctgagcggcctgaacctgctgggcaagaggaagaccaggtag

SEQ ID NO: 159492 - DNA, 732 bp, Artificial Sequence
  Description of Artificial Sequence: Synthetic coding sequence
atggagcgggccttccagacagccctgtggctgctgcagcctgaggtggtgttcatcctgggggacatctttgatgagggcaagtggagcaccccagaggcctgggcagatgatgtggagcgcttccagaagatgttccgccaccccagccacgtgcagctgaaggtggtggccggcaaccacgacatcggcttccactatgagatgaacacctacaaggtggagagatttgagaaggtgttcagcagcgagcggctcttctcctggaagggcatcaactttgtgatggtgaacagcgtggccctgaatggagatggctgcggcatctgcagcgagacagaagctgagctgattgaggtgagccaccggctgaactgcagccgggaggcccggggcagcagccgctgtggccctggccccctgctgcccaccagcgcccctgtgctgctgcagcactaccccctgtacagaagaagtgatgccaactgcagcggggaggatgctgccccagctgaggagcgggacatccccttcaaggagaactatgatgtgctgagccgggaggccagccagaagctgctgtggtggctgcagccccggctggtgctgagcggccacacccacagcgcctgtgaggtgcaccacggcggccgggtgcctgagctgtctgtgcccagcttctcctggaggaacagaaacaaccccagcttcatcatgggcacagatgcctag

SEQ ID NO: 159493 - DNA, 1194 bp, Artificial Sequence
  Description of Artificial Sequence: Synthetic coding sequence
atggccatgattgagctgggcttcggccggcagaacttccaccccctgaagaggaagagcagcctgctgctgaagctgattgctgtggtgtttgctgtgctgctcttctgtgagttcctgatctactacctggccatcttccagtgcaactggccagaggtgaagaccacagccagtgatggagagcagaccacccgggagcctgtgctgaaggccatgttcctggccgacacccacctgctgggggagttcctgggccactggctggacaagctgcggcgggagtggcagatggagcgggccttccagacagccctgtggctgctgcagcctgaggtggtgttcatcctgggggacatctttgatgagggcaagtggagcaccccagaggcctgggcagatgatgtggagcgcttccagaagatgttccgccaccccagccacgtgcagctgaaggtggtggccggcaaccacgacatcggcttccactatgagatgaacacctacaaggtggagagatttgagaaggtgttcagcagcgagcggctcttctcctggaagggcatcaactttgtgatggtgaacagcgtggccctgaatggagatggctgcggcatctgcagcgagacagaggccgagctgattgaggtgagccaccggctgaactgcagccgggagcaggcccggggcagcagccgctgtggccctggccccctgctgcccaccagcgcccctgtgctgctgcagcactaccccctgtacagaagaagtgatgccaactgcagcggggaggatgctgccccagctgaggagcgggacatccccttcaaggagaactatgatgtgctgagccgggaggccagccagaagctgctgtggtggctgcagccccggctggtgctgagcggccacacccacagcgcctgtgaggtgcaccacggcggccgggtgcctgagctgtctgtgcccagcttctcctggaggaacagaaacaaccccagcttcatcatgggcagcatcacccccacagactacaccctgagcaagtgctacctgcccagagaagatgtggtgctgatcatctactgcggcgtggtgggcttcctggtggtgctgaccctgacccacttcggcctgctggccagccccttcctgagcggcctgaacctgctgggcaagaggaagaccaggtag

SEQ ID NO: 159494 - DNA, 1026 bp, Artificial Sequence
  Description of Artificial Sequence: Synthetic coding sequence
atggccatgattgagctgggcttcggccggcagaacttccaccccctgaagaggaagagcagcctgctgctgaagctgattgctgtggtgtttgctgtgctgctcttctgtgagttcctgatctactacctggccatcttccagtgcaactggccagaggtgaagaccacagccagtgatggagagcagaccacccgggagcctgtgctgaaggccatgttcctggccgacacccacctgctgggggagttcctgggccactggctggacaagctgcggcgggagtggcagatggagcgggccttccagacagccctgtggctgctgcagcctgaggtggtgttcatcctgggggacatctttgatgagggcaagtggagcaccccagaggcctgggcagatgatgtggagcgcttccagaagatgttccgccaccccagccacgtgcagctgaaggtggtggccggcaaccacgacatcggcttccactatgagatgaacacctacaaggtggagagatttgagaaggtgttcagcagcgagcggctcttctcctggaagggcatcaactttgtgatggtgaacagcgtggccctgaatggagatggctgcggcatctgcagcgagacagaggccgagctgattgaggtgagccaccggctgaactgcagccgggagcaggcccggggcagcagccgctgtggccctggccccctgctgcccaccagcgcccctgtgctgctgcagcactaccccctgtacagaagaagtgatgccaactgcagcggggaggatgctgccccagctgaggagcgggacatccccttcaaggagaactatgatgtgctgagccgggaggccagccagaagctgctgtggtggctgcagccccggctggtgctgagcggccacacccacagcgcctgtgaggtgcaccacggcggccgggtgcctgagctgtctgtgcccagcttctcctggaggaacagaaacaaccccagcttcatcatgggcacagatgcctag

SEQ ID NO: 159495 - DNA, 1191 bp, Artificial Sequence; identical to SEQ ID NO: 159490
  Description of Artificial Sequence: Synthetic coding sequence

SEQ ID NO: 159496 - DNA, 360 bp, Artificial Sequence
  Description of Artificial Sequence: Synthetic coding sequence
atgtggaggagccgctgggatgcctctgtgctgaaggccgaggccctggccctgctgccctgtggcctgggcatggccttcagccagagccacgtgatggccgcccggcggcaccagcacagccgcctcatcatcgaggtggatgagtacagcagcaaccccacccaggccttcaccttctacaacatcaaccagggccgcttccagcccccccacgtgcagatggtggaccctgtgccccatgatgcccccaagcccccaggctacaccaggtttgtgtgtgtgtctgacacccacagcaggacagaccccatccagatgccctatggagatgtgctgattcatgctggggacttctag

SEQ ID NO: 159497 - DNA, 663 bp, Artificial Sequence
  Description of Artificial Sequence: Synthetic coding sequence
atgccctatggagatgtgctgattcatgctggggacttcacagagctgggcctgcccagcgaggtgaagaagttcaatgagtggctgggcagcctgccctatgagtacaagatcgtgattgctggcaaccacgagctgacctttgaccaggagttcatggctgacctgatcaagcaggacttctactacttccccagcgtgtccaagctgaagccagaaaattatgaaaatgtgcagagcctgctgaccaactgcatctacctgcaggacagcgaggtgacagtgcggggcttccgcatctacggcagcccctggcagccctggttctacggctggggcttcaacctgccccggggccaggccctgctggagaagtggaacctgatccctgagggcgtggacatcctgatcacccacggcccccccctgggcttcctggactgggtgcccaagaagatgcagagggtgggctgtgtggagctgctgaacacagtgcagaggagagtgcagccccggctgcacgtgtttggccacatccacgagggctatggagtgatggctgatggcaccaccacctacgtgaatgcctctgtgtgcaccgtgaactaccagcctgtgaacccccccatcgtcatcgacctgcccacccccaggaacagctag

SEQ ID NO: 159498 - DNA, 981 bp, Artificial Sequence
  Description of Artificial Sequence: Synthetic coding sequence
atgtggaggagccgctgggatgcctctgtgctgaaggccgaggccctggccctgctgccctgtggcctgggcatggccttcagccagagccacgtgatggccgcccggcggcaccagcacagccgcctcatcatcgaggtggatgagtacagcagcaaccccacccaggccttcaccttctacaacatcaaccagggccgcttccagcccccccacgtgcagatggtggaccctgtgccccatgatgcccccaagcccccaggctacaccaggtttgtgtgtgtgtctgacacccacagcaggacagaccccatccagatgccctatggagatgtgctgattcatgctggggacttcacagagctgggcctgcccagcgaggtgaagaagttcaatgagtggctgggcagcctgccctatgagtacaagatcgtgattgctggcaaccacgagctgacctttgaccaggagttcatggctgacctgatcaagcaggacttctactacttccccagcgtgtccaagctgaagccagaaaattatgaaaatgtgcagagcctgctgaccaactgcatctacctgcaggacagcgaggtgacagtgcggggcttccgcatctacggcagcccctggcagccctggttctacggctggggcttcaacctgccccggggccaggccctgctggagaagtggaacctgatccctgagggcgtggacatcctgatcacccacggcccccccctgggcttcctggactgggtgcccaagaagatgcagagggtgggctgtgtggagctgctgaacacagtgcagaggagagtgcagccccggctgcacgtgtttggccacatccacgagggctatggagtgatggctgatggcaccaccacctacgtgaatgcctctgtgtgcaccgtgaactaccagcctgtgaacccccccatcgtcatcgacctgcccacccccaggaacagctag

SEQ ID NO: 159499 - DNA, 507 bp, Artificial Sequence
  Description of Artificial Sequence: Synthetic coding sequence
atggctgacctgatcaagcaggacttctactacttccccagcgtgtccaagctgaagccagaaaattatgaaaatgtgcagagcctgctgaccaactgcatctacctgcaggacagcgaggtgacagtgcggggcttccgcatctacggcagcccctggcagccctggttctacggctggggcttcaacctgccccggggccaggccctgctggagaagtggaacctgatccctgagggcgtggacatcctgatcacccacggcccccccctgggcttcctggactgggtgcccaagaagatgcagagggtgggctgtgtggagctgctgaacacagtgcagaggagagtgcagccccggctgcacgtgtttggccacatccacgagggctatggagtgatggctgatggcaccaccacctacgtgaatgcctctgtgtgcaccgtgaactaccagcctgtgaacccccccatcgtcatcgacctgcccacccccaggaacagctag

SEQ ID NO: 159500 - DNA, 981 bp, Artificial Sequence; identical to SEQ ID NO: 159498
  Description of Artificial Sequence: Synthetic coding sequence

SEQ ID NO: 159501 - DNA, 225 bp, Artificial Sequence
  Description of Artificial Sequence: Synthetic coding sequence
atgtggaggagccgctgggatgcctctgtgctgaaggccgaggccctggccctgctgccctgtggcctgggcatggccttcagccagagccacgtgatggccgcccggcggcaccagcacagccgcctcatcatcgaggtggatgagtacagcagcaaccccacccaggccttcaccttctacaacatcaaccagggccgcttccagcccccccacgtgcagtag

SEQ ID NO: 159502 - DNA, 1080 bp, Artificial Sequence
  Description of Artificial Sequence: Synthetic coding sequence
atgaatggccgggagacccagagcgtgagccgcagcggcggcggccctggctgcggcggcggcagcggcggccgctgccggggcggcagaagaagatccatgtggaggagccgctgggatgcctctgtgctgaaggccgaggccctggccctgctgccctgtggcctgggcatggccttcagccagagccacgtgatggccgcccggcggcaccagcacagccgcctcatcatcgaggtggatgagtacagcagcaaccccacccaggccttcaccttctacaacatcaaccagggccgcttccagccccctcatgtgcagatggtggaccctgtgccccatgatgcccccaagcccccaggctacaccaggtttgtgtgtgtgtctgacacccacagcaggacagaccccatccagatgccctatggagatgtgctgattcatgctggggacttcacagagctgggcctgcccagcgaggtgaagaagttcaatgagtggctgggcagcctgccctatgagtacaagatcgtgattgctggcaaccacgagctgacctttgaccaggagttcatggctgacctgatcaagcaggacttctactacttccccagcgtgtccaagctgaagccagagaactatgaaaatgtgcagagcctgctgaccaactgcatctacctgcaggacagcgaggtgacagtgcggggcttccgcatctacggcagcccctggcagccctggttctacggctggggcttcaacctgccccggggccaggccctgctggagaagtggaacctgatccctgagggcgtggacatcctgatcacccacggcccccccctgggcttcctggactgggtgcccaagaagatgcagagggtgggctgtgtggagctgctgaacacagtgcagaggagagtgcagccccggctgcacgtgtttggccacatccacgagggctacggcgtgatggctgatggcaccaccacctacgtgaatgcctctgtgtgcaccgtgaactaccagcctgtgaacccccccatcgtgattgacctgcccaccccaagaaacagctag

SEQ ID NO: 159503 - DNA, 981 bp, Artificial Sequence; identical to SEQ ID NO: 159498
  Description of Artificial Sequence: Synthetic coding sequence

SEQ ID NO: 159504 - DNA, 915 bp, Artificial Sequence
  Description of Artificial Sequence: Synthetic coding sequence
atgtggaggagcttcagccagagccacgtgatggccgcccggcggcaccagcacagccgcctcatcatcgaggtggatgagtacagcagcaaccccacccaggccttcaccttctacaacatcaaccagggccgcttccagcccccccacgtgcagatggtggaccctgtgccccatgatgcccccaagcccccaggctacaccaggtttgtgtgtgtgtctgacacccacagcaggacagaccccatccagatgccctatggagatgtgctgattcatgctggggacttcacagagctgggcctgcccagcgaggtgaagaagttcaatgagtggctgggcagcctgccctatgagtacaagatcgtgattgctggcaaccacgagctgacctttgaccaggagttcatggctgacctgatcaagcaggacttctactacttccccagcgtgtccaagctgaagccagaaaattatgaaaatgtgcagagcctgctgaccaactgcatctacctgcaggacagcgaggtgacagtgcggggcttccgcatctacggcagcccctggcagccctggttctacggctggggcttcaacctgccccggggccaggccctgctggagaagtggaacctgatccctgagggcgtggacatcctgatcacccacggcccccccctgggcttcctggactgggtgcccaagaagatgcagagggtgggctgtgtggagctgctgaacacagtgcagaggagagtgcagccccggctgcacgtgtttggccacatccacgagggctatggagtgatggctgatggcaccaccacctacgtgaatgcctctgtgtgcaccgtgaactaccagcctgtgaacccccccatcgtcatcgacctgcccacccccaggaacagctag

SEQ ID NO: 159505 - DNA, 885 bp, Artificial Sequence
  Description of Artificial Sequence: Synthetic coding sequence
atggcccacggcatccccagccagggcaaggtgaccatcaccgtggatgagtacagcagcaaccccacccaggccttcacccactacaacatcaaccagagccgcttccagcccccccacgtgcacatggtggaccccatcccctatgacacccccaagccagctggccacaccaggtttgtgtgcatcagtgacacccacagcaggacagatggcatccagatgccctatggagacatcctgctgcacactggagacttcacagagctgggcctgcccagcgaggtgaagaagttcaatgactggctgggcaacctgccctatgagtacaagatcgtgattgctggcaaccacgagctgacctttgacaaggagttcatggctgacctggtgaagcaggactactaccgcttccccagcgtgtccaagctgaagccagaagattttgacaacgtgcagagcctgctgaccaacagcatctacctgcaggacagcgaggtgacagtgaagggcttccgcatctatggagccccctggaccccctggttcaacggctggggcttcaacctgccccggggccagagcctgctggacaagtggaacctgatccctgagggcatcgacatcctgatgacccacggcccccccctgggcttccgggactgggtgcccaaggagctgcagagggtgggctgtgtggagctgctgaacacagtgcagaggagagtgcggcccaagctgcacgtgtttggaggcatccacgagggctacggcatcatgacagatggctacaccacctacatcaatgccagcacctgcaccgtgtccttccagcccaccaacccccccatcatctttgacctgcccaacccccagggcagctag

SEQ ID NO: 159506 - DNA, 834 bp, Artificial Sequence
  Description of Artificial Sequence: Synthetic coding sequence
atggcccacggcatccccagccagggcaaggtgaccatcaccgtggatgagtacagcagcaaccccacccaggccttcacccactacaacatcaaccagagccgcttccagcccccccacgtgcacatggtggaccccatcccctatgacacccccaagccagctggccacaccaggtttgtgtgcatcagtgacacccacagcaggacagatggcatccagatgccctatggagacatcctgctgcacactggagacttcacagagctgggcctgcccagcgaggtgaagaagttcaatgactggctgggcaacctgccctatgagtacaagatcgtgattgctggcaaccacgagctgacctttgacaaggagttcatggctgacctggtgaagcaggactactaccgcttccccagcgtgtccaagctgaagccagaagattttgacaacgtgcagagcctgctgaccaacagcatctacctgcaggacagcgaggtgacagtgaagggcttccgcatctatggagccccctggaccccctggttcaacggctggggcttcaacctgccccggggccagagcctgctggacaagtggaacctgatccctgagggcatcgacatcctgatgacccacggcccccccctgggcttccgggactgggtgcccaaggagctgcagagggtgggctgtgtggagctgctgaacacagtgcagaggagagtgcggcccaagctgcacgtgtttggaggcatccacgaggtgaaccctgtgtccatcagcaaggccctgcggaccaagatctgcagcctgcccagcaagaccagctag

SEQ ID NO: 159507 - DNA, 132 bp, Artificial Sequence
  Description of Artificial Sequence: Synthetic coding sequence
atggcccacggcatccccagccagggcaaggtgaccatcaccgtggatgagtacagcagcaaccccacccaggccttcacccactacaacatcaaccagagccgcttccagcccccccacgtgcacatgtag

SEQ ID NO: 159508 - DNA, 186 bp, Artificial Sequence
  Description of Artificial Sequence: Synthetic coding sequence
atggaccccaactgcagctgtgccactggaggcagctgcacctgcaccggcagctgcaagtgcaaggagtgcaagtgcaccagctgcaagaagagctgctgcagctgctgccccatgagctgtgccaagtgtgcccagggctgcatctgcaagggggccagcgagaagtgcagctgctgtgcctag

SEQ ID NO: 159509 - DNA, 186 bp, Artificial Sequence
  Description of Artificial Sequence: Synthetic coding sequence
atggaccccaactgcagctgcaccactggaggcagctgtgcctgtgccggcagctgcaagtgcaaggagtgcaagtgcaccagctgcaagaagtgctgctgcagctgctgccctgtgggctgtgccaagtgtgcccagggctgtgtgtgcaagggcagcagcgagaagtgccgctgctgtgcctag

SEQ ID NO: 159510 - DNA, 186 bp, Artificial Sequence
  Description of Artificial Sequence: Synthetic coding sequence
atggaccccaactgcagctgtgccactggaggcagctgcacctgtgccggcagctgcaagtgcaaggagtgcaagtgcaccagctgcaagaagagctgctgcagctgctgccctgtgggctgtgccaagtgtgcccagggctgtgtgtgcaagggggccagcgagaagtgcagctgctgtgcctag

SEQ ID NO: 159511 - DNA, 384 bp, Artificial Sequence
  Description of Artificial Sequence: Synthetic coding sequence
atggaccccaactgcagctgtgccactggaggcagctgcacctgtgccggcagctgcaagtgcaaggagtgcaagtgcaccagctgcaagaagtcagaatgtggggccatcagcaggaacctgggcctgtggctgcggctgggcggcaacagccggctggccctgagcgccagcttctggggcaccggcctgagcctgcccagcctgcctgtgtccttccccctgcaggccttctgccccaagttccgctggggccgcacagccttcttctcctgggacaccaaccccaactgcaccccctacggcttcagaacagagctgtgccagaccaagaagagcatcctgtgggtgtgggtgctgagcagcagccaggcctgctactag

SEQ ID NO: 159512 - DNA, 186 bp, Artificial Sequence
  Description of Artificial Sequence: Synthetic coding sequence
atggaccccaactgcagctgtgccgccggcgtgtcctgcacctgtgccggcagctgcaagtgcaaggagtgcaagtgcaccagctgcaagaagagctgctgcagctgctgccctgtgggctgcagcaaatgtgcccagggctgtgtgtgcaagggggccagcgagaagtgcagctgctgtgactag

SEQ ID NO: 159513 - DNA, 189 bp, Artificial Sequence
  Description of Artificial Sequence: Synthetic coding sequence
atggaccccaactgcagctgtgccgccgccggcgtgtcctgcacctgtgccggcagctgcaagtgcaaggagtgcaagtgcaccagctgcaagaagagctgctgcagctgctgccctgtgggctgcagcaaatgtgcccagggctgtgtgtgcaagggggccagcgagaagtgcagctgctgtgactag

SEQ ID NO: 159514 - DNA, 189 bp, Artificial Sequence
  Description of Artificial Sequence: Synthetic coding sequence
atggaccccaactgcagctgtgccgccgccggcgtgtcctgcacctgtgccagcagctgcaagtgcaaggagtgcaagtgcaccagctgcaagaagagctgctgcagctgctgccctgtgggctgtgccaagtgtgcccagggctgcatctgcaagggggccagcgagaagtgcagctgctgtgcctag

SEQ ID NO: 159515 - DNA, 186 bp, Artificial Sequence
  Description of Artificial Sequence: Synthetic coding sequence
atggaccccaactgcagctgtgccgccggcgtgtcctgcacctgtgccagcagctgcaagtgcaaggagtgcaagtgcaccagctgcaagaagagctgctgcagctgctgccctgtgggctgtgccaagtgtgcccagggctgcatctgcaagggggccagcgagaagtgcagctgctgtgcctag

SEQ ID NO: 159516 - DNA, 186 bp, Artificial Sequence
  Description of Artificial Sequence: Synthetic coding sequence
atggaccccaactgcagctgtgaggccggcggcagctgtgcctgtgccggcagctgcaagtgcaagaagtgcaagtgcaccagctgcaagaagagctgctgcagctgctgccccctgggctgtgccaagtgtgcccagggctgcatctgcaagggggccagcgagaagtgcagctgctgtgcctag

SEQ ID NO: 159517 - DNA, 186 bp, Artificial Sequence
  Description of Artificial Sequence: Synthetic coding sequence
atggaccccaactgcagctgcagccctgtgggcagctgtgcctgtgccggcagctgcaagtgcaaggagtgcaagtgcaccagctgcaagaagagctgctgcagctgctgccctgtgggctgtgccaagtgtgcccagggctgcatctgcaagggcaccagtgacaagtgcagctgctgtgcctag

SEQ ID NO: 159518 - DNA, 186 bp, Artificial Sequence
  Description of Artificial Sequence: Synthetic coding sequence
atggaccccaactgcagctgtgccgccggggacagctgcacctgtgccggcagctgcaagtgcaaggagtgcaagtgcaccagctgcaagaagagctgctgcagctgctgccctgtgggctgtgccaagtgtgcccagggctgcatctgcaagggggccagtgacaagtgcagctgctgtgcctag

SEQ ID NO: 159519 - DNA, 207 bp, Artificial Sequence
  Description of Artificial Sequence: Synthetic coding sequence
atggaccctgagacctgcccctgccccagcggcggcagctgcacctgtgccgacagctgcaagtgtgagggctgcaagtgcaccagctgcaagaagagctgctgcagctgctgcccagcagaatgtgagaagtgtgccaaggactgtgtgtgcaagggcggggaggccgctgaggccgaggccgagaagtgcagctgctgccagtag

SEQ ID NO: 159520 - DNA, 687 bp, Artificial Sequence
  Description of Artificial Sequence: Synthetic coding sequence
atgaagatcaagccaggcttcatgggcaaggccaccccaccctatgatgtgcagttccacatggaggcctctgtggagaactgcatcatcgtgtccatgaacacagctgaccccggcagccagggcatcacccacagcctgctgctgcaggtgattgatgacaagggcagcatcctgccccccaacacagagggcaacatcggcatccgcatcaagcctgtgcggcctgtgtccctcttcatgtgctatgaaggagaccctgagaagacagccaaggtggagtgtggggacttctacaacacaggagaccggggcaagatggatgaggagggctacatctgcttcctgggccgcagtgatgacatcatcaatgccagcggctaccgcatcggccctgctgaggtggagagcgccctggtggagcaccctgctgtggccgagagcgctgtggtgggcagcccagaccccatccggggggaggtggtgaaggccttcatcgtgctgaccccccagttcctgagccatgacaaggaccagctgaccaaggagctgcagcagcacgtgaagtctgtgacagccccctacaagtaccccaggaaggtggagtttgtgtctgagctgcccaagaccatcaccgggaagattgaaaggaaggagctgaggaagaaggagaccggccagatgtag

SEQ ID NO: 159521 - DNA, 1527 bp, Artificial Sequence
  Description of Artificial Sequence: Synthetic coding sequence
atggaggagggccccctgcccggcggcctgcccagcccagaagatgccatggtgacagagctgctgagccctgagggcccctttgcctctgaaaatattggcctgaaggcccctgtgaagtatgaagaagatgagttccacgtgttcaaggaggcctacctgggccctgctgaccccaaggagcctgtgctgcacgccttcaacccagccctgggcgctgactgcaagggccaggtgaaggccaagctggccggcggggacagtgatggaggagagctgctgggggagtacccaggcatccctgagctgagcgccctggaggatgtggccctgctgcaggccccccagcccccagcctgcaatgtgcacttcctgagcagcctgctgcctgcccacaggagccctgctgtgctgcccctgggcgcctgggtgctggagggcgccagccaccctggggtgaggatgatccctgtggagatcaaggaggccggcggcaccaccaccagcaacaaccctgaggaggccaccctgcagaacctgctggcccaggagagctgctgcaagttccccagcagccaggagctggaggatgccagctgctgcagcctgaagaaggacagcaaccccatggtgatctgccagctgaagggcggcacccagatgctgtgcatcgacaacagcaggacccgggagctgaaggccctgcacctggtgccccagtaccaggaccagaacaactacctgcagagtgatgtgcccaagcccatgacagccctggtgggccgcttcctgcctgccagcaccaagctgaacctgatcacccagcagctggagggcgccctgcccagcgtggtgaatggcagcgccttccccagcggcagcaccctgcccggcccccccaagatcaccctggccggctactgtgactgctttgccagcggggacttctgcaacaactgcaactgcaacaactgctgcaacaacctgcaccacgacatcgagcgcttcaaggccatcaaggcctgcctgggcagaaatcctgaggccttccagcccaagattggcaagggccagctgggcaatgtgaagccccagcacaacaagggctgcaactgcagaagaagtggctgcctgaagaactactgtgaatgttatgaggcccagatcatgtgcagcagcatctgcaagtgcatcggctgcaagaactatgaggagagccctgagaggaagaccctgatgtccatgcccaactacatgcagacaggaggcctggagggcagccactacctgccccccaccaagttcagcggcctgccccgcttcagccatgacagaagacccagcagctgcatctcctgggaggtggtggaggccacctgtgcctgcctgctggcccagggcgaggaggccgagaaggagcactgcagcaagtgcctggccgagcagatgatcctggaggagtttggccgctgcctgagccagatcctgcacacagagttcaagagcaagggcctgaagatggagtag

SEQ ID NO: 159522 - DNA, 756 bp, Artificial Sequence
  Description of Artificial Sequence: Synthetic coding sequence
atggaggagggccccctgcccggcggcctgcccagcccagaagatgccatggtgacagagctgctgagccctgagggcccctttgcctctgaaaatattggcctgaaggcccctgtgaagtatgaagaagatgagttccacgtgttcaaggaggcctacctgggccctgctgaccccaaggagcctgtgctgcacgccttcaacccagccctgggcgctgactgcaagggccaggtgaaggccaagctggccggcggggacagtgatggaggagagctgctgggggagtacccaggcatccctgagctgagcgccctggaggatgtggccctgctgcaggccccccagcccccagcctgcaatgtgcacttcctgagcagcctgctgcctgcccacaggagccctgctgtgctgcccctgggcgcctgggtgctggagggcgccagccaccctggggtgaggatgatccctgtggagatcaaggaggccggcggcaccaccaccagcaacaaccctgaggaggccaccctgcagaacctgctggcccaggagagctgctgcaagttccccagcagccaggagctggaggatgccagctgctgcagcctgaagaaggacagcaaccccatggtgatctgccagctgaagggcggcacccagatgctgtgcatcgacaacagcaggacccgggagctgaaggccctgcacctggtgccccagtaccaggaccagaacaactacctgcagagcgcctag

SEQ ID NO: 159523 - DNA, 921 bp, Artificial Sequence
  Description of Artificial Sequence: Synthetic coding sequence
atggaggagggccccctgcccggcggcctgcccagcccagaagatgccatggtgacagagctgctgagccctgagggcccctttgcctctgaaaatattggcctgaaggcccctgtgaagtatgaagaagatgagttccacgtgttcaaggaggcctacctgggccctgctgaccccaaggagcctgtgctgcacgccttcaacccagccctgggcgctgactgcaagggccaggtgaaggccaagctggccggcggggacagtgatggaggagagctgctgggggagtacccaggcatccctgagctgagcgccctggaggatgtggccctgctgcaggccccccagcccccagcctgcaatgtgcacttcctgagcagcctgctgcctgcccacaggagccctgctgtgctgcccctgggcgcctgggtgctggagggcgccagccaccctggggtgaggatgatccctgtggagatcaaggaggccggcggcaccaccaccagcaacaaccctgaggaggccaccctgcagaacctgctggcccaggagagctgctgcaagttccccagcagccaggagctggaggatgccagctgctgcagcctgaagaaggacagcaaccccatggtgatctgccagctgaagggcggcacccagatgctgtgcatcgacaacagcaggacccgggagctgaaggccctgcacctggtgccccagtaccaggaccagaacaactacctgcagagtgatgtgcccaagcccatgacagccctggtgggccgcttcctgcctgccagcaccaagctgaacctgatcacccagcagctggagggcgccctgcccagcgtggtgaatggcagcgccttccccagcggcagcaccctgcccggcccccccaagatcaccctggccggctag

SEQ ID NO: 159524 - DNA, 2262 bp, Artificial Sequence
  Description of Artificial Sequence: Synthetic coding sequence
atgggagagcacagcccagacaacaacatcatctactttgaagcagaagaagatgagctgaccccagatgacaagatgctgcgctttgtggacaagaatggcctggtgcccagcagcagcggcaccgtgtatgacaggaccaccgtgctgattgagcaggaccccggcaccctggaggatgaagatgatgatggccagtgtggggagcacctgcccttcctggtgggcggggaggagggcttccacctgattgaccacgaggccatgagccagggctacgtgcagcacatcatcagcccagaccagatccacctgaccatcaaccctggcagcacccccatgcccaggaacatcgagggcgccaccctgaccctgcagagcgagtgcccagagaccaagaggaaggaggtgaagcgctaccagtgcacctttgagggctgccccaggacctacagcacagctggcaacctgcggacccaccagaagacccacagaggagagtacacctttgtgtgcaaccaggagggctgcggcaaggccttcctgaccagctacagcctgcgcatccacgtgcgggtgcacaccaaggagaagccctttgaatgtgatgtgcagggctgtgagaaggccttcaacaccctgtaccgcctgaaggcccaccagaggctgcacacaggcaagaccttcaactgtgagagcgagggctgcagcaagtacttcaccaccctgagtgacctgaggaagcacatccgcacccacactggagagaagcccttccgctgtgaccatgatggctgtgggaaggcctttgctgccagccaccacctgaagacccacgtgaggacccacactggagagcggcccttcttctgccccagcaatggctgtgagaagaccttcagcacccagtacagcctgaagagccacatgaagggccatgacaacaagggccacagctacaatgccctgccccagcacaatggaagtgaggacaccaaccacagcctgtgcctgagtgacctgagcctgctgagcacagacagcgagctgcgggagaacagcagcaccacccagggccaggacctgagcaccatcagccctgccatcatctttgagagcatgttccagaacagtgatgacacagccatccaggaggacccccagcagacagccagcctgacagagagcttcaatggagatgctgagagcgtgtctgatgtgccccccagcactggaaacagcgccagcctgagcctgcccctggtgctgcagcccggcctgtctgagcccccccagcccctgctgcctgccagcgcccccagcgcccctcctccagcccccagcctgggccctggcagccagcaggccgccttcggcaaccccccagccctgctgcagcccccagaggtgcctgtgccccacagcacccagtttgctgccaaccaccaggagttcctgccccacccccaggccccccagcccatcgtgcccggcctgtctgtggtggccggggccagcgccagcgctgctgctgtggccagcgctgtggccgccccagccccaccccagagcaccacagagcccctgcctgccatggtgcagaccctgcccctgggcgccaacagcgtgctgaccaacaaccccaccatcaccatcacccccacccccaacacagccatcctgcagagcagcctggtgatgggagagcagaacctgcagtggatcctgaatggagccaccagcagcccccagaaccaggagcagatccagcaggccagcaaggtggagaaggtgttcttcaccacagctgtgcctgtggccagcagccctggcagctctgtgcagcagatcggcctgtctgtgcctgtgatcatcatcaagcaggaggaggcctgccagtgccagtgtgcctgccgggacagcgccaaggagcgggccagcagcaggaggaagggctgcagcagccccccacctcctgagcccagcccccaggccccagatggccccagcctgcagctgcctgcccagaccttcagcagcgcccctgtgcccggcagcagcagcagcaccctgcccagcagctgtgagcagagccggcaggccgagacccccagcgacccccagacagagaccctgagcgccatggatgtgtctgagttcctgagcctgcagagcctggacacccccagcaacctgatccccatcgaggccctgctgcagggcgaggaggagatgggcctgaccagcagcttcagcaagtag

SEQ ID NO: 159525 - DNA, 603 bp, Artificial Sequence
  Description of Artificial Sequence: Synthetic coding sequence
aagcagagccaggtgaagcgctaccagtgcacctttgagggctgccccaggacctacagcacagctggcaacctgcggacccaccagaagacccacagaggagagtacacctttgtgtgcaaccaggagggctgcggcaaggccttcctgaccagctacagcctgcgcatccacgtgcgggtgcacaccaaggagaagccctttgaatgtgatgtgcagggctgtgagaaggccttcaacaccctgtaccgcctgaaggcccaccagaggctgcacacaggcaagaccttcaactgtgagagcgagggctgcagcaagtacttcaccaccctgagtgacctgaggaagcacatccgcacccacactggagagaagcccttccgctgtgaccatgatggctgtgggaaggcctttgctgccagccaccacctgaagacccacgtgaggacccacactggagagcggcccttcttctgccccagcaatggctgtgagaagaccttcagcacccagtacagcctgaagagccacatgaagggccatgacaacaagggccacagctacaatgccctgccccagcacaatggaagtgagagcacctag

SEQ ID NO: 159526 - DNA, 2559 bp, Artificial Sequence
  Description of Artificial Sequence: Synthetic coding sequence
atgctgatcacagagaggaagcacttccgcagcggccgcatcgcccagagcatgtctgaggccaacctgattgacatggaggccggcaagctgagcaagagctgcaacatcacagagtgccaggaccctgacctgctgcacaactggccagatgccttcaccctgcggggcaacaatgccagcaaggtggccaaccccttctggaaccagctgagcgccagcaaccccttcctggatgacatcacccagctgaggaacaacaggaagaggaacaacatcagcatcctgaaggaggaccccttcctgttctgccgggagattgaaaatggaaacagctttgacagcagtggagatgagctggatgtgcaccagctgctgcggcagaccagcagcaggaacagcggccgcagcaagtctgtgtctgagctgctggacatcctggatgacacagcccacgcccaccagagcatccacaacagcgaccagatcctgctgcatgacctggagtggctgaagaatgaccgggaggcctacaagatggcctggctgagccagaggcagctggcccggagctgcctggacctgaacaccatcagccagagccctggctgggcccagacccagctggccgaggtgaccatcgcctgcaaggtgaaccaccagggcggctctgtgcagctgcctgagagtgacatcaccgtgcacgtgccccagggccacgtggccgtgggggagttccaggaggtgtccctgcgggccttcctggaccccccccacatgctgaaccacgacctgagctgcaccgtgagccccctgctggagatcatgctgggcaacctgaacaccatggaggccctgctgctggagatgaagatcggggctgaggtgaggaaggaccccttcagccaggtgatgacagagatggtgtgcctgcacagcctgggcaaggagggccccttcaaggtgctgagcaactgctacatctacaaggacaccatccaggtgaagctgattgacctgagccaggtgatgtacctggtggtggccgcccaggccaaggccctgcccagccctgctgccaccatctgggactacatccacaagaccaccagcatcggcatctacggccccaagtacatccaccccagcttcaccgtggtgctgactgtgtgtggccacaactacatgcctggccagctgaccatcagtgacatcaagaagggcggcaagaacatcagccctgtggtgttccagctgtggggcaagcagagcttcctgctggacaagccccaggacctgagcatcagcatcttcagctgtgaccctgactttgaggtgaagacagaaggagagaggaaggagatcaagcagaagcagctggaggccggggaggtggtgcaccagcagttcctgttcagcctggtggagcaccgggagatgcacctgtttgacttctgtgtgcaggtggagcccccaaatggagagcctgtggcccagttcagcatcaccaccccagaccccacccccaacctgaagaggctgagcaacctgcccggctacctgcagaagaaggaggagatcaagagcgcccccctgagccccaagatcctggtgaagtaccccaccttccaggacaagaccctgaacttcagcaactatggagtgaccctgaaggctgtgctgcggcagagcaagattgactacttcctggagtacttcaagggggacaccatcgccctgctgggggagggcaaggtgaaggccatcggccagagcaaggtgaaggagtggtacgtgggcgtgctgcggggcaagattggcctggtgcactgcaagaatgtgaaggtgatcagcaaggagcaggtgatgttcatgtctgacagcgtcttcaccaccaggaacctgctggagcagatcgtgctgcccctgaagaagctgacctacatctacagcgtggtgctgaccctggtgtctgagaaggtgtatgactggaaggtgctggctgatgtgctgggctacagccacctgagcctggaggactttgaccagatccaggccgacaaggagagcgagaaggtgtcctatgtgatcaagaagctgaaggaggactgccacacagagaggaacaccaggaagttcctgtatgagctgattgtggccctgctgaagatggactgccaggagctggtggcccggctcatccaggaggccgctgtgctgaccagcgctgtgaagctgggcaagggctggagggagctggccgagaagctggtgcggctgaccaagcagcagatggaggcctatgagatcccccaccggggcaacacaggagatgtggccgtggagatgatgtggaagccagcctatgacttcctgtacacctggagcgcccactacggcaacaactacagagatgtgctgcaggacctgcagagcgccctggacaggatgaagaaccctgtgaccaagcactggagggagctgactggagtgctgatcctggtgaacagcctggaggtgctgcgggtgacagccttcagcaccagcgaggaggtgtag

SEQ ID NO: 159527 - DNA, 2559 bp, Artificial Sequence; identical to SEQ ID NO: 159526
  Description of Artificial Sequence: Synthetic coding sequence

SEQ ID NO: 159528 - DNA, 1308 bp, Artificial Sequence
  Description of Artificial Sequence: Synthetic coding sequence
atgctgctgggcggcccccccaggagccccaggagcggcaccagccccaagggcccctggagcagcactggacatgtgcagtttgggaagagcccccagacctggcccaggaggacccggcccaggagccctgagcctgctgcccccagcggcgtgcggggcagcacctggacccggcggcgggacaccccaagaagagctggccccacagccctgagccgctacgtgggccacctgtggatgggcagaagaccacccagccctgaggcccggggccctgtgcccaggagcagcgctgccagccgggcccggcgcagcctggccagccctggcatcagccctggccccctgacagccaccatcggcggcgctgtggccggcggcggcccccggcagggccgggcagaggcccacaaggaggtgtttcctggccagagggtgggcaagatggccgcccccatggagctgttctgctggagcggcggctggggcctgcccagcgtggacctggacagcctggccgtgctgacctacgcccgcttcaccggggcccccctgaaggtgcacaagatcagcaacccctggcagagccccagcggcaccctgcctgccctgcggaccagccatggagaggtgatctctgtgccccacaagatcatcacccacctgaggaaggaggtgcacaccttctggattgacaccaagaactacgtggaggtgaccaggaagtggtacgccgaggccatgcccttccccctgaacttcttcctgcccggccgcatgcagaggcagtacatggagcggctgcagctgctgactggagagcacaggccagaagatgaggaggagctggagaaggagctgtaccgggaggcccgggagtgcctgaccctgctgagccagaggctgggcagccagaagttcttctttggagatgccccagccagcctggatgcctttgtgttctcctacctggccctgctgctgcaggccaagctgcccagcggcaagctgcaggtgcacctgcggggcctgcacaacctgtgtgcctactgcacccacatcctgagcctgtacttcccctgggatggagctgaggtgcccccccagaggcagaccccagctggccctgagacagaggaggagccctacagaagaagaaaccagatcctgtctgtgctggccggcctggccgccatggtgggctacgccctgctgtctggaattgtgtccatccagagggccaccccagcccgggcccctggcaccaggaccctgggcatggccgaggaggatgaggaggagtag

SEQ ID NO: 159529 - DNA, 1401 bp, Artificial Sequence
  Description of Artificial Sequence: Synthetic coding sequence
atgctgctgggcggcccccccaggagccccaggagcggcaccagccccaagggcccctggagcagcactggacatgtgcagtttgggaagagcccccagacctggcccaggaggacccggcccaggagccctgagcctgctgcccccagcggcgtgcggggcagcacctggacccggcggcgggacaccccaagaagagctggccccacagccctgagccgctacgtgggccacctgtggatgggcagaagaccacccagccctgaggcccggggccctgtgcccaggagcagcgctgccagccgggcccggcgcagcctggccagccctggcatcagccctggccccctgacagccaccatcggcggcgctgtggccggcggcggcccccggcagggccgggcagaggcccacaaggaggtgtttcctggccagagggtgggcaagatggccgcccccatggagctgttctgctggagcggcggctggggcctgcccagcgtggacctggacagcctggccgtgctgacctacgcccgcttcaccggggcccccctgaaggtgcacaagatcagcaacccctggcagagccccagcggcaccctgcctgccctgcggaccagccatggagaggtgatctctgtgccccacaagatcatcacccacctgaggaaggagaagtacaatgctgactatgacctgagcgcccggcagggcgctgacaccctggccttcatgagcctgctggaggagaagctgctgcctgtgctggtgcacaccttctggattgacaccaagaactacgtggaggtgaccaggaagtggtatgcagaggccatgcccttccccctgaacttcttcctgcccggccgcatgcagaggcagtacatggagcggctgcagctgctgaccggggagcacaggccagaagatgaggaggagctggagaaggagctgtaccgggaggccagagaatgtctgaccctgctgagccagaggctgggcagccagaagttcttctttggagatgccccagccagcctggatgcctttgtgttctcctacctggccctgctgctgcaggccaagctgcccagcggcaagctgcaggtgcacctgcggggcctgcacaacctgtgtgcctactgcacccacatcctgagcctgtacttcccctgggatggagctgaggtgcccccccagaggcagaccccagctggccctgagacagaggaggagccctacagaagaagaaaccagatcctgtctgtgctggccggcctggccgccatggtgggctacgccctgctgagcggcatcgtgtccatccagagggccaccccagcccgggcccctggcaccaggaccctgggcatggccgaggaggatgaggaggagtag

SEQ ID NO: 159530 - DNA, 951 bp, Artificial Sequence
  Description of Artificial Sequence: Synthetic coding sequence
tgagaaggaggccaggacggcggggcccacggggctgtgctgctggtgcggggcctgggcgctgctgtgtctggccctggccagcccggccgggctgacctgtgccagatctactggtgcagcacagagggcacccaggaccagcagcccctggccgagcccttccgctaccctgtgtccctgggcggcaccctgcctgccctgcggaccagccacggggaggtgatctctgtgccccacaagatcatcacccacctgaggaaggagaagtacaatgctgactatgacctgagcgcccggcagggcgctgacaccctggccttcatgagcctgctggaggagaagctgctgcctgtgctggtgcacaccttctggattgacaccaagaactacgtggaggtgaccaggaagtggtacgccgaggccatgcccttccccctgaacttcttcctgcccggccgcatgcagaggcagtacatggagcggctgcagctgctgactggagagcacaggccagaagatgaggaggagctggagaaggagctgtaccgggaggcccgggagtgcctgaccctgctgagccagaggctgggcagccagaagttcttctttggagatgccccagccagcctggatgcctttgtgttctcctacctggccctgctgctgcaggccaagctgcccagcggcaagctgcaggtgcacctgcggggcctgcacaacctgtgtgcctactgcacccacatcctgagcctgtacttcccctgggatggagctgaggtgcccccccagaggcagaccccagctggccctgagacagaggaggagccctacagaagaagaaaccagatcctgtctgtgctggccggcctggccgccatggtgggctacgccctgctgtctggaattgtgtccatccagagggccaccccagcccgggcccctggatag

SEQ ID NO: 159531 - DNA, 1188 bp, Artificial Sequence
  Description of Artificial Sequence: Synthetic coding sequence
atgaatggacctgtggatggcctgtgtgaccacagcctgtctgagggcgtcttcatgttcaccagcgagagcgtgggggagggccacccagacaagatctgtgaccagatcagtgatgctgtgctggatgcccacctgaagcaggaccccaatgccaaggtggcctgtgagaccgtgtgcaagacaggcatggtgctgctgtgtggggagatcacctccatggccatggtggactaccagagggtggtgcgggacaccatcaagcacatcggctatgatgattctgccaagggctttgacttcaagacctgcaatgtgctggtggccctggagcagcagagcccagacatcgcccagtgtgtgcacctggacagaaatgaggaggatgtgggcgctggggaccagggcctgatgtttggctacgccacagatgaaacagaggagtgcatgcccctgaccatcatcctggcccacaagctgaatgccaggatggctgacctgcggcgcagcggcctgctgccctggctgcggccagacagcaagacccaggtgacagtgcagtacatgcaggacaacggggccgtcatccctgtgcgcatccacaccatcgtcatctctgtgcagcacaatgaagacatcaccctggaggagatgagaagagccctgaaggagcaggtgatccgggctgtggtgcctgccaagtacctggatgaggacacagtgtaccacctgcagcccagcggccgcttcgtcatcggcggcccccagggagatgctggggtgacaggcaggaagatcatcgtggacacctatggaggctggggcgcccatggaggaggagccttcagcggcaaggactacaccaaggtggacagatctgctgcctatgctgcccgctgggtggccaagagcctggtgaaggccggcctgtgccggcgggtgctggtgcaggtgtcctatgccatcggcgtggccgagcccctgagcatcagcatcttcacctacggcaccagccagaagacagagcgggagctgctggatgtggtgcacaagaactttgacctgcggcctggggtcatcgtgcgggacctggacctgaagaagcccatctaccagaagacagcctgctacggccacttcggccgctctgagttcccctgggaggtgcccaggaagctggtgttctag

SEQ ID NO: 159532 - DNA, 1188 bp, Artificial Sequence; identical to SEQ ID NO: 159531
  Description of Artificial Sequence: Synthetic coding sequence

SEQ ID NO: 159533 - DNA, 438 bp, Artificial Sequence
  Description of Artificial Sequence: Synthetic coding sequence
gagagcgtgggggagggccacccagacaagatctgtgaccagatcagtgatgctgtgctggatgcccacctgaagcaggaccccaatgccaaggtggcctgtggctttgacttcaagacctgcaatgtgctggtggccctggagcagcagagcccagacatcgcccagtgtgtgcacctggacagaaatgaagaagatgtgggcgctggggaccagggcctgatgtttggctacgccacagatgaaacagaggagtgcatgcccctgaccatcatcctggcccacaagctgaatgccaggatggctgacctgcggcgcagcggcctgctgccctggctgcggccagacagcaagacccaggtgacagtgcagtacatgcaggacaatggagctgtgattcctgtgcgcatccacaccatcgtcatctctgtgcagtag

SEQ ID NO: 159534 - DNA, 1188 bp, Artificial Sequence
  Description of Artificial Sequence: Synthetic coding sequence
atgaatggccagctgaatggcttccacgaggccttcatcgaggagggcaccttcctgttcaccagcgagagcgtgggggagggccacccagacaagatctgtgaccagatcagtgatgctgtgctggatgcccacctgcagcaggaccctgatgccaaggtggcctgtgagaccgtggccaagacaggcatgatcctgctggccggggagatcaccagcagagctgctgtggactaccagaaggtggtgcgggaggccgtgaagcacatcggctatgatgacagcagcaaaggatttgactacaagacctgcaatgtgctggtggccctggagcagcagagcccagacatcgcccagggcgtgcacctggacagaaatgaggaggacatcggggccggggaccagggcctgatgtttggctacgccacagatgaaacagaggagtgcatgcccctgaccatcgtgctggcccacaagctgaatgccaagctggccgagctgcggagaaatggcaccctgccctggctgcggccagacagcaagacccaggtgacagtgcagtacatgcaggacagaggagctgtgctgcccatccgggtgcacaccatcgtcatctctgtgcagcatgatgaggaggtgtgcctggatgagatgagagatgccctgaaggagaaggtgatcaaggctgtggtgcctgccaagtacctggatgaggacaccatctaccacctgcagcccagcggccgcttcgtcatcggcggcccccagggagatgctggcctgaccggcaggaagatcatcgtggacacctatggaggctggggcgcccatggaggaggagccttcagcggcaaggactacaccaaggtggacagatctgctgcctatgctgcccgctgggtggccaagagcctggtgaagggcggcctgtgccggcgggtgctggtgcaggtgtcctatgccatcggcgtgagccaccccctgagcatcagcatcttccactacggcaccagccagaagtctgagcgggagctgctggagatcgtgaagaagaactttgacctgcggcctggggtcatcgtgcgggacctggacctgaagaagcccatctaccagaggacagctgcctacggccacttcggccgggacagcttcccctgggaggtgcccaagaagctgaagtactag

SEQ ID NO: 159535 - DNA, 531 bp, Artificial Sequence
  Description of Artificial Sequence: Synthetic coding sequence
atgaatggccagctgaatggcttccacgaggccttcatcgaggagggcaccttcctgttcaccagcgagagcgtgggggagggccacccagacaagatctgtgaccagattggagatgctggcctgactggaaggaagatcatcgtggacacctacggcggctggggcgcccacggcggcggggccttcagcggcaaggactacaccaaggtggacagatctgctgcctatgctgcccgctgggtggccaagagcctggtgaagggcggcctgtgcagaagagtgctggtgcaggtgtcctatgccatcggcgtgagccaccccctgagcatcagcatcttccactacggcaccagccagaagtctgagcgggagctgctggagatcgtgaagaagaactttgacctgcggcctggggtgattgtgcgggacctggacctgaagaagcccatctaccagaggacagctgcctacggccacttcggccgggacagcttcccctgggaggtgcccaagaagctgaagtactag

SEQ ID NO: 159536 - DNA, 549 bp, Artificial Sequence
  Description of Artificial Sequence: Synthetic coding sequence
atggcccggctgctgtggctgctgcggggcctgaccctgggcacagccccccggcgggctgtgcggggccaggccggcggcggcggccctggcaccggccctggcctgggggaggccggcagcctggccacctgtgagctgcccctggccaagtctgagtggcagaagaagctgaccccagagcagttctacgtgacccgggagaagggcacagagccccccttcagcggcatctacctgaacaacaaggaggccggcatgtaccactgtgtgtgctgtgacagccccctcttcagcagcgagaagaagtactgcagcggcaccggctggcccagcttcagcgaggcccacggcaccagcggcagtgatgagagccacacaggcatcctgcggcggctggacaccagcctgggcagcgccaggacagaggtggtgtgcaagcagtgtgaggcccacctgggccacgtgtttcctgatggccctggccccaacggccagcgcttctgcatcaacagcgtggccctgaagttcaagcccaggaagcactag

SEQ ID NO: 159537 - DNA, 558 bp, Artificial Sequence
  Description of Artificial Sequence: Synthetic coding sequence
atgtctgccttcaacctgctgcacctggtgaccaagagccagcctgtggccctgcgggcctgtggcctgcccagcggcagctgccgggacaagaagaactgcaaggtggtgttcagccagcaggagctgaggaagaggctgacccccctgcagtaccacgtgacccaggagaagggcacagagagcgcctttgaaggagagtacacccaccacaaggaccccggcatctacaagtgtgtggtgtgtggcacccccctcttcaagtctgagaccaagtttgattctggcagcggctggcccagcttccatgatgtgatcaacagcgaggccatcaccttcacagatgacttctcctatggcatgcaccgggtggagaccagctgcagccagtgtggggcccacctgggccacatctttgatgatggcccccggcccaccgggaagcgctactgcatcaacagcgctgccctgtccttcaccccagctgacagcagcggcacagctgagggcggcagcggcgtggccagccctgcccaggccgacaaggccgagctgtag

SEQ ID NO: 159538 - DNA, 579 bp, Artificial Sequence
  Description of Artificial Sequence: Synthetic coding sequence
atgagccccaggaggaccctgccccggcccctgagcctgtgcctgagcctgtgcctgtgcctgtgcctggccgccgccctgggcagcgcccagagcggcagctgccgggacaagaagaactgcaaggtggtgttcagccagcaggagctgaggaagaggctgacccccctgcagtaccacgtgacccaggagaagggcacagaaagtgcctttgaaggagagtacacccaccacaaggaccccggcatctacaagtgtgtggtgtgtggcacccccctcttcaagtctgagaccaagtttgacagcggcagcggctggcccagcttccatgatgtgatcaacagcgaggccatcaccttcacagatgacttctcctatggcatgcaccgggtggagaccagctgcagccagtgtggggcccacctgggccacatctttgatgatggcccccggcccaccgggaagcgctactgcatcaacagcgctgccctgtccttcaccccagctgacagcagcggcacagctgagggcggcagcggcgtggccagccctgcccaggccgacaaggccgagctgtag

SEQ ID NO: 159539 - DNA, 495 bp, Artificial Sequence
  Description of Artificial Sequence: Synthetic coding sequence
atgtctgccttcaacctgctgcacctggtgaccaagagccagcctgtggccctgcgggcctgtggcctgcccagcggcagctgccgggacaagaagaactgcaaggtggtgttcagccagcaggagctgaggaagaggctgacccccctgcagtaccacgtgacccaggagaagggcacagagagcgcctttgaaggagagtacacccaccacaaggaccccggcatctacaagtgtgtggtgtgtggcacccccctcttcaagtctgagaccaagtttgattctggcagcggctggcccagcttccatgatgtgatcaacagcgaggccatcaccttcacagatgacttctcctatggcatgcaccgggtggagaccagctgcagccagtgtggggcccacctgggccacatctttgatgatggcccccggcccaccgggaagcgctactgcatcaacagcgctgccctgtccttcaccccagctgacagctag

SEQ ID NO: 159540 - DNA, 558 bp, Artificial Sequence; identical to SEQ ID NO: 159537
  Description of Artificial Sequence: Synthetic coding sequence

SEQ ID NO: 159541 - DNA, 354 bp, Artificial Sequence
  Description of Artificial Sequence: Synthetic coding sequence
atgtctgccttcaacctgctgcacctggtgaccaagagccagcctgtggccctgcgggcctgtggcctgcccagcggcagctgccgggacaagaagaactgcaaggtggtgttcagccagcaggagctgaggaagaggctgacccccctgcagtaccacgtgacccaggagaagggcacagagagcgcctttgaaggagagtacacccaccacaaggaccccggcatctacaagtgtgtggtgtgtggcacccccctcttcaagtctgagaccaagtttgattctggcagcggctggcccagcttccatgatgtgatcaacagcgaggccatcaccttcacagatgacttctag

SEQ ID NO: 159542 - DNA, 2703 bp, Artificial Sequence
  Description of Artificial Sequence: Synthetic coding sequence
atgaggctgtttgtgtctgatggagtgcccggctgcctgcctgtgctggccgctgctggccgggcccggggccgggcagaggtgctgatcagcacagtgggccctgaggactgtgtggtgcccttcctgacccggcccaaggtgcctgtgctgcagctggacagcggcaactacctgttcagcaccagcgccatctgccgctacttcttcctgctgagcggctgggagcaggatgacctgaccaaccagtggctggagtgggaggccacagagctgcagcctgccctgtctgctgccctgtactacctggtggtgcagggcaagaagggagaagatgtgctgggctctgtgcggcgggccctgacccacatcgaccacagcctgagccggcagaactgccccttcctggccggggagacagagagcctggccgacatcgtgctgtggggcgccctgtaccccctgctgcaggaccctgcctacctgcctgaggagctgagcgccctgcacagctggttccagaccctgagcacccaggagccctgccagagagctgctgagaccgtgctgaagcagcagggcgtgctggccctgcggccctacctgcagaagcagccccagcccagccctgctgagggccgggctgtgaccaatgaacctgaggaggaggagctggccaccctgtctgaggaggagatcgccatggctgtgacagcctgggagaagggcctggagagcctgccccccctgcggccccagcagaaccctgtgctgcctgtggccggggagagaaatgtgctgatcaccagcgccctgccctacgtgaacaacgtgccccacctgggcaacatcatcggctgtgtgctgtctgcagatgtgtttgcccgctacagccggctgcggcagtggaacaccctgtacctgtgtggcacagatgaatatggaacagccacagagaccaaggccctggaggagggcctgaccccccaggagatctgtgacaagtaccacatcatccatgctgacatctaccgctggttcaacatcagctttgacatcttcggccgcaccaccaccccccagcagaccaagatcacccaggacatcttccagcagctgctgaagaggggctttgtgctgcaggacacagtggagcagctgcgctgtgagcactgtgcccgcttcctggccgacagatttgtggagggcgtgtgccccttctgtggctatgaggaggcccggggggaccagtgtgacaagtgtgggaagctgatcaatgctgtggagctgaagaagccccagtgcaaggtgtgccgcagctgccctgtggtgcagagcagccagcacctgttcctggacctgcccaagctggagaagaggctggaggagtggctgggccgcaccctgcccggcagtgactggaccccaaatgcccagttcatcaccaggtcctggctgagagatggcctgaagccccgctgcatcacccgggacctgaagtggggcacccctgtgcccctggagggctttgaggacaaggtgttctacgtgtggtttgatgccaccatcggctacctgagcatcacagccaactacacagaccagtgggagcgctggtggaagaaccctgagcaggtggacctgtaccagttcatggccaaggacaacgtgcccttccacagcctggtgttcccctgcagcgccctgggcgctgaggacaactacaccctggtgagccacctgattgccacagagtacctgaactatgaagatggcaagttcagcaagagcagaggagtgggcgtgtttggagacatggcccaggacaccggcatcccagctgacatctggaggttctacctgctgtacatccggcctgagggccaggacagcgccttctcctggacagacctgctgctgaagaacaacagcgagctgctgaacaacctgggcaacttcatcaacagagctggcatgtttgtgtccaagttctttggaggctacgtgcctgagatggtgctgaccccagatgaccagaggctgctggcccacgtgaccctggagctgcagcactaccaccagctgctggagaaggtgcgcatcagagatgccctgcggagcatcctgaccatcagccgccacggcaaccagtacatccaggtgaatgagccctggaagaggatcaagggcagcgaggccgaccggcagagagctggcaccgtgacaggcctggccgtgaacattgctgccctgctgtctgtgatgctgcagccctacatgcccaccgtgtctgccaccatccaggcccagctgcagctgcccccaccagcctgcagcatcctgctgaccaacttcctgtgcaccctgcctgctggccaccagattggaacagtgagccccctcttccagaagctggagaatgaccagatcgagagcctgcggcagagatttggaggcggccaggccaagaccagccccaagccagctgtggtggagaccgtgaccacagccaagccccagcagatccaggccctgatggatgaggtgaccaagcagggcaacatcgtgcgggagctgaaggcccagaaggctgacaagaatgaggtggccgctgaggtggccaagctgctggacctgaagaagcagctggccgtggccgagggcaagcccccagaggcccccaagggcaagaagaagaagtag

SEQ ID NO: 159543 - DNA, 1908 bp, Artificial Sequence
  Description of Artificial Sequence: Synthetic coding sequence
atggctgtgacagcctgggagaagggcctggagagcctgccccccctgcggccccagcagaaccctgtgctgcctgtggccggggagagaaatgtgctgatcaccagcgccctgccctacgtgaacaacgtgccccacctgggcaacatcatcggctgtgtgctgtctgcagatgtgtttgcccgctacagccggctgcggcagtggaacaccctgtacctgtgtggcacagatgaatatggaacagccacagagaccaaggccctggaggagggcctgaccccccaggagatctgtgacaagtaccacatcatccatgctgacatctaccgctggttcaacatcagctttgacatcttcggccgcaccaccaccccccagcagaccaagatcacccaggacatcttccagcagctgctgaagaggggctttgtgctgcaggacacagtggagcagctgcgctgtgagcactgtgcccgcttcctggccgacagatttgtggagggcgtgtgccccttctgtggctatgaggaggcccggggggaccagtgtgacaagtgtgggaagctgatcaatgctgtggagctgaagaagccccagtgcaaggtgtgccgcagctgccctgtggtgcagagcagccagcacctgttcctggacctgcccaagctggagaagaggctggaggagtggctgggccgcaccctgcccggcagtgactggaccccaaatgcccagttcatcaccaggtcctggctgagagatggcctgaagccccgctgcatcacccgggacctgaagtggggcacccctgtgcccctggagggctttgaggacaaggtgttctacgtgtggtttgatgccaccatcggctacctgagcatcacagccaactacacagaccagtgggagcgctggtggaagaaccctgagcaggtggacctgtaccagttcatggccaaggacaacgtgcccttccacagcctggtgttcccctgcagcgccctgggcgctgaggacaactacaccctggtgagccacctgattgccacagagtacctgaactatgaagatggcaagttcagcaagagcagaggagtgggcgtgtttggagacatggcccaggacaccggcatcccagctgacatctggaggttctacctgctgtacatccggcctgagggccaggacagcgccttctcctggacagacctgctgctgaagaacaacagcgagctgctgaacaacctgggcaacttcatcaacagagctggcatgtttgtgtccaagttctttggaggctacgtgcctgagatggtgctgaccccagatgaccagaggctgctggcccacgtgaccctggagctgcagcactaccaccagctgctggagaaggtgcgcatcagagatgccctgcggagcatcctgaccatcagccgccacggcaaccagtacatccaggtgaatgagccctggaagaggatcaagggcagcgaggccgaccggcagagagctggcaccgtgacaggcctggccgtgaacattgctgccctgctgtctgtgatgctgcagccctacatgcccaccgtgtctgccaccatccaggcccagctgcagctgcccccaccagcctgcagcatcctgctgaccaacttcctgtgcaccctgcctgctggccaccagattggaacagtgagccccctcttccagaagctggagaatgaccagatcgagagcctgcggcagagatttggaggcggccaggtgaggaagctgaaggctgtgcccagcctgcacaacagccacagcatcaccagcctcatcagcctgagcagcccccaccccagcctcttccccagctttggacctgctgccagcagcctgaccgtcttcctgagctgcctgaactag

SEQ ID NO: 159544 - DNA, 1641 bp, Artificial Sequence
  Description of Artificial Sequence: Synthetic coding sequence
atgaggctgtttgtgtctgatggagtgcccggctgcctgcctgtgctggccgctgctggccgggcccggggccgggcagaggtgctgatcagcacagtgggccctgaggactgtgtggtgcccttcctgacccggcccaaggtgcctgtgctgcagctggacagcggcaactacctgttcagcaccagcgccatctgccgctacttcttcctgctgagcggctgggagcaggatgacctgaccaaccagtggctggagtgggaggccacagagctgcagcctgccctgtctgctgccctgtactacctggtggtgcagggcaagaagggagaagatgtgctgggctctgtgcggcgggccctgacccacatcgaccacagcctgagccggcagaactgccccttcctggccggggagacagagagcctggccgacatcgtgctgtggggcgccctgtaccccctgctgcaggaccctgcctacctgcctgaggagctgagcgccctgcacagctggttccagaccctgagcacccaggagccctgccagagagctgctgagaccgtgctgaagcagcagggcgtgctggccctgcggccctacctgcagaagcagccccagcccagccctgctgagggccgggctgtgaccaatgaacctgaggaggaggagctggccaccctgtctgaggaggagatcgccatggctgtgacagcctgggagaagggcctggagagcctgccccccctgcggccccagcagaaccctgtgctgcctgtggccggggagagaaatgtgctgatcaccagcgccctgccctacgtgaacaacgtgccccacctgggcaacatcatcggctgtgtgctgtctgcagatgtgtttgcccgctacagccggctgcggcagtggaacaccctgtacctgtgtggcacagatgaatatggaacagccacagagaccaaggccctggaggagggcctgaccccccaggagatctgtgacaagtaccacatcatccatgctgacatctaccgctggttcaacatcagctttgacatcttcggccgcaccaccaccccccagcagaccaagatcacccaggacatcttccagcagctgctgaagaggggctttgtgctgcaggacacagtggagcagctgcgctgtgagcactgtgcccgcttcctggccgacagatttgtggagggcgtgtgccccttctgtggctatgaggaggcccggggggaccagtgtgacaagtgtgggaagctgatcaatgctgtggagctgaagaagccccagtgcaaggtgtgccgcagctgccctgtggtgcagagcagccagcacctgttcctggacctgcccaagctggagaagaggctggaggagtggctgggccgcaccctgcccggcagtgactggaccccaaatgcccagttcatcaccaggtcctggctgagagatggcctgaagccccgctgcatcacccgggacctgaagtggggcacccctgtgcccctggagggctttgaggacaaggtgttctacgtgtggtttgatgccaccatcggctacctgagcatcacagccaactacacagaccagtgggagcgctggtggaagaaccctgagcagccctag

SEQ ID NO: 159545 - DNA, 1782 bp, Artificial Sequence
  Description of Artificial Sequence: Synthetic coding sequence
atgctgcggacctctgtgctgcggctgctgggccgcactggagccagccggctgagcctgctggaggactttggcccccgctactacagcagcggcagcctgtctgctggagatgatgcctgtgatgtgcgggcctacttcaccacccccatcttctacgtgaatgctgccccccacatcggccacctgtacagcgccctgctggctgatgccctgtgccgccaccggcggctgcggggccccagcacagctgccacccgcttcagcactggaacagatgaacatggcctgaagatccagcaggccgccgccacagctggcctggcccccacagagctgtgtgacagagtgtctgagcagttccagcagctgttccaggaggccggcatcagctgcacagacttcatccgcaccacagaggcccggcaccgggtggccgtgcagcacttctggggcgtgctgaagagccggggcctgctgtacaagggcgtgtatgagggctggtactgtgccagtgatgagtgcttcctgcctgaggccaaggtgacccagcagcccggccccagcggggacagcttccctgtgtccctggagagcggccaccctgtgtcctggaccaaggaggagaactacatcttccggctgagccagttcaggaagcccctgcagcgctggctgcggggcaacccccaggccatcaccccagagcccttccaccacgtggtgctgcagtggctggatgaggagctgcctgacctgtctgtgtccagaagaagcagccacctgcactggggcatccctgtgcctggagatgacagccagaccatctacgtgtggctggatgccctggtgaactacctgaccgtcatcggctacccaaatgctgagttcaagtcctggtggccagccaccagccacatcatcggcaaggacatcctgaagttccacgccatctactggccagccttcctgctgggcgccggcatgagccccccccagaggatctgtgtgcacagccactggacagtgtgtggccagaagatgagcaagagcctgggcaatgtggtggaccccaggacctgcctgaaccgctacacagtggatggcttccgctacttcctgctgcggcagggcgtgcccaactgggactgtgactactatgatgagaaggtggtgaagctgctgaacagcgagctggctgatgccctgggcggcctgctgaaccgctgcacagccaagaggatcaaccccagcgagacctacccagccttctgcaccacctgcttccccagcgagcccggcctggtgggccccagcgtgcgggcccaggctgaagattatgccctggtgtctgctgtggccaccctgcccaagcaggtggccgaccactatgacaacttccgcatctacaaggccctggaggccgtgagcagctgtgtgcggcagaccaacggctttgtgcagagacatgccccctggaagctgaactgggagagccctgtggatgccccctggctgggcaccgtgctgcacgtggccctggagtgcctgcgggtgtttggcaccctgctgcagcctgtgacccccagcctggccgacaagctgctgagccggctgggcgtgtctgccagcgagaggagcctgggggagctgtacttcctgccccgcttctacggccacccctgcccctttgagggccgccgcctgggccctgagaccggcctgctcttcccccggctggaccagagcaggacctggctggtgaaggcccacaggacatag

SEQ ID NO: 159546 - DNA, 1563 bp, Artificial Sequence
  Description of Artificial Sequence: Synthetic coding sequence
atgctgcggacctctgtgctgcggctgctgggccgcactggagccagccggctgagcctgctggaggactttggcccccgctactacagcagcggcagcctgtctgctggagatgatgcctgtgatgtgcgggcctacttcaccacccccatcttctacgtgaatgctgccccccacatcggccacctgtacagcgccctgctggctgatgccctgtgccgccaccggcggctgcggggccccagcacagctgccacccgcttcagcactggaacagatgaacatggcctgaagatccagcaggccgccgccacagctggcctggcccccacagagctgtgtgacagagtgtctgagcagttccagcagctgttccaggaggccggcatctcctggaccaaggaggagaactacatcttccggctgagccagttcaggaagcccctgcagcgctggctgcggggcaacccccaggccatcaccccagagcccttccaccacgtggtgctgcagtggctggatgaggagctgcctgacctgtctgtgagccgccgcagcagccacctgcactggggcatccctgtgcctggagatgacagccagaccatctacgtgtggctggatgccctggtgaactacctgactgtgattggctacccaaatgctgagttcaagtcctggtggccagccaccagccacatcatcggcaaggacatcctgaagttccacgccatctactggccagccttcctgctgggcgccggcatgagccccccccagaggatctgtgtgcacagccactggacagtgtgtggccagaagatgagcaagagcctgggcaatgtggtggaccccaggacctgcctgaaccgctacacagtggatggcttccgctacttcctgctgcggcagggcgtgcccaactgggactgtgactactatgatgagaaggtggtgaagctgctgaacagcgagctggctgatgccctgggcggcctgctgaaccgctgcacagccaagaggatcaaccccagcgagacctacccagccttctgcaccacctgcttccccagcgagcccggcctggtgggccccagcgtgcgggcccaggccgaggactatgccctggtgtctgctgtggccaccctgcccaagcaggtggccgaccactatgacaacttccgcatctacaaggccctggaggccgtgagcagctgtgtgcggcagaccaatggatttgtgcagagacatgccccctggaagctgaactgggagagccctgtggatgccccctggctgggcaccgtgctgcacgtggccctggagtgcctgcgggtgtttggcaccctgctgcagcctgtgacccccagcctggccgacaagctgctgagccggctgggcgtgtctgccagcgagaggagcctgggggagctgtacttcctgccccgcttctacggccacccctgcccctttgagggccggcggctgggccctgagaccggcctgctcttcccccggctggaccagagcaggacctggctggtgaaggcccacaggacatag

SEQ ID NO: 159547 - DNA, 1461 bp, Artificial Sequence
  Description of Artificial Sequence: Synthetic coding sequence
atggtggccggcatgctgggcctgcgggaggagaagtctgaggaccaggacctgcagggcctgaaggacaagcccctgaagttcaagaaggtgaagaaggacaagaaggaggagaaggagggcaagcatgagcctgtgcagcccagcgcccaccacagcgctgagcctgctgaggccggcaaggccgagaccagcgagggcagcggcagcgccccagctgtgcctgaggccagcgccagccccaagcagaggaggagcatcatccgggaccggggccccatgtatgatgaccccaccctgcctgagggctggaccaggaagctgaagcagaggaagagcggccgctctgctgggaagtatgatgtgtacctgatcaacccccagggcaaggccttccgcagcaaggtggagctgattgcctactttgagaaggtgggggacaccagcctggaccccaatgactttgacttcaccgtgacaggccggggcagccccagcagaagagagcagaagccacccaagaagcccaagagccccaaggcccctggcaccggccggggccggggccggcccaagggcagcggcaccacccggcccaaggccgccaccagcgagggcgtgcaggtgaagagggtgctggagaagagccctgggaagctgctggtgaagatgcccttccagaccagccctgggggcaaggccgagggcggcggggccaccaccagcacccaggtgatggtgatcaagaggcctggcaggaagaggaaggccgaggccgacccccaggccatccccaagaagaggggcaggaagccaggctctgtggtggccgctgctgctgctgaggccaagaagaaggctgtgaaggagagcagcatccgctctgtgcaggagaccgtgctgcccatcaagaagaggaagacccgggagaccgtgtccattgaggtgaaggaggtggtgaagcccctgctggtgtccaccctgggggagaagagcggcaagggcctgaagacctgcaagagccctggcaggaagagcaaggagagcagccccaagggccgcagcagcagcgccagcagcccccccaagaaggagcaccaccaccaccaccaccacagcgagagccccaaggcccctgtgcccctgctgccccccctgcccccacctcctcctgagcctgagagcagcgaggaccccaccagccccccagagccccaggacctgagcagctctgtgtgcaaggaggagaagatgccccggggcggcagcctggagagtgatggctgccccaaggagcccgccaagacccagcctgctgtggccacagctgccacagctgctgagaagtacaagcacagaggagagggggagaggaaggacatcgtgagcagctccatgccccggcccaaccgggaggagcctgtggacagcaggacccctgtgacagagcgggtgtcctag

SEQ ID NO: 159548 - DNA, 816 bp, Artificial Sequence
  Description of Artificial Sequence: Synthetic coding sequence
atggtggccggcatgctgggcctgcgggaggagaagtctgaggaccaggacctgcagggcctgaaggacaagcccctgaagttcaagaaggtgaagaaggacaagaaggaggagaaggagggcaagcatgagcctgtgcagcccagcgcccaccacagcgctgagcctgctgaggccggcaaggccgagaccagcgagggcagcggcagcgccccagctgtgcctgaggccagcgccagccccaagcagaggaggagcatcatccgggaccggggccccatgtatgatgaccccaccctgcctgagggctggaccaggaagctgaagcagaggaagagcggccgctctgctgggaagtatgatgtgtacctgatcaacccccagggcaaggccttccgcagcaaggtggagctgattgcctactttgagaaggtgggggacaccagcctggaccccaatgactttgacttcaccgtgacaggccggggcagccccagcagaagagagcagaagccacccaagaagcccaagagccccaaggcccctggcaccggccggggccggggccggcccaagggcagcggcaccacccggcccaaggccgccaccagcgagggcgtgcaggtgaagagggtgctggagaagagccctgggaagctgctggtgaagatgcccttccagaccagccctgggggcaaggccgagggcggcggggccaccaccagcacccaggtgatggtgatcaagaggcctggcaggaagaggagcccccgggcccccaggaccccaccagcccccctgagccccaggacatag

SEQ ID NO: 159549 - DNA, 153 bp, Artificial Sequence
  Description of Artificial Sequence: Synthetic coding sequence
atggtggccggcatgctgggcctgcgggaggagaagtctgaggaccaggacctgcagggcctgaaggacaagcccctgaagttcaagaaggtgaagaaggacaagaaggaggagaaggagggcaagcatgagcctgtgcagcccagcgcctag

SEQ ID NO: 159550 - DNA, 1497 bp, Artificial Sequence
  Description of Artificial Sequence: Synthetic coding sequence
atggctgctgctgctgctgctgcccccagcggcggcggcggcggcggggaggaggagcggctggaggagaagtctgaggaccaggacctgcagggcctgaaggacaagcccctgaagttcaagaaggtgaagaaggacaagaaggaggagaaggagggcaagcatgagcctgtgcagcccagcgcccaccacagcgctgagcctgctgaggccggcaaggccgagaccagcgagggcagcggcagcgccccagctgtgcctgaggccagcgccagccccaagcagaggaggagcatcatccgggaccggggccccatgtatgatgaccccaccctgcctgagggctggaccaggaagctgaagcagaggaagagcggccgctctgctgggaagtatgatgtgtacctgatcaacccccagggcaaggccttccgcagcaaggtggagctgattgcctactttgagaaggtgggggacaccagcctggaccccaatgactttgacttcaccgtgacaggccggggcagccccagcagaagagagcagaagccacccaagaagcccaagagccccaaggcccctggcaccggccggggccggggccggcccaagggcagcggcaccacccggcccaaggccgccaccagcgagggcgtgcaggtgaagagggtgctggagaagagccctgggaagctgctggtgaagatgcccttccagaccagccctgggggcaaggccgagggcggcggggccaccaccagcacccaggtgatggtgatcaagaggcctggcaggaagaggaaggccgaggccgacccccaggccatccccaagaagaggggcaggaagccaggctctgtggtggccgctgctgctgctgaggccaagaagaaggctgtgaaggagagcagcatccgctctgtgcaggagaccgtgctgcccatcaagaagaggaagacccgggagaccgtgtccattgaggtgaaggaggtggtgaagcccctgctggtgtccaccctgggggagaagagcggcaagggcctgaagacctgcaagagccctggcaggaagagcaaggagagcagccccaagggccgcagcagcagcgccagcagcccccccaagaaggagcaccaccaccaccaccaccacagcgagagccccaaggcccctgtgcccctgctgccccccctgcccccacctcctcctgagcctgagagcagcgaggaccccaccagccccccagagccccaggacctgagcagctctgtgtgcaaggaggagaagatgccccggggcggcagcctggagagtgatggctgccccaaggagcccgccaagacccagcctgctgtggccacagctgccacagctgctgagaagtacaagcacagaggagagggggagaggaaggacatcgtgagcagctccatgccccggcccaaccgggaggagcctgtggacagcaggacccctgtgacagagcgggtgtcctag

SEQ ID NO: 159551 - DNA, 1185 bp, Artificial Sequence
  Description of Artificial Sequence: Synthetic coding sequence
atggtggccggcatgctgggcctgcgggaggagaagtctgaggaccaggacctgcagggcctgaaggacaagcccctgaagttcaagaaggtgaagaaggacaagaaggaggagaaggagggcaagcatgagcctgtgcagcccagcgcccaccacagcgctgagcctgctgaggccggcaaggccgagaccagcgagggcagcggcagcgccccagctgtgcctgaggccagcgccagccccaagcagaggaggagcatcatccgggaccggggccccatgtatgatgaccccaccctgcctgagggctggaccaggaagctgaagcagaggaagagcggccgctctgctgggaagtatgatgtgtacctgatcaacccccagggcaaggccttccgcagcaaggtggagctgattgcctactttgagaaggtgggggacaccagcctggaccccaatgactttgacttcaccgtgacaggccggggcagccccagcagaagagagcagaagccacccaagaagcccaagagccccaaggcccctggcaccggccggggccggggccggcccaagggcagcggcaccacccggcccaaggccgccaccagcgagggcgtgcaggtgaagagggtgctggagaagagccctgggaagctgctggtgaagatgcccttccagaccagccctgggggcaaggccgagggcggcggggccaccaccagcacccaggtgatggtgatcaagaggcctggcaggaagaggaaggccgaggccgacccccaggccatccccaagaagaggggcaggaagccaggctctgtggtggccgctgctgctgctgaggccaagaagaaggctgtgaaggagagcagcatccgctctgtgcaggagaccgtgctgcccatcaagaagaggaagacccgggagaccgtgtccattgaggtgaaggaggtggtgaagcccctgctggtgtccaccctgggggagaagagcggcaagggcctgaagacctgcaagagccctggcaggaagagcaaggagagcagccccaagggccgcagcagcagcgccagcagcccccccaagaaggagcaccaccaccaccaccaccacagcgagagccccaaggcccctgtgcccacccgcatcaaggctgctgtggtgagcagcccctatggatag

SEQ ID NO: 159552 - DNA, 1818 bp, Artificial Sequence
  Description of Artificial Sequence: Synthetic coding sequence
atggccgaggactggctggactgcccagccctgggccctggctggaagagaagagaggtgttcaggaagagcggggccacctgtggccgcagtgacacctactaccagagccccactggagaccgcatccgcagcaaggtggagctgacccgctacctgggccctgcctgtgacctgaccctgtttgacttcaagcagggcatcctgtgctacccagcccccaaggcccaccctgtggccgtggccagcaagaagaggaagaagcccagcaggcctgccaagaccaggaagaggcaggtgggcccccagagcggggaggtgaggaaggaggcccccagagatgagaccaaggctgacacagacacagccccagccagcttccctgcccctggctgctgtgagaactgtggcatctccttctctggagatggcacccagaggcagaggctgaagaccctgtgcaaggactgccgggcccagagaattgccttcaaccgggagcagaggatgttcaagagggtgggctgtggggagtgtgccgcctgccaggtgacagaggactgtggggcctgcagcacctgcctgctgcagctgccccatgatgtggccagcggcctcttctgcaagtgtgagcggcggcgctgcctgcgcatcgtggagaggagccggggctgcggcgtgtgccggggctgccagacccaggaggactgtggccactgccccatctgcctgcggccccccaggcctggcctgcggcggcagtggaagtgtgtgcagaggcgctgcctgcggggcaagcacgcccggaggaaaggaggctgtgacagcaagatggccgcccggcggcggcctggggcccagcccctgcccccacctccacccagccagagccctgagcccacagagccccacccccgggccctggcccccagccccccagctgagttcatctactactgtgtggatgaagatgagctgcagccctacaccaacagacggcagaacagaaaatgtggggcctgtgccgcctgcctgcggaggatggactgtggccgctgtgacttctgctgtgacaagcccaagtttggaggcagcaaccagaagaggcagaagtgccgctggaggcagtgcctgcagtttgccatgaagaggctgctgcccagcgtgtggagcgagagtgaagatggagctggcagccccccaccctacagaagaaggaagaggcccagcagcgcccggcggcaccacctgggccccaccctgaagcccaccctggccaccaggacagcccagcctgaccacacccaggcccccaccaagcaggaggccggcggcggctttgtgctgcccccacctggaacagacctggtgttcctgcgggagggcgccagcagccctgtgcaggtgcccggccctgtggccgccagcacagaggccctgctgcaggaggcccagtgcagcggcctgtcctgggtggtggccctgccccaggtgaagcaggagaaggctgacacccaggatgagtggaccccaggcacagctgtgctgaccagccctgtgctggtgcccggctgccccagcaaggctgtggaccccggcctgcccagcgtgaagcaggagcccccagaccctgaggaggacaaggaggagaacaaggatgattctgccagcaagctggcccctgaggaggaggccggcggggccggcacccctgtgatcacagagatcttcagcctgggcggcacccgcttccgggacacagctgtgtggctgcccaggagcaaggacctgaagaagccaggggccaggaagcagtag

SEQ ID NO: 159553 - DNA, 1761 bp, Artificial Sequence
  Description of Artificial Sequence: Synthetic coding sequence
atggccgaggactggctggactgcccagccctgggccctggctggaagagaagagaggtgttcaggaagagcggggccacctgtggccgcagtgacacctactaccagagccccactggagaccgcatccgcagcaaggtggagctgacccgctacctgggccctgcctgtgacctgaccctgtttgacttcaagcagggcatcctgtgctacccagcccccaaggcccaccctgtggccgtggccagcaagaagaggaagaagcccagcaggcctgccaagaccaggaagaggcaggtgggcccccagagcggggaggtgaggaaggaggcccccagagatgagaccaaggctgacacagacacagccccagccagcttccctgcccctggctgctgtgagaactgtggcatctccttctctggagatggcacccagaggcagaggctgaagaccctgtgcaaggactgccgggcccagagaattgccttcaaccgggagcagaggatgttcaagagggtgggctgtggggagtgtgccgcctgccaggtgacagaggactgtggggcctgcagcacctgcctgctgcagctgccccatgatgtggccagcggcctcttctgcaagtgtgagcggcggcgctgcctgcgcatcgtggagaggagccggggctgcggcgtgtgccggggctgccagacccaggaggactgtggccactgccccatctgcctgcggccccccaggcctggcctgcggcggcagtggaagtgtgtgcagaggcgctgcctgcggggcaagcacgcccggaggaaaggaggctgtgacagcaagatggccgcccggcggcggcctggggcccagcccctgcccccacctccacccagccagagccctgagcccacagagccccagccctacaccaacagacggcagaacagaaaatgtggggcctgtgccgcctgcctgcggaggatggactgtggccgctgtgacttctgctgtgacaagcccaagtttggaggcagcaaccagaagaggcagaagtgccgctggaggcagtgcctgcagtttgccatgaagaggctgctgcccagcgtgtggagcgagagtgaagatggagctggcagccccccaccctacagaagaaggaagaggcccagcagcgcccggcggcaccacctgggccccaccctgaagcccaccctggccaccaggacagcccagcctgaccacacccaggcccccaccaagcaggaggccggcggcggctttgtgctgcccccacctggaacagacctggtgttcctgcgggagggcgccagcagccctgtgcaggtgcccggccctgtggccgccagcacagaggccctgctgcaggccgtggaccccggcctgcccagcgtgaagcaggagcccccagaccctgaggaggacaaggaggagaacaaggatgacagcgccagcaagctggcccctgaggaggaggccggcggggccggcacccctgtgatcacagagatcttcagcctgggcggcacccgcttccgggacacagctgtgtggctgcccagcctgcagggccgccacagcggcagagaagatggctgcaaggtgtgggagacagaggacacagtggagcccaccagcacctcctggaacccccggggctggccaggcacccacgtgtccctgagccccccaccagcctccatgatgtgggtgtcctgcagaagatcctggtgccccagcagccagagctag

SEQ ID NO: 159554 - DNA, 1653 bp, Artificial Sequence
  Description of Artificial Sequence: Synthetic coding sequence
atggccgaggactggctggactgcccagccctgggccctggctggaagagaagagaggtgttcaggaagagcggggccacctgtggccgcagtgacacctactaccagagccccactggagaccgcatccgcagcaaggtggagctgacccgctacctgggccctgcctgtgacctgaccctgtttgacttcaagcagggcatcctgtgctacccagcccccaaggcccaccctgtggccgtggccagcaagaagaggaagaagcccagcaggcctgccaagaccaggaagaggcaggtgggcccccagagcggggaggtgaggaaggaggcccccagagatgagaccaaggctgacacagacacagccccagccagcttccctgcccctggctgctgtgagaactgtggcatctccttctctggagatggcacccagaggcagaggctgaagaccctgtgcaaggactgccgggcccagagaattgccttcaaccgggagcagaggatgttcaagagggtgggctgtggggagtgtgccgcctgccaggtgacagaggactgtggggcctgcagcacctgcctgctgcagctgccccatgatgtggccagcggcctcttctgcaagtgtgagcggcggcgctgcctgcgcatcgtggagaggagccggggctgcggcgtgtgccggggctgccagacccaggaggactgtggccactgccccatctgcctgcggccccccaggcctggcctgcggcggcagtggaagtgtgtgcagaggcgctgcctgcggggcaagcacgcccggaggaaaggaggctgtgacagcaagatggccgcccggcggcggcctggggcccagcccctgcccccacctccacccagccagagccctgagcccacagagccccacccccgggccctggcccccagccccccagctgagttcatctactactgtgtggatgaagatgagctgcagccctacaccaacagacggcagaacagaaaatgtggggcctgtgccgcctgcctgcggaggatggactgtggccgctgtgacttctgctgtgacaagcccaagtttggaggcagcaaccagaagaggcagaagtgccgctggaggcagtgcctgcagtttgccatgaagaggctgctgcccagcgtgtggagcgagagtgaagatggagctggcagccccccaccctacagaagaaggaagaggcccagcagcgcccggcggcaccacctgggccccaccctgaagcccaccctggccaccaggacagcccagcctgaccacacccaggcccccaccaagcaggaggccggcggcggctttgtgctgcccccacctggaacagacctggtgttcctgcgggagggcgccagcagccctgtgcaggtgcccggccctgtggccgccagcacagaggccctgctgcaggccgtggaccccggcctgcccagcgtgaagcaggagcccccagaccctgaggaggacaaggaggagaacaaggatgattctgccagcaagctggcccctgaggaggaggccggcggggccggcacccctgtggagcccaccacccagccccagtacagcggcaactttgacaatgacctgtatgagatctacctgattgacatctag

SEQ ID NO: 159555 - DNA, 1650 bp, Artificial Sequence
  Description of Artificial Sequence: Synthetic coding sequence
atggccgaggactggctggactgcccagccctgggccctggctggaagagaagagaggtgttcaggaagagcggggccacctgtggccgcagtgacacctactaccagagccccactggagaccgcatccgcagcaaggtggagctgacccgctacctgggccctgcctgtgacctgaccctgtttgacttcaagcagggcatcctgtgctacccagcccccaaggcccaccctgtggccgtggccagcaagaagaggaagaagcccagcaggcctgccaagaccaggaagaggcaggtgggcccccagagcggggaggtgaggaaggaggcccccagagatgagaccaaggctgacacagacacagccccagccagcttccctgcccctggctgctgtgagaactgtggcatctccttctctggagatggcacccagaggcagaggctgaagaccctgtgcaaggactgccgggcccagagaattgccttcaaccgggagcagaggatgttcaagagggtgggctgtggggagtgtgccgcctgccaggtgacagaggactgtggggcctgcagcacctgcctgctgcagctgccccatgatgtggccagcggcctcttctgcaagtgtgagcggcggcgctgcctgcgcatcgtggagaggagccggggctgcggcgtgtgccggggctgccagacccaggaggactgtggccactgccccatctgcctgcggccccccaggcctggcctgcggcggcagtggaagtgtgtgcagaggcgctgcctgcggggcaagcacgcccggaggaaaggaggctgtgacagcaagatggccgcccggcggcggcctggggcccagcccctgcccccacctccacccagccagagccctgagcccacagagccccacccccgggccctggcccccagccccccagctgagttcatctactactgtgtggatgaagatgagctgaagaggctgctgcccagcgtgtggagcgagagtgaagatggagctggcagccccccaccctacagaagaaggaagaggcccagcagcgcccggcggcaccacctgggccccaccctgaagcccaccctggccaccaggacagcccagcctgaccacacccaggcccccaccaagcaggaggccggcggcggctttgtgctgcccccacctggaacagacctggtgttcctgcgggagggcgccagcagccctgtgcaggtgcccggccctgtggccgccagcacagaggccctgctgcaggaggcccagtgcagcggcctgtcctgggtggtggccctgccccaggtgaagcaggagaaggctgacacccaggatgagtggaccccaggcacagctgtgctgaccagccctgtgctggtgcccggctgccccagcaaggctgtggaccccggcctgcccagcgtgaagcaggagcccccagaccctgaggaggacaaggaggagaacaaggatgattctgccagcaagctggcccctgaggaggaggccggcggggccggcacccctgtgatcacagagatcttcagcctgggcggcacccgcttccgggacacagctgtgtggctgcccaggagcaaggacctgaagaagccaggggccaggaagcagtag

SEQ ID NO: 159556 - DNA, 1512 bp, Artificial Sequence
  Description of Artificial Sequence: Synthetic coding sequence
atggccgaggactggctggactgcccagccctgggccctggctggaagagaagagaggtgttcaggaagagcggggccacctgtggccgcagtgacacctactaccagagccccactggagaccgcatccgcagcaaggtggagctgacccgctacctgggccctgcctgtgacctgaccctgtttgacttcaagcagggcatcctgtgctacccagcccccaaggcccaccctgtggccgtggccagcaagaagaggaagaagcccagcaggcctgccaagaccaggaagaggcaggtgggcccccagagcggggaggtgaggaaggaggcccccagagatgagaccaaggctgacacagacacagccccagccagcttccctgcccctggctgctgtgagaactgtggcatctccttctctggagatggcacccagaggcagaggctgaagaccctgtgcaaggactgccgggcccagagaattgccttcaaccgggagcagaggatgttcaagagggtgggctgtggggagtgtgccgcctgccaggtgacagaggactgtggggcctgcagcacctgcctgctgcagctgccccatgatgtggccagcggcctcttctgcaagtgtgagcggcggcgctgcctgcgcatcgtggagaggagccggggctgcggcgtgtgccggggctgccagacccaggaggactgtggccactgccccatctgcctgcggccccccaggcctggcctgcggcggcagtggaagtgtgtgcagaggcgctgcctgcggggcaagcacgcccggaggaaaggaggctgtgacagcaagatggccgcccggcggcggcctggggcccagcccctgcccccacctccacccagccagagccctgagcccacagagccccacccccgggccctggcccccagccccccagctgagttcatctactactgtgtggatgaagatgagctgaagaggctgctgcccagcgtgtggagcgagagtgaagatggagctggcagccccccaccctacagaagaaggaagaggcccagcagcgcccggcggcaccacctgggccccaccctgaagcccaccctggccaccaggacagcccagcctgaccacacccaggcccccaccaagcaggaggccggcggcggctttgtgctgcccccacctggaacagacctggtgttcctgcgggagggcgccagcagccctgtgcaggtgcccggccctgtggccgccagcacagaggccctgctgcaggccgtggaccccggcctgcccagcgtgaagcaggagcccccagaccctgaggaggacaaggaggagaacaaggatgattctgccagcaagctggcccctgaggaggaggccggcggggccggcacccctgtgatcacagagatcttcagcctgggcggcacccgcttccgggacacagctgtgtggctgcccaggagcaaggacctgaagaagccaggggccaggaagcagtag

SEQ ID NO: 159557 - DNA, 1671 bp, Artificial Sequence
  Description of Artificial Sequence: Synthetic coding sequence
atggccgaggactggctggactgcccagccctgggccctggctggaagagaagagaggtgttcaggaagagcggggccacctgtggccgcagtgacacctactaccagagccccactggagaccgcatccgcagcaaggtggagctgacccgctacctgggccctgcctgtgacctgaccctgtttgacttcaagcagggcatcctgtgctacccagcccccaaggcccaccctgtggccgtggccagcaagaagaggaagaagcccagcaggcctgccaagaccaggaagaggcaggtgggcccccagagcggggaggtgaggaaggaggcccccagagatgagaccaaggctgacacagacacagccccagccagcttccctgcccctggctgctgtgagaactgtggcatctccttctctggagatggcacccagaggcagaggctgaagaccctgtgcaaggactgccgggcccagagaattgccttcaaccgggagcagaggatgttcaagagccggggctgcggcgtgtgccggggctgccagacccaggaggactgtggccactgccccatctgcctgcggcccccccggcccggcctgcggcggcagtggaagtgtgtgcagaggcgctgcctgcggggcaagcacgcccggaggaagggcggctgtgacagcaagatggccgccaggagaagacctggggcccagcccctgcccccacctccacccagccagagccctgagcccacagagccccacccccgggccctggcccccagccccccagctgagttcatctactactgtgtggatgaagatgagctgcagccctacaccaacagacggcagaacagaaaatgtggggcctgtgccgcctgcctgcggaggatggactgtggccgctgtgacttctgctgtgacaagcccaagtttggaggcagcaaccagaagaggcagaagtgccgctggaggcagtgcctgcagtttgccatgaagaggctgctgcccagcgtgtggagcgagagtgaagatggagctggcagccccccaccctacagaagaaggaagaggcccagcagcgcccggcggcaccacctgggccccaccctgaagcccaccctggccaccaggacagcccagcctgaccacacccaggcccccaccaagcaggaggccggcggcggctttgtgctgcccccacctggaacagacctggtgttcctgcgggagggcgccagcagccctgtgcaggtgcccggccctgtggccgccagcacagaggccctgctgcaggaggcccagtgcagcggcctgtcctgggtggtggccctgccccaggtgaagcaggagaaggctgacacccaggatgagtggaccccaggcacagctgtgctgaccagccctgtgctggtgcccggctgccccagcaaggctgtggaccccggcctgcccagcgtgaagcaggagcccccagaccctgaggaggacaaggaggagaacaaggatgacagcgccagcaagctggcccctgaggaggaggccggcggggccggcacccctgtgatcacagagatcttcagcctgggcggcacccgcttccgggacacagctgtgtggctgcccaggagcaaggacctgaagaagccaggggccaggaagcagtag

SEQ ID NO: 159558 - DNA, 1818 bp, Artificial Sequence; identical to SEQ ID NO: 159552
  Description of Artificial Sequence: Synthetic coding sequence

SEQ ID NO: 159559 - DNA, 1512 bp, Artificial Sequence; identical to SEQ ID NO: 159556
  Description of Artificial Sequence: Synthetic coding sequence

SEQ ID NO: 159560 - DNA, 1650 bp, Artificial Sequence; identical to SEQ ID NO: 159555
  Description of Artificial Sequence: Synthetic coding sequence

SEQ ID NO: 159561 - DNA, 1818 bp, Artificial Sequence; identical to SEQ ID NO: 159552
  Description of Artificial Sequence: Synthetic coding sequence

SEQ ID NO: 159562 - DNA, 1971 bp, Artificial Sequence
  Description of Artificial Sequence: Synthetic coding sequence
atgggcggcttccggctgaggactggaagaaatgctgccctgaacagcgaccggctgctgctgctgcctgtggcctccatggccgaggactggctggactgcccagccctgggccctggctggaagagaagagaggtgttcaggaagagcggggccacctgtggccgcagtgacacctactaccagagccccactggagaccgcatccgcagcaaggtggagctgacccgctacctgggccctgcctgtgacctgaccctgtttgacttcaagcagggcatcctgtgctacccagcccccaaggcccaccctgtggccgtggccagcaagaagaggaagaagcccagcaggcctgccaagaccaggaagaggcaggtgggcccccagagcggggaggtgaggaaggaggcccccagagatgagaccaaggctgacacagacacagccccagccagcttccctgcccctggctgctgtgagaactgtggcatctccttctctggagatggcacccagaggcagaggctgaagaccctgtgcaaggactgccgggcccagagaattgccttcaaccgggagcagaggatgttcaagagggtgggctgtggggagtgtgccgcctgccaggtgacagaggactgtggggcctgcagcacctgcctgctgcagctgccccatgatgtggccagcggcctcttctgcaagtgtgagcggcggcgctgcctgcgcatcgtggagaggagccggggctgcggcgtgtgccggggctgccagacccaggaggactgtggccactgccccatctgcctgcggccccccaggcctggcctgcggcggcagtggaagtgtgtgcagaggcgctgcctgcggcacctggcccaccggctgcggcggcggcaccagcgctgccagaggaggacccccctggccgtggcccccccaacaggcaagcacgcccggaggaagggcggctgtgacagcaagatggccgccaggagaagacctggggcccagcccctgcccccacctccacccagccagagccctgagcccacagagccccacccccgggccctggcccccagccccccagctgagttcatctactactgtgtggatgaagatgagctgcagccctacaccaacagacggcagaacagaaaatgtggggcctgtgccgcctgcctgcggaggatggactgtggccgctgtgacttctgctgtgacaagcccaagtttggaggcagcaaccagaagaggcagaagtgccgctggaggcagtgcctgcagtttgccatgaagaggctgctgcccagcgtgtggagcgagagtgaagatggagctggcagccccccaccctacagaagaaggaagaggcccagcagcgcccggcggcaccacctgggccccaccctgaagcccaccctggccaccaggacagcccagcctgaccacacccaggcccccaccaagcaggaggccggcggcggctttgtgctgcccccacctggaacagacctggtgttcctgcgggagggcgccagcagccctgtgcaggtgcccggccctgtggccgccagcacagaggccctgctgcaggaggcccagtgcagcggcctgtcctgggtggtggccctgccccaggtgaagcaggagaaggctgacacccaggatgagtggaccccaggcacagctgtgctgaccagccctgtgctggtgcccggctgccccagcaaggctgtggaccccggcctgcccagcgtgaagcaggagcccccagaccctgaggaggacaaggaggagaacaaggatgacagcgccagcaagctggcccctgaggaggaggccggcggggccggcacccctgtgatcacagagatcttcagcctgggcggcacccgcttccgggacacagctgtgtggctgcccaggagcaaggacctgaagaagccaggggccaggaagcagtag

SEQ ID NO: 159563 - DNA, 1611 bp, Artificial Sequence
  Description of Artificial Sequence: Synthetic coding sequence
atggccgaggactggctggactgcccagccctgggccctggctggaagagaagagaggtgttcaggaagagcggggccacctgtggccgcagtgacacctactaccagagccccactggagaccgcatccgcagcaaggtggagctgacccgctacctgggccctgcctgtgacctgaccctgtttgacttcaagcagggcatcctgtgctacccagcccccaaggcccaccctgtggccgtggccagcaagaagaggaagaagcccagcaggcctgccaagaccaggaagaggcaggtgggcccccagagcggggaggtgaggaaggaggcccccagagatgagaccaaggctgacacagacacagccccagccagcttccctgcccctggctgctgtgagaactgtggcatctccttctctggagatggcacccagaggcagaggctgaagaccctgtgcaaggactgccgggcccagagaattgccttcaaccgggagcagaggatgttcaagagggtgggctgtggggagtgtgccgcctgccaggtgacagaggactgtggggcctgcagcacctgcctgctgcagctgccccatgatgtggccagcggcctcttctgcaagtgtgagcggcggcgctgcctgcgcatcgtggagaggagccggggctgcggcgtgtgccggggctgccagacccaggaggactgtggccactgccccatctgcctgcggccccccaggcctggcctgcggcggcagtggaagtgtgtgcagaggcgctgcctgcggggcaagcacgcccggaggaaaggaggctgtgacagcaagatggccgcccggcggcggcctggggcccagcccctgcccccacctccacccagccagagccctgagcccacagagccccagccctacaccaacagacggcagaacagaaaatgtggggcctgtgccgcctgcctgcggaggatggactgtggccgctgtgacttctgctgtgacaagcccaagtttggaggcagcaaccagaagaggcagaagtgccgctggaggcagtgcctgcagtttgccatgaagaggctgctgcccagcgtgtggagcgagagtgaagatggagctggcagccccccaccctacagaagaaggaagaggcccagcagcgcccggcggcaccacctgggccccaccctgaagcccaccctggccaccaggacagcccagcctgaccacacccaggcccccaccaagcaggaggccggcggcggctttgtgctgcccccacctggaacagacctggtgttcctgcgggagggcgccagcagccctgtgcaggtgcccggccctgtggccgccagcacagaggccctgctgcaggccgtggaccccggcctgcccagcgtgaagcaggagcccccagaccctgaggaggacaaggaggagaacaaggatgacagcgccagcaagctggcccctgaggaggaggccggcggggccggcacccctgtgatcacagagatcttcagcctgggcggcacccgcttccgggacacagctgtgtggctgcccaggagcaaggacctgaagaagccaggggccaggaagcagtag

SEQ ID NO: 159564 - DNA, 1893 bp, Artificial Sequence
  Description of Artificial Sequence: Synthetic coding sequence
atggccgaggactggctggactgcccagccctgggccctggctggaagagaagagaggtgttcaggaagagcggggccacctgtggccgcagtgacacctactaccagagccccactggagaccgcatccgcagcaaggtggagctgacccgctacctgggccctgcctgtgacctgaccctgtttgacttcaagcagggcatcctgtgctacccagcccccaaggcccaccctgtggccgtggccagcaagaagaggaagaagcccagcaggcctgccaagaccaggaagaggcaggtgggcccccagagcggggaggtgaggaaggaggcccccagagatgagaccaaggctgacacagacacagccccagccagcttccctgcccctggctgctgtgagaactgtggcatctccttctctggagatggcacccagaggcagaggctgaagaccctgtgcaaggactgccgggcccagagaattgccttcaaccgggagcagaggatgttcaagagggtgggctgtggggagtgtgccgcctgccaggtgacagaggactgtggggcctgcagcacctgcctgctgcagctgccccatgatgtggccagcggcctcttctgcaagtgtgagcggcggcgctgcctgcgcatcgtggagaggagccggggctgcggcgtgtgccggggctgccagacccaggaggactgtggccactgccccatctgcctgcggccccccaggcctggcctgcggcggcagtggaagtgtgtgcagaggcgctgcctgcggcacctggcccaccggctgcggcggcggcaccagcgctgccagaggaggacccccctggccgtggcccccccaacaggcaagcacgcccggaggaagggcggctgtgacagcaagatggccgccaggagaagacctggggcccagcccctgcccccacctccacccagccagagccctgagcccacagagccccacccccgggccctggcccccagccccccagctgagttcatctactactgtgtggatgaagatgagctgcagccctacaccaacagacggcagaacagaaaatgtggggcctgtgccgcctgcctgcggaggatggactgtggccgctgtgacttctgctgtgacaagcccaagtttggaggcagcaaccagaagaggcagaagtgccgctggaggcagtgcctgcagtttgccatgaagaggctgctgcccagcgtgtggagcgagagtgaagatggagctggcagccccccaccctacagaagaaggaagaggcccagcagcgcccggcggcaccacctgggccccaccctgaagcccaccctggccaccaggacagcccagcctgaccacacccaggcccccaccaagcaggaggccggcggcggctttgtgctgcccccacctggaacagacctggtgttcctgcgggagggcgccagcagccctgtgcaggtgcccggccctgtggccgccagcacagaggccctgctgcaggaggcccagtgcagcggcctgtcctgggtggtggccctgccccaggtgaagcaggagaaggctgacacccaggatgagtggaccccaggcacagctgtgctgaccagccctgtgctggtgcccggctgccccagcaaggctgtggaccccggcctgcccagcgtgaagcaggagcccccagaccctgaggaggacaaggaggagaacaaggatgacagcgccagcaagctggcccctgaggaggaggccggcggggccggcacccctgtgatcacagagatcttcagcctgggcggcacccgcttccgggacacagctgtgtggctgcccaggagcaaggacctgaagaagccaggggccaggaagcagtag

SEQ ID NO: 159565 - DNA, 1704 bp, Artificial Sequence
  Description of Artificial Sequence: Synthetic coding sequence
atggccgaggactggctggactgcccagccctgggccctggctggaagagaagagaggtgttcaggaagagcggggccacctgtggccgcagtgacacctactaccagagccccactggagaccgcatccgcagcaaggtggagctgacccgctacctgggccctgcctgtgacctgaccctgtttgacttcaagcagggcatcctgtgctacccagcccccaaggcccaccctgtggccgtggccagcaagaagaggaagaagcccagcaggcctgccaagaccaggaagaggcaggtgggcccccagagcggggaggtgaggaaggaggcccccagagatgagaccaaggctgacacagacacagccccagccagcttccctgcccctggctgctgtgagaactgtggcatctccttctctggagatggcacccagaggcagaggctgaagaccctgtgcaaggactgccgggcccagagaattgccttcaaccgggagcagaggatgttcaagagccggggctgcggcgtgtgccggggctgccagacccaggaggactgtggccactgccccatctgcctgcggcccccccggcccggcctgcggcggcagtggaagtgtgtgcagaggcgctgcctgcggggcaagcacgcccggaggaagggcggctgtgacagcaagatggccgccaggagaagacctggggcccagcccctgcccccacctccacccagccagagccctgagcccacagagccccacccccgggccctggcccccagccccccagctgagttcatctactactgtgtggatgaagatgagctgccctacaccaacagacggcagaacagaaaatgtggggcctgtgccgcctgcctgcggaggatggactgtggccgctgtgacttctgctgtgacaagcccaagtttggaggcagcaaccagaagaggcagaagtgccgctggaggcagtgcctgcagtttgccatgaagaggctgctgcccagcgtgtggagcgagagtgaagatggagctggcagccccccaccctacagaagaaggaagaggcccagcagcgcccggcggcaccacctgggccccaccctgaagcccaccctggccaccaggacagcccagcctgaccacacccaggcccccaccaagcaggaggccggcggcggctttgtgctgcccccacctggaacagacctggtgttcctgcgggagggcgccagcagccctgtgcaggtgcccggccctgtggccgccagcacagaggccctgctgcaggaggcccagtgcagcggcctgtcctgggtggtggccctgccccaggtgaagcaggagaaggctgacacccaggatgagtggaccccaggcacagctgtgctgaccagccctgtgctggtgcccggctgccccagcaaggctgtggaccccggcctgcccagcgtgaagcaggagcccccagaccctgaggaggacaaggaggagaacaaggatgattctgccagcaagctggcccctgaggaggaggccggcggggccggcacccctgtgatcacagagatcttcagcctgggcggcacccgcttccgggacacagctgtgtggctgccccgctactaccacctggccctggactggaagtgcaactgtggctaccacctgtgctgccgctctgtgctggtgccctag

SEQ ID NO: 159566 - DNA, 1608 bp, Artificial Sequence
  Description of Artificial Sequence: Synthetic coding sequence
atggccgaggactggctggactgcccagccctgggccctggctggaagagaagagaggtgttcaggaagagcggggccacctgtggccgcagtgacacctactaccagagccccactggagaccgcatccgcagcaaggtggagctgacccgctacctgggccctgcctgtgacctgaccctgtttgacttcaagcagggcatcctgtgctacccagcccccaaggcccaccctgtggccgtggccagcaagaagaggaagaagcccagcaggcctgccaagaccaggaagaggcaggtgggcccccagagcggggaggtgaggaaggaggcccccagagatgagaccaaggctgacacagacacagccccagccagcttccctgcccctggctgctgtgagaactgtggcatctccttctctggagatggcacccagaggcagaggctgaagaccctgtgcaaggactgccgggcccagagaattgccttcaaccgggagcagaggatgttcaagagggtgggctgtggggagtgtgccgcctgccaggtgacagaggactgtggggcctgcagcacctgcctgctgcagctgccccatgatgtggccagcggcctcttctgcaagtgtgagcggcggcgctgcctgcgcatcgtggagaggagccggggctgcggcgtgtgccggggctgccagacccaggaggactgtggccactgccccatctgcctgcggccccccaggcctggcctgcggcggcagtggaagtgtgtgcagaggcgctgcctgcggggcaagcacgcccggaggaaaggaggctgtgacagcaagatggccgcccggcggcggcctggggcccagcccctgcccccacctccacccagccagagccctgagcccacagagccccacccccgggccctggcccccagccccccagctgagttcatctactactgtgtggatgaagatgagctgaagaggctgctgcccagcgtgtggagcgagagtgaagatggagctggcagccccccaccctacagaagaaggaagaggcccagcagcgcccggcggcaccacctgggccccaccctgaagcccaccctggccaccaggacagcccagcctgaccacacccaggcccccaccaagcaggaggccggcggcggctttgtgctgcccccacctggaacagacctggtgttcctgcgggagggcgccagcagccctgtgcaggtgcccggccctgtggccgccagcacagaggccctgctgcaggccgtggaccccggcctgcccagcgtgaagcaggagcccccagaccctgaggaggacaaggaggagaacaaggatgattctgccagcaagctggcccctgaggaggaggccggcggggccggcacccctgtgatcacagagatcttcagcctgggcggcacccgcttccgggacacagctgtgtggctgccccgggccggcacccgggagggcaagatggatgtgaagtgtggccggcccaggacccagtggagcccccgggcccgggccggcacccatgaagatggcctggagcccatgtctgtgagccaccacctgcagctgaggtag

SEQ ID NO: 159567 - DNA, 1968 bp, Artificial Sequence
  Description of Artificial Sequence: Synthetic coding sequence
atggccgaggactggctggactgcccagccctgggccctggctggaagagaagagaggtgttcaggaagagcggggccacctgtggccgcagtgacacctactaccagagccccactggagaccgcatccgcagcaaggtggagctgacccgctacctgggccctgcctgtgacctgaccctgtttgacttcaagcagggcatcctgtgctacccagcccccaaggcccaccctgtggccgtggccagcaagaagaggaagaagcccagcaggcctgccaagaccaggaagaggcaggtgggcccccagagcggggaggtgaggaaggaggcccccagagatgagaccaaggctgacacagacacagccccagccagcttccctgcccctggctgctgtgagaactgtggcatctccttctctggagatggcacccagaggcagaggctgaagaccctgtgcaaggactgccgggcccagagaattgccttcaaccgggagcagaggatgttcaagagggtgggctgtggggagtgtgccgcctgccaggtgacagaggactgtggggcctgcagcacctgcctgctgcagctgccccatgatgtggccagcggcctcttctgcaagtgtgagcggcggcgctgcctgcgcatcgtggagaggagccggggctgcggcgtgtgccggggctgccagacccaggaggactgtggccactgccccatctgcctgcggccccccaggcctggcctgcggcggcagtggaagtgtgtgcagaggcgctgcctgcggggcaagcacgcccggaggaaaggaggctgtgacagcaagatggccgcccggcggcggcctggggcccagcccctgcccccacctccacccagccagagccctgagcccacagagccccacccccgggccctggcccccagccccccagctgagttcatctactactgtgtggatgaagatgagctgcagccctacaccaacagacggcagaacagaaaatgtggggcctgtgccgcctgcctgcggaggatggactgtggccgctgtgacttctgctgtgacaagcccaagtttggaggcagcaaccagaagaggcagaagtgccgctggaggcagtgcctgcagtttgccatgaagaggctgctgcccagcgtgtggagcgagagtgaagatggagctggcagccccccaccctacagaagaaggaagaggcccagcagcgcccggcggcaccacctgggccccaccctgaagcccaccctggccaccaggacagcccagcctgaccacacccaggcccccaccaagcaggaggccggcggcggctttgtgctgcccccacctggaacagacctggtgttcctgcgggagggcgccagcagccctgtgcaggtgcccggccctgtggccgccagcacagaggccctgctgcaggaggcccagtgcagcggcctgtcctgggtggtggccctgccccaggtgaagcaggagaaggctgacacccaggatgagtggaccccaggcacagctgtgctgaccagccctgtgctggtgcccggctgccccagcaaggctgtggaccccggcctgcccagcgtgaagcaggagcccccagaccctgaggaggacaaggaggagaacaaggatgattctgccagcaagctggcccctgaggaggaggccggcggggccggcacccctgtgatcacagagatcttcagcctgggcggcacccgcttccgggacacagctgtgtggctgcccagcctgcagggccgccacagcggccgggaggatggctgcaaggtgtgggagacagaagatactgtggagcccaccagcacctcctggaacccccggggctggccaggcacccacgtgtccctgagccccccaccagcctccatgatgtgggtgtcctgccgccgctcctggtgccccagcagccagagctag

SEQ ID NO: 159568 - DNA, 1236 bp, Artificial Sequence
  Description of Artificial Sequence: Synthetic coding sequence
atgagggcccaccctgggggcggccgctgctgcccagagcaggaggagggggagagcgctgctgggggcagcggggccggcggggacagcgccatcgagcagggcggccagggcagcgccctggcccccagccctgtgtctggagtgcggcgggagggcgcccggggcggcggccggggccggggccgctggaagcaggccggccggggcggcggcgtgtgtggccggggccggggccggggccggggccggggccggggccggggccggggccggggccggggccggcccccatctgggggcagcggcctgggcggagatggcggcggctgcggcggcggcggcagcggcggcggcggggccccccggcgggagcctgtgcccttccccagcggcagcgctggccctggcccccggggcccccgggccacagagagcggcaagaggatggactgcccagccctgcccccaggctggaagaaggaggaggtgatcaggaagagcggcctgtctgctgggaagagtgatgtgtactacttcagccccagcggcaagaagttccgcagcaagccccagctggcccgctacctgggcaacacagtggacctgagcagctttgacttcagaacaggcaagatgatgcccagcaagctgcagaagaacaagcagaggctgagaaatgaccccctgaaccagaacaagggcaagccagacctgaacaccaccctgcccatccggcagacagccagcatcttcaagcagcctgtgaccaaggtgaccaaccaccccagcaacaaggtgaagagtgacccccagaggatgaatgagcagccccggcagctgttctgggagaagaggctgcagggcctgagcgccagtgatgtgacagagcagatcatcaagaccatggagctgcccaagggcctgcagggcgtgggccctggcagcaatgatgagaccctgctgtctgctgtggccagcgccctgcacaccagcagcgcccccatcaccggccaggtgtctgctgctgtggagaagaacccagctgtgtggctgaacaccagccagcccctgtgcaaggccttcatcgtgacagatgaggacatcaggaagcaggaggagcgggtgcagcaggtgaggaagaagctggaggaggccctgatggctgacatcctgagcagagctgctgacacagaggagatggacatcgagatggattctggagatgaggcctag

SEQ ID NO: 159569 - DNA, 909 bp, Artificial Sequence
  Description of Artificial Sequence: Synthetic coding sequence
atgagggcccaccctgggggcggccgctgctgcccagagcaggaggagggggagagcgctgctgggggcagcggggccggcggggacagcgccatcgagcagggcggccagggcagcgccctggcccccagccctgtgtctggagtgcggcgggagggcgcccggggcggcggccggggccggggccgctggaagcaggccggccggggcggcggcgtgtgtggccggggccggggccggggccggggccggggccggggccggggccggggccggggccggggccggcccccatctgggggcagcggcctgggcggagatggcggcggctgcggcggcggcggcagcggcggcggcggggccccccggcgggagcctgtgcccttccccagcggcagcgctggccctggcccccggggcccccgggccacagagagcggcaagaggatggactgcccagccctgcccccaggctggaagaaggaggaggtgatcaggaagagcggcctgtctgctgggaagagtgatgtgtactacttcagccccagcggcaagaagttccgcagcaagccccagctggcccgctacctgggcaacacagtggacctgagcagctttgacttcagaacaggcaagatgatgcccagcaagctgcagaagaacaagcagaggctgagaaatgaccccctgaaccagaacaagctgcgctggaacacccacaggcctgccccctggcacgccctgagccggctgtgcctgctgatccgctgcctgctgtgcctggagtgtgcctaccccctgcccctgcacctggtgaacagctacagcagcaagacccagctgcactgcctgcacctgtgggaggcctgcccagcctacagccggcagaaccagagcttccccccatag

SEQ ID NO: 159570 - DNA, 909 bp, Artificial Sequence; identical to SEQ ID NO: 159569
  Description of Artificial Sequence: Synthetic coding sequence

SEQ ID NO: 159571 - DNA, 876 bp, Artificial Sequence
  Description of Artificial Sequence: Synthetic coding sequence
atggagaggaagcgctgggagtgcccagccctgccccagggctgggagcgggaggaggtgccccggcgcagcggcctgtctgctggccacagagatgtgttctactacagccccagcggcaagaagttccgcagcaagccccagctggcccgctacctgggcggctccatggacctgagcacctttgacttcagaacaggcaagatgctgatgagcaagatgaacaagagccggcagagggtgcgctatgacagcagcaaccaggtgaagggcaagccagacctgaacacagccctgcctgtgcggcagacagccagcatcttcaagcagcctgtgaccaagatcaccaaccaccccagcaacaaggtgaagagtgacccccagaaggctgtggaccagccccggcagctgttctgggagaagaagctgagcggcctgaatgcctttgatattgctgaggagctggtgaagaccatggacctgcccaagggcctgcagggcgtgggccctggctgcacagatgagaccctgctgagcgccatcgccagcgccctgcacaccagcaccatgcccatcaccggccagctgtctgctgctgtggagaagaaccctggggtgtggctgaacaccacccagcccctgtgcaaggccttcatggtgacagatgaggacatcaggaagcaggaggagctggtgcagcaggtgaggaagaggctggaggaggccctgatggctgacatgctggcccacgtggaggagctggccagagatggagaggcccccctggacaaggcctgtgccgaggatgatgatgaagaagatgaggaggaggaggaggaggagccagaccctgaccctgagatggagcacgtgtag

SEQ ID NO: 159572 - DNA, 780 bp, Artificial Sequence
  Description of Artificial Sequence: Synthetic coding sequence
atggagaggaagagccccagcggcaagaagttccgcagcaagccccagctggcccgctacctgggcggctccatggacctgagcacctttgacttcagaacaggcaagatgctgatgagcaagatgaacaagagccggcagagggtgcgctatgacagcagcaaccaggtgaagggcaagccagacctgaacacagccctgcctgtgcggcagacagccagcatcttcaagcagcctgtgaccaagatcaccaaccaccccagcaacaaggtgaagagtgacccccagaaggctgtggaccagccccggcagctgttctgggagaagaagctgagcggcctgaatgcctttgatattgctgaggagctggtgaagaccatggacctgcccaagggcctgcagggcgtgggccctggctgcacagatgagaccctgctgagcgccatcgccagcgccctgcacaccagcaccatgcccatcaccggccagctgtctgctgctgtggagaagaaccctggggtgtggctgaacaccacccagcccctgtgcaaggccttcatggtgacagatgaggacatcaggaagcaggaggagctggtgcagcaggtgaggaagaggctggaggaggccctgatggctgacatgctggcccacgtggaggagctggccagagatggagaggcccccctggacaaggcctgtgccgaggatgatgatgaagaagatgaggaggaggaggaggaggagccagaccctgaccctgagatggagcacgtgtag

SEQ ID NO: 159573 - DNA, 4485 bp, Artificial Sequence
  Description of Artificial Sequence: Synthetic coding sequence
atgaatggaggcaaggaatgtgatggaggagacaaggagggcggcctgcctgccatccaggtgcctgtgggctggcagaggagagtggaccagaatggagtgctgtatgtgagccccagcggcagcctgctgagctgcctggagcaggtgaagacctacctgctgacagatggcacctgcaagtgtggcctggagtgccccctcatcctgcccaaggtgttcaactttgaccccggggctgctgtgaagcagaggacagcagaagatgtgaaggcagatgaagatgtgaccaagctgtgcatccacaagaggaagatcatcgctgtggccaccctgcacaagtccatggaggccccccaccccagcctggtgctgaccagccctgggggcggcaccaatgccacccctgtggtgcccagccgggccgccacccccaggtctgtgaggaacaagagccatgagggcatcaccaacagcgtgatgcctgagtgcaagaaccccttcaagctgatgattggcagcagcaatgccatgggccgcctgtatgtgcaggagctgcccggcagccagcagcaggagctgcaccctgtgtacccccggcagaggctgggcagcagcgagcacggccagaagagccccttccggggcagccacggcggcctgcccagccctgccagcagcggcagccagatctatggagatggcagcatcagccccaggacagaccccctgggcagcccagatgtgttcaccaggagcaaccctggcttccacggggcccccaacagcagccccatccacctgaacagaacacccctgagccccccatctgtgatgctgcacggcagccctgtgcagagcagctgtgccatggccggccgcaccaacatccccctgagccccaccctgaccaccaagagccctgtgatgaagaagcccatgtgcaacttcagcaccaacatggagatcccccgggccatgttccaccacaagccaccccagggccccccacctcctcctccacccagctgtgccctgcagaagaagcccctgaccagcgagaaggaccccctgggcatcctggaccccatccccagcaagcctgtgaaccagaaccctgtgatcatcaaccccaccagcttccacagcaatgtgcacagccaggtgcccatgatgaatgtgtccatgcctcctgctgtggtgcccctgcccagcaacctgcccctgcccaccgtgaagccaggccacatgaaccacggcagccacgtgcagagggtgcagcacagcgccagcaccagcctgagccccagccctgtgaccagccctgtgcacatgatgggcaccggcatcggcagaattgaggccagcccccagaggagccgcagcagcagcaccagcagtgaccacggcaacttcatgatgcctcctgtgggcccccaggccaccagcagcggcatcaaggtgcccccaagaagccccaggagcaccatcggcagcccccggcccagcatgcccagcagccccagcaccaagagtgatggccaccaccagtacaaggacatccccaaccccctgattgctggcatcagcaatgtgctgaacacccccagcagcgctgccttccccacagccagcgctggcagcagctctgtgaagagccagcccggcctgctgggcatgcccctgaaccagatcctgaaccagcacaatgctgccagcttccctgccagcagcctgctgtctgctgctgccaaggcccagctggccaaccagaacaagctggccggcaacaacagcagcagcagcagcaacagcggggctgtggccggcagcggcaacacagagggccacagcaccctgaacaccatgtttcctcccacagccaacatgctgctgcccaccggggagggccagagcggccgggccgccctgcgggacaagctgatgagccagcagaaggatgccctgaggaagaggaagcagccccccaccaccgtgctgagcctgctgcggcagagccagatggacagcagcgctgtgcccaagccaggccctgacctgctgaggaagcagggccagggcagcttccccatcagctccatgagccagctgctgcagagcatgagctgccagagcagccacctgagcagcaacagcaccccaggctgtggggccagcaacacagccctgccctgcagcgccaaccagctgcacttcacagaccccagcatgaacagctctgtgctgcagaacatccccctgcggggggaggccgtgcactgccacaatgccaacaccaactttgtgcacagcaacagccctgtgcccaaccaccacctggccggcctcatcaaccagatccaggccagcggcaactgtggcatgctgagccagagcggcatggccctgggcaacagcctgcaccccaaccccccccagagccgcatcagcaccagcagcacccctgtgatccccaacagcatcgtgtcctcctacaaccagaccagcagcgaggccggcggcagcggccccagcagcagcatcgccatcgccggcaccaaccacccagccatcaccaagaccacctctgtgctgcaggatggagtcatcgtgaccacagctgctggcaaccccctgcagagccagctgcccatcggcagtgacttcccctttgtgggccaggagcacgccctgcacttccccagcaacagcaccagcaacaaccacctgccccaccccctgaaccccagcctgctgagcagcctgcccatcagcctgcctgtgaaccagcagcacctgctgaaccagaacctgctgaacatcctgcagcccagcgctggggagggggacatgagcagcatcaacaacaccctgagcaaccaccagctgacccacctgcagagcctgctgaacaacaaccagatgtttcctcccaaccagcagcagcagcagctgctgcagggctaccagaacctgcaggccttccagggccagagcaccatcccctgcccagccaacaacaaccccatggcctgcctcttccagaacttccaggtgaggatgcaggaggatgctgccctgctgaacaagaggatcagcacccagcccggcctgacagccctgcctgagaaccccaacaccaccctgccccccttccaggacaccccctgtgagctgcagcccagaattgaccccagcctgggccagcaggtgaaggatggcctggtggtgggcggccctggagatgcctctgtggatgccatctacaaggctgtggtggatgctgccagcaagggcatgcaggtggtgatcaccacagctgtgaacagcaccacccagatcagccccatcccagccctgagcgccatgtctgccttcaccgccagcatcggggaccccctgaacctgagcagcgctgtgtctgctgtgattcatggaagaaacatgggcggcgtggaccatgatggccgcctgaggaacagcagaggagcccggctgcccaagaacctggaccacggcaagaatgtgaatgaaggagatggctttgagtacttcaagagcgccagctgccacaccagcaagaagcagtgggatggagagcagagccccagaggagagaggaaccgctggaagtatgaggagttcctggaccaccctggccacatccacagcagcccctgccacgagcggcccaacaacgtgtccaccctgcccttcctgcctggagagcagcaccccatcctgctgccccccaggaactgccctggggacaagatcctggaggagaacttccgctacaacaactacaagaggaccatgatgtccttcaaggagcggctggagaacacagtggagcgctgtgcccacatcaatggaaaccggccccggcagagccggggctttggagagctgctgagcacagccaagcaggacctggtgctggaggagcagagccccagcagcagcaacagcctggagaacagcctggtgaaggactacatccactacaatggagacttcaatgccaagtctgtgaatggctgtgtgcccagccccagtgatgccaagagcatcagcagtgaagatgacctgagaaatccagacagccccagcagcaatgaactcatccactaccggcccaggaccttcaacgtgggggacctggtgtggggccagatcaagggcctgacctcctggccaggcaagctggtgcgggaggatgatgtgcacaacagctgccagcagagccctgaggagggcaaggtggagcctgagaagctgaagaccctgacagagggcctggaggcctacagccgggtgaggaagaggaacaggaagagcggcaagctgaacaaccacctggaggccgccatccacgaggccatgtctgagctggacaagatgtctggaacagtgcaccagatcccccagggcgaccggcagatgaggcctcccaagcccaagaggaggaagatcagcaggtag

SEQ ID NO: 159574 - DNA, 2178 bp, Artificial Sequence
  Description of Artificial Sequence: Synthetic coding sequence
atggctgctgccagcgctgtgtctgtgctgctggtggccgctgagaggaaccgctggcaccggctgcccagcctgctgctgccccccaggacctgggtgtggaggcagaggaccatgaagtacaccacagccactggaagaaacatcaccaaggtgctgattgccaacagaggagagatcgcctgccgggtgatgaggacagccaagaagctgggcgtgcagacagtggccgtgtacagcgaggccgacaggaacagcatgcacgtggacatggctgatgaggcctacagcatcggccctgcccccagccagcagagctacctgtccatggagaagatcatccaggtggccaagaccagcgctgcccaggccatccaccctggctgcggcttcctgtctgagaacatggagtttgctgagctgtgcaagcaggagggcatcatcttcatcggccccccaccttctgccatccgggacatgggcatcaagagcaccagcaagagcatcatggctgctgctggggtgcctgtggtggagggctaccacggggaggaccagagcgaccagtgcctgaaggagcacgcccggcgcatcggctaccctgtgatgatcaaggctgtgcggggcggcggcggcaagggcatgagaattgtgcgctctgagcaggagttccaggagcagctggagagcgcccggcgggaggccaagaagagcttcaatgatgatgccatgctgattgagaagtttgtggacacccccaggcatgtggaggtgcaggtgtttggagaccaccacggcaatgctgtgtacctgtttgagcgggactgcagcgtgcagaggaggcaccagaagatcatcgaggaggccccagcccctggcatcaagtctgaggtgaggaagaagctgggggaggccgctgtgcgggccgccaaggctgtgaactacgtgggcgccggcaccgtggagttcatcatggacagcaagcacaacttctgcttcatggagatgaacacccggctgcaggtggagcaccctgtgacagagatgatcactggaacagacctggtggagtggcagctgagaattgctgctggggagaagatccccctgagccaggaggagatcaccctgcagggccacgcctttgaggcccgcatctatgcagaggaccccagcaacaacttcatgcctgtggccggccccctggtgcacctgagcacccccagggctgaccccagcacccgcatcgagaccggggtgcggcagggagatgaggtgtctgtgcactatgaccccatgattgccaagctggtggtgtgggccgctgaccggcaggccgccctgaccaagctgcgctacagcctgcggcagtacaacatcgtgggcctgcacaccaacatcgacttcctgctgaacctgagcggccaccctgagtttgaagctggaaatgtgcacacagacttcatcccccagcaccacaagcagctgctgctgagcaggaaggctgctgccaaggagagcctgtgccaggccgccctgggcctcatcctgaaggagaaggccatgacagacaccttcaccctgcaggcccatgaccagttcagccccttcagcagcagcagtggaagaaggctgaacatctcctacaccaggaacatgaccctgaaggatggcaagaacaacgtggccatcgctgtgacctacaaccatgatggcagctacagcatgcagatcgaggacaagaccttccaggtgctgggcaacctgtacagcgagggggactgcacctacctgaagtgcagcgtgaatggagtggccagcaaggccaagctgatcatcctggagaacaccatctacctgttcagcaaggagggcagcattgaaattgacatccctgtgcccaagtacctgagctctgtgagcagccaggagacccagggcggccccctggcccccatgacaggcaccatcgagaaggtgtttgtgaaggccggggacaaggtgaaggccggggacagcctgatggtgatgattgccatgaagatggagcacaccatcaagagccccaaggatggcaccgtgaagaaggtgttctaccgggagggcgcccaggccaacagacacacccccctggtggagtttgaggaggaggagagtgacaagcgggagagcgagtag

SEQ ID NO: 159575 - DNA, 1728 bp, Artificial Sequence
  Description of Artificial Sequence: Synthetic coding sequence
atggagaagatcatccaggtggccaagaccagcgctgcccagcacatccagagcatcatggctgctgctggggtgcctgtggtggagggctaccacggggaggaccagagcgaccagtgcctgaaggagcacgcccggcgcatcggctaccctgtgatgatcaaggctgtgcggggcggcggcggcaagggcatgagaattgtgcgctctgagcaggagttccaggagcagctggagagcgcccggcgggaggccaagaagagcttcaatgatgatgccatgctgattgagaagtttgtggacacccccaggcatgtggaggtgcaggtgtttggagaccaccacggcaatgctgtgtacctgtttgagcgggactgcagcgtgcagaggaggcaccagaagatcatcgaggaggccccagcccctggcatcaagtctgaggtgaggaagaagctgggggaggccgctgtgcgggccgccaaggctgtgaactacgtgggcgccggcaccgtggagttcatcatggacagcaagcacaacttctgcttcatggagatgaacacccggctgcaggtggagcaccctgtgacagagatgatcactggaacagacctggtggagtggcagctgagaattgctgctggggagaagatccccctgagccaggaggagatcaccctgcagggccacgcctttgaggcccgcatctatgcagaggaccccagcaacaacttcatgcctgtggccggccccctggtgcacctgagcacccccagggctgaccccagcacccgcatcgagaccggggtgcggcagggagatgaggtgtctgtgcactatgaccccatgattgccaagctggtggtgtgggccgctgaccggcaggccgccctgaccaagctgcgctacagcctgcggcagtacaacatcgtgggcctgcacaccaacatcgacttcctgctgaacctgagcggccaccctgagtttgaagctggaaatgtgcacacagacttcatcccccagcaccacaagcagctgctgctgagcaggaaggctgctgccaaggagagcctgtgccaggccgccctgggcctcatcctgaaggagaaggccatgacagacaccttcaccctgcaggcccatgaccagttcagccccttcagcagcagcagtggaagaaggctgaacatctcctacaccaggaacatgaccctgaaggatggcaagaacaacgtggccatcgctgtgacctacaaccatgatggcagctacagcatgcagatcgaggacaagaccttccaggtgctgggcaacctgtacagcgagggggactgcacctacctgaagtgcagcgtgaatggagtggccagcaaggccaagctgatcatcctggagaacaccatctacctgttcagcaaggagggcagcattgaaattgacatccctgtgcccaagtacctgagctctgtgagcagccaggagacccagggcggccccctggcccccatgacaggcaccatcgagaaggtgtttgtgaaggccggggacaaggtgaaggccggggacagcctgatggtgatgattgccatgaagatggagcacaccatcaagagccccaaggatggcaccgtgaagaaggtgttctaccgggagggcgcccaggccaacagacacacccccctggtggagtttgaggaggaggagagtgacaagcgggagagcgagtag

SEQ ID NO: 159576 - DNA, 1425 bp, Artificial Sequence
  Description of Artificial Sequence: Synthetic coding sequence
atggctgctgccagcgctgtgtctgtgctgctggtggccgctgagaggaaccgctggcaccggctgcccagcctgctgctgccccccaggacctgggtgtggaggcagaggaccatgaagtacaccacagccacagatgaggcctacagcatcggccctgcccccagccagcagagctacctgtccatggagaagatcatccaggtggccaagaccagcgctgcccaggccatccaccctggctgcggcttcctgtctgagaacatggagtttgctgagctgtgcaagcaggagggcatcatcttcatcggccccccacccagcgccatccgggacatgggcatcaagagcaccagcaagagcatcatggctgctgctggggtgcctgtggtggagggctaccatggagaggaccagagcgaccagtgcctgaaggagcacgccaggagaattggctaccctgtgatgatcaaggctgtgcggggcggcggcggcaagggcatgagaattgtgcgctctgagcaggagttccaggagcagctggagagcgcccggcgggaggccaagaagagcttcaatgatgatgccatgctgattgagaagtttgtggacacccccaggcatgtggaggtgcaggtgtttggagaccaccacggcaatgctgtgtacctgtttgagcgggactgcagcgtgcagaggaggcaccagaagatcatcgaggaggccccagcccctggcatcaagtctgaggtgaggaagaagctgggggaggccgctgtgcgggccgccaaggctgtgaactacgtgggcgccggcaccgtggagttcatcatggacagcaagcacaacttctgcttcatggagatgaacacccggctgcaggtggagcaccctgtgacagagatgatcaccggcacagacctggtggagtggcagctgagaattgctgctggggagaagatccccctgagccaggaggagatcaccctgcagggccacgcctttgaggcccgcatctatgcagaggaccccagcaacaacttcatgcctgtggccggccccctggtgcacctgagcacccccagggctgaccccagcaccagaattgaaacaggagtgcggcagggagatgaggtgtctgtgcactatgaccccatgattgccaagctggtggtgtgggccgctgaccggcaggccgccctgaccaagctgcgctacagcctgcggcagtacaacatcgtgggcctgcacaccaacctgaccagctacagcacctgcctggccacccagagcctgaagctgggcacctgcaccctcatcagcagcctgaacaccaccaacagctgctgcagcgtgggccgcctgcagcccaagagcctgtatgcccggcagccctgggtgagcagcagcaggaggaagccctag

SEQ ID NO: 159577 - DNA, 1281 bp, Artificial Sequence
  Description of Artificial Sequence: Synthetic coding sequence
atggagtttgctgagctgtgcaagcaggagggcatcatcttcatcggccccccacccagcgccatccgggacatgggcatcaagagcaccagcaagagcatcatggctgctgctggggtgcctgtggtggagggctaccatggagaggaccagagcgaccagtgcctgaaggagcacgccaggagaattggctaccctgtgatgatcaaggctgtgcggggcggcggcggcaagggcatgagaattgtgcgctctgagcaggagttccaggagcagctggagagcgcccggcgggaggccaagaagagcttcaatgatgatgccatgctgattgagaagtttgtggacacccccaggcatgtggaggtgcaggtgtttggagaccaccacggcaatgctgtgtacctgtttgagcgggactgcagcgtgcagaggaggcaccagaagatcatcgaggaggccccagcccctggcatcaagtctgaggtgaggaagaagctgggggaggccgctgtgcgggccgccaaggctgtgaactacgtgggcgccggcaccgtggagttcatcatggacagcaagcacaacttctgcttcatggagatgaacacccggctgcaggtggagcaccctgtgacagagatgatcaccggcacagacctggtggagtggcagctgagaattgctgctggggagaagatccccctgagccaggaggagatcaccctgcagggccacgcctttgaggcccgcatctatgcagaggaccccagcaacaacttcatgcctgtggccggccccctggtgcacctgagcacccccagggctgaccccagcaccagaattgaaacaggagtgcggcagggagatgaggtgtctgtgcactatgaccccatgattgccaagctggtggtgtgggccgctgaccggcaggccgccctgaccaagctgcgctacagcctgcggcagtacaacatcgtgggcctgcacaccaacatcgacttcctgctgaacctgagcggccaccctgagtttgaggccggaaatgtgcacacagacttcatcccccagcaccacaagcagctgctgctgagcaggaaggccgccgccaaggagagcctgtgccaggccgccctgggcctcatcctgaaggagaaggccatgacagacaccttcaccctgcaggcccatgaccagttcagccccttcagcagcagcagcggccggcggctgaacatctcctacaccaggaacatgaccctgaaggatggcaagaacaactag

SEQ ID NO: 159578 - DNA, 603 bp, Artificial Sequence
  Description of Artificial Sequence: Synthetic coding sequence
atggagaagatcatccaggtggccaagaccagcgctgcccaggccatccaccctggctgcggcttcctgtctgagaacatggagtttgctgagctgtgcaagcaggagggcatcatcttcatcggccccccacccagcgccatccgggacatgggcatcaagagcaccagcaagagcatcatggctgctgctggggtgcctgtggtggagggctaccatggagaggaccagagcgaccagtgcctgaaggagcacgccaggagaattggctaccctgtgatgatcaaggctgtgcggggcggcggcggcaagggcatgagaattgtgcgctctgagcaggagttccaggagcagctggagagcgcccggcgggaggccaagaagagcttcaatgatgatgccatgctgattgagaagtttgtggacacccccaggcatgtggaggtgcaggtgtttggagaccaccacggcaatgctgtgtacctgtttgagcgggactgcagcgtgcagaggaggcaccagaagatcatcgaggaggccccagcccctggcatcaagtctgaggtgaggaagaagggccgcagctgcagccagagctgctag

SEQ ID NO: 159579 - DNA, 1578 bp, Artificial Sequence
  Description of Artificial Sequence: Synthetic coding sequence
atgtgggccgtgctgcggctggccctgcggccctgtgcccgggccagccctgctggcccccgggcctaccacggggacagcgtggccagcctgggcacccagcctgacctgggcagcgccctgtaccaggagaactacaagcagatgaaggccctggtgaaccagctgcacgagcgggtggagcacatcaagctgggcggcggggagaaggcccgggccctgcacatcagccggggcaagctgctgccccgggagagaattgacaacctgattgatcctggcagccccttcctggagctgagccagtttgctggctaccagctgtatgacaatgaggaggtgcctgggggcggcatcatcactggaattggccgggtgtctggagtggagtgcatgatcatcgccaatgatgccaccgtgaagggcggggcctactaccctgtgacagtgaagaagcagctgcgggcccaggagatcgccatgcagaaccggctgccctgcatctacctggtggacagcggcggggcctacctgccccggcaggctgatgtgtttcctgaccgggaccactttggaagaaccttctacaaccaggccatcatgagcagcaagaacatcgcccaggtgaaggccgccactggagaggaggtgtctgctgaggacctgggcggcgctgacctgcactgcaggaagagcggcgtgtctgaccactgggccctggatgaccaccacgccctgcacctgaccaggaaggtggtgaggaacctgaactaccagaagaagctggatgtgaccatcgagcccagcgaggagcccctcttcccagcagatgagctgtatggcatcgtgggcgccaacctgaagaggagctttgatgtgcgggaggtgattgcccgcatcgtggatggcagccgcttcacagagttcaaggccttctatggagacaccctggtgactggatttgcccgcatcttcggctaccctgtgggcatcgtgggcaacaatggagtgctcttcagcgagagcgccaagaagggcacccactttgtgcagctgtgctgccagaggaacatccccctgctcttcctgcagaacatcaccggcttcatggtgggccgggagtatgaagctgagggcatcgccaaggatggagccaagatggtggccgctgtggcctgtgcccaggtgcccaagatcaccctcatcattggaggcagctatggagctggcaactacggcatgtgtggccgggcctacagcccccgcttcctgtacatctggcccaatgcccgcatctctgtgatgggcggggagcaggccgccaacgtgctggccaccatcaccaaggaccagagggcccgggagggcaagcagttcagcagcgcagatgaagctgccctgaaggagcccatcatcaagaagtttgaggaggagggcaacccctactacagcagcgcccgggtgtgggatgatggcatcatcgaccctgctgacacccggctggtgctgggcctgtccttctctgctgccctgaatgcccccatcgagaagacagactttggcatcttcaggatgtag

SEQ ID NO: 159580 - DNA, 1692 bp, Artificial Sequence
  Description of Artificial Sequence: Synthetic coding sequence
atgtgggccgtgctgcggctggccctgcggccctgtgcccgggccagccctgctggcccccgggcctaccacggggacagcgtggccagcctgggcacccagcctgacctgggcagcgccctgtaccaggagaactacaagcagatgaaggccctggtgaaccagctgcacgagcgggtggagcacatcaagctgggcggcggggagaaggcccgggccctgcacatcagccggggcaagctgctgccccgggagagaattgacaacctgattgatcctggcagccccttcctggagctgagccagtttgctggctaccagctgtatgacaatgaggaggtgcctgggggcggcatcatcactggaattggccgggtgtctggagtggagtgcatgatcatcgccaatgatgccaccgtgaagggcggggcctactaccctgtgacagtgaagaagcagctgcgggcccaggagatcgccatgcagaaccggctgccctgcatctacctggtggacagcggcggggcctacctgccccggcaggctgatgtgtttcctgaccgggaccactttggaagaaccttctacaaccaggccatcatgagcagcaagaacatcgcccagattgctgtggtgatgggcagctgcacagctgggggcgcctacgtgcctgccatggctgatgagaacatcatcgtgaggaagcagggcaccatcttcctggccggcccccccctggtgaaggccgccactggagaggaggtgtctgctgaggacctgggcggcgctgacctgcactgcaggaagagcggcgtgtctgaccactgggccctggatgaccaccacgccctgcacctgaccaggaaggtggtgaggaacctgaactaccagaagaagctggatgtgaccatcgagcccagcgaggagcccctcttcccagcagatgagctgtatggcatcgtgggcgccaacctgaagaggagctttgatgtgcgggaggtgattgcccgcatcgtggatggcagccgcttcacagagttcaaggccttctatggagacaccctggtgactggatttgcccgcatcttcggctaccctgtgggcatcgtgggcaacaatggagtgctcttcagcgagagcgccaagaagggcacccactttgtgcagctgtgctgccagaggaacatccccctgctcttcctgcagaacatcaccggcttcatggtgggccgggagtatgaagctgagggcatcgccaaggatggagccaagatggtggccgctgtggcctgtgcccaggtgcccaagatcaccctcatcattggaggcagctatggagctggcaactacggcatgtgtggccgggcctacagcccccgcttcctgtacatctggcccaatgcccgcatctctgtgatgggcggggagcaggccgccaacgtgctggccaccatcaccaaggaccagagggcccgggagggcaagcagttcagcagcgcagatgaagctgccctgaaggagcccatcatcaagaagtttgaggaggagggcaacccctactacagcagcgcccgggtgtgggatgatggcatcatcgaccctgctgacacccggctggtgctgggcctgtccttctctgctgccctgaatgcccccatcgagaagacagactttggcatcttcaggatgtag

SEQ ID NO: 159581 - DNA, 870 bp, Artificial Sequence
  Description of Artificial Sequence: Synthetic coding sequence
atggccaagcacatccagaaggagatccagaggggcgtggagagctgggtgtccctgggcaacagaagaccccacctgagcatcatcctggtgggggacaacccagccagccacacctacgtgaggaacaagatccgggccgccagcgctgtgggcatctgcagcgagctgatcctgaagcccaaggatgtgtcccaggaggagctgctggatgtgacagaccagctgaacatggacccccgggtgtctggcatcctggtgcagctgcccctgcctgaccacgtggatgagaggaccatctgcaatggcatcgcccctgagaaggatgtggatggcttccacatcatcaacatcggccgcctgtgcctggaccagcacagcctcatcccagccacagccagcgctgtgtgggagatcatcaagaggacaggcatccagaccttcggcaagaatgtggtggtggccggccgcagcaagaatgtgggcatgcccatcgccatgctgctgcacacagatggagaacatgagaggcctggaggagatgccaccgtgaccatcgcccaccgctacacccccaaggagcagctgaagatccacacccagctggccgacatcatcatcgtggccgccggcatccccaagctgatcaccagtgacatggtgaaggagggcgctgctgtgattgatgtgggcatcaactacgtgcatgaccctgtgacaggcaagaccaagctggtgggagatgtggactttgaagctgtgaagaagaaggccggcttcatcacccctgtgcctggaggagtgggccccatgacagtggccatgctgctgaagaacaccctgctggccgccaagaagatcatctactag

SEQ ID NO: 159582 - DNA, 672 bp, Artificial Sequence
  Description of Artificial Sequence: Synthetic coding sequence
atggccaagcacatccagaaggagatccagaggggcgtggagagctgggtgtccctgggcaacagaagaccccacctgagcatcatcctggtgggggacaacccagccagccacacctacgtgaggaacaagatccgggccgccagcgctgtgggcatctgcagcgagctgatcctgaagcccaaggatgtgtcccaggaggagctgctggatgtgacagaccagctgaacatggacccccgggtgtctggcatcctggtgcagctgcccctgcctgaccacgtggatgagaggaccatctgcaatggcatcgcccctgagaaggatgtggatggcttccacatcatcaacatcggccgcctgtgcctggaccagcacagcctcatcccagccacagccagcgctgtgtgggagatcatcaagaggacaggcatccagaccttcggcaagaatgtggtggtggccggccgcagcaagaatgtgggcatgcccatcgccatgctgctgcacacagatggagaacatgagaggcctggaggagatgccaccgtgaccatcgcccaccgctacacccccaaggagcagctgaagatccacacccagctggccgacatcatcatcgtggccgctgagcgcttccaccactttgcccaggacctgagcaacagctag

SEQ ID NO: 159583 - DNA, 762 bp, Artificial Sequence
  Description of Artificial Sequence: Synthetic coding sequence
atggccaagcacatccagaaggagatccagaggggcgtggagagctgggtgtccctgggcaacagaagaccccacctgagcatcatcctggtgggggacaacccagccagccacacctacgtgaggaacaagatccgggccgccagcgctgtgggcatctgcagcgagctgatcctgaagcccaaggatgtgtcccaggaggagctgctggatgtgacagaccagctgaacatggacccccgggtgtctggcatcctggtgcagctgcccctgcctgaccacgtggatgagaggaccatctgcaatggcatcgcccctgagaaggatgtggatggcttccacatcatcaacatcggccgcctgtgcctggaccagcacagcctcatcccagccacagccagcgctgtgtgggagatcatcaagaggacaggcatccagaccttcggcaagaatgtggtggtggccggccgcagcaagaatgtgggcatgcccatcgccatgctgctgcacacagatggagaacatgagaggcctggaggagatgccaccgtgaccatcgcccaccgctacacccccaaggagcagctgaagatccacacccagctggccgacatcatcatcgtggccgccggcatccccaagctgatcaccagtgacatggtgaaggagggcgctgctgtgattgatgtgggcatcaactacgtgcatgaccctgtgacaggcaagaccaagctggtgggagatgtggactttgaggcctag

SEQ ID NO: 159584 - DNA, 1044 bp, Artificial Sequence
  Description of Artificial Sequence: Synthetic coding sequence
atgacagtgcctgtgcggggcttcagcctgctgcggggccgcctgggccgggccccagccctgggccgcagcacagcccccagcgtgcgggcccctggagagcccggcagcgccttccggggcttccgcagcagtggagtgagacatgaggccatcatcatctctggaacagagatggccaagcacatccagaaggagatccagaggggcgtggagagctgggtgtccctgggcaacagaagaccccacctgagcatcatcctggtgggggacaacccagccagccacacctacgtgaggaacaagatccgggccgccagcgctgtgggcatctgcagcgagctgatcctgaagcccaaggatgtgtcccaggaggagctgctggatgtgacagaccagctgaacatggacccccgggtgtctggcatcctggtgcagctgcccctgcctgaccacgtggatgagaggaccatctgcaatggcatcgcccctgagaaggatgtggatggcttccacatcatcaacatcggccgcctgtgcctggaccagcacagcctcatcccagccacagccagcgctgtgtgggagatcatcaagaggacaggcatccagaccttcggcaagaatgtggtggtggccggccgcagcaagaatgtgggcatgcccatcgccatgctgctgcacacagatggagaacatgagaggcctggaggagatgccaccgtgaccatcgcccaccgctacacccccaaggagcagctgaagatccacacccagctggccgacatcatcatcgtggccgccggcatccccaagctgatcaccagtgacatggtgaaggagggcgctgctgtgattgatgtgggcatcaactacgtgcatgaccctgtgacaggcaagaccaagctggtgggagatgtggactttgaagctgtgaagaagaaggccggcttcatcacccctgtgcctggaggagtgggccccatgacagtggccatgctgctgaagaacaccctgctggccgccaagaagatcatctactag

SEQ ID NO: 159585 - DNA, 441 bp, Artificial Sequence
  Description of Artificial Sequence: Synthetic coding sequence
atggacccccgggtgtctggcatcctggtgcagctgcccctgcctgaccacgtggatgagaggaccatctgcaatggaattgcccctgagaaggatgtggatggcttccacatcatcaacatcggccgcctgtgcctggaccagcacagcctcatcccagccacagccagcgctgtgtgggagatcatcaagaggacaggcatccagaccttcggcaagaatgtggtggtggccggccgcagcaagaatgtgggcatgcccatcgccatgctgctgcacacagatggagagcacgagaggcctggaggagatgccaccgtgaccatcgcccaccgctacacccccaaggagcagctgaagatccacacccagctggccgacatcatcatcgtggccgctgagcgcttccaccactttgcccaggacctgagcaacagctag

SEQ ID NO: 159586 - DNA, 1257 bp, Artificial Sequence
  Description of Artificial Sequence: Synthetic coding sequence
atgcccatgctgctgccccacccccaccagcacttcctgaagggcctgctgcgggcccccttccgctgctaccacttcatcttccacagcagcacccacctgggcagcggcatcccctgtgcccagcccttcaacagcctgggcctgcactgcaccaagtggatgctgctgagtgatggcctgaagaggaagctgtgtgtgcagaccaccctgaaggaccacacagagggcctgagtgacaaggagcagagatttgtggacaagctgtacacaggcctcatccagggccagagggcctgcctggccgaggccatcaccctggtggagagcacccacagcaggaagaaggagctggcccaggtgctgctgcagaaggtgctgctgtaccaccgggagcaggagcagagcaacaagggcaagcccctggccttccgggtgggcctgagcggccccccaggggccggcaagagcaccttcatcgagtactttgggaagatgctgacagagcggggccacaagctgtctgtgctggccgtggaccccagcagctgcaccagcggcggcagcctgctgggggacaagaccaggatgacagagctgagccgggacatgaatgcctacatccggcccagccccacccggggcaccctgggcggcgtgaccaggaccaccaatgaggccatcctgctgtgtgagggcgccggctatgacatcatcctgattgaaacagtgggcgtgggccagagcgagtttgctgtggccgacatggtggacatgtttgtgctgctgctgcccccagctggaggagatgagctgcagggcatcaagaggggcatcatcgagatggctgacctggtggccgtgaccaagagtgatggagacctgattgtgcctgcccggcgcatccaggccgagtatgtgtctgccctgaagctgctgaggaagaggagccaggtgtggaagcccaaggtgatccgcatcagcgcccggtctggagagggcatcagcgagatgtgggacaagatgaaggacttccaggacctgatgctggccagcggggagctgacagccaagaggaggaagcagcagaaggtgtggatgtggaacctgatccaggagagcgtgctggagcacttccgcacccaccccaccgtgcgggagcagatccccctgctggagcagaaggtgctgattggagccctgagccctggcctggccgctgacttcctgctgaaggccttcaagagccgggactag

SEQ ID NO: 159587 - DNA, 1275 bp, Artificial Sequence
  Description of Artificial Sequence: Synthetic coding sequence
atgcccatgctgctgccccacccccaccagcacttcctgaagggcctgctgcgggcccccttccgctgctaccacttcatcttccacagcagcacccacctgggcagcggcatcccctgtgcccagcccttcaacagcctgggcctgcactgcaccaagtggatgctgctgagtgatggcctgaagaggaagctgtgtgtgcagaccaccctgaaggaccacacagagggcctgagtgacaaggagcagagatttgtggacaagctgtacacaggcctcatccagggccagagggcctgcctggccgaggccatcaccctggtggagagcacccacagcaggaagaaggagctggcccaggtgctgctgcagaaggtgctgctgtaccaccgggagcaggagcagagcaacaagggcaagcccctggccttccgggtgggcctgagcggccccccaggggccggcaagagcaccttcatcgagtactttgggaagatgctgacagagcggggccacaagctgtctgtgctggccgtggaccccagcagctgcaccagcggcggcagcctgctgggggacaagaccaggatgacagagctgagccgggacatgaatgcctacatccggcccagccccacccggggcaccctgggcggcgtgaccaggaccaccaatgaggccatcctgctgtgtgagggcgccggctatgacatcatcctgattgaaacagtgggcgtgggccagagcgagtttgctgtggccgacatggtggacatgtttgtgctgctgctgcccccagctggaggagatgagctgcagggcatcaagaggggcatcatcgagatggctgacctggtggccgtgaccaagagtgatggagacctgattgtgcctgcccggcgcatccaggccgagtatgtgtctgccctgaagctgctgaggaagaggagccaggtgtggaagcccaaggtgatccgcatcagcgcccggtctggagagggcatcagcgagatgtgggacaagatgaaggacttccaggacctgatgctggccagcggggagctgacagccaagaggaggaagcagcagaaggtgtggatgtggaacctgatccaggagagcgtgctggagcacttccgcacccaccccaccgtgcgggagcagatccccctgctggagcagaaggtgctgattggagccctgagccctggcctggccgctgacttcctgctgaaggccctgaaggccgagaccaacaagatccaccctgtgtag

SEQ ID NO: 159588 - DNA, 414 bp, Artificial Sequence
  Description of Artificial Sequence: Synthetic coding sequence
atggctgacctggtggccgtgaccaagagtgatggagacctgattgtgcctgcccggcgcatccaggccgagtatgtgtctgccctgaagctgctgaggaagaggagccaggtgtggaagcccaaggtgatccgcatcagcgcccggagcggggagggcatcagcgagatgtgggacaagatgaaggacttccaggacctgatgctggccagcggggagctgacagccaagaggaggaagcagcagaaggtgtggatgtggaacctgatccaggagagcgtgctggagcacttccgcacccaccccaccgtgcgggagcagatccccctgctggagcagaaggtgctgattggagccctgagccctggcctggccgctgacttcctgctgaaggccttcaagagccgggactag

SEQ ID NO: 159589 - DNA, 480 bp, Artificial Sequence
  Description of Artificial Sequence: Synthetic coding sequence
atggccggcctgaccaggtttgccctggagctggtgacagagaagggccacacctttgctgaggagctgcagaagatccagtgcaccctgcaggatgtgggcagcgccctggccaccccctgcagcagcgcccgggaggcccacctgaagtacaccaccttcaaggccggccccatcctggagctggagcagtggattgacaagtacaccagccagctgccccccctgacagccttcatcctgcccagcggcggcaagatcagcagcgccctgcacttctgcagagctgtgtgcagaagagctgagaggagagtggtgcccctggtgcagatgggagaaacagatgccaacgtggccaagttcctgaaccggctgagtgactacctgttcaccctggcccgctatgctgccatgaaggagggcaaccaggagaagatctacatgaagaatgaccccagcgctgagagcgagggcctgtag

SEQ ID NO: 159590 - DNA, 753 bp, Artificial Sequence
  Description of Artificial Sequence: Synthetic coding sequence
atggctgtgtgtggcctgggcagccggctgggcctgggcagccggctgggcctgcggggctgcttcggggccgcccggctgctgtacccccgcttccagagccggggcccccagggcgtggaggatggagaccggccccagcccagcagcaagaccccccgcatccccaagatctacaccaagacaggagacaagggcttcagcagcaccttcaccggggagcggcggcccaaggatgaccaggtgtttgaagctgtgggcaccacagatgagctgagcagcgccatcggctttgccctggagctggtgacagagaagggccacacctttgctgaggagctgcagaagatccagtgcaccctgcaggatgtgggcagcgccctggccaccccctgcagcagcgcccgggaggcccacctgaagtacaccaccttcaaggccggccccatcctggagctggagcagtggattgacaagtacaccagccagctgccccccctgacagccttcatcctgcccagcggcggcaagatcagcagcgccctgcacttctgcagagctgtgtgccggcgggcagagcggcgggtggtgcccctggtgcagatgggagaaacagatgccaacgtggccaagttcctgaaccggctgagtgactacctgttcaccctggcccgctatgctgccatgaaggagggcaaccaggagaagatctacatgaagaatgaccccagcgctgagagcgagggcctgtag

SEQ ID NO: 159591 - DNA, 849 bp, Artificial Sequence
  Description of Artificial Sequence: Synthetic coding sequence
atggagcccaaggtggccgagctgaagcagaagattgaggacaccctgtgcccctttggatttgaggtgtaccccttccaggtggcctggtacaatgagctgctgcccccagccttccacctgcccctgcccggccccaccctggccttcctggtgctgagcaccccagccatgtttgaccgggccctgaagcccttcctgcagagctgccacctgaggatgctgacagatcctgtggaccagtgtgtggcctaccacctgggccgggtgcgggagagcctgcctgagctgcagatcgagatcatcgctgactatgaggtgcaccccaacagaagacccaagatcctggcccagacagctgcccacgtggccggggccgcctactactaccagaggcaggatgtggaggccgacccctggggcaaccagaggatcagcggcgtgtgcatccaccccaggtttggaggctggtttgccatccggggcgtggtgctgctgcccggcatcgaggtgcctgacctgccccccaggaagccccatgactgtgtgcccaccagggctgaccgcatcgccctgctggagggcttcaacttccactggagggactggacctacagagatgctgtgaccccccaggagcgctacagcgaggagcagaaggcctacttcagcaccccaccagcccagaggctggccctgctgggcctggcccagcccagcgagaagcccagcagccccagcccagacctgcccttcaccaccccagcccccaagaagccaggcaaccccagccgggcccgctcctggctgagcccccgggtgagccccccagccagccctggcccctag

SEQ ID NO: 159592 - DNA, 891 bp, Artificial Sequence
  Description of Artificial Sequence: Synthetic coding sequence
atggccaacgtgctgtgcaacagagcccggctggtgtcctacctgcccggcttctgcagcctggtgaagagggtggtgaaccccaaggccttcagcacagctggcagcagcggcagtgatgagagccacgtggccgccgcccccccagacatctgcagcaggacagtgtggccagatgagaccatgggccccttcggcccccaggaccagcgcttccagctgcccggcaacatcggctttgactgccacctgaatggaacagccagccagaagaagagcctggtgcacaagaccctgcctgatgtgctggccgagcccctgagcagcgagagacatgaatttgtgatggcccagtatgtgaatgagttccagggcaatgatgcccctgtggagcaggagatcaacagcgctgagacctactttgaaagtgcccgggtggagtgtgccatccagacctgcccagagctgctgaggaaggactttgagagcctcttccctgaggtggccaacgggaagctgatgatcctgactgtgacccagaagaccaagaatgacatgacagtgtggagcgaggaggtggagattgagcgggaggtgctgctggagaagttcatcaacggggccaaggagatctgctacgccctgcgggcagagggctactgggccgacttcatcgaccccagcagcggcctggccttcttcggcccctacaccaacaacaccctgtttgaaacagatgagcgctaccgccacctgggcttctctgtggatgacctgggctgctgcaaggtgatccgccacagcctgtggggcacccacgtggtggtgggcagcatcttcaccaatgccaccccagacagccacatcatgaagaagctgagcggcaactag

SEQ ID NO: 159593 - DNA, 891 bp, Artificial Sequence; identical to SEQ ID NO: 159592
  Description of Artificial Sequence: Synthetic coding sequence

SEQ ID NO: 159594 - DNA, 531 bp, Artificial Sequence
  Description of Artificial Sequence: Synthetic coding sequence
atggcccgggtgctgaaggctgctgctgccaatgctgtgggcctcttcagccggctgcaggcccccatccccaccgtgcgggccagcagcaccagccagcccctggaccaggtgactggatctgtgtggaacctgggccgcctgaaccacgtggccatcgctgtgcctgacctggagaaggccgccgccttctacaagaacatcctgggcgcccaggtgtctgaggccgtgcccctgcctgagcacggcgtgtctgtggtgtttgtgaacctgggcaacaccaagatggagctgctgcaccccctgggccgggacagccccatcgccggcttcctgcagaagaacaaggccggcggcatgcaccacatctgcatcgaggtggacaacatcaatgctgctgtgatggacctgaagaagaagaagatccgcagcctgtctgaggaggtgaagattggagcccacggcaagcctgtgatcttcctgcaccccaaggactgtggcggcgtgctggtggagctggagcaggcctag

SEQ ID NO: 159595 - DNA, 2070 bp, Artificial Sequence
  Description of Artificial Sequence: Synthetic coding sequence
atgattgagatggctgctgagaaggagcccttcctggtgcctgcccctcctccacccctgaaggatgagagcggcggcggcggcggccccaccgtgcccccccaccaggaggccgccagcggggagctgcggggcggcacagagcggggccctggccgctgtgcccccagcgctggcagccctgctgctgctgtgggccgggagagccctggagctgctgccaccagcagcagcggcccccaggcccagcagcacagaggaggcggcccccaggcccagagccatggagaggcccggctgagtgaccccccaggccgggccgcccccccagatgtgggggaggagcggcggggcggcggcggcacagagctgggccccccagccccaccccggcccagaaatggctaccagccccacaggcctcctgggggcggcggcggcaagagaagaaacagctgcaatgtgggcggcggcggcggcggcttcaagcacccagccttcaagagaagaagaagagtgaacagcgactgtgacagcgtgctgcccagcaacttcctgctgggcggcaacatctttgaccccctgaacctgaacagcctgctggatgaggaggtgtccaggaccctgaatgctgagacccccaagagcagccccctgcctgccaagggccgggaccctgtggagatcctgatccccaaggacatcacagaccccctgagcctgaacacctgcacagatgagggccacgtggtgctggccagccccctgaagacaggcaggaagaggcaccgccaccggggccagcaccaccagcagcagcaggccgccggcggcagcgagagccaccctgtgcccccaacagcccccctgacccccctgctgcatggagagggcgccagccagcagcccaggcaccggggccagaacagagatgccccccagccctatgagctgaacacagccatcaactgcagagatgaggtggtgagccccctgcccagcgccctgcagggccccagcggcagcctgagcgcccccccagctgccagcgtcatcagcgccccacccagcagcagcagccgccacaggaagagaagaaggaccagcagcaagtctgaggccggggcccggggcggcggccagggcagcaaggagaagggccggggctcctggggcggccgccaccaccaccaccaccccctgcctgctgctggcttcaagaagcagcagaggaagttccagtatggcaactactgcaagtactacggctacagaaaccccagctgtgaagatggccgcctgcgggtgctgaagccagagtggttccggggcagagatgtgctggacctgggctgcaatgtgggccacctgaccctgagcatcgcctgcaagtggggccccagcaggatggtgggcctggacatcgacagccgcctcatccacagcgcccggcagaacatccgccactacctgtctgaggagctgcggctgcccccccagaccctggagggggaccccggggctgagggggaggagggcaccaccaccgtgaggaagaggagctgcttccctgccagcctgacagccagccggggccccatcgccgccccccaggtgcccctggatggagctgacacctctgtgttccccaacaacgtggtgtttgtgactggaaactacgtgctggacagagatgacctggtggaggcccagaccccagaatatgatgtggtgctgtgcctgagcctgaccaagtgggtgcacctgaactggggagatgagggcctgaagaggatgttccgccgcatctaccgccacctgcggcctgggggcatcctggtgctggagccccagccctggagcagctatggcaagaggaagaccctgacagagaccatctacaagaactactaccgcatccagctgaagccagagcagttcagcagctacctgaccagcccagatgtgggcttcagcagctatgagctggtggccaccccccacaacaccagcaagggcttccagaggcctgtgtacctgttccacaaggcccggagccccagccactag

SEQ ID NO: 159596 - DNA, 663 bp, Artificial Sequence
  Description of Artificial Sequence: Synthetic coding sequence
atggtgggcctggacatcgacagccgcctcatccacagcgcccggcagaacatccgccactacctgtctgaggagctgcggctgcccccccagaccctggagggggaccctggagctgagggggaggagggcaccaccaccgtgaggaagaggagctgcttccctgccagcctgacagccagccggggccccatcgccgccccccaggtgcccctggatggagctgacaccagcgtcttccccaacaacgtggtgtttgtgacaggcaactacgtgctggacagagatgacctggtggaggcccagaccccagaatatgatgtggtgctgtgcctgagcctgaccaagtgggtgcacctgaactggggagatgagggcctgaagaggatgttccgccgcatctaccgccacctgcggcctgggggcatcctggtgctggagccccagccctggagcagctatggcaagaggaagaccctgacagagaccatctacaagaactactaccgcatccagctgaagccagagcagttcagcagctacctgaccagcccagatgtgggcttcagcagctatgagctggtggccaccccccacaacaccagcaagggcttccagaggcctgtgtacctgttccacaaggcccggagccccagccactag

SEQ ID NO: 159597 - DNA, 852 bp, Artificial Sequence
  Description of Artificial Sequence: Synthetic coding sequence
atggccagcggcaccaccaccacagctgtgaagattggcatcattggaggcaccggcctggatgatcctgagatcctggagggccgcacagagaagtatgtggacaccccatttgggaagcccagtgatgccctgatcctgggcaagatcaagaatgtggactgtgtgctgctggcccggcacggccggcagcacaccatcatgcccagcaaggtgaactaccaggccaacatctgggccctgaaggaggagggctgcacccacgtgattgtgaccacagcctgtggcagcctgcgggaggagatccagcccggggacatcgtcatcatcgaccagttcatcgacaggaccaccatgaggccccagagcttctatgatggcagccacagctgtgcccggggcgtgtgccacatccccatggccgagcccttctgccccaagacccgggaggtgctgattgaaacagccaagaagctgggcctgcgctgccacagcaagggcaccatggtgaccatcgagggcccccgcttcagcagcagagctgagagcttcatgttccgcacctggggcgcagatgtgatcaacatgaccaccgtgcctgaggtggtgctggccaaggaggccggcatctgctacgccagcatcgccatggccacagattatgactgctggaaggagcacgaggaggccgtgtctgtggacagagtgctgaagaccctgaaggaaaatgccaacaaggccaagagcctgctgctgaccaccatcccccagatcggcagcacagagtggagcgagaccctgcacaacctgaagaacatggcccagttctctgtgctgctgcccaggcactag

SEQ ID NO: 159598 - DNA, 468 bp, Artificial Sequence
  Description of Artificial Sequence: Synthetic coding sequence
atggctgctgagaccagaaatgtggccggggctgaggcccccccaccccagaagcgctactaccggcagagggcccacagcaaccccatggctgaccacaccctgcgctaccctgtgaagccagaggagatggactggagcgagctgtacccagagttctttgcccccctgacccagaaccagagccatgatgaccccaaggacaagaaggagaagagggcccaggcccaggtggagtttgctgacatcggctgcggctatggaggcctgctggccgacaaggatgtgctgcccctgccccggcccaccttccaggccgacaaggcccaggtggccaaccaccagagccacccagccagccgcatctgcctgcgggccaagtcctggggcgccggcgtgtaccacaacagatgtgccggggccacccggctggatgtgcacagcttccggcgggcccccaccgtgtag

SEQ ID NO: 159599 - DNA, 831 bp, Artificial Sequence
  Description of Artificial Sequence: Synthetic coding sequence
atggctgctgagaccagaaatgtggccggggctgaggcccccccaccccagaagcgctactaccggcagagggcccacagcaaccccatggctgaccacaccctgcgctaccctgtgaagccagaggagatggactggagcgagctgtacccagagttctttgcccccctgacccagaaccagagccatgatgaccccaaggacaagaaggagaagagggcccaggcccaggtggagtttgctgacatcggctgcggctatggaggcctgctggtggagctgagccccctcttcccagacaccctcatcctgggcctggagatccgggtgaaggtgtctgactatgtgcaggaccgcatccgggccctgcgggccgccccagctgggggcttccagaacatcgcctgcctgcggagcaatgccatgaagcacctgcccaacttcttctacaagggccagctgaccaagatgttcttcctgttcccagacccccacttcaagaggaccaagcacaagtggaggatcatcagccccaccctgctggccgagtatgcctacgtgctgcgggtgggcggcctggtgtacaccatcacagatgtgctggagctgcatgactggatgtgcacccactttgaggagcaccccctgtttgagcgggtgcccctggaggacctgtctgaagatcctgtggtgggccacctgggcaccagcacagaggagggcaagaaggtgctgagaaatggaggcaagaacttccctgccatcttccgccgcatccaggaccctgtgctgcaggccgtgaccagccagaccagcctgcccggccactag

SEQ ID NO: 159600 - DNA, 2274 bp, Artificial Sequence
  Description of Artificial Sequence: Synthetic coding sequence
atggccgaggtgggccgcacaggcatctcctacccaggggccctgctgccccagggcttctgggccgctgtggaggtgtggctggagcggccccaggtggccaacaagaggctgtgtggggcccggctggaggcccgctggagcgctgccctgccctgtgccgaggcccggggccctggcaccagcgctggcagcgagcagaaggagcggggccctggccctggccagggcagccctgggggcggccctggccccaggagcctgagcggccctgagcagggcacagcctgctgtgagctggaggaggcccagggccagtgccagcaggaggaggcccagcgggaggccgcctctgtgcccctgcgggacagcggccaccctggccacgccgagggccgggagggggacttccctgctgctgacctggacagcctgtgggaggacttcagccagagcctggcccggggcaacagcgagctgctggccttcctgaccagcagtggagctggcagccagcctgaggcccagcgggagctggatgtggtgctgaggacagtcatccccaagaccagcccccactgccccctgaccaccccccggcgggagatcgtggtgcaggatgtgctgaatggcaccatcaccttcctgcccctggaggaggatgatgagggcaacctgaaggtgaagatgagcaatgtgtaccagatccagctgagccacagcaaggaggagtggttcatctctgtgctgatcttctgcccagagcgctggcacagtgatggcatcgtgtaccccaagcccacctggctgggggaggagctgctggccaagctggccaagtggagcgtggagaacaagaagagtgacttcaagagcaccctgagcctcatcagcatcatgaagtacagcaaggcctaccaggagctgaaggagaagtacaaggagatggtgaaggtgtggccagaggtgacagatcctgagaagtttgtgtatgaagatgtggccatcgccgcctacctgctgatcctgtgggaggaggagagagctgagcggcggctgacagcccggcagagctttgtggacctgggctgtggaaatggcctgctggtgcacatcctgagcagcgagggccaccctggccggggcattgatgtgagaagaaggaagatctgggacatgtatggcccccagacccagctggaggaggatgccatcaccccaaatgacaagaccctcttcccagatgtggactggctgattggcaaccacagtgatgagctgaccccctggatccctgtgattgctgcccggagcagctacaactgccgcttctttgtgctgccctgctgcttctttgacttcatcggccgctacagccggcggcagagcaagaagacccagtaccgggagtacctggacttcatcaaggaggtgggcttcacctgtggcttccacgtggatgaggactgcctgcgcatccccagcaccaagagggtgtgcctggtgggcaagagcaggacctaccccagcagccgggaggcctctgtggatgagaagaggacccagtacatcaagagcagaagaggctgccctgtgagccccccaggctgggagctgagccccagcccccgctgggtggccgccggcagcgctggccactgtgatggccagcaggccctggatgcccgggtgggctgtgtgacccgggcctgggccgctgagcacggggccggcccccaggccgagggcccctggctgcccggcttccacccccgggagaaggccgagcgggtgaggaactgtgccgccctgccccgggacttcatcgaccaggtggtgctgcaggtggccaacctgctgctgggcggcaagcagctgaacaccaggagcagcagaaatggcagcctgaagacctggaatggaggagagagcctgagcctggccgaggtggccaatgagctggacacagagaccctgcggcggctgaagagagaatgtggcggcctgcagaccctgctgaggaacagccaccaggtgttccaggtggtgaatggccgggtgcacatccgggactggagggaggagaccctgtggaagaccaagcagcctgaggccaagcagaggctgctgtctgaggcctgcaagacccggctgtgctggttcttcatgcaccacccagatggctgtgccctgagcacagactgctgcccctttgcccacggccctgctgagctgcggccccccaggaccacccccaggaagaagatctcctag

SEQ ID NO: 159601 - DNA, 1236 bp, Artificial Sequence
  Description of Artificial Sequence: Synthetic coding sequence
atgtgcatcaagttcagctctgtgattgccaagaagaatgaacgctggcacagtgatggcatcgtgtaccccaagcccacctggctgggggaggagctgctggccaagctggccaagtggagcgtggagaacaagaagagtgacttcaagagcaccctgagcctcatcagcatcatgaagtacagcaaggcctaccaggagctgaaggagaagtacaaggagatggtgaaggtgtggccagaggtgacagatcctgagaagtttgtgtatgaagatgtggccatcgccgcctacctgctgatcctgtgggaggaggagcgggcagagcggcggctgacagcccggcagagctttgtggacctgggctgtggaaatggcctgctggtgcacatcctgagcagcgagggccaccctggccggggcattgatgtgagaagaaggaagatctgggacatgtatggcccccagacccagctggaggaggatgccatcaccccaaatgacaagaccctcttcccagatgtggactggctgattggcaaccacagtgatgagctgaccccctggatccctgtgattgctgcccggagcagctacaactgccgcttctttgtgctgccctgctgcttctttgacttcatcggccgctacagccggcggcagagcaagaagacccagtaccgggagtacctggacttcatcaaggaggtgggcttcacctgtggcttccacgtggatgaggactgcctgcgcatccccagcaccaagagggtgtgcctggtgggcaagagcaggacctaccccagcagccgggaggcctctgtggatgagaagaggacccagtacatcaagagccggcggggctgccctgtgtccccacctggctgggagctgagccccagcccccgctgggtggccgccggcagcgctggccactgtgatggccagcaggccctggatgcccgggtgggctgtgtgacccgggcctgggccgctgagcacggggccggcccccaggccgagggcccctggctgcccggcttccacccccgggagaaggccgagcgggtgaggaactgtgccgccctgccccgggacttcatcgaccaggtggtgctgcaggtggccaacctgctgctgggcggcaagcagctgaacaccaggagcagcagaaatggcagcctgaagacctggaatggaggcggcaagctgagcaccatcctgggccggggctag

SEQ ID NO: 159602 - DNA, 1743 bp, Artificial Sequence
  Description of Artificial Sequence: Synthetic coding sequence
atgtctgacacctggagcagcatccaggcccacaagaagcagctggacagcctgcgggagcggctgcagaggaggaggaagcaggacagcggccacctggacctgaggaaccctgaggccgccctgagccccaccttcagaagtgacagccctgtgcccacagcccccaccagcggcggccccaagcccagcacagccagcgctgtgcctgagctggccacagatcctgagctggagaagaagctgctgcaccacctgagtgacctggccctgaccctgcccacagatgctgtgtccatctgcctggccatcagcaccccagatgccccagccacccaggatggagtggagagcctgctgcagaagtttgctgcccaggagctgattgaggtgaagaggggcctgctgcaggatgatgcccaccccaccctggtgacctacgccgaccacagcaagctgagcgccatgatgggcgctgtggccgagaagaagggccctggagaggtggccggcaccgtgacaggccagaagagaagagctgagcaggacagcaccaccgtggccgcctttgccagcagcctggtgtctggcctgaacagcagcgccagcgagcccgccaaggagcccgccaagaagagcaggaagcatgctgccagtgatgtggacctggagattgagagcctgctgaaccagcagagcaccaaggagcagcagagcaagaaggtgtcccaggagatcctggagctgctgaacaccaccacagccaaggagcagagcatcgtggagaagttccgcagccggggccgggcccaggtgcaggagttctgtgactatggcaccaaggaggagtgcatgaaggccagtgatgctgaccggccctgcaggaagctgcacttccgccgcatcatcaacaagcacacagatgagagcctgggggactgcagcttcctgaacacctgcttccacatggacacctgcaagtatgtgcactatgaaattgatgcctgcatggattctgaggcccctggcagcaaggaccacacccccagccaggagctggccctgacccagagcgtgggcggggacagcagcgctgacaggctcttccccccccagtggatctgctgtgacatccgctacctggatgtgtccatcctgggcaagtttgctgtggtgatggctgaccccccctgggacatccacatggagctgccctacggcaccctgacagatgatgagatgaggcggctgaacatccctgtgctgcaggatgatggcttcctgttcctgtgggtgacaggccgggccatggagctgggccgggagtgcctgaacctgtggggctatgagcgggtggatgagatcatctgggtgaagaccaaccagctgcagaggatcatcagaactggaagaacaggccactggctgaaccacggcaaggagcactgcctggtgggcgtgaagggcaacccccagggcttcaaccagggcctggactgtgatgtgattgtggccgaggtgcgcagcaccagccacaagccagatgagatctacggcatgattgagcggctgagccctggcaccaggaagattgagctgtttggccggccccacaacgtgcagcccaactggatcaccctgggcaaccagctggatggcatccacctgctggaccctgatgtggtggcccgcttcaagcagcgctacccagatggcatcatcagcaagcccaagaacctgtag

SEQ ID NO: 159603 - DNA, 492 bp, Artificial Sequence
  Description of Artificial Sequence: Synthetic coding sequence
atgtctgacacctggagcagcatccaggcccacaagaagcagctggacagcctgcgggagcggctgcagaggaggaggaagcaggacagcggccacctggacctgaggaaccctgaggccgccctgagccccaccttcagaagtgacagccctgtgcccacagcccccaccagcggcggccccaagcccagcacagccagcgctgtgcctgagctggccacagatcctgagctggagaagaagctgctgcaccacctgagtgacctggccctgaccctgcccacagatgctgtgtccatctgcctggccatcagcaccccagatgccccagccacccaggatggagtggagagcctgctgcagaagtttgctgcccaggagctgattgaggtgaagaggggcctgctgcaggatgatgcccaccccaccctggtgacctacgccgaccacagcaagctgagcgccatgatgggcgctgtggccgagaagtag

SEQ ID NO: 159604 - DNA, 462 bp, Artificial Sequence
  Description of Artificial Sequence: Synthetic coding sequence
atgtctgacacctggagcagcatccaggcccacaagaagcagctggacagcctgcgggagcggctgcagaggaggaggaagcaggacagcggccacctggacctgaggaaccctgaggccgccctgagccccaccttcagaagtgacagccctgtgcccacagcccccaccagcggcggccccaagcccagcacagccagcgctgtgcctgagctggccacagatcctgagctggagaagaagctgctgcaccacctgagtgacctggccctgaccctgcccacagatgctgtgtccatctgcctggccatcagcaccccagatgccccagccacccaggatggagtggagagcctgctgcagaagtttgctgcccaggagctgattgagcacaggaaccagcagaggagccagcccaggaaccagggcaacatgctgccccagatgctgatctggaggtag

SEQ ID NO: 159605 - DNA, 879 bp, Artificial Sequence
  Description of Artificial Sequence: Synthetic coding sequence
atgctgggcgcctgggccgtggagggcacagctgtggccctgctgcggctgctgctgctgctgctgcccccagccatccggggccctggcctgggcgtggccggcgtggccggggccgccggggccggcctgcctgagagcgtcatctgggccgtgaatgctggaggagaggcccacgtggatgtgcacggcatccacttcaggaaggaccccctggagggccgggtgggccgggccagtgactatggcatgaagctgcccatcctgcggagcaaccctgaggaccagatcctgtaccagacagagcgctacaatgaggagaccttcggctatgaggtgcccatcaaggaggagggggactatgtgctggtgctgaagtttgctgaggtgtactttgcccagagccagcagaaggtgtttgatgtgcggctgaatggacatgtggtggtgaaggacctggacatctttgacagagtgggccacagcacagcccatgatgagatcatccccatgagcatcaggaagggcaagctgtctgtgcagggcgaggtgtccaccttcaccgggaagctgtacattgaatttgtgaagggctactatgacaaccccaaggtgtgtgccctgtacatcatggccggcaccgtggatgatgtgcccaagctgcagccccaccctggcctggagaagaaggaggaggaggaggaggaggaggagtatgatgagggcagcaacctgaagaagcagaccaacaagaacagagtgcagagcggccccaggacccccaacccctatgccagtgacaacagcagcctgatgttccccatcctggtggcctttggagtcttcatccccaccctcttctgcctgtgccgcctgtag

SEQ ID NO: 159606 - DNA, 1035 bp, Artificial Sequence
  Description of Artificial Sequence: Synthetic coding sequence
atgctgtctgaggtgctgctggtgtctgcccctgggaaggtgatcctgcatggagagcacgctgtggtgcacggcaaggtggccctggccgtgtccctgaacctgcggaccttcctgcggctgcagccccacagcaatggcaaggtggacctgagcctgcccaacatcggcatcaagagggcctgggatgtggcccggctgcagagcctggacaccagcttcctggagcagggagatgtgaccacccccaccagcgagcaggtggagaagctgaaggaggtggccggcctgcctgatgactgtgctgtgacagagcggctggccgtgctggccttcctgtacctgtacctgagcatctgcaggaagcagcgctggaccaaggaggacctggagctgatcaacaagtgggccttccagggcgagaggatgattcatggcaaccccagcggcgtggacaatgctgtgtccacctggggcggggccctgcgctaccaccagggcaagatcagcagcctgaagaggagccctgccctgcagatcctgctgaccaacaccaaggtgcccaggaacacccgggccctggtggccggcgtgaggaaccggctgctgaagtttcctgagatcgtggcccccctgctgaccagcattgatgccatcagcctggagtgtgagcgggtgctgggggagatgggagaggccccagcccctgagcagtacctggtgctggaggagctgattgacatgaaccagcaccacctgaatgccctgggcgtgggccacgccagcctggaccagctgtgccaggtgacccgggcccggggcctgcacagcaagctgaccggggccggcggcggcggctgcggcatcaccctgctgaagccaggcctggagcagcctgaggtggaggccaccaagcaggccctgaccagctgtggctttgactgcctggagaccagcatcggggcccctggggtgtccatccacagcgccaccagcctggacagccgggtgcagcaggccctggatggcctgtag

SEQ ID NO: 159607 - DNA, 516 bp, Artificial Sequence
  Description of Artificial Sequence: Synthetic coding sequence
atgctgtctgaggtgctgctggtgtctgcccctgggaaggtgatcctgcatggagagcacgctgtggtgcacggcaaggtggccctggccgtgtccctgaacctgcggaccttcctgcggctgcagccccacagcaatggcaaggtggacctgagcctgcccaacatcggcatcaagagggcctgggatgtggcccggctgcagagcctggacaccagcttcctggagcagggagatgtgaccacccccaccagcgagcaggtggagaagctgaaggaggtggccggcctgcctgatgactgtgctgtgacagagcggctggccgtgctggccttcctgtacctgtacctgagcatctgcaggaagcagagggccctgcccagcctggacatcgtggtgtggagcgagctgcccccaggagctggcctgggcagcagcgctgcctacagcgtgtgcctggccgccgccctgctgactgtgtgtgaggagatccccaaccccctgaaggatggatag

SEQ ID NO: 159608 - DNA, 1035 bp, Artificial Sequence; identical to SEQ ID NO: 159606
  Description of Artificial Sequence: Synthetic coding sequence

SEQ ID NO: 159609 - DNA, 609 bp, Artificial Sequence
  Description of Artificial Sequence: Synthetic coding sequence
atgattcatggcaaccccagcggcgtggacaatgctgtgtccacctggggcggggccctgcgctaccaccagggcaagatcagcagcctgaagaggagccctgccctgcagatcctgctgaccaacaccaaggtgcccaggaacacccgggccctggtggccggcgtgaggaaccggctgctgaagtttcctgagatcgtggcccccctgctgaccagcattgatgccatcagcctggagtgtgagcgggtgctgggggagatgggagaggccccagcccctgagcagtacctggtgctggaggagctgattgacatgaaccagcaccacctgaatgccctgggcgtgggccacgccagcctggaccagctgtgccaggtgacccgggcccggggcctgcacagcaagctgaccggggccggcggcggcggctgcggcatcaccctgctgaagccaggcctggagcagcctgaggtggaggccaccaagcaggccctgaccagctgtggctttgactgcctggagaccagcatcggggcccctggggtgtccatccacagcgccaccagcctggacagccgggtgcagcaggccctggatggcctgtag

SEQ ID NO: 159610 - DNA, 606 bp, Artificial Sequence
  Description of Artificial Sequence: Synthetic coding sequence
atgctgtctgaggtgctgctggtgtctgcccctgggaaggtgatcctgcatggagagcacgctgtggtgcacggcaaggtggccctggccgtgtccctgaacctgcggaccttcctgcggctgcagccccacagcaatggcaaggtggacctgagcctgcccaacatcggcatcaagagggcctgggatgtggcccggctgcagagcctggacaccagcttcctggagcagggagatgtgaccacccccaccagcgagcaggtggagaagctgaaggaggtggccggcctgcctgatgactgtgctgtgacagagcggctggccgtgctggccttcctgtacctgtacctgagcatctgcaggaagcagagggccctgcccagcctggacatcgtggtgtggagcgagctgcccccaggagctggcctgggcagcagcgctgcctacagcgtgtgcctggccgccgccctgctgactgtgtgtgaggagatccccaaccccctgaaggatggagactgtgtgaaccgctggaccaaggaggacctggagctgatcaacaagtgggccttccagggcgagaggatgattcatggcaaccccagctag

SEQ ID NO: 159611 - DNA, 1563 bp, Artificial Sequence
  Description of Artificial Sequence: Synthetic coding sequence
atgcccagcctggtggtgtctggcatcatggagagaaatggaggctttggagagctgggctgcttcggcggcagcgccaaggaccggggcctgctggaggatgagcgggccctgcagctggccctggaccagctgtgcctgctgggcctgggggagcccccagcccccacagctggggaggatggcggcggcggcggcggcggggccccagcccagcctgctgccccaccccagcctgcccctcctcctcctcctgctgcccccccagctgcccccacagctgccccagctgcccagaccccccagcccccaacagcccccaagggggccagtgatgccaagctgtgtgccctgtacaaggaggccgagctgcggctgaagggcagcagcaacaccacagaatgtgtgcctgtgcccaccagcgagcacgtggccgagatcgtgggccggcagggctgcaagatcaaggccctgcgggccaagaccaacacctacatcaagacccctgtgcggggggaggagcctgtgttcatggtgacaggccggcgggaggatgtggccacagcccggcgggagatcatctctgctgctgagcacttctccatgatccgggccagcaggaacaagagcggggccgccttcggcgtggccccagccctgcccggccaggtgaccatccgggtgcgggtgccctacagagtggtgggcctggtggtgggccccaagggggccaccatcaagaggatccagcagcagaccaacacctacatcatcacccccagccgggaccgggaccctgtgtttgagatcactggagcccctggaaatgtggagcgggcccgggaggagattgagacccacatcgctgtgaggacaggcaagatcctggagtacaacaatgaaaatgacttcctggccggcagcccagatgctgccatcgacagccgctacagtgatgcctggagggtgcaccagcccggctgcaagcccctgagcaccttccggcagaacagcctgggctgcatcggggagtgtggggtggacagcggctttgaggccccccggctgggggagcagggcggggactttggctatggaggctacctgtttcctggctatggagtgggcaagcaggatgtgtactacggcgtggccgagaccagcccccccctgtgggccggccaggagaatgccacccccacctctgtgctcttcagcagcgccagcagcagcagcagcagcagcgccaaggcccgggccggccccccaggggcccacaggagccctgccaccagcgctggccctgagctggccggcctgccccggcggcccccaggagagcccctgcagggcttcagcaagctgggcggcggcggcctgcggagccctgggggcggccgggactgcatggtgtgctttgaaagtgaggtgacagctgccctggtgccctgtggccacaacctcttctgcatggagtgtgctgtgcgcatctgtgagaggacagatcctgagtgccctgtgtgccacatcacagccacccaggccatccgcatcttctcctag

SEQ ID NO: 159612 - DNA, 1710 bp, Artificial Sequence
  Description of Artificial Sequence: Synthetic coding sequence
atgcccagcagcctgtttgctgacctggagagaaatggcagcggcggcggcggcggcggcagcagcggcggcggggagaccctggatgaccagagggccctgcagctggccctggaccagctgagcctgctgggcctggacagtgatgaaggagccagcctgtatgattctgagcccaggaagaagtctgtgaacatgacagaatgtgtgcctgtgcccagcagcgagcacgtggccgagatcgtgggccggcagggctgcaagatcaaggccctgcgggccaagaccaacacctacatcaagacccctgtgcggggggaggagcctgtgtttgtggtgacaggcaggaaggaggatgtggccatggcccggcgggagatcatctctgctgctgagcacttctccatgatccgggccagcaggaacaagaacacagccctgaatggagctgtgcccggcccccccaacctgcccggccagaccaccatccaggtgcgggtgccctacagagtggtgggcctggtggtgggccccaagggggccaccatcaagaggatccagcagcagacccacacctacatcgtgacccccagccgggacaaggagcctgtgtttgaggtgacaggcatgccagaaaatgtggaccgggcccgggaggagattgaggcccacatcgccctgaggactggaggcatcatcgagctgacagatgaaaatgacttccacgccaacggcacagatgtgggctttgacctgcaccacggcagcggcggcagcggccctggcagcctgtggagcaagcccacccccagcatcacccccaccccaggcaggaagcccttcagcagctacagaaatgacagcagcagcagcctgggcagcgccagcacagacagctactttggaggcggcaccagcagcagcgctgctgccacccagaggctggccgactacagcccccccagccctgccctgagctttgcccacaacggcaacaacaacaacaatggaaatggctacacctacacagctggaggagaggcctctgtgcccagcccagatggctgcccagagctgcagcccacctttgatcctgccccagcccctcctcctggggcccccctcatctgggcccagtttgagaggagccctgggggcggccctgctgcccctgtgagcagcagctgcagcagcagcgccagcagcagcgccagcagcagctctgtggtgtttcctgggggcggggccagcgcccccagcaatgccaacctgggcctgctggtgcaccggcggctgcaccctggcaccagctgcccccggctgagcccccccctgcacatggcccctggagctggggagcaccacctggcccggcgggtgcggagtgaccccggcggcggcggcctggcctatgctgcctatgccaacggcctgggcgcccagctgcccggcctgcagcccagcgacaccagcggcagcagcagcagcagcagcagcagcagcagcagcagcagcagcagcagcggcctgcggaggaagggcagccgggactgcagcgtgtgctttgagagcgaggtgattgctgccctggtgccctgtggccacaacctcttctgcatggagtgtgccaaccgcatctgtgagaagtctgagccagaatgtcctgtgtgccacacagctgtgacccaggccatccgcatcttctcctag

SEQ ID NO: 159613 - DNA, 1980 bp, Artificial Sequence
  Description of Artificial Sequence: Synthetic coding sequence
atgcccagcggcagcagcgctgccctggccctggccgccgccccagcccccctgccccagcccccacctcctcctcctcctcctcctccacccctgcccccacccagcggcggccctgagctggagggagatggcctgctgctgcgggagcggctggccgccctgggcctggatgaccccagccctgctgagcccggggccccagccctgcgggccccagctgctgctgcccagggccaggcccggcgggctgctgagctgagccctgaggagcgggcccctcctggccggcctggggcccctgaggccgctgagctggagctggaggaggatgaggaggagggggaggaggccgagctggatggagacctgctggaggaggaggagctggaggaggccgaggaggaggacaggagcagcctgctgctgctgagccccccagctgccacagccagccagacccagcagatccctgggggcagcctgggctctgtgctgctgcctgctgccaggtttgatgcccgggaggccgctgctgctgctgctgctgctggggtgctgtatggaggagatgatgcccagggcatgatggccgccatgctgagccacgcctacggccctgggggctgtggggctgctgctgctgccctgaatggagagcaggccgccctgctgcggaggaagtctgtgaacaccacagaatgtgtgcctgtgcccagcagcgagcacgtggccgagatcgtgggccggcagggctgcaagatcaaggccctgcgggccaagaccaacacctacatcaagacccctgtgcggggggaggagcccatctttgtggtgacaggcaggaaggaggatgtggccatggccaagcgggagatcctgtctgctgctgagcacttctccatgatccgggccagcaggaacaagaatggacctgccctgggcggcctgagctgcagccccaacctgcccggccagaccaccgtgcaggtgcgggtgccctacagagtggtgggcctggtggtgggccccaagggggccaccatcaagaggatccagcagcagacccacacctacatcgtgacccccagccgggacaaggagcctgtgtttgaggtgacaggcatgccagaaaatgtggaccgggcccgggaggagattgagatgcacatcgccatgaggactggaaactacatcgagctgaatgaggagaatgacttccactacaacggcacagatgtgtcctttgagggcggcaccctgggcagcgcctggctgagcagcaaccctgtgccccccagccgggccaggatgatcagcaactacagaaatgacagcagcagcagcctgggcagcggcagcacagacagctacttcggcagcaaccggctggccgacttcagccccaccagccccttcagcactggaaacttctggtttggagacaccctgcccagcgtgggcagcgaggacctggccgtggacagccctgcctttgacagcctgcccaccagcgcccagaccatctggaccccatttgagcctgtgaaccccctgagcggcttcggcagtgaccccagcggcaacatgaagacccagaggcggggcagccagcccagcaccccccggctgagccccaccttccctgagagcattgagcaccccctggcccggcgggtgcggagtgacccccccagcactggaaaccacgtgggcctgcccatctacatcccagccttcagcaatggcaccaacagctacagcagcagcaatggaggcagcaccagcagcagccccccagagagcaggaggaagcatgactgtgtgatctgctttgaaaatgaggtgattgctgccctggtgccctgtggccacaacctcttctgcatggagtgtgccaacaagatctgtgagaagaggacccccagctgccctgtgtgccagacagctgtgacccaggccatccagatccacagctag

SEQ ID NO: 159614 - DNA, 498 bp, Artificial Sequence
  Description of Artificial Sequence: Synthetic coding sequence
tggcgctggaccagctgcagaagaagtggctggggcgccctggccaccaggacccggcggggccggcccggcaccccacctccaccccggcccagccccccagatgtgtttgctggctttgccccccaccctgctgccctgggcccccccaccctgctggccgaccagatgtctgtcatcggcagcaggaagaagtctgtgaacatgacagaatgtgtgcctgtgcccagcagcgagcacgtggccgagatcgtgggccggcagggctgcaagatcaaggccctgcgggccaagaccaacacctacatcaagacccctgtgcggggggaggagcccgtcttcatcgtgactggaagaaaagaagatgtggagatggccaagcgggagatcctgtctgctgctgagcacttcagcatcatccgggccaccaggagcaaggccggcggcctgcctggagctgcccagggcccccccaacctgcccggccagaccacctag

SEQ ID NO: 159615 - DNA, 2001 bp, Artificial Sequence
  Description of Artificial Sequence: Synthetic coding sequence
atgcccagcagcctgggccagccagatggcggcggcggcggcggcggcggcggcggcggcgtgggcgccgccggggaggaccccggccctggccctgcccctcctcctgagggcgcccaggaggccgccccagccccccggcccccacctgagccagatgatgctgctgctgccctgcggctggccctggaccagctgagcgccctgggcctgggcggggccggggacacagatgaggagggcgctgctggagatggagctgctgctgctgggggcgcagatggaggagctgcccctgagcctgtgcccccagatggccctgaggccggggccccacccaccctggccccagctgtggcccctggcagcctgcccctgctggaccccaatgccagccccccacctcctcctccaccccggcccagccccccagatgtgtttgctggctttgccccccaccctgctgccctgggcccccccaccctgctggccgaccagatgtctgtcatcggcagcaggaagaagtctgtgaacatgacagaatgtgtgcctgtgcccagcagcgagcacgtggccgagatcgtgggccggcagggctgcaagatcaaggccctgcgggccaagaccaacacctacatcaagacccctgtgcggggggaggagcccgtcttcatcgtgactggaagaaaagaagatgtggagatggccaagcgggagatcctgtctgctgctgagcacttcagcatcatccgggccaccaggagcaaggccggcggcctgcctggagctgcccagggcccccccaacctgcccggccagaccaccatccaggtgcgggtgccctacagagtggtgggcctggtggtgggccccaagggggccaccatcaagaggatccagcagaggacccacacctacatcgtgaccccaggccgggacaaggagcctgtgtttgctgtgacaggcatgccagaaaatgtggaccgggcccgggaggagattgaggcccacatcaccctgaggactggagccttcacagatgctggccctgacagcgacttccacgccaatggaacagatgtgtgcctggacctgctgggcgctgctgccagcctgtgggccaagacccccaaccagggcagaagaccacccacagccacagctggcctgcggggggacacagccctgggcgcccccagcgcccctgaggccttctacgccggcagcagaggaggccccagcgtgcctgaccccggccctgccagcccctacagcggcagcggaaatggaggctttgccttcggggctgagggccctggggcccctgtgggcacagctgccccagatgactgtgactttggatttgattttgacttcctggccctggacctgactgtgcctgctgctgccaccatctgggccccctttgaaagagctgcccccctgcctgccttcagcggctgcagcacagtgaatggagcccctggccccccagctgctggggcccggcgcagcagcggggccggcacccccaggcacagccccaccctgcctgagcccggcggcctgcggctggagctgcccctgagcagaagaggagccccagaccctgtgggcgccctgtcctggaggcctccccagggccctgtgtccttccctggaggagctgccttcagcacagccaccagcctgcccagcagccctgctgctgctgcctgtgcccccctggacagcggggccagcgagaacagcaggaagcccccatctgccagcagcgccccagccctggccagagaatgtgtggtgtgtgccgagggggaggtgatggccgccctggtgccctgtggccacaacctcttctgcatggactgtgctgtgcgcatctgtgggaagtctgagccagaatgtcctgcctgcaggaccccagccacccaggccatccgggtggagacagagaccccccagcccggcggggccagcgccctgcagaggcagtactag

SEQ ID NO: 159616 - DNA, 1956 bp, Artificial Sequence
  Description of Artificial Sequence: Synthetic coding sequence
atgcccagcagcctgggccagccagatggcggcggcggcggcggcggcggcggcggcggcgtgggcgccgccggggaggaccccggccctggccctgcccctcctcctgagggcgcccaggaggccgccccagccccccggcccccacctgagccagatgatgctgctgctgccctgcggctggccctggaccagctgagcgccctgggcctgggcggggccggggacacagatgaggagggcgctgctggagatggagctgctgctgctgggggcgcagatggaggagctgcccctgagcctgtgcccccagatggccctgaggccggggccccacccaccctggccccagctgtggcccctggcagcctgcccctgctggaccccaatgccagccccccacctcctcctccaccccggcccagccccccagatgtgtttgctggctttgccccccaccctgctgccctgggcccccccaccctgctggccgaccagatgtctgtcatcggcagcaggaagaagtctgtgaacatgacagaatgtgtgcctgtgcccagcagcgagcacgtggccgagatcgtgggccggcagggctgcaagatcaaggccctgcgggccaagaccaacacctacatcaagacccctgtgcggggggaggagcccgtcttcatcgtgactggaagaaaagaagatgtggagatggccaagcgggagatcctgtctgctgctgagcacttcagcatcatccgggccaccaggagcaaggccggcggcctgcctggagctgcccagggcccccccaacctgcccggccagaccaccatccaggtgcgggtgccctacagagtggtgggcctggtggtgggccccaagggggccaccatcaagaggatccagcagaggacccacacctacatcgtgaccccaggccgggacaaggagcctgtgtttgctgtgacaggcatgccagaaaatgtggaccgggcccgggaggagattgaggcccacatcaccctgaggactggagccttcacagatgctggccctgacagcgacttccacgccaatggaacagatgtgtgcctggacctgctgggcgctgctgccagcctgtgggccaagacccccaaccagggcagaagaccacccacagccacagctggcctgcggggggacacagccctgggcgcccccagcgcccctgaggccttctacgccggcagcagaggaggccccagcgtgcctgaccccggccctgccagcccctacagcggcagcggaaatggaggctttgccttcggggctgagggccctggggcccctgtgggcacagctgccccagatgactgtgactttggatttgattttgacttcctggccctggacctgactgtgcctgctgctgccaccatctgggccccctttgaaagagctgcccccctgcctgccttcagcggctgcagcacagtgaatggagcccctggccccccagctgctggggcccggcgcagcagcggggccggcacccccaggcacagccccaccctgcctgagcccggcggcctgcggctggagctgcccctgagcagaagaggagccccagaccctgtgggcgccctgtcctggaggcctccccagggccctgtgtccttccctggaggagctgccttcagcacagccaccagcctgcccagcagccctgctgctgctgcctgtgcccccctggacagcggggccagcgagaacagcaggaagcccccatctgccagcagcgccccagccctggccagagaatgtgtggtgtgtgccgagggggaggtgatggccgccctggtgccctgtggccacaacctcttctgcatggactgtgctgtgcgcatctgtgggaagtctgagccagaatgtcctgcctgcaggaccccagccacccaggccatccacatcttctcctag

SEQ ID NO: 159617 - DNA, 966 bp, Artificial Sequence
  Description of Artificial Sequence: Synthetic coding sequence
atgcagtgccgcctgccccggggcctggccggggccctgctgaccctgctgtgcatgggcctgctgtgcctgcgctaccacctgaacctgagcccccagagggtgcagggcaccccagagctgagccagcccaaccctggcccccccaagctgcagctgcatgatgtgttcatcgctgtgaagaccacccgggccttccaccggctgcggctggagctgctgctggacacctgggtgtccaggacccgggagcagacctttgtgttcacagacagcccagacaagggcctgcaggagcggctgggcagccacctggtggtgaccaactgcagcgctgagcacagccacccagccctgagctgcaagatggctgctgagtttgacaccttcctggccagcggcctgcgctggttctgccacgtggatgatgacaactacgtgaacccccgggccctgctgcagctgctgcgggccttccccctggccagagatgtgtatgtgggccggcccagcctgaaccggcccatccacgccagcgagccccagccccacaacagaacccggctggtgcagttctggtttgccaccggcggggccggcttctgcatcaacaggaagctggccctgaagatggccccctgggccagcggcagccgcttcatggacaccagcgccctgatccggctgcctgatgactgcaccatgggctacatcatcgagtgcaagctgggcggccgcctgcagcccagccccctcttccacagccacctggagaccctgcagctgctgaggacagcccagctgcctgagcaggtgaccctgtcctatggagtgtttgagggcaagctgaatgtcatcaagctgcagggccccttcagccctgaggaggaccccagccgcttccgcagcctgcactgcctgctgtacccagacaccccctggtgcccccagctgggcgccaggtag

SEQ ID NO: 159618 - DNA, 924 bp, Artificial Sequence
  Description of Artificial Sequence: Synthetic coding sequence
atgcagtgccgcctgccccggggcctggccggggccctgctgaccctgctgtgcatgggcctgctgtgcctgcgctaccacctgaacctgagcccccagagggtgcagggcaccccagagctgagccagcccaaccctggcccccccaagctgcagctgcatgatgtgttcatcgctgtgaagaccacccgggccttccaccggctgcggctggagctgctgctggacacctgggtgtccaggacccgggagcaggtgaccaggagccacctggtggtgaccaactgcagcgctgagcacagccacccagccctgagctgcaagatggctgctgagtttgacaccttcctggccagcggcctgcgctggttctgccacgtggatgatgacaactacgtgaacccccgggccctgctgcagctgctgcgggccttccccctggccagagatgtgtatgtgggccggcccagcctgaaccggcccatccacgccagcgagccccagccccacaacagaacccggctggtgcagttctggtttgccaccggcggggccggcttctgcatcaacaggaagctggccctgaagatggccccctgggccagcggcagccgcttcatggacaccagcgccctgatccggctgcctgatgactgcaccatgggctacatcatcgagtgcaagctgggcggccgcctgcagcccagccccctcttccacagccacctggagaccctgcagctgctgaggacagcccagctgcctgagcaggtgaccctgtcctatggagtgtttgagggcaagctgaatgtcatcaagctgcagggccccttcagccctgaggaggaccccagccgcttccgcagcctgcactgcctgctgtacccagacaccccctggtgcccccagctgggcgccaggtag

SEQ ID NO: 159619 - DNA, 357 bp, Artificial Sequence
  Description of Artificial Sequence: Synthetic coding sequence
atgcagtgccgcctgccccggggcctggccggggccctgctgaccctgctgtgcatgggcctgctgtgcctgcgctaccacctgaacctgagcccccagagggtgcagggcaccccagagctgagccagcccaaccctggcccccccaagctgcagctgcatgatgtgttcatcgctgtgaagaccacccgggccttccaccggctgcggctggagctgctgctggacacctgggtgtccaggacccgggagcagacctttgtgttcacagacagcccagacaagggcctgcaggagcggctgggcagcccagacagcagcagcctgctgcagggccccaccctgtggagcccctag

SEQ ID NO: 159620 - DNA, 399 bp, Artificial Sequence
  Description of Artificial Sequence: Synthetic coding sequence
atggctgctgagtttgacaccttcctggccagcggcctgcgctggttctgccacgtggatgatgacaactacgtgaacccccgggccctgctgcagctgctgcgggccttccccctggccagagatgtgtatgtgggccggcccagcctgaaccggcccatccacgccagcgagccccagccccacaacagaacccggctggtgcagttctggtttgccaccggcggggccggcttctgcatcaacaggaagctggccctgaagatggccccctgggccagcggcagccgcttcatggacaccagcgccctgatccggctgcctgatgactgcaccatgggctacatcatcgagtgcaagctgggcggccgcctgcagcccagccccctcttccactag

SEQ ID NO: 159621 - DNA, 132 bp, Artificial Sequence
  Description of Artificial Sequence: Synthetic coding sequence
atggctgctgagtttgacaccttcctggccagcggcctgcgctggttctgccacgtggatgatgacaactacgtgaacccccgggccctgctgcagctgctgcgggccttccccctggccagagatgtgtag

SEQ ID NO: 159622 - DNA, 264 bp, Artificial Sequence
  Description of Artificial Sequence: Synthetic coding sequence
tgaagccacctggagaccctgcagctgctgaggacagcccagctgcctgagcagatcagcctgccccccctgagcgccctgagccgctacaccctggtgtccccagctggctgccccatgaaccctgagctgctgggcaagggctgggccgagaccagcggctgtgccctggcccccaaggtggccctgtgggtgcctgggaagtgcctggtgattggcagcccctggcagggcctgcgggtggtgggcaagccccgcatctag

SEQ ID NO: 159623 - DNA, 999 bp, Artificial Sequence
  Description of Artificial Sequence: Synthetic coding sequence
atgggcctgggccctgtgttcctgctgctggccggcatcttcccctttgcccctcctggagctgctgctgagccccacagcctgcgctacaacctgactgtgctgtcctgggatggctctgtgcagagcggcttcctggccgaggtgcacctggatggccagcccttcctgcgctatgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggagggcctgcacagcctgcaggagatccgggtgtgtgagatccacgaggacaacagcaccaggagcagccagcacttctactatgatggagagctgttcctgagccagaacctggagacagaggagtggacagtgccccagagcagccgggcccagaccctggccatgaatgtgaggaacttcctgaaggaggatgccatgaagaccaagacccactaccacgccatgcatgctgactgcctgcaggagctgcggcgctacctggagagcggcgtggtgctgcggaggacagtgccccccatggtgaatgtgaccaggtctgaggccagcgagggcaacatcaccgtgacctgccgggccagcagcttctaccccaggaacatcatcctgacctggaggcaggatggagtgtccctgagccatgacacccagcagtggggagatgtgctgcctgatggaaatggcacctaccagacctgggtggccacccgcatctgccgcggggaggagcagcgcttcacctgctacatggagcacagcggcaaccacagcacccaccctgtgcccagcggcaaggtgctggtgctgcagagccactggcagaccttccacgtgtctgctgtggccgccggctgctgctacttctgctactactacttcctgtgccccctgctgtag

SEQ ID NO: 159624 - DNA, 585 bp, Artificial Sequence
  Description of Artificial Sequence: Synthetic coding sequence
atgggccagagggaccagggcctggaccgggagaggaagggcccccaggatgatcctggcagctaccagggccctgagaggaggaacttcctgaaggaggatgccatgaagaccaagacccactaccacgccatgcatgctgactgcctgcaggagctgcggcgctacctggagagcggcgtggtgctgcggaggacagtgccccccatggtgaatgtgaccaggtctgaggccagcgagggcaacatcaccgtgacctgccgggccagcagcttctaccccaggaacatcatcctgacctggaggcaggatggagtgtccctgagccatgacacccagcagtggggagatgtgctgcctgatggaaatggcacctaccagacctgggtggccacccgcatctgccgcggggaggagcagcgcttcacctgctacatggagcacagcggcaaccacagcacccaccctgtgcccagcggcaaggtgctggtgctgcagagccactggcagaccttccacgtgtctgctgtggccgccggctgctgctacttctgctactactacttcctgtgccccctgctgtag

SEQ ID NO: 159625 - DNA, 870 bp, Artificial Sequence
  Description of Artificial Sequence: Synthetic coding sequence
atgggcctgggccctgtgttcctgctgctggccggcatcttcccctttgcccctcctggagctgctgctgagccccacagcctgcgctacaacctgactgtgctgtcctgggatggctctgtgcagagcggcttcctggccgaggtgcacctggatggccagcccttcctgcgctatgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggaggtgccccagagcagccgggcccagaccctggccatgaatgtgaggaacttcctgaaggaggatgccatgaagaccaagacccactaccacgccatgcacgccgactgcctgcaggagctgcggcgctacctggagagcggcgtggtgctgcggaggacagtgccccccatggtgaatgtgaccaggtctgaggccagcgagggcaacatcaccgtgacctgccgggccagcagcttctaccccaggaacatcatcctgacctggaggcaggatggagtgtccctgagccatgacacccagcagtggggagatgtgctgcctgatggaaatggcacctaccagacctgggtggccacccgcatctgccgcggggaggagcagcgcttcacctgctacatggagcacagcggcaaccacagcacccaccctgtgcccagcggcaaggtgctggtgctgcagagccactggcagaccttccacgtgtctgctgtggccgccggctgctgctacttctgctactactacttcctgtgccccctgctgtag

SEQ ID NO: 159626 - DNA, 738 bp, Artificial Sequence
  Description of Artificial Sequence: Synthetic coding sequence
atgggccagagggaccagaggctggaccgggagaggaagggcccccaggatgatcctggcagctaccagggccctgagaggaggaacttcctgaaggaggatgccatgaagaccaagacccactaccacgccatgcatgctgactgcctgcaggagctgcggcgctacctgaagtctggagtggtgctgcggaggacagtgccccccatggtgaatgtgaccaggtctgaggccagcgagggcaacatcaccgtgacctgccgggccagcggcttctacccctggaacatcaccctgtcctggaggcaggatggagtgtccctgagccatgacacccagcagtggggagatgtgctgcctgatggaaatggcacctaccagacctgggtggccacccgcatctgccagggcgaggagcagcgcttcacctgctacatggagcacagcggcaaccacagcacccaccctgtgcccagcggcaaggtgctggtgctgcagagccactggcagaccttccacgtgtctgctgtggccgccgccgccatctttgtgatcatcatcttctacgtgcgctgctgcaagaagaagaccagcgctgctgagggccctgagctggtgtccctgcaggtgctggaccagcaccctgtgggcaccagtgaccacagagatgccacccagctgggcttccagcccctgatgtctgacctgggcagcacaggcagcacagagggcgcctag

SEQ ID NO: 159627 - DNA, 1152 bp, Artificial Sequence
  Description of Artificial Sequence: Synthetic coding sequence
atgggcctgggccctgtgttcctgctgctggccggcatcttcccctttgcccctcctggagctgctgctgagccccacagcctgcgctacaacctgactgtgctgtcctgggatggctctgtgcagagcggcttcctgacagaggtgcacctggatggccagcccttcctgcgctgtgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggagggcctgcacagcctgcaggagatccgggtgtgtgagatccacgaggacaacagcaccaggagcagccagcacttctactatgatggagagctgttcctgagccagaacctggagaccaaggagtggaccatgccccagagcagccgggcccagaccctggccatgaatgtgaggaacttcctgaaggaggatgccatgaagaccaagacccactaccacgccatgcatgctgactgcctgcaggagctgcggcgctacctgaagtctggagtggtgctgcggaggacagtgccccccatggtgaatgtgaccaggtctgaggccagcgagggcaacatcaccgtgacctgccgggccagcggcttctacccctggaacatcaccctgtcctggaggcaggatggagtgtccctgagccatgacacccagcagtggggagatgtgctgcctgatggaaatggcacctaccagacctgggtggccacccgcatctgccagggcgaggagcagcgcttcacctgctacatggagcacagcggcaaccacagcacccaccctgtgcccagcggcaaggtgctggtgctgcagagccactggcagaccttccacgtgtctgctgtggccgccgccgccatctttgtgatcatcatcttctacgtgcgctgctgcaagaagaagaccagcgctgctgagggccctgagctggtgtccctgcaggtgctggaccagcaccctgtgggcaccagtgaccacagagatgccacccagctgggcttccagcccctgatgtctgacctgggcagcacaggcagcacagagggcgcctag

SEQ ID NO: 159628 - DNA, 870 bp, Artificial Sequence; identical to SEQ ID NO: 159625
  Description of Artificial Sequence: Synthetic coding sequence

SEQ ID NO: 159629 - DNA, 999 bp, Artificial Sequence; identical to SEQ ID NO: 159623
  Description of Artificial Sequence: Synthetic coding sequence

SEQ ID NO: 159630 - DNA, 585 bp, Artificial Sequence; identical to SEQ ID NO: 159624
  Description of Artificial Sequence: Synthetic coding sequence

SEQ ID NO: 159631 - DNA, 831 bp, Artificial Sequence
  Description of Artificial Sequence: Synthetic coding sequence
ttcccctttgcccctcctggagctgctgctgagccccacagcctgcgctacaacctgactgtgctgtcctgggatggctctgtgcagagcggcttcctggccgaggtgcacctggatggccagcccttcctgcgctatgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggaggtgccccccatggtgaatgtgaccaggtctgaggccagcgagggcaacatcaccgtgacctgccgggccagcagcttctaccccaggaacatcaccctgacctggaggcaggatggagtgtccctgagccatgacacccagcagtggggagatgtgctgcctgatggaaatggcacctaccagacctgggtggccacccgcatctgccagggcgaggagcagcgcttcacctgctacatggagcacagcggcaaccacagcacccaccctgtgcccagcggcaaggtgctggtgctgcagagccactggcagaccttccacgtgtctgctgtggccgctgctgctgctgccatcttcgtcatcatcatcttctacgtgcgctgctgcaagaagaagaccagcgctgctgagggccctgagctggtgtccctgcaggtgctggaccagcaccctgtgggcaccagtgaccacagagatgccacccagctgggcttccagcccctgatgtctgccctgggcagcacaggcagcacagaaggagcctag

SEQ ID NO: 159632 - DNA, 1158 bp, Artificial Sequence
  Description of Artificial Sequence: Synthetic coding sequence
atgggcctgggccctgtgttcctgctgctggccggcatcttcccctttgcccctcctggagctgctgctgagccccacagcctgcgctacaacctgactgtgctgtcctgggatggctctgtgcagagcggcttcctggccgaggtgcacctggatggccagcccttcctgcgctatgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggagggcctgcacagcctgcaggagatccgggtgtgtgagatccacgaggacaacagcaccaggagcagccagcacttctactatgatggagagctgttcctgagccagaatgtggagacagaggagtggacagtgccccagagcagccgggcccagaccctggccatgaatgtgaggaacttcctgaaggaggatgccatgaagaccaagacccactaccacgccatgcatgctgactgcctgcaggagctgcggcgctacctggagagctctgtggtgctgcggaggagagtgccccccatggtgaatgtgaccaggtctgaggccagcgagggcaacatcaccgtgacctgccgggccagcagcttctaccccaggaacatcaccctgacctggaggcaggatggagtgtccctgagccatgacacccagcagtggggagatgtgctgcctgatggaaatggcacctaccagacctgggtggccacccgcatctgccagggcgaggagcagcgcttcacctgctacatggagcacagcggcaaccacagcacccaccctgtgcccagcggcaaggtgctggtgctgcagagccactggcagaccttccacgtgtctgctgtggccgctgctgctgctgccatctttgtgatcatcatcttctacgtgcgctgctgcaagaagaagaccagcgctgctgagggccctgagctggtgtccctgcaggtgctggaccagcaccctgtgggcaccagtgaccacagagatgccacccagctgggcttccagcccctgatgtctgccctgggcagcacaggcagcacagagggcgcctag

SEQ ID NO: 159633 - DNA, 744 bp, Artificial Sequence
  Description of Artificial Sequence: Synthetic coding sequence
atgggccagagggaccagggcctggaccgggagaggaagggcccccaggatgatcctggcagctaccagggccctgagaggaggaacttcctgaaggaggatgccatgaagaccaagacccactaccacgccatgcatgctgactgcctgcaggagctgcggcgctacctggagagctctgtggtgctgcggaggagagtgccccccatggtgaatgtgaccaggtctgaggccagcgagggcaacatcaccgtgacctgccgggccagcagcttctaccccaggaacatcaccctgacctggaggcaggatggagtgtccctgagccatgacacccagcagtggggagatgtgctgcctgatggaaatggcacctaccagacctgggtggccacccgcatctgccagggcgaggagcagcgcttcacctgctacatggagcacagcggcaaccacagcacccaccctgtgcccagcggcaaggtgctggtgctgcagagccactggcagaccttccacgtgtctgctgtggccgctgctgctgctgccatctttgtgatcatcatcttctacgtgcgctgctgcaagaagaagaccagcgctgctgagggccctgagctggtgtccctgcaggtgctggaccagcaccctgtgggcaccagtgaccacagagatgccacccagctgggcttccagcccctgatgtctgccctgggcagcacaggcagcacagagggcgcctag

SEQ ID NO: 159634 - DNA, 672 bp, Artificial Sequence
  Description of Artificial Sequence: Synthetic coding sequence
ttcccctttgcccctcctggagctgctgctgagccccacagcctgcgctacaacctgactgtgctgtcctgggatggctctgtgcagagcggcttcctggccgaggtgcacctggatggccagcccttcctgcgctatgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggaggtgccccccatggtgaatgtgaccaggtctgaggccagcgagggcaacatcaccgtgacctgccgggccagcagcttctaccccaggaacatcatcctgacctggaggcaggatggagtgtccctgagccatgacacccagcagtggggagatgtgctgcctgatggaaatggcacctaccagacctgggtggccacccgcatctgccgcggggaggagcagcgcttcacctgctacatggagcacagcggcaaccacagcacccaccctgtgcccagcggcaaggtgctggtgctgcagagccactggcagaccttccacgtgtctgctgtggccgccggctgctgctacttctgctactactacttcctgtgccccctgctgtag

SEQ ID NO: 159635 - DNA, 672 bp, Artificial Sequence; identical to SEQ ID NO: 159634
  Description of Artificial Sequence: Synthetic coding sequence

SEQ ID NO: 159636 - DNA, 672 bp, Artificial Sequence; identical to SEQ ID NO: 159634
  Description of Artificial Sequence: Synthetic coding sequence

SEQ ID NO: 159637 - DNA, 999 bp, Artificial Sequence; identical to SEQ ID NO: 159623
  Description of Artificial Sequence: Synthetic coding sequence

SEQ ID NO: 159638 - DNA, 1029 bp, Artificial Sequence
  Description of Artificial Sequence: Synthetic coding sequence
atgggcctgggccctgtgttcctgctgctggccggcatcttcccctttgcccctcctggagctgctgctgagccccacagcctgcgctacaacctgactgtgctgtcctgggatggctctgtgcagagcggcttcctggccgaggtgcacctggatggccagcccttcctgcgctatgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggaggtgccccagagcagccgggcccagaccctggccatgaatgtgaggaacttcctgaaggaggatgccatgaagaccaagacccactaccacgccatgcacgccgactgcctgcaggagctgcggcgctacctggagagctctgtggtgctgcggcggcgggtgccccccatggtgaatgtgaccaggtctgaggccagcgagggcaacatcaccgtgacctgccgggccagcagcttctaccccaggaacatcaccctgacctggaggcaggatggagtgtccctgagccatgacacccagcagtggggagatgtgctgcctgatggaaatggcacctaccagacctgggtggccacccgcatctgccagggcgaggagcagcgcttcacctgctacatggagcacagcggcaaccacagcacccaccctgtgcccagcggcaaggtgctggtgctgcagagccactggcagaccttccacgtgtctgctgtggccgctgctgctgctgccatcttcgtcatcatcatcttctacgtgcgctgctgcaagaagaagaccagcgctgctgagggccctgagctggtgtccctgcaggtgctggaccagcaccctgtgggcaccagtgaccacagagatgccacccagctgggcttccagcccctgatgtctgccctgggcagcacaggcagcacagaaggagcctag

SEQ ID NO: 159639 - DNA, 825 bp, Artificial Sequence
  Description of Artificial Sequence: Synthetic coding sequence
ttcccctttgcccctcctggagctgctgctgagccccacagcctgcgctacaacctgactgtgctgtcctgggatggctctgtgcagagcggcttcctgacagaggtgcacctggatggccagcccttcctgcgctgtgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggaggtgccccccatggtgaatgtgaccaggtctgaggccagcgagggcaacatcaccgtgacctgccgggccagcggcttctacccctggaacatcaccctgtcctggaggcaggatggagtgtccctgagccatgacacccagcagtggggagatgtgctgcctgatggaaatggcacctaccagacctgggtggccacccgcatctgccagggcgaggagcagcgcttcacctgctacatggagcacagcggcaaccacagcacccaccctgtgcccagcggcaaggtgctggtgctgcagagccactggcagaccttccacgtgtctgctgtggccgctgctgccatcttcgtcatcatcatcttctacgtgcgctgctgcaagaagaagaccagcgctgctgagggccctgagctggtgtccctgcaggtgctggaccagcaccctgtgggcaccagtgaccacagagatgccacccagctgggcttccagcccctgatgtctgacctgggcagcacaggcagcacagaaggagcctag

SEQ ID NO: 159640 - DNA, 585 bp, Artificial Sequence; identical to SEQ ID NO: 159624
  Description of Artificial Sequence: Synthetic coding sequence

SEQ ID NO: 159641 - DNA, 870 bp, Artificial Sequence; identical to SEQ ID NO: 159625
  Description of Artificial Sequence: Synthetic coding sequence

SEQ ID NO: 159642 - DNA, 999 bp, Artificial Sequence; identical to SEQ ID NO: 159623
  Description of Artificial Sequence: Synthetic coding sequence

SEQ ID NO: 159643 - DNA, 999 bp, Artificial Sequence; identical to SEQ ID NO: 159623
  Description of Artificial Sequence: Synthetic coding sequence

SEQ ID NO: 159644 - DNA, 1152 bp, Artificial Sequence; identical to SEQ ID NO: 159627
  Description of Artificial Sequence: Synthetic coding sequence

SEQ ID NO: 159645 - DNA, 999 bp, Artificial Sequence; identical to SEQ ID NO: 159623
  Description of Artificial Sequence: Synthetic coding sequence

SEQ ID NO: 159646 - DNA, 999 bp, Artificial Sequence
  Description of Artificial Sequence: Synthetic coding sequence
atgggcctgggccctgtgttcctgctgctggccggcatcttcccctttgcccctcctggagctgctgctgagccccacagcctgcgctacaacctgactgtgctgtcctgggatggctctgtgcagagcggcttcctggccgaggtgcacctggatggccagcccttcctgcgctatgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggagggcctgcacagcctgcaggagatccgggtgtgtgagatccacgaggacaacagcaccaggagcagccagcacttctactatgatggagagctgttcctgagccagaatgtggagacagaggagtggacagtgccccagagcagccgggcccagaccctggccatgaatgtgaggaacttcctgaaggaggatgccatgaagaccaagacccactaccacgccatgcatgctgactgcctgcaggagctgcggcgctacctggagagctctgtggtgctgcggaggagagtgccccccatggtgaatgtgaccaggtctgaggccagcgagggcaacatcaccgtgacctgccgggccagcagcttctaccccaggaacatcaccctgacctggaggcaggatggagtgtccctgagccatgacacccagcagtggggagatgtgctgcctgatggaaatggcacctaccagacctgggtggccacccgcatctgccagggcgaggagcagcgcttcacctgctacatggagcacagcggcaaccacagcacccaccctgtgcccagcggcaaggtgctggtgctgcagagccactggcagaccttccacgtgtctgctgtggccgcctgctgctgctacttctgctactactacttcctgtgccccctgctgtag

SEQ ID NO: 159647 - DNA, 1152 bp, Artificial Sequence
  Description of Artificial Sequence: Synthetic coding sequence
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgagaatgtgctgggcgccaagacctgggacacagaaacagaggacctgacagaaaatggccaggacctgcggaggaccctgacccacatcaaggaccagaagggcggcctgcacagcctgcaggagatccgggtgtgtgagatccacgaggacagcagcacccggggcagccgccacttctactatgatggagagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcacctag

SEQ ID NO: 159648 - DNA, 1152 bp, Artificial Sequence
  Description of Artificial Sequence: Synthetic coding sequence
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgaggatgtgctgggcgccaagacctgggacacagaaacagaggacctgacagaaaatggccaggacctgcggaggaccctgacccacatcaaggaccagaagggcggcctgcacagcctgcaggagatccgggtgtgtgagatccacgaggacagcagcacccggggcagccgccacttctactatgatggagagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtcatctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcacctag

SEQ ID NO: 159649 - DNA, 1023 bp, Artificial Sequence
  Description of Artificial Sequence: Synthetic coding sequence
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgagaatgtgctgggcgccaagacctgggacacagaaacagaggacctgacagaaaatggccaggacctgcggaggaccctgacccacatcaaggaccagaagggcgtgccccagagcagccgggcccagaccctggccatgaatgtgaccaacttctggaaggaggatgccatgaagaccaagacccactaccgggccatgcaggccgactgcctgcagaagctgcagcgctacctgaagagcggcgtggccatcagaagaacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgctttgtgatcatcatcatcctgtgtgtgccctgctgcaagaagaagaccagcgctgctgagggccctgagctggtgtccctgcaggtgctggaccagcaccctgtgggcactggagaccacagagatgctgcccagctgggcttccagcccctgatgtctgccaccggcagcacaggcagcacagagggcacctag

SEQ ID NO: 159650 - DNA, 1023 bp, Artificial Sequence
  Description of Artificial Sequence: Synthetic coding sequence
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgaggatgtgctgggcgccaagacctgggacacagaaacagaggacctgacagaaaatggccaggacctgcggaggaccctgacccacatcaaggaccagaagggcgtgccccagagcagccgggcccagaccctggccatgaatgtgaccaacttctggaaggaggatgccatgaagaccaagacccactaccgggccatgcaggccgactgcctgcagaagctgcagcgctacctgaagagcggcgtggccatcagaagaacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgctttgtgatcatcatcatcctgtgtgtgccctgctgcaagaagaagaccagcgctgctgagggccctgagctggtgtccctgcaggtgctggaccagcaccctgtgggcactggagaccacagagatgctgcccagctgggcttccagcccctgatgtctgccaccggcagcacaggcagcacagaaggagcctag

SEQ ID NO: 159651 - DNA, 126 bp, Artificial Sequence
  Description of Artificial Sequence: Synthetic coding sequence
atgggcctgggccgggtgctgctcttcctggccgtggccttcccctttgcccccccagctgctgctgctgtggagatgggcttccaccgggtgtcccaggacggcctggacctgctgaccagctag

SEQ ID NO: 159652 - DNA, 1083 bp, Artificial Sequence
  Description of Artificial Sequence: Synthetic coding sequence
tgaccccacagcctgcgctacaacctgatggtgctgagccaggacggctctgtgcagagcggcttcctggccgagggccacctggatggccagcccttcctgcgctatgaccggcagaagagaagagccaagccccagggccagtgggccgaggatgtgctgggcgccaagacctgggacacagaaacagaggacctgacagaaaatggccaggacctgcggaggaccctgacccacatcaaggaccagaagggcggcctgcacagcctgcaggagatccgggtgtgtgagatccacgaggacagcagcacccggggcagccgccacttctactatgatggagagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagagcggcgtggccatcagaagaacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgctttgtgatcatcatcatcctgtgtgtgccctgctgcaagaagaagaccagcgctgctgagggccctgagctggtgtccctgcaggtgctggaccagcaccctgtgggcactggagaccacagagatgctgcccagctgggcttccagcccctgatgtctgccaccggcagcacaggcagcacagaaggagcctag

SEQ ID NO: 159653 - DNA, 1152 bp, Artificial Sequence
  Description of Artificial Sequence: Synthetic coding sequence
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgaggatgtgctgggcgccaagacctgggacacagaaacagaggacctgacagaaaatggccaggacctgcggaggaccctgacccacatcaaggaccagaagggcggcctgcacagcctgcaggagatccgggtgtgtgagatccacgaggacagcagcacccggggcagccgccacttctactatgatggagagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcgcctag

SEQ ID NO: 159654 - DNA, 1023 bp, Artificial Sequence
  Description of Artificial Sequence: Synthetic coding sequence
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgaggatgtgctgggcgctgagacctgggacacagaaacagaggacctgacagaaaatggccaggacctgcggaggaccctgacccacatcaaggaccagaagggcgtgccccagagcagccgggcccagaccctggccatgaatgtgaccaacttctggaaggaggatgccatgaagaccaagacccactaccgggccatgcaggccgactgcctgcagaagctgcagcgctacctgaagagcggcgtggccatcagaagaacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgctttgtgatcatcatcatcctgtgtgtgccctgctgcaagaagaagaccagcgctgctgagggccctgagctggtgtccctgcaggtgctggaccagcaccctgtgggcactggagaccacagagatgctgcccagctgggcttccagcccctgatgtctgccaccggcagcacaggcagcacagaaggagcctag

SEQ ID NO: 159655 - DNA, 1152 bp, Artificial Sequence
  Description of Artificial Sequence: Synthetic coding sequence
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgaggatgtgctgggcgctgagacctgggacacagaaacagaggacctgacagaaaatggccaggacctgcggaggaccctgacccacatcaaggaccagaagggcggcctgcacagcctgcaggagatccgggtgtgtgagatccacgaggacagcagcacccggggcagccgccacttctactacaacggggagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcgcctag

SEQ ID NO: 159656 - DNA, 1023 bp, Artificial Sequence
  Description of Artificial Sequence: Synthetic coding sequence
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgaggatgtgctgggcgccaagacctgggacacagaaacagaggacctgacagaaaatggccaggacctgcggaggaccctgacccacatcaaggaccagaagggcgtgccccagagcagccgggcccagaccctggccatgaatgtgaccaacttctggaaggaggatgccatgaagaccaagacccactaccgggccatgcaggccgactgcctgcagaagctgcagcgctacctgaagagcggcgtggccatcagaagaacagtgccccccatggtgaatgtcatctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgctttgtgatcatcatcatcctgtgtgtgccctgctgcaagaagaagaccagcgctgctgagggccctgagctggtgtccctgcaggtgctggaccagcaccctgtgggcactggagaccacagagatgctgcccagctgggcttccagcccctgatgtctgccaccggcagcacaggcagcacagagggcacctag

SEQ ID NO: 159657 - DNA, 1023 bp, Artificial Sequence; identical to SEQ ID NO: 159654
  Description of Artificial Sequence: Synthetic coding sequence

SEQ ID NO: 159658 - DNA, 1023 bp, Artificial Sequence; identical to SEQ ID NO: 159649
  Description of Artificial Sequence: Synthetic coding sequence

SEQ ID NO: 159659 - DNA, 1152 bp, Artificial Sequence; identical to SEQ ID NO: 159653
  Description of Artificial Sequence: Synthetic coding sequence

SEQ ID NO: 159660 - DNA, 1152 bp, Artificial Sequence; identical to SEQ ID NO: 159647
  Description of Artificial Sequence: Synthetic coding sequence

SEQ ID NO: 159661 - DNA, 1023 bp, Artificial Sequence; identical to SEQ ID NO: 159650
  Description of Artificial Sequence: Synthetic coding sequence

SEQ ID NO: 159662 - DNA, 954 bp, Artificial Sequence
  Description of Artificial Sequence: Synthetic coding sequence
tgaccccacagcctgcgctacaacctgatggtgctgagccaggacggctctgtgcagagcggcttcctggccgagggccacctggatggccagcccttcctgcgctatgaccggcagaagagaagagccaagccccagggccagtgggccgaggatgtgctgggcgccaagacctgggacacagaaacagaggacctgacagaaaatggccaggacctgcggaggaccctgacccacatcaaggaccagaagggcgtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcgcctag

SEQ ID NO: 159663 - DNA, 1152 bp, Artificial Sequence
  Description of Artificial Sequence: Synthetic coding sequence
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgaggatgtgctgggcgctgagacctgggacacagaaacagaggacctgacagaaaatggccaggacctgcggaggaccctgacccacatcaaggaccagaagggcggcctgcacagcctgcaggagatccgggtgtgtgagatgcatgaggacagcagcacccggggcagccgccacttctactacaacggggagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcgcctag

SEQ ID NO: 159664 - DNA, 1056 bp, Artificial Sequence
  Description of Artificial Sequence: Synthetic coding sequence
atggtgctgagccaggacggctctgtgcagagcggcttcctggccgagggccacctggatggccagcccttcctgcgctatgaccggcagaagaggcgggccaagccccagggccagtgggccgagaatgtgctgggcgccaagacctgggacacagaaacagaggacctgacagaaaatggccaggacctgcggaggaccctgacccacatcaaggaccagaagggcggcctgcacagcctgcaggagatccgggtgtgtgagatccacgaggacagcagcacccggggcagccgccacttctactatgatggagagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcacctag

SEQ ID NO: 159665 - DNA, 126 bp, Artificial Sequence; identical to SEQ ID NO: 159651
  Description of Artificial Sequence: Synthetic coding sequence

SEQ ID NO: 159666 - DNA, 126 bp, Artificial Sequence; identical to SEQ ID NO: 159651
  Description of Artificial Sequence: Synthetic coding sequence

SEQ ID NO: 159667 - DNA, 1056 bp, Artificial Sequence
  Description of Artificial Sequence: Synthetic coding sequence
atggtgctgagccaggacggctctgtgcagagcggcttcctggccgagggccacctggatggccagcccttcctgcgctatgaccggcagaagaggcgggccaagccccagggccagtgggccgaggatgtgctgggcgctgagacctgggacacagaaacagaggacctgacagaaaatggccaggacctgcggaggaccctgacccacatcaaggaccagaagggcggcctgcacagcctgcaggagatccgggtgtgtgagatgcatgaggacagcagcacccggggcagccgccacttctactacaacggggagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcgcctag

SEQ ID NO: 159668 - DNA, 1056 bp, Artificial Sequence
  Description of Artificial Sequence: Synthetic coding sequence
atggtgctgagccaggacggctctgtgcagagcggcttcctggccgagggccacctggatggccagcccttcctgcgctatgaccggcagaagaggcgggccaagccccagggccagtgggccgaggatgtgctgggcgccaagacctgggacacagaaacagaggacctgacagaaaatggccaggacctgcggaggaccctgacccacatcaaggaccagaagggcggcctgcacagcctgcaggagatccgggtgtgtgagatccacgaggacagcagcacccggggcagccgccacttctactatgatggagagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtcatctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcacctag

SEQ ID NO: 159669 - DNA, 126 bp, Artificial Sequence; identical to SEQ ID NO: 159651
  Description of Artificial Sequence: Synthetic coding sequence

SEQ ID NO: 159670 - DNA, 126 bp, Artificial Sequence; identical to SEQ ID NO: 159651
  Description of Artificial Sequence: Synthetic coding sequence

SEQ ID NO: 159671 - DNA, 1056 bp, Artificial Sequence; identical to SEQ ID NO: 159664
  Description of Artificial Sequence: Synthetic coding sequence

SEQ ID NO: 159672 - DNA, 126 bp, Artificial Sequence; identical to SEQ ID NO: 159651
  Description of Artificial Sequence: Synthetic coding sequence

SEQ ID NO: 159673 - DNA, 126 bp, Artificial Sequence; identical to SEQ ID NO: 159651
  Description of Artificial Sequence: Synthetic coding sequence

SEQ ID NO: 159674 - DNA, 1056 bp, Artificial Sequence
  Description of Artificial Sequence: Synthetic coding sequence
atggtgctgagccaggacggctctgtgcagagcggcttcctggccgagggccacctggatggccagcccttcctgcgctatgaccggcagaagaggcgggccaagccccagggccagtgggccgaggatgtgctgggcgctgagacctgggacacagaaacagaggacctgacagaaaatggccaggacctgcggaggaccctgacccacatcaaggaccagaagggcggcctgcacagcctgcaggagatccgggtgtgtgagatccacgaggacagcagcacccggggcagccgccacttctactacaacggggagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcgcctag

SEQ ID NO: 159675 - DNA, 2088 bp, Artificial Sequence
  Description of Artificial Sequence: Synthetic coding sequence
atgagcccccccaaggaccccagccccagcctgcccctgcccagcagcagcagccacagcagcagcccccccagcagcagcagcacctctgtgtctggaaatgccccagatggcagcagccccccccagatgacagccagcgagcccctgagccaggtgtcccggggccaccccagcccccccacccccaacttcagaagaagagctgtggcccagggcgccccccgggagatccccctgtacctgccccaccaccccaagccagagtgggccgagtactgcctggtgtccccaggagaagatggcctgagtgaccctgctgagatgaccagtgatgagtgccagcctgctgaggcccccctgggggacatcggcagcaaccaccgggacccccaccccatctggggcaaggaccgctcctggacaggccaggagctgagccccctggccggggaggaccgggagaagggcagcactggagccaggaaggaggaggagggcggccctgtgctggtgaaggagaagctgggcctgaagaagctggtgctgacccaggagcagaagaccatgctgctggactggaatgacagcatccctgagagcgtgcacctgaaggccggggagcgcatcagccagaagtctgcagaaaatggccggggcggccgggtgctgaagcctgtgcggcccctgctgctgcccagggctgctggggagcccctgcccacccagagaggagcccaggagaagatgggcaccccagctgagcaggcccagggcgagagaaatgtgcccccacccaagagccccctgcggctgattgccaatgccatccgccgcagcctggagcccctgctgagcaacagcgagggcggcaagaaggcctgggccaagcaggagagcaagaccctgcctgcccaggcctgcaccaggagcttcagcctgaggaagaccaacagcaacaaggatggagaccagcacagccctggcaggaaccagagcagcgccttcagccccccagaccctgccctgcggacccacagcctgcccaaccggcccagcaaggtgtttcctgccctgcggagccccccctgcagcaagattgaagatgtgcccaccctgctggagaaggtgtccctgcaggagaacttcccagatgccagcaagccacccaagaagaggatcagcctcttcagcagcctgcggctgaaggacaagagctttgagagcttcctgcaggagagccggcagaggaaggacatccgggacctgtttggcagccccaagaggaaggtgctgcctgaggacagcgcccaggccctggagaagctgctgcagcccttcaagagcaccagcctgcggcaggccgcccctcctcctcctcctcctcctcctcctcctcctcctccacccacagctgggggcgctgacagcaagaacttccccctgcgggcccaggtgacagaggccagcagcagcgccagcagcaccagcagcagcagcgcagatgaggagtttgacccccagctgagcctgcagctgaaggagaagaagaccctgcggcggaggaagaagctggagaaggccatgaagcagctggtgaagcaggaggagctgaagaggctgtacaaggcccaggccatccagaggcagctggaggaggtggaggagcggcagagggccagcgagatccagggcgtgcggctggagaaggccctgcggggggaggccgacagcggcacccaggatgaggcccagctgctgcaggagtggttcaagctggtgctggagaagaacaagctgatgagatatgaaagtgagctgctgatcatggcccaggagctggagctggaggaccaccagagccggctggagcagaagctgcgggagaagatgctgaaggaggagagccagaaggatgagaaggacctgaatgaggagcaggaggtgttcacagagctgatgcaggtgattgagcagagggacaagctggtggacagcctggaggagcagaggatccgggagaaggccgaggaccagcactttgagagctttgtgttcagccggggctgccagctgagcaggacatag

SEQ ID NO: 159676 - DNA, 90 bp, Artificial Sequence; identical to SEQ ID NO: 88880
  Description of Artificial Sequence: Synthetic coding sequence

SEQ ID NO: 159677 - DNA, 522 bp, Artificial Sequence
  Description of Artificial Sequence: Synthetic coding sequence
atgagcctgctgggccccaaggtgctgctcttcctggccgccttcatcatcaccagtgactggatccccctgggcgtgaacagccagagaggagatgatgtgacccaggccaccccagagaccttcacagaggaccccaacctggtgaatgaccctgccacagatgaaacagtgctggccgtgctggccgacatcgcccccagcacagatgacctggccagcctgtctgagaagaacaccacagctgagtgctgggatgagaagttcacctgcacccggctgtacagcgtgcacaggcctgtgaagcagtgcatccaccagctgtgcttcaccagcctgcggaggatgtacatcgtgaacaaggagatctgcagccggctggtgtgcaaggagcacgaggccatgaaggatgagctgtgccggcagatggccggcctgcccccccggcggctgcggcgcagcaactacttccggctgcccccctgtgaaaatgtggacctgcagaggcccaacggcctgtag

SEQ ID NO: 159678 - DNA, 492 bp, Artificial Sequence
  Description of Artificial Sequence: Synthetic coding sequence
atgagcctgctgggccccaaggtgctgctcttcctggccgccttcatcatcaccagtgactggatccccctgggcgtgaacagccagagaggagatgatgtgacccaggccaccccagagaccttcacagaggaccccaacctggtgaatgaccctgccacagatgaaacagtgctggccgtgctggccgacatcgcccccagcacagatgacctggagtgctgggatgagaagttcacctgcacccggctgtacagcgtgcacaggcctgtgaagcagtgcatccaccagctgtgcttcaccagcctgcggaggatgtacatcgtgaacaaggagatctgcagccggctggtgtgcaaggagcacgaggccatgaaggatgagctgtgccggcagatggccggcctgcccccccggcggctgcggcgcagcaactacttccggctgcccccctgtgaaaatgtggacctgcagaggcccaacggcctgtag

SEQ ID NO: 159679 - DNA, 447 bp, Artificial Sequence
  Description of Artificial Sequence: Synthetic coding sequence
atgagcctgctgggccccaaggtgctgctcttcctggccgccttcatcatcaccagtgactggatccccctgggcgtgaacagccagagaggagatgatgtgacccaggccaccccagagaccttcacagaggaccccaacctggtgaatgaccctgccacagatgaaacagagtgctgggatgagaagttcacctgcacccggctgtacagcgtgcacaggcctgtgaagcagtgcatccaccagctgtgcttcaccagcctgcggaggatgtacatcgtgaacaaggagatctgcagccggctggtgtgcaaggagcacgaggccatgaaggatgagctgtgccggcagatggccggcctgcccccccggcggctgcggcgcagcaactacttccggctgcccccctgtgaaaatgtggacctgcagaggcccaacggcctgtag

SEQ ID NO: 159680 - DNA, 492 bp, Artificial Sequence; identical to SEQ ID NO: 159678
  Description of Artificial Sequence: Synthetic coding sequence

SEQ ID NO: 159681 - DNA, 276 bp, Artificial Sequence
  Description of Artificial Sequence: Synthetic coding sequence
atgagcctgctgggccccaaggtgctgctcttcctggccgccttcatcatcaccagtgactggatccccctgggcgtgaacagccagagaggagatgatgtgacccaggccaccccagagaccttcacagaggaccccaacctggtgaatgaccctgccacagatgaaacagtgctggccgtgctggccgacatcgcccccagcacagatgacctggccagcctgtctgagaagaacaccacagctgagtgctgggatgagaagttcacctgctag

SEQ ID NO: 159682 - DNA, 1320 bp, Artificial Sequence
  Description of Artificial Sequence: Synthetic coding sequence
atgtctgtgcccagcgccctgatgaagcagccccccatccagagcacagctggagctgtgcctgtgagaaatgagaagggggagatctccatggagaaggtgaaggtgaagagatatgtgtctgggaagaggccagactatgcccccatggagagcagtgatgaggaggatgaggagttccagttcatcaagaaggccaaggagcaggaggccgagcctgaggagcaggaggaggacagcagcagtgacccccggctgcggcggctgcagaaccgcatcagtgaagatgtggaggagcggctggcccggcacaggaagatcgtggagcctgaggtggtgggggagagtgacagcgaggtggagggagatgcctggaggatggagcgggaggacagcagcgaggaggaggaggaggagattgatgatgaggagattgaaagaagaagaggcatgatgaggcagagggcccaggagaggaagaatgaggagatggaggtgatggaggtggaggatgagggccgctctggagaggagagcgagagcgagagtgaatatgaggagtacacagattctgaagatgagatggagccccggctgaagcctgtgttcatcaggaagaaggacagagtgacagtgcaggagcgggaggccgaggccctgaagcagaaggagctggagcaggaggccaagaggatggccgaggagaggaggaagtacaccctgaagatcgtggaggaggagaccaagaaggagctggaggagaacaagaggagcctggccgccctggatgccctgaacacagatgatgaaaatgatgaggaggagtatgaggcctggaaggtgcgggagctgaagaggatcaagagggaccgggaggaccgggaggccctggagaaggagaaggccgagattgaaagaatgaggaacctgacagaggaggagaggagagctgagctgcgggccaacgggaaggtgatcaccaacaaggctgtgaagggcaagtacaagttcctgcagaagtactaccacagaggagccttcttcatggatgaagatgaggaggtgtacaagagggacttcagcgcccccaccctggaggaccacttcaacaagaccatcctgcccaaggtgatgcaggtgaagaactttggccgcagcggccgcaccaagtacacccacctggtggaccaggacaccaccagctttgacagcgcctggggccaggagagcgcccagaacaccaagttcttcaagcagaaggccgccggcgtgagagatgtgtttgagcggcccagcgccaagaagaggaagaccacctag

SEQ ID NO: 159683 - DNA, 549 bp, Artificial Sequence
  Description of Artificial Sequence: Synthetic coding sequence
atgagagctgcctacctgttcctgctcttcctgcccggcctgctggcccagggccagtatgacctggaccccctgccccccttcccagaccacgtgcagtacacccactacagcgaccagattgacaacccagactactatgactaccaggaggtgaccccccggcccagcgaggagcagttccagttccagagccagcagcaggtgcagcaggaggtgatcccagcccccaccccagagcctggaaatgctgagctggagcccacagagcccggccccctggactgccgggaggagcagtacccctgcacccggctgtacagcatccaccggccctgcaagcagtgcctgaatgaggtgtgcttctacagcctgcggcgggtgtatgtgatcaacaaggagatctgtgtgaggacagtgtgtgcccacgaggagctgctgcgggctgacctgtgccgggacaagttcagcaaatgtggggtgatggccagcagcggcctgtgccagagcgtggccgccagctgtgcccggagctgtggcagctgctag

SEQ ID NO: 159684 - DNA, 552 bp, Artificial Sequence
  Description of Artificial Sequence: Synthetic coding sequence
atgagagctgcctacctgttcctgctcttcctgcctgctggcctgctggcccagggccagtatgacctggaccccctgccccccttcccagaccacgtgcagtacacccactacagcgaccagattgacaacccagactactatgactaccaggaggtgaccccccggcccagcgaggagcagttccagttccagagccagcagcaggtgcagcaggaggtgatcccagcccccaccccagagcctggaaatgctgagctggagcccacagagcccggccccctggactgccgggaggagcagtacccctgcacccggctgtacagcatccaccggccctgcaagcagtgcctgaatgaggtgtgcttctacagcctgcggcgggtgtatgtgatcaacaaggagatctgtgtgaggacagtgtgtgcccacgaggagctgctgcgggctgacctgtgccgggacaagttcagcaaatgtggggtgatggccagcagcggcctgtgccagagcgtggccgccagctgtgcccggagctgtggcagctgctag

SEQ ID NO: 159685 - DNA, 549 bp, Artificial Sequence; identical to SEQ ID NO: 159683
  Description of Artificial Sequence: Synthetic coding sequence

SEQ ID NO: 159686 - DNA, 1089 bp, Artificial Sequence
  Description of Artificial Sequence: Synthetic coding sequence
atgaagctgcactgctgcctcttcaccctggtggccagcatcatcgtgcctgctgcctttgtgctggaggatgtggactttgaccagatggtgtccctggaggccaacagaagcagctacaatgccagcttccccagcagctttgagctgagcgccagcagccacagtgatgatgatgtgatcatcgccaaggagggcacctctgtgtccattgagtgcctgctgacagccagccactatgaagatgtgcactggcacaacagcaagggccagcagctggatggccgcagcagaggaggcaagtggctggtgtctgacaacttcctgaacatcaccaacgtggcctttgatgaccggggcctgtacacctgctttgtgaccagccccatccgggccagctacagcgtgaccctgcgggtcatcttcaccagcggggacatgtctgtgtactacatgattgtgtgcctgattgccttcaccatcaccctcatcctgaatgtgacccggctgtgcatgatgagcagccacctgaggaagacagagaaggccatcaatgagttcttcagaacagagggcgctgagaagctgcagaaggcctttgagatcgccaagaggatccccatcatcaccagcgccaagaccctggagctggccaaggtgacccagttcaagaccatggagtttgcccgctacatcgaggagctggcccggtctgtgcccctgcccccactcatcctgaactgccgggcctttgtggaggagatgtttgaggccgtgcgggtggatgatcctgatgacctgggggagcgcatcaaggagaggcctgccctgaatgcccagggcggcatctacgtgatcaaccctgagatgggccgcagcaacagccctggaggagacagtgatgatggcagcctgaatgagcagggccaggagattgctgtgcaggtgtctgtgcacctgcagagcgagaccaagagcattgacacagagagccagggcagcagccacttcagccccccagatgacatcggcagcgctgagagcaactgcaactacaaggatggagcctatgagaactgccagctgtag

SEQ ID NO: 159687 - DNA, 1089 bp, Artificial Sequence; identical to SEQ ID NO: 159686
  Description of Artificial Sequence: Synthetic coding sequence

SEQ ID NO: 159688 - DNA, 651 bp, Artificial Sequence
  Description of Artificial Sequence: Synthetic coding sequence
atgtctgtgtactacatgattgtgtgcctgattgccttcaccatcaccctcatcctgaatgtgacccggctgtgcatgatgagcagccacctgaggaagacagagaaggccatcaatgagttcttcagaacagagggcgctgagaagctgcagaaggcctttgagatcgccaagaggatccccatcatcaccagcgccaagaccctggagctggccaaggtgacccagttcaagaccatggagtttgcccgctacatcgaggagctggcccggtctgtgcccctgcccccactcatcctgaactgccgggcctttgtggaggagatgtttgaggccgtgcgggtggatgatcctgatgacctgggggagcgcatcaaggagaggcctgccctgaatgcccagggcggcatctacgtgatcaaccctgagatgggccgcagcaacagccctggaggagacagtgatgatggcagcctgaatgagcagggccaggagattgctgtgcaggtgtctgtgcacctgcagagcgagaccaagagcattgacacagagagccagggcagcagccacttcagccccccagatgacatcggcagcgctgagagcaactgcaactacaaggatggagcctatgagaactgccagctgtag

SEQ ID NO: 159689 - DNA, 54 bp, Artificial Sequence
  Description of Artificial Sequence: Synthetic coding sequence
atgaagctgcactgctgcctcttcaccctggtggccagcatcatcgtgccctag

SEQ ID NO: 159690 - DNA, 330 bp, Artificial Sequence
  Description of Artificial Sequence: Synthetic coding sequence
atgaagctgcactgctgcctcttcaccctggtggccagcatcatcgtgcctgctgcctttgtgctggaggatgtggactttgaccagatggtgtccctggaggccaacagaagcagctacaatgccagcttccccagcagctttgagctgagcgccagcagccacagtgatgatgatgtgatcatcgccaaggagggcacctctgtgtccattgagtgcctgctgacagccagccactatgaagatgtgcactggcacaacagcaagggccagcagctggatggccgcagcagaggaggcaagtggctggtgtctgacaacttcctgtag

SEQ ID NO: 159691 - DNA, 372 bp, Artificial Sequence
  Description of Artificial Sequence: Synthetic coding sequence
atgaagctgcactgctgcctcttcaccctggtggccagcatcatcgtgcctgctgcctttgtgctggaggatgtggactttgaccagatggtgtccctggaggccaacagaagcagctacaatgccagcttccccagcagctttgagctgagcgccagcagccacagtgatgatgatgtgatcatcgccaaggagggcacctctgtgtccattgagtgcctgctgacagccagccactatgaagatgtgcactggcacaacagcaagggccagcagctggatggccgcagcagaggaggcaagtggctggtgtctgacaacttcctgaacatcaccaacgtggcctttgatgaccggggcctgtacacctag

SEQ ID NO: 159692 - DNA, 768 bp, Artificial Sequence
  Description of Artificial Sequence: Synthetic coding sequence
atgaaggccctgctggccctgcccctgctgctgctgctgagcaccccaccctgtgccccccaggtgtctggcatcagaggagatgccctggagcgcttctgcctgcagcagcccctggactgtgatgacatctatgcccagggctaccagagtgatggagtgtacctgatctaccccagcggccccagcgtgcctgtgcctgtgttctgtgacatgaccacagagggcggcaagtggacagtgttccagaagcgcttcaatggatctgtgtccttcttccggggctggaatgactacaagctgggcttcggccgggcagatggagagtactggctgggcctgcagaacatgcacctgctgaccctgaagcagaagtatgagctgcgggtggacctggaggactttgagaacaacacagcctatgccaagtatgctgacttcagcatcagccccaatgctgtgtctgctgaggaggatggctacaccctgtttgtggccggctttgaagatggaggagctggggacagcctgagctaccacagcggccagaagttcagcacctttgaccgggaccaggacctgtttgtgcagaactgtgccgccctgagcagcggggccttctggttccgcagctgccactttgccaacctgaatggcttctacctgggcggcagccacctgtcctatgccaacggcatcaactgggcccagtggaagggcttctactacagcctgaagaggacagagatgaagatcagaagagcctag

SEQ ID NO: 159693 - DNA, 840 bp, Artificial Sequence
  Description of Artificial Sequence: Synthetic coding sequence
atgggagagctgagccccctgcagaggcccctggccacagagggcaccatgaaggcccagggcgtgctgctgaagctggccctgctggccctgcccctgctgctgctgctgagcaccccaccctgtgccccccaggtgtctggcatcagaggagatgccctggagcgcttctgcctgcagcagcccctggactgtgatgacatctatgcccagggctaccagagtgatggagtgtacctgatctaccccagcggccccagcgtgcctgtgcctgtgttctgtgacatgaccacagagggcggcaagtggacagtgttccagaagcgcttcaatggatctgtgtccttcttccggggctggaatgactacaagctgggcttcggccgggcagatggagagtactggctgggcctgcagaacatgcacctgctgaccctgaagcagaagtatgagctgcgggtggacctggaggactttgagaacaacacagcctatgccaagtatgctgacttcagcatcagccccaatgctgtgtctgctgaggaggatggctacaccctgtttgtggccggctttgaagatggaggagctggggacagcctgagctaccacagcggccagaagttcagcacctttgaccgggaccaggacctgtttgtgcagaactgtgccgccctgagcagcggggccttctggttccgcagctgccactttgccaacctgaatggcttctacctgggcggcagccacctgtcctatgccaacggcatcaactgggcccagtggaagggcttctactacagcctgaagaggacagagatgaagatcagaagagcctag

SEQ ID NO: 159694 - DNA, 468 bp, Artificial Sequence
  Description of Artificial Sequence: Synthetic coding sequence
atggtggacctgacccaggtgatggatgatgaggtgttcatggcctttgccagctatgccaccatcatcctgagcaagatgatgctgatgagcacagccacagccttctaccgcctgaccaggaaggtgtttgccaaccctgaggactgtgtggcctttggaaaaggagaaaatgccaagaagtacctgaggacagatgacagagtggagcgggtgagaagagcccacctgaatgacctggagaacatcatccccttcctgggcatcggcctgctgtacagcctgagcggccctgaccccagcacagccatcctgcacttccggctgtttgtgggcgcccgcatctaccacaccatcgcctacctgacccccctgccccagcccaacagagccctgtccttctttgtgggctacggcgtgaccctgtccatggcctaccgcctgctgaagagcaagctgtacctgtag

SEQ ID NO: 159695 - DNA, 468 bp, Artificial Sequence; identical to SEQ ID NO: 159694
  Description of Artificial Sequence: Synthetic coding sequence

SEQ ID NO: 159696 - DNA, 468 bp, Artificial Sequence; identical to SEQ ID NO: 159694
  Description of Artificial Sequence: Synthetic coding sequence

SEQ ID NO: 159697 - DNA, 468 bp, Artificial Sequence; identical to SEQ ID NO: 159694
  Description of Artificial Sequence: Synthetic coding sequence

SEQ ID NO: 159698 - DNA, 234 bp, Artificial Sequence
  Description of Artificial Sequence: Synthetic coding sequence
atggtggacctgacccaggtgatggatgatgaggtgttcatggcctttgccagctatgccaccatcatcctgagcaagatgatgctgatgagcacagccacagccttctaccgcctgaccaggaaggtgtttgccaaccctgaggactgtgtggcctttggaaaaggagaaaatgccaagaagtacctgaggacagatgacagagtggagcgggtgagaagagcccacctgtag

SEQ ID NO: 159699 - DNA, 129 bp, Artificial Sequence
  Description of Artificial Sequence: Synthetic coding sequence
atggtggacctgacccaggtgatggatgatgaggtgttcatggcctttgccagctatgccaccatcatcctgagcaagatgatgctgatgagcacagccacagccttctaccgcctgaccaggaagtag

SEQ ID NO: 159700 - DNA, 243 bp, Artificial Sequence
  Description of Artificial Sequence: Synthetic coding sequence
atggtggacctgacccaggtgatggatgatgaggtgttcatggcctttgccagctatgccaccatcatcctgagcaagatgatgctgatgagcacagccacagccttctaccgcctgaccaggaaggtgtttgccaaccctgaggactgtgtggcctttggaaaaggagaaaatgccaagaagtacctgaggacagatgacagagtggagcgggtgagaagagcccacctgaatgacctgtag

SEQ ID NO: 159701 - DNA, 264 bp, Artificial Sequence
  Description of Artificial Sequence: Synthetic coding sequence
atggtggacctgacccaggtgatggatgatgaggtgttcatggcctttgccagctatgccaccatcatcctgagcaagatgatgctgatgagcacagccacagccttctaccgcctgaccaggaaggtgtttgccaaccctgaggactgtgtggcctttggaaaaggagaaaatgccaagaagtacctgaggacagatgacagagtggagcgggtgcggcgcatcaagcagaccctgagcatctacctggccagcagcatctag

SEQ ID NO: 159702 - DNA, 444 bp, Artificial Sequence
  Description of Artificial Sequence: Synthetic coding sequence
atggccggcaacagcatcctgctggccgctgtgtccatcctgagcgcctgccagcagagctactttgccctgcaggtgggcaaggcccggctgaagtacaaggtgaccccacctgctgtgacaggcagccctgagtttgagagggtcttccgggcccagcagaactgtgtggagttctaccccatcttcatcatcaccctgtggatggccggctggtacttcaaccaggtgtttgccacctgcctgggcctggtgtacatctacggccgccacctgtacttctggggctacagcgaggccgccaagaagaggatcaccggcttccggctgagcctgggcatcctggccctgctgaccctgctgggcgccctgggcatcgccaacagcttcctggatgagtacctggacctgaacatcgccaagaagctgcggcggcagttctag

SEQ ID NO: 159703 - DNA, 444 bp, Artificial Sequence; identical to SEQ ID NO: 159702
  Description of Artificial Sequence: Synthetic coding sequence

SEQ ID NO: 159704 - DNA, 234 bp, Artificial Sequence
  Description of Artificial Sequence: Synthetic coding sequence
atggccggcaacagcatcctgctggccgctgtgtccatcctgagcgcctgccagcagagctactttgccctgcaggtgggcaaggcccggctgaagtacaaggtgaccccacctgctgtgacaggcagccctgagtttgagagggtcttccgggcccacttctgctacctgagcggcagcggcgtgcacatctggcccagccccatcctgctgggcatcttccgcagctgctag

SEQ ID NO: 159705 - DNA, 501 bp, Artificial Sequence
  Description of Artificial Sequence: Synthetic coding sequence
atgccctggaggggccgccgcttccggctgtgcaggaggaagatggctgtgctgagcaaggagtatggctttgtgctgctgaccggggccgccagcttcatcatggtggcccacctggccatcaacgtgtccaaggccaggaagaagtacaaggtggagtaccccatcatgtacagcacagatcctgaaaatggccacatcttcaactgcatccagagggcccaccagaacaccctggaggtgtacccacccttcctgttcttcctggccgtgggcggcgtgtaccaccccagaattgccagcggcctgggcctggcctggatcgtgggccgggtgctgtatgcctacggctactacaccggggagcccagcaagaggagcagaggagccctgggcagcatcgccctgctgggcctggtgggcaccaccgtgtgcagcgccttccagcacctgggctgggtgaagagcggcctgggcagcggccccaagtgctgccactag

SEQ ID NO: 159706 - DNA, 459 bp, Artificial Sequence
  Description of Artificial Sequence: Synthetic coding sequence
atggctgtgctgagcaaggagtatggctttgtgctgctgaccggggccgccagcttcatcatggtggcccacctggccatcaacgtgtccaaggccaggaagaagtacaaggtggagtaccccatcatgtacagcacagatcctgaaaatggccacatcttcaactgcatccagagggcccaccagaacaccctggaggtgtacccacccttcctgttcttcctggccgtgggcggcgtgtaccaccccagaattgccagcggcctgggcctggcctggatcgtgggccgggtgctgtatgcctacggctactacaccggggagcccagcaagaggagcagaggagccctgggcagcatcgccctgctgggcctggtgggcaccaccgtgtgcagcgccttccagcacctgggctgggtgaagagcggcctgggcagcggccccaagtgctgccactag

SEQ ID NO: 159707 - DNA, 501 bp, Artificial Sequence; identical to SEQ ID NO: 159705
  Description of Artificial Sequence: Synthetic coding sequence

SEQ ID NO: 159708 - DNA, 501 bp, Artificial Sequence; identical to SEQ ID NO: 159705
  Description of Artificial Sequence: Synthetic coding sequence

SEQ ID NO: 159709 - DNA, 459 bp, Artificial Sequence; identical to SEQ ID NO: 159706
  Description of Artificial Sequence: Synthetic coding sequence

SEQ ID NO: 159710 - DNA, 501 bp, Artificial Sequence; identical to SEQ ID NO: 159705
  Description of Artificial Sequence: Synthetic coding sequence

SEQ ID NO: 159711 - DNA, 972 bp, Artificial Sequence
  Description of Artificial Sequence: Synthetic coding sequence
atgccccggctgacctttgcccccaagggctggccccacccccccaccagcctgcactggtggctgttccaggagctgcccacccccagtgaaaattccatgcctcctggcctgagcacccccacagccagccaggagggcgccggccctgtgcctgaccccagccagcccacccggcggcagatccggctgagcagccctgagcggcagaggctgagcagcctgaacctgaccccagaccctgagatggagcccccacccaagcccccaagaagctgcagcgccctggcccggcatgccctggagagcagctttgtgggctggggcctgcctgtgcagagcccccaggccctggtggccatggagaaggaggagaaggagagccccttcagcagcgaggaggaggaggaggatgtgcccctggacagtgatgtggagcaggccctgcagacctttgccaagaccagcggcaccatgaacaactaccccacctggaggaggaccctgctgcggcgggccaaggaggaggagatgaagcgcttctgcaaggcccagaccatccagaggcggctgaatgaaattgaggccgccctgcgggagctggaggccgagggcgtgaagctggagctggccctgcggcggcagagcagcagccctgagcagcagaagaagctgtgggtgggccagctgctgcagctggtggacaagaagaacagcctggtggccgaggaggccgagctgatgatcaccgtgcaggagctgaacctggaggagaagcagtggcagctggaccaggagctgcggggctacatgaaccgggaggagaacctgaagacagctgctgaccggcaggccgaggaccaggtgctgaggaagctggtggacctggtgaaccagagagatgccctgatccgcttccaggaggagcggcggctgtctgagctggccctgggcactggagcccagggctag

SEQ ID NO: 159712 - DNA, 2946 bp, Artificial Sequence
  Description of Artificial Sequence: Synthetic coding sequence
atggccagccccaccagcaccaacccagcccacgcccactttgagagcttcctgcaggcccagctgtgccaggatgtgctgagcagcttccaggagctgtgtggggccctgggcctggagcccggcggcggcctgccccagtaccacaagatcaaggaccagctgaactactggagcgccaagagcctgtggaccaagctggacaagagagctggccagcctgtgtaccagcagggccgggcctgcaccagcaccaagtgcctggtggtgggcgccggcccctgtggcctgcgggtggccgtggagctggccctgctgggcgcccgggtggtgctggtggagaagaggaccaagttcagccgccacaacgtgctgcacctgtggcccttcaccatccatgacctgcgggccctgggcgccaagaagttctacggccgcttctgcaccggcaccctggaccacatcagcatccggcagctgcagctgctgctgctgaaggtggccctgctgctgggcgtggagatccactggggcgtgaccttcaccggcctgcagcccccacccaggaagggcagcggctggagggcccagctgcagcccaaccccccagcccagctggccaactatgaatttgatgtgctgatctctgctgctgggggcaagtttgtgcctgagggcttcaaggtgcgggagatgaggggcaagctggccatcggcatcacagccaactttgtgaatggccgcacagtggaggagacccaggtgcctgagatctctggagtggcccgcatctacaaccagagcttcttccagagcctgctgaaggccactggaattgacctggagaacatcgtgtactacaaggatgacacccactactttgtgatgacagccaagaagcagtgcctgctgcggctgggcgtgctgcggcagcccttctggcccctgggcaccggggtggcccggggcttcctggccgcctttgatgctgcctggatggtgaagcgctgggccgagggcgctgagagcctggaggtgctggccgagcgggagagcctgtaccagctgctgagccagaccagccctgagaacatgcacagaaatgtggcccagtatggcctggaccctgccacccgctaccccaacctgaacctgcgggctgtgacccccaaccaggtgcgggacctgtatgatgtgctggccaaggagcctgtgcagagaaataatgacaagacagacaccggcatgcctgccactggatctgctggcacccaggaggagctgctgcgctggtgccaggagcagacagctggctacccaggagtgcacgtgtctgacctgagcagctcctgggcagatggcctggccctgtgtgccctggtgtaccgcctgcagcccggcctgctggagcccagcgagctgcagggcctgggcgccctggaggccacagcctgggccctgaaggtggctgaaaatgagctgggcatcacccctgtggtgtctgcccaggccgtggtggccggcagtgaccccctgggcctgattgcctacctgagccacttccacagcgccttcaagtccatggcccacagccctggccctgtgtcccaggccagccctggcaccagcagcgctgtgctcttcctgagcaagctgcagaggaccctgcagaggagccgggccaaggaaaatgcagaagatgctgggggcaagaagctgcggctggagatggaggccgagacccccagcacagaggtgcccccagaccctgagcccggggtgcccctgaccccacccagccagcaccaggaggccggggccggggacctgtgtgccctgtgtggggagcacctgtatgtgctggagcggctgtgtgtgaatggccacttcttccacaggagctgcttccgctgccacacctgtgaggccaccctgtggccaggcggctatgagcagcaccctggagatggccacttctactgcctgcagcacctgccccagacagaccacaaggccgagggcagtgaccggggccctgagagccctgagctgcccacccccagtgaaaattccatgcctcctggcctgagcacccccacagccagccaggagggcgccggccctgtgcctgaccccagccagcccacccggcggcagatccggctgagcagccctgagcggcagaggctgagcagcctgaacctgaccccagaccctgagatggagcccccacccaagcccccaagaagctgcagcgccctggcccggcatgccctggagagcagctttgtgggctggggcctgcctgtgcagagcccccaggccctggtggccatggagaaggaggagaaggagagccccttcagcagcgaggaggaggaggaggatgtgcccctggacagtgatgtggagcaggccctgcagacctttgccaagaccagcggcaccatgaacaactaccccacctggaggaggaccctgctgcggcgggccaaggaggaggagatgaagcgcttctgcaaggcccagaccatccagaggcggctgaatgaaattgaggccgccctgcgggagctggaggccgagggcgtgaagctggagctggccctgcggcggcagagcagcagccctgagcagcagaagaagctgtgggtgggccagctgctgcagctggtggacaagaagaacagcctggtggccgaggaggccgagctgatgatcaccgtgcaggagctgaacctggaggagaagcagtggcagctggaccaggagctgcggggctacatgaaccgggaggagaacctgaagacagctgctgaccggcaggccgaggaccaggtgctgaggaagctggtggacctggtgaaccagagagatgccctgatccgcttccaggaggagcggcggctgtctgagctggccctgggcactggagcccagggctag

SEQ ID NO: 159713 - DNA, 3204 bp, Artificial Sequence
  Description of Artificial Sequence: Synthetic coding sequence
atggccagccccaccagcaccaacccagcccacgcccactttgagagcttcctgcaggcccagctgtgccaggatgtgctgagcagcttccaggagctgtgtggggccctgggcctggagcccggcggcggcctgccccagtaccacaagatcaaggaccagctgaactactggagcgccaagagcctgtggaccaagctggacaagagagctggccagcctgtgtaccagcagggccgggcctgcaccagcaccaagtgcctggtggtgggcgccggcccctgtggcctgcgggtggccgtggagctggccctgctgggcgcccgggtggtgctggtggagaagaggaccaagttcagccgccacaacgtgctgcacctgtggcccttcaccatccatgacctgcgggccctgggcgccaagaagttctacggccgcttctgcaccggcaccctggaccacatcagcatccggcagctgcagctgctgctgctgaaggtggccctgctgctgggcgtggagatccactggggcgtgaccttcaccggcctgcagcccccacccaggaagggcagcggctggagggcccagctgcagcccaaccccccagcccagctggccaactatgaatttgatgtgctgatctctgctgctgggggcaagtttgtgcctgagggcttcaaggtgcgggagatgaggggcaagctggccatcggcatcacagccaactttgtgaatggccgcacagtggaggagacccaggtgcctgagatctctggagtggcccgcatctacaaccagagcttcttccagagcctgctgaaggccactggaattgacctggagaacatcgtgtactacaaggatgacacccactactttgtgatgacagccaagaagcagtgcctgctgcggctgggcgtgctgcggcaggactggccagacaccaaccggctgctgggcagcgccaacgtggtgcctgaggccctgcagcgcttcaccagggctgctgctgactttgccacccacggcaagctgggcaagctggagtttgcccaggatgcccacggccagccagatgtgtctgcctttgacttcacctccatgatgagagctgagagcagcgcccgggtgcaggagaagcacggggcccggctgctgctgggcctggtgggggactgcctggtggagcccttctggcccctgggcaccggggtggcccggggcttcctggccgcctttgatgctgcctggatggtgaagcgctgggccgagggcgctgagagcctggaggtgctggccgagcgggagagcctgtaccagctgctgagccagaccagccctgagaacatgcacagaaatgtggcccagtatggcctggaccctgccacccgctaccccaacctgaacctgcgggctgtgacccccaaccaggtgcgggacctgtatgatgtgctggccaaggagcctgtgcagagaaataatgacaagacagacaccggcatgcctgccactggatctgctggcacccaggaggagctgctgcgctggtgccaggagcagacagctggctacccaggagtgcacgtgtctgacctgagcagctcctgggcagatggcctggccctgtgtgccctggtgtaccgcctgcagcccggcctgctggagcccagcgagctgcagggcctgggcgccctggaggccacagcctgggccctgaaggtggctgaaaatgagctgggcatcacccctgtggtgtctgcccaggccgtggtggccggcagtgaccccctgggcctgattgcctacctgagccacttccacagcgccttcaagtccatggcccacagccctggccctgtgtcccaggccagccctggcaccagcagcgctgtgctcttcctgagcaagctgcagaggaccctgcagaggagccgggccaaggaaaatgcagaagatgctgggggcaagaagctgcggctggagatggaggccgagacccccagcacagaggtgcccccagaccctgagcccggggtgcccctgaccccacccagccagcaccaggaggccggggccggggacctgtgtgccctgtgtggggagcacctgtatgtgctggagcggctgtgtgtgaatggccacttcttccacaggagctgcttccgctgccacacctgtgaggccaccctgtggccaggcggctatgagcagcaccctggagatggccacttctactgcctgcagcacctgccccagacagaccacaaggccgagggcagtgaccggggccctgagagccctgagctgcccacccccagtgaaaattccatgcctcctggcctgagcacccccacagccagccaggagggcgccggccctgtgcctgaccccagccagcccacccggcggcagatccggctgagcagccctgagcggcagaggctgagcagcctgaacctgaccccagaccctgagatggagcccccacccaagcccccaagaagctgcagcgccctggcccggcatgccctggagagcagctttgtgggctggggcctgcctgtgcagagcccccaggccctggtggccatggagaaggaggagaaggagagccccttcagcagcgaggaggaggaggaggatgtgcccctggacagtgatgtggagcaggccctgcagacctttgccaagaccagcggcaccatgaacaactaccccacctggaggaggaccctgctgcggcgggccaaggaggaggagatgaagcgcttctgcaaggcccagaccatccagaggcggctgaatgaaattgaggccgccctgcgggagctggaggccgagggcgtgaagctggagctggccctgcggcggcagagcagcagccctgagcagcagaagaagctgtgggtgggccagctgctgcagctggtggacaagaagaacagcctggtggccgaggaggccgagctgatgatcaccgtgcaggagctgaacctggaggagaagcagtggcagctggaccaggagctgcggggctacatgaaccgggaggagaacctgaagacagctgctgaccggcaggccgaggaccaggtgctgaggaagctggtggacctggtgaaccagagagatgccctgatccgcttccaggaggagcggcggctgtctgagctggccctgggcactggagcccagggctag

SEQ ID NO: 159714 - DNA, 3261 bp, Artificial Sequence
  Description of Artificial Sequence: Synthetic coding sequence
atgagctgcctgagccacagcagcctgcccagctgctgccccccccaggaggcctccatggccagccccaccagcaccaacccagcccacgcccactttgagagcttcctgcaggcccagctgtgccaggatgtgctgagcagcttccaggagctgtgtggggccctgggcctggagcccggcggcggcctgccccagtaccacaagatcaaggaccagctgaactactggagcgccaagagcctgtggaccaagctggacaagagagctggccagcctgtgtaccagcagggccgggcctgcaccagcaccaagtgcctggtggtgggcgccggcccctgtggcctgcgggtggccgtggagctggccctgctgggcgcccgggtggtgctggtggagaagaggaccaagttcagccgccacaacgtgctgcacctgtggcccttcaccatccatgacctgcgggccctgggcgccaagaagttctacggccgcttctgcaccggcaccctggaccacatcagcatccggcagctgcagctgctgctgctgaaggtggccctgctgctgggcgtggagatccactggggcgtgaccttcaccggcctgcagcccccacccaggaaaggaagtggctggagggcccagctgcagcccaaccccccagcccagctggccaactatgaatttgatgtgctgatctctgctgctgggggcaagtttgtgcctgagggcttcaaggtgcgggagatgaggggcaagctggccatcggcatcacagccaactttgtgaatggaagaacagtggaggagacccaggtgcctgagatcagcggcgtggcccgcatctacaaccagagcttcttccagagcctgctgaaggccaccggcatcgacctggagaacatcgtgtactacaaggatgacacccactactttgtgatgacagccaagaagcagtgcctgctgcggctgggcgtgctgcggcaggactggccagacaccaaccggctgctgggcagcgccaacgtggtgcctgaggccctgcagcgcttcaccagggctgctgctgactttgccacccacggcaagctgggcaagctggagtttgcccaggatgcccacggccagccagatgtgtctgcctttgacttcacctccatgatgagagctgagagcagcgcccgggtgcaggagaagcatggagcccggctgctgctgggcctggtgggggactgcctggtggagcccttctggcccctgggcactggagtggcccggggcttcctggccgcctttgatgctgcctggatggtgaagcgctgggccgagggcgctgagagcctggaggtgctggccgagcgggagagcctgtaccagctgctgagccagaccagccctgagaacatgcacagaaatgtggcccagtatggcctggaccctgccacccgctaccccaacctgaacctgcgggctgtgacccccaaccaggtgcgggacctgtatgatgtgctggccaaggagcctgtgcagaggaacaatgacaagacagacaccggcatgcctgccaccggcagcgctggcacccaggaggagctgctgcgctggtgccaggagcagacagctggctacccaggagtgcacgtgtctgacctgagcagctcctgggcagatggcctggccctgtgtgccctggtgtaccgcctgcagcccggcctgctggagcccagcgagctgcagggcctgggcgccctggaggccacagcctgggccctgaaggtggccgagaatgagctgggcatcacccctgtggtgtctgcccaggccgtggtggccggcagtgaccccctgggcctcatcgcctacctgagccacttccacagcgccttcaagtccatggcccacagccctggccctgtgtcccaggccagccctggcaccagcagcgctgtgctcttcctgagcaagctgcagaggaccctgcagaggagccgggccaaggaaaatgcagaagatgctgggggcaagaagctgcggctggagatggaggccgagacccccagcacagaggtgcccccagaccctgagcccggggtgcccctgaccccacccagccagcaccaggaggccggggccggggacctgtgtgccctgtgtggggagcacctgtatgtgctggagcggctgtgtgtgaatggccacttcttccacaggagctgcttccgctgccacacctgtgaggccaccctgtggccaggcggctatgagcagcaccctggagatggccacttctactgcctgcagcacctgccccagacagaccacaaggccgagggcagtgaccggggccctgagagccctgagctgcccaccccatctgagaacagcatgcctcctggcctgagcacccccacagccagccaggagggcgccggccctgtgcctgaccccagccagcccacccggcggcagatccggctgagcagccctgagcggcagaggctgagcagcctgaacctgaccccagaccctgagatggagcccccacccaagccacccaggagctgcagcgccctggcccggcatgccctggagagcagctttgtgggctggggcctgcctgtgcagagcccccaggccctggtggccatggagaaggaggagaaggagagccccttcagcagcgaggaggaggaggaggatgtgcccctggacagtgatgtggagcaggccctgcagacctttgccaagaccagcggcaccatgaacaactaccccacctggaggaggaccctgctgcggcgggccaaggaggaggagatgaagcgcttctgcaaggcccagaccatccagaggcggctgaatgaaattgaagctgccctgcgggagctggaggccgagggcgtgaagctggagctggccctgcggcggcagagcagcagccctgagcagcagaagaagctgtgggtgggccagctgctgcagctggtggacaagaagaacagcctggtggccgaggaggccgagctgatgatcaccgtgcaggagctgaacctggaggagaagcagtggcagctggaccaggagctgcggggctacatgaaccgggaggagaacctgaagacagctgctgaccggcaggccgaggaccaggtgctgaggaagctggtggacctggtgaaccagagagatgccctgatccgcttccaggaggagcggcggctgtctgagctggccctgggcaccggggcccagggctag

SEQ ID NO: 159715 - DNA, 1776 bp, Artificial Sequence
  Description of Artificial Sequence: Synthetic coding sequence
cccaagtatgtgctgcccagcgaggcccaggtggtgcctgccaagcagctgcagccccaggacaggagctctgtgcctgagcacagcctgctggccggcacccaggaggagctgctgcgctggtgccaggagcagacagctggctacccaggagtgcacgtgtctgacctgagcagctcctgggcagatggcctggccctgtgtgccctggtgtaccgcctgcagcccggcctgctggagcccagcgagctgcagggcctgggcgccctggaggccacagcctgggccctgaaggtggctgaaaatgagctgggcatcacccctgtggtgtctgcccaggccgtggtggccggcagtgaccccctgggcctgattgcctacctgagccacttccacagcgccttcaagtccatggcccacagccctggccctgtgtcccaggccagccctggcaccagcagcgctgtgctcttcctgagcaagctgcagaggaccctgcagaggagccgggccaaggaaaatgcagaagatgctgggggcaagaagctgcggctggagatggaggccgagacccccagcacagaggtgcccccagaccctgagcccggggtgcccctgaccccacccagccagcaccaggaggccggggccggggacctgtgtgccctgtgtggggagcacctgtatgtgctggagcggctgtgtgtgaatggccacttcttccacaggagctgcttccgctgccacacctgtgaggccaccctgtggccaggcggctatgagcagcaccctggagatggccacttctactgcctgcagcacctgccccagacagaccacaaggccgagggcagtgaccggggccctgagagccctgagctgcccacccccagtgaaaattccatgcctcctggcctgagcacccccacagccagccaggagggcgccggccctgtgcctgaccccagccagcccacccggcggcagatccggctgagcagccctgagcggcagaggctgagcagcctgaacctgaccccagaccctgagatggagcccccacccaagcccccaagaagctgcagcgccctggcccggcatgccctggagagcagctttgtgggctggggcctgcctgtgcagagcccccaggccctggtggccatggagaaggaggagaaggagagccccttcagcagcgaggaggaggaggaggatgtgcccctggacagtgatgtggagcaggccctgcagacctttgccaagaccagcggcaccatgaacaactaccccacctggaggaggaccctgctgcggcgggccaaggaggaggagatgaagcgcttctgcaaggcccagaccatccagaggcggctgaatgaaattgaggccgccctgcgggagctggaggccgagggcgtgaagctggagctggccctgcggcggcagagcagcagccctgagcagcagaagaagctgtgggtgggccagctgctgcagctggtggacaagaagaacagcctggtggccgaggaggccgagctgatgatcaccgtgcaggagctgaacctggaggagaagcagtggcagctggaccaggagctgcggggctacatgaaccgggaggagaacctgaagacagctgctgaccggcaggccgaggaccaggtgctgaggaagctggtggacctggtgaaccagagagatgccctgatccgcttccaggaggagcggcggctgtctgagctggccctgggcactggagcccagggctag

SEQ ID NO: 159716 - DNA, 735 bp, Artificial Sequence
  Description of Artificial Sequence: Synthetic coding sequence
atggccagccccaccagcaccaacccagcccacgcccactttgagagcttcctgcaggcccagctgtgccaggatgtgctgagcagcttccaggagctgtgtggggccctgggcctggagcccggcggcggcctgccccagtaccacaagatcaaggaccagctgaactactggagcgccaagagcctgtggaccaagctggacaagagagctggccagcctgtgtaccagcagggccgggcctgcaccagcaccaagtgcctggtggtgggcgccggcccctgtggcctgcgggtggccgtggagctggccctgctgggcgcccgggtggtgctggtggagaagaggaccaagttcagccgccacaacgtgctgcacctgtggcccttcaccatccatgacctgcgggccctgggcgccaagaagttctacggccgcttctgcaccggcaccctggaccacatcagcatccggcagctgcagctgctgctgctgaaggtggccctgctgctgggcgtggagatccactggggcgtgaccttcaccggcctgcagcccccacccaggaagggcagcggctggagggcccagctgcagcccaaccccccagcccagctggccaactatgaatttgatgtgctgatctctgctgctgggggcaagtttgtgcctgagggcttcaaggtgcgggagatgaggggcaagctggccatcggcatcacagccaacttctag

SEQ ID NO: 159717 - DNA, 3375 bp, Artificial Sequence
  Description of Artificial Sequence: Synthetic coding sequence
atgggagaaaatgaagatgagaagcaggcccaggccggccaggtgtttgaaaattttgtgcaggccagcacctgcaagggcaccctgcaggccttcaacatcctgaccaggcacctggacctggaccccctggaccacaggaacttctacagcaagctgaagagcaaggtgaccacctggaaggccaaggccctgtggtacaagctggacaagaggggcagccacaaggagtacaagaggggcaagagctgcaccaacaccaagtgcctgattgtgggcggcggcccctgtggcctgaggacagccatcgagctggcctacctgggcgccaaggtggtggtggtggagaagagggacagcttcagcagaaataatgtgctgcacctgtggcccttcaccatccatgacctgcggggcctgggcgccaagaagttctacggcaagttctgtgccggcagcattgaccacatcagcatccggcagctgcagctgatcctcttcaaggtggccctgatgctgggcgtggagatccacgtgaatgtggagtttgtgaaggtgctggagcccccagaggaccaggagaaccagaagattggctggagggctgagttcctgcccacagaccacagcctgtctgaatttgaatttgatgtgatcatcggggctgatggaagaagaaacaccctggagggcttccggaggaaggagttccggggcaagctggccatcgccatcacagccaacttcatcaacagaaacagcacagctgaggccaaggtggaggagatcagcggcgtggccttcatcttcaaccagaagttcttccaggacctgaaggaggagaccggcatcgacctggagaacatcgtgtactacaaggactgcacccactactttgtgatgacagccaagaagcagagcctgctggacaagggcgtcatcatcaatgactacatcgacacagagatgctgctgtgtgccgagaatgtgaaccaggacaacctgctgtcctatgcccgggaggccgctgactttgccaccaactaccagctgcccagcctggactttgccatgaaccactacggccagccagatgtggccatgtttgacttcacctgcatgtatgcctctgaaaatgctgccctggtgcgggagcggcaggcccaccagctgctggtggccctggtgggggacagcctgctggagcccttctggcccatgggcaccggctgtgcccggggcttcctggccgcctttgacacagcctggatggtgaagtcctggaaccagggcaccccacccctggagctgctggccgagcgggagagcctgtaccgcctgctgccccagaccaccccagagaacatcaacaagaactttgagcagtacaccctggaccccggcacccgctaccccaacctgaacagccactgtgtgcggccccaccaggtgaagcacctgtacatcaccaaggagctggagcactaccccctggagcggctgggctctgtgagaagatctgtgaacctgagcaggaaggagagtgacatccggcccagcaagctgctgacctggtgccagcagcagacagagggctaccagcacgtgaatgtgacagacctgaccacctcctggaggagcggcctggccctgtgtgccatcatccaccgcttccggcctgagctgatcaactttgacagcctgaatgaagatgatgctgtggagaacaaccagctggcctttgatgtggccgagcgggagtttggcatcccccctgtgaccaccgggaaggagatggccagcgcccaggagccagacaagctgtccatggtgatgtacctgagcaagttctatgagctgttccggggcacccccctgcggcctgtggacagctggaggaagaactacggggagaatgctgacctgagcctggccaagagcagcatcagcaacaactacctgaacctgaccttccccaggaagaggaccccccgggtggatggccagacaggagaaaatgacatgaacaagagaagaaggaagggcttcaccaacctggatgagcccagcaacttcagcagccgcagcctgggcagcaaccaggagtgtggcagcagcaaggagggcggcaaccagaacaaggtgaagtccatggccaaccagctgctggccaagtttgaggagagcaccaggaaccccagcctgatgaagcaggagcggcgggtgtctggaattggcaagcctgtgctgtgcagcagcagcggcccccctgtgcacagctgctgccccaagccagaggaggccacccccagccccagcccccccctgaagaggcagttccccagcgtggtggtgacaggccacgtgctgcgggagctgaagcaggtgtctgctggctctgaatgtctgagccggccctggagggcccgggccaagagtgacctgcagctgggcggcacagaaaattttgccaccctgcccagcacccggccccgggcccaggccctgtctggagtgctgtggaggctgcagcaggtggaggagaagatcctgcagaagagggcccagaacctggccaaccgggagttccacaccaagaacatcaaggagaaggccgcccacctggcctccatgtttggacatggagacttcccccagaacaagctgctgagcaagggcctgagccacacccacccccccagcccccccagccggctgcccagcccagaccctgctgccagcagcagccccagcacagtggacagcgccagccctgccaggaaggagaagaagagccccagcggcttccacttccaccccagccacctgaggacagtgcacccccagctgactgtgggcaaggtgtcctctggaattggagctgctgctgaggtgctggtgaacctgtacatgaatgaccaccggcccaaggcccaggccaccagcccagacctggagagcatgaggaagagcttccccctgaacctgggcggcagtgacacctgctacttctgcaagaagagggtgtatgtgatggagcggctgtctgctgagggccacttcttccaccgggagtgcttccgctgcagcatctgtgccaccaccctgcggctggccgcctacacctttgactgtgatgagggcaagttctactgcaagccccacttcatccactgcaagaccaacagcaagcagaggaagagaagagctgagctgaagcagcagcgggaggaggaggccacctggcaggagcaggaggccccccggcgggacacccccacagagagcagctgtgctgtggccgccatcggcaccctggagggcagcccccctgtgcacttcagcctgcctgtgctgcaccccctgctgggctag

SEQ ID NO: 159718 - DNA, 3312 bp, Artificial Sequence
  Description of Artificial Sequence: Synthetic coding sequence
atgggagaaaatgaagatgagaagcaggcccaggccggccaggtgtttgaaaattttgtgcaggccagcacctgcaagggcaccctgcaggccttcaacatcctgaccaggcacctggacctggaccccctggaccacaggaacttctacagcaagctgaagagcaaggtgaccacctggaaggccaaggccctgtggtacaagctggacaagaggggcagccacaaggagtacaagaggggcaagagctgcaccaacaccaagtgcctgattgtgggcggcggcccctgtggcctgaggacagccatcgagctggcctacctgggcgccaaggtggtggtggtggagaagagggacagcttcagcagaaataatgtgctgcacctgtggcccttcaccatccatgacctgcggggcctgggcgccaagaagttctacggcaagttctgtgccggcagcattgaccacatcagcatccggcagctgcagctgatcctcttcaaggtggccctgatgctgggcgtggagatccacgtgaatgtggagtttgtgaaggtgctggagcccccagaggaccaggagaaccagaagattggctggagggctgagttcctgcccacagaccacagcctgtctgaatttgaatttgatgtgatcatcggggctgatggaagaagaaacaccctggagggcttccggaggaaggagttccggggcaagctggccatcgccatcacagccaacttcatcaacagaaacagcacagctgaggccaaggtggaggagatcagcggcgtggccttcatcttcaaccagaagttcttccaggacctgaaggaggagaccggcatcgacctggagaacatcgtgtactacaaggactgcacccactactttgtgatgacagccaagaagcagagcctgctggacaagggcgtcatcatcaatgactacatcgacacagagatgctgctgtgtgccgagaatgtgaaccaggacaacctgctgtcctatgcccgggaggccgctgactttgccaccaactaccagctgcccagcctggactttgccatgaaccactacggccagccagatgtggccatgtttgacttcacctgcatgtatgcctctgaaaatgctgccctggtgcgggagcggcaggcccaccagctgctggtggccctggtgggggacagcctgctggagcccttctggcccatgggcaccggctgtgcccggggcttcctggccgcctttgacacagcctggatggtgaagtcctggaaccagggcaccccacccctggagctgctggccgagcgggagagcctgtaccgcctgctgccccagaccaccccagagaacatcaacaagaactttgagcagtacaccctggaccccggcacccgctaccccaacctgaacagccactgtgtgcggccccaccaggtgaagcacctgtacatcaccaaggagctggagcactaccccctggagcggctgggctctgtgagaagatctgtgaacctgagcaggaaggagagtgacatccggcccagcaagctgctgacctggtgccagcagcagacagagggctaccagcacgtgaatgtgacagacctgaccacctcctggaggagcggcctggccctgtgtgccatcatccaccgcttccggcctgagctgatcaactttgacagcctgaatgaagatgatgctgtggagaacaaccagctggcctttgatgtggccgagcgggagtttggcatcccccctgtgaccaccgggaaggagatggccagcgcccaggagccagacaagctgtccatggtgatgtacctgagcaagttctatgagctgttccggggcacccccctgcggcctgtggacagctggaggaagaactacggggagaatgctgacctgagcctggccaagagcagcatcagcaacaactacctgaacctgaccttccccaggaagaggaccccccgggtggatggccagacaggagaaaatgacatgaacaagagaagaaggaagggcttcaccaacctggatgagcccagcaacttcagcagccgcagcctgggcagcaaccaggagtgtggcagcagcaaggagggcggcaaccagaacaaggtgaagtccatggccaaccagctgctggccaagtttgaggagagcaccaggaaccccagcctgatgaagcaggagcggcgggtgtctggaattggcaagcctgtgctgtgcagcagcagcggcccccctgtgcacagctgctgccccaagccagaggaggccacccccagccccagcccccccctgaagaggcagttccccagcgtggtggtgacaggccacgtgctgcgggagctgaagcaggtgtctgctggctctgaatgtctgagccggccctggagggcccgggccaagagtgacctgcagctgggcggcacagaaaattttgccaccctgcccagcacccggccccgggcccaggccctgtctggagtgctgtggaggctgcagcaggtggaggagaagatcctgcagaagagggcccagaacctggccaaccgggagttccacaccaagaacatcaaggagaaggccgcccacctggcctccatgtttggacatggagacttcccccagaacaagctgctgagcaagggcctgagccacacccacccccccagcccccccagccggctgcccagcccagaccctgctgccagcagcagccccagcacagtggacagcgccagccctgccaggaagctgactgtgggcaaggtgagcagcggcatcggggctgctgctgaggtgctggtgaacctgtacatgaatgaccaccggcccaaggcccaggccaccagcccagacctggagagcatgaggaagagcttccccctgaacctgggcggcagtgacacctgctacttctgcaagaagagggtgtatgtgatggagcggctgtctgctgagggccacttcttccaccgggagtgcttccgctgcagcatctgtgccaccaccctgcggctggccgcctacacctttgactgtgatgagggcaagttctactgcaagccccacttcatccactgcaagaccaacagcaagcagaggaagagaagagctgagctgaagcagcagcgggaggaggaggccacctggcaggagcaggaggccccccggcgggacacccccacagagagcagctgtgctgtggccgccatcggcaccctggagggcagcccccctgtgcacttcagcctgcctgtgctgcaccccctgctgggctag

SEQ ID NO: 159719 - DNA, 2931 bp, Artificial Sequence
  Description of Artificial Sequence: Synthetic coding sequence
atgggagaaaatgaagatgagaagcaggcccaggccggccaggtgtttgaaaattttgtgcaggccagcacctgcaagggcaccctgcaggccttcaacatcctgaccaggcacctggacctggaccccctggaccacaggaacttctacagcaagctgaagagcaaggtgaccacctggaaggccaaggccctgtggtacaagctggacaagaggggcagccacaaggagtacaagaggggcaagagctgcaccaacaccaagtgcctgattgtgggcggcggcccctgtggcctgaggacagccatcgagctggcctacctgggcgccaaggtggtggtggtggagaagagggacagcttcagcagaaataatgtgctgcacctgtggcccttcaccatccatgacctgcggggcctgggcgccaagaagttctacggcaagttctgtgccggcagcattgaccacatcagcatccggcagctgcagctgatcctcttcaaggtggccctgatgctgggcgtggagatccacgtgaatgtggagtttgtgaaggtgctggagcccccagaggaccaggagaaccagaagattggctggagggctgagttcctgcccacagaccacagcctgtctgaatttgaatttgatgtgatcatcggggctgatggaagaagaaacaccctggagggcttccggaggaaggagttccggggcaagctggccatcgccatcacagccaacttcatcaacagaaacagcacagctgaggccaaggtggaggagatcagcggcgtggccttcatcttcaaccagaagttcttccaggacctgaaggaggagaccggcatcgacctggagaacatcgtgtactacaaggactgcacccactactttgtgatgacagccaagaagcagagcctgctggacaagggcgtcatcatcaatgactacatcgacacagagatgctgctgtgtgccgagaatgtgaaccaggacaacctgctgtcctatgcccgggaggccgctgactttgccaccaactaccagctgcccagcctggactttgccatgaaccactacggccagccagatgtggccatgtttgacttcacctgcatgtatgcctctgaaaatgctgccctggtgcgggagcggcaggcccaccagctgctggtggccctggtgggggacagcctgctggagcccttctggcccatgggcaccggctgtgcccggggcttcctggccgcctttgacacagcctggatggtgaagtcctggaaccagggcaccccacccctggagctgctggccgagcgggagagcctgtaccgcctgctgccccagaccaccccagagaacatcaacaagaactttgagcagtacaccctggaccccggcacccgctaccccaacctgaacagccactgtgtgcggccccaccaggtgaagcacctgtacatcaccaaggagctggagcactaccccctggagcggctgggctctgtgagaagatctgtgaacctgagcaggaaggagagtgacatccggcccagcaagctgctgacctggtgccagcagcagacagagggctaccagcacgtgaatgtgacagacctgaccacctcctggaggagcggcctggccctgtgtgccatcatccaccgcttccggcctgagctgatcaactttgacagcctgaatgaagatgatgctgtggagaacaaccagctggcctttgatgtggccgagcgggagtttggcatcccccctgtgaccaccgggaaggagatggccagcgcccaggagccagacaagctgtccatggtgatgtacctgagcaagttctatgagctgttccggggcacccccctgcggcctgtggacagctggaggaagaactacggggagaatgctgacctgagcctggccaagagcagcatcagcaacaactacctgaacctgaccttccccaggaagaggaccccccgggtggatggccagacaggagaaaatgacatgaacaagagaagaaggaagggcttcaccaacctggatgagcccagcaacttcagcagccgcagcctgggcagcaaccaggagtgtggcagcagcaaggagggcggcaaccagaacaaggtgaagtccatggccaaccagctgctggccaagtttgaggagagcaccaggaaccccagcctgatgaagcaggagaagaagagccccagcggcttccacttccaccccagccacctgaggacagtgcacccccaggagagcatgaggaagagcttccccctgaacctgggcggcagtgacacctgctacttctgcaagaagagggtgtatgtgatggagcggctgtctgctgagggccacttcttccaccgggagtgcttccgctgcagcatctgtgccaccaccctgcggctggccgcctacacctttgactgtgatgagggcaagttctactgcaagccccacttcatccactgcaagaccaacagcaagcagaggaagagaagagctgagctgaagcagcagcgggaggaggaggccacctggcaggagcaggaggccccccggcgggacacccccacagagagcagctgtgctgtggccgccatcggcaccctggagggcagccccccaggcatcagcaccagcttcttcaggaaggtgctgggctggcccctgcggctgccccgggacctgtgcaactggatgcagggcctgctgcaggccgccggcctgcacatccgggacaatgcctacaactactgctacatgtatgagctgctgagcctgggcctgcccctgctgtgggccttcagcgaggtgctggccgccatgtaccgggagagcgagggcagcctggagagcatctgcaactgggtgctgcgctgcttccctgtgaagctgaggtag

SEQ ID NO: 159720 - DNA, 363 bp, Artificial Sequence
  Description of Artificial Sequence: Synthetic coding sequence
atgggagaaaatgaagatgagaagcaggcccaggccggccaggtgtttgaaaattttgtgcaggccagcacctgcaagggcaccctgcaggccttcaacatcctgaccaggcacctggacctggaccccctggaccacaggaacttctacagcaagctgaagagcaaggtgaccacctggaaggccaaggccctgtggtacaagctggacaagaggggcagccacaaggagtacaagaggggcaagagctgcaccaacaccaagtgcctgattgtgggcggcggcccctgtggcctgaggacagccatcgagctggcctacctgggcgccaaggtggtggtggtggagaagagggacagctag

SEQ ID NO: 159721 - DNA, 405 bp, Artificial Sequence
  Description of Artificial Sequence: Synthetic coding sequence
atgggagaaaatgaagatgagaagcaggcccaggccggccaggtgtttgaaaattttgtgcaggccagcacctgcaagggcaccctgcaggccttcaacatcctgaccaggcacctggacctggaccccctggaccacaggaacttctacagcaagctgaagagcaaggtgaccacctggaaggccaaggccctgtggtacaagctggacaagaggggcagccacaaggagtacaagaggggcaagagctgcaccaacaccaagtgcctgattgtgggcggcggcccctgtggcctgaggacagccatcgagctggcctacctgggcgccaaggtggtggtggtggagaagagggacagcttcagcagaaataatgtgctgcacctgtggcccttcaccatctag

SEQ ID NO: 159722 - DNA, 267 bp, Artificial Sequence
  Description of Artificial Sequence: Synthetic coding sequence
atgggagaaaatgaagatgagaagcaggcccaggccggccaggtgtttgaaaattttgtgcaggccagcacctgcaagggcaccctgcaggccttcaacatcctgaccaggcacctggacctggaccccctggaccacaggaacttctacagcaagctgaagagcaaggtgaccacctggaaggccaaggccctgtggtacaagctggacaagaggggcagccacaaggagtacaagaggggcaagagctgcaccaacaccaagtag

SEQ ID NO: 159723 - DNA, 12 bp, Artificial Sequence
  Description of Artificial Sequence: Synthetic coding sequence
atgggagagtag

SEQ ID NO: 159724 - DNA, 297 bp, Artificial Sequence
  Description of Artificial Sequence: Synthetic coding sequence
atgggagaaaatgaagatgagaagcaggcccaggccggccaggtgtttgaaaattttgtgcaggccagcacctgcaagggcaccctgcaggccttcaacatcctgaccaggcacctggacctggaccccctggaccacaggaacttctacagcaagctgaagagcaaggtgaccacctggaaggccaaggccctgtggtacaagctggacaagaggggcagccacaaggagtacaagaggggcaagagctgcaccaacaccaagtgcctgattgtgggcggcggcccctgtggctag

SEQ ID NO: 159725 - DNA, 267 bp, Artificial Sequence; identical to SEQ ID NO: 159722
  Description of Artificial Sequence: Synthetic coding sequence

SEQ ID NO: 159726 - DNA, 309 bp, Artificial Sequence
  Description of Artificial Sequence: Synthetic coding sequence
atgggagaaaatgaagatgagaagcaggcccaggccggccaggtgtttgaaaattttgtgcaggccagcacctgcaagggcaccctgcaggccttcaacatcctgaccaggcacctggacctggaccccctggaccacaggaacttctacagcaagctgaagagcaaggtgaccacctggaaggccaaggccctgtggtacaagctggacaagaggggcagccacaaggagtacaagaggggcaagagctgcaccaacaccaagtgcctgattgtgggcggcggcccctgtggcctgaggacagcctag

SEQ ID NO: 159727 - DNA, 2805 bp, Artificial Sequence
  Description of Artificial Sequence: Synthetic coding sequence
atgggagaaaatgaagatgagaagcaggcccaggccggccaggtgtttgaaaattttgtgcaggccagcacctgcaagggcaccctgcaggccttcaacatcctgaccaggcacctggacctggaccccctggaccacaggaacttctacagcaagctgaagagcaaggtgaccacctggaaggccaaggccctgtggtacaagctggacaagaggggcagccacaaggagtacaagaggggcaagagctgcaccaacaccaagtgcctgattgtgggcggcggcccctgtggcctgaggacagccatcgagctggcctacctgggcgccaaggtggtggtggtggagaagagggacagcttcagcagaaataatgtgctgcacctgtggcccttcaccatccatgacctgcggggcctgggcgccaagaagttctacggcaagttctgtgccggcagcattgaccacatcagcatccggcagctgcagctgatcctcttcaaggtggccctgatgctgggcgtggagatccacgtgaatgtggagtttgtgaaggtgctggagcccccagaggaccaggagaaccagaagattggctggagggctgagttcctgcccacagaccacagcctgtctgaatttgaatttgatgtgatcatcggggctgatggaagaagaaacaccctggagggcttccggaggaaggagttccggggcaagctggccatcgccatcacagccaacttcatcaacagaaacagcacagctgaggccaaggtggaggagatcagcggcgtggccttcatcttcaaccagaagttcttccaggacctgaaggaggagaccggcatcgacctggagaacatcgtgtactacaaggactgcacccactactttgtgatgacagccaagaagcagagcctgctggacaagggcgtcatcatcaatgactacatcgacacagagatgctgctgtgtgccgagaatgtgaaccaggacaacctgctgtcctatgcccgggaggccgctgactttgccaccaactaccagctgcccagcctggactttgccatgaaccactacggccagccagatgtggccatgtttgacttcacctgcatgtatgcctctgaaaatgctgccctggtgcgggagcggcaggcccaccagctgctggtggccctggtgggggacagcctgctggagcccttctggcccatgggcaccggctgtgcccggggcttcctggccgcctttgacacagcctggatggtgaagtcctggaaccagggcaccccacccctggagctgctggccgagcgggagagcctgtaccgcctgctgccccagaccaccccagagaacatcaacaagaactttgagcagtacaccctggaccccggcacccgctaccccaacctgaacagccactgtgtgcggccccaccaggtgaagcacctgtacatcaccaaggagctggagcactaccccctggagcggctgggctctgtgagaagatctgtgaacctgagcaggaaggagagtgacatccggcccagcaagctgctgacctggtgccagcagcagacagagggctaccagcacgtgaatgtgacagacctgaccacctcctggaggagcggcctggccctgtgtgccatcatccaccgcttccggcctgagctgatcaactttgacagcctgaatgaagatgatgctgtggagaacaaccagctggcctttgatgtggccgagcgggagtttggcatcccccctgtgaccaccgggaaggagatggccagcgcccaggagccagacaagctgtccatggtgatgtacctgagcaagttctatgagctgttccggggcacccccctgcggcctgtggacagctggaggaagaactacggggagaatgctgacctgagcctggccaagagcagcatcagcaacaactacctgaacctgaccttccccaggaagaggaccccccgggtggatggccagacaggagaaaatgacatgaacaagagaagaaggaagggcttcaccaacctggatgagcccagcaacttcagcagccgcagcctgggcagcaaccaggagtgtggcagcagcaaggagggcggcaaccagaacaaggtgaagtccatggccaaccagctgctggccaagtttgaggagagcaccaggaaccccagcctgatgaagcaggagaagaagagccccagcggcttccacttccaccccagccacctgaggacagtgcacccccagctgactgtgggcaaggtgtcctctggaattggagctgctgctgaggtgctggtgaacctgtacatgaatgaccaccggcccaaggcccaggccaccagcccagacctggagagcatgaggaagagcttccccctgaacctgggcggcagtgacacctgctacttctgcaagaagagggtgtatgtgatggagcggctgtctgctgagggccacttcttccaccgggagtgcttccgctgcagcatctgtgccaccaccctgcggctggccgcctacacctttgactgtgatgagggcaagttctactgcaagccccacttcatccactgcaagaccaacagcaagcagaggaagagaagagctgagctgaagcagcagcgggaggaggaggccacctggcaggagcaggaggccccccggcgggacacccccacagagagcagctgtgctgtggccgccatcggcaccctggagggcagcccccctgtgcacttcagcctgcctgtgctgcaccccctgctgggctag

SEQ ID NO: 159728 - DNA, 1638 bp, Artificial Sequence
  Description of Artificial Sequence: Synthetic coding sequence
atgaggagcagcccagacctgaacagccactgtgtgcggccccaccaggtgaagcacctgtacatcaccaaggagctggagcactaccccctggagcggctgggctctgtgcggcgctctgtgaacctgagcaggaaggagagtgacatccggcccagcaagctgctgacctggtgccagcagcagacagagggctaccagcacgtgaatgtgacagacctgaccacctcctggaggagcggcctggccctgtgtgccatcatccaccgcttccggcctgagctgatcaactttgacagcctgaatgaagatgatgctgtggagaacaaccagctggcctttgatgtggccgagcgggagtttggcatcccccctgtgaccaccgggaaggagatggccagcgcccaggagccagacaagctgtccatggtgatgtacctgagcaagttctatgagctgttccggggcacccccctgcggcctgtggacagctggaggaagaactatggagaaaatgctgacctgagcctggccaagagcagcatcagcaacaactacctgaacctgaccttccccaggaagaggaccccccgggtggatggccagacaggagaaaatgacatgaacaagagaagaaggaagggcttcaccaacctggatgagcccagcaacttcagcagccgcagcctgggcagcaaccaggagtgtggcagcagcaaggagggcggcaaccagaacaaggtgaagtccatggccaaccagctgctggccaagtttgaggagagcaccaggaaccccagcctgatgaagcaggagaagaagagccccagcggcttccacttccaccccagccacctgaggacagtgcacccccagctgactgtgggcaaggtgagcagcggcatcggggctgctgctgaggtgctggtgaacctgtacatgaatgaccaccggcccaaggcccaggccaccagcccagacctggagagcatgaggaagagcttccccctgaacctgggcggcagtgacacctgctacttctgcaagaagagggtgtatgtgatggagcggctgtctgctgagggccacttcttccaccgggagtgcttccgctgcagcatctgtgccaccaccctgcggctggccgcctacacctttgactgtgatgagggcaagttctactgcaagccccacttcatccactgcaagaccaacagcaagcagaggaagagaagagctgagctgaagcagcagcgggaggaggaggccacctggcaggagcaggaggccccccggcgggacacccccacagagagcagctgtgctgtggccgccatcggcaccctggagggcagccccccaggcatcagcaccagcttcttcaggaaggtgctgggctggcccctgcggctgccccgggacctgtgcaactggatgcagggcctgctgcaggccgccggcctgcacatccgggacaatgcctacaactactgctacatgtatgagctgctgagcctgggcctgcccctgctgtgggccttcagcgaggtgctggccgccatgtaccgggagagcgagggcagcctggagagcatctgcaactgggtgctgcgctgcttccctgtgaagctgaggtag

SEQ ID NO: 159729 - DNA, 3273 bp, Artificial Sequence
  Description of Artificial Sequence: Synthetic coding sequence
atggccaccctgctgagccacccccagcagaggcctcccttcctgcggcaggccatcaagatcagaagaagaagagtgcgggacctgcaggaccccccaccccagatggcccctgagatccagccccccagccaccacttcagccctgagcagagggccctgctgtatgaagatgccctgtacacagtgctgcaccggctgggccaccctgagcccaaccacgtgacagaggccagcgagctgctgcgctacctgcaggaggccttccacgtggagcctgaggagcaccagcagaccctgcagagggtgcgggagctggagaagcccatcttctgcctgaaggccaccgtgaagcaggccaagggcatcctgggcaaggatgtgtctggcttcagtgacccctactgcctgctgggcatcgagcagggcgtgggcgtgcctgggggcagccctggcagccgccaccggcagaaggctgtggtgcgccacaccatccctgaggaggagacccacaggacccaggtgatcacccagaccctgaaccctgtgtgggatgagaccttcatcctggagtttgaggacatcaccaatgccagcttccacctggacatgtgggacctggacacagtggagagcgtgcggcagaagctgggggagctgacagacctgcacggcctgcggcgcatcttcaaggaggccaggaaggacaagggccaggatgacttcctgggcaatgtggtgctgcggctgcaggacctgcgctgccgggaggaccagtggtaccccctggagcccaggacagagacctacccagaccggggccagtgccacctgcagttccagctgatccacaagaggcgggccaccagcgccagccgcagccagcccagctacacagtgcacctgcacctgctgcagcagctggtgtcccatgaggtgacccagcacgaggccggcagcacctcctgggatggcagcctgagcccccaggccgccaccgtgctcttcctgcacgccacccagaaggacctgagtgacttccaccagagcatggcccagtggctggcctacagccggctgtaccagagcctggagttccccagcagctgcctgctgcaccccatcaccagcattgagtaccagtggatccagggccgcctgaaggccgagcagcaggaggagctggccgccagcttcagcagcctgctgacctacggcctgagcctcatccgccgcttccgctctgtgttccccctgtctgtgtctgacagccctgcccggctgcagagcctgctgcgggtgctggtgcagatgtgcaagatgaaggccttcggggagctgtgccccaacacagcccccctgccccagctggtgacagaggccctgcagacaggcaccacagagtggttccacctgaagcagcagcaccaccagcccatggtgcagggcatccctgaggccggcaaggccctgctgggcctggtgcaggatgtgattggagacctgcaccagtgccagaggacctgggacaagatcttccacaacaccctgaagatccacctgttctccatggccttccgggagctgcagtggctggtggccaagagggtgcaggaccacaccaccgtggtgggagatgtggtgtccccagagatgggagagagcctcttccagctgtacatcagcctgaaggagctgtgccagctgaggatgagcagcagcgagagagatggagtgctggccctggacaacttccaccgctggttccagcctgccatccccagctggctgcagaagacctacaatgaggccctggcccgggtgcagagagctgtgcagatggatgagctggtgcccctgggggagctgaccaagcacagcaccagcgctgtggacctgagcacctgctttgcccagatcagccacacagcccggcagctggactggccagaccctgaggaggccttcatgatcaccgtgaagtttgtggaggacacctgccgcctggccctggtgtactgcagcctcatcaaggcccgggcccgggagctgagcagcggccagaaggaccagggccaggccgccaacatgctgtgtgtggtggtgaatgacatggagcagctgcggctggtgattggcaagctgcctgcccagctggcctgggaggccctggagcagagggtgggcgctgtgctggagcagggccagctgcagaacaccctgcacgcccagctgcagagcgccctggccggcctgggccacgagatcagaactggagtgaggaccctggccgagcagctggaggtgggcatcgccaagcacatccagaagctggtgggcgtgcgggagagcgtgctgcctgaagatgccatcctgcccctgatgaagttcctggaggtggagctgtgctacatgaacaccaacctggtgcaggagaacttcagcagcctgctgaccctgctgtggacccacaccctgactgtgctggtggaggccgccgccagccagaggagcagcagcctggccagcaaccggctgaagatcgccctgcagaacctggagatctgcttccacgccgagggctgcggcctgccccccaaggccctgcacacagccaccttccaggccctgcagagggacctggagctgcaggccgccagcagccgggagctgatcaggaagtacttctgcagccgcatccagcagcaggccgagaccaccagcgaggagctgggcgctgtgacagtgaaggccagctaccgggccagcgagcagaagctgcgggtggagctgctgagcgccagcagcctgctgcccctggacagcaatggcagcagtgacccctttgtgcagctgaccctggagcccaggcatgagttccctgagctggccgcccgggagacccagaagcacaagaaggacctgcaccccctgtttgatgagacctttgagttcctggtgcctgctgagccctgcaggaaggccggggcctgcctgctgctgactgtgctggactatgacaccctgggcgcagatgacctggagggggaggccttcctgcccctgcgggaggtgcccggcctgagcggcagcgaggagcccggggaggtgccccagacccggctgcccctgacctacccagcccccaacggggaccccatcctgcagctgctggagggcaggaagggggaccgggaggcccaggtgtttgtgcggctgcggcggcaccgggccaagcaggccagccagcacgccctgcggcctgccccctag

SEQ ID NO: 159730 - DNA, 2847 bp, Artificial Sequence
  Description of Artificial Sequence: Synthetic coding sequence
atggaggagaggaagcatgagaccatgaacccagcccacgtgctgtttgacagatttgtgcaggccaccacctgcaagggcaccctgaaggccttccaggagctgtgtgaccacctggagctgaagcccaaggactaccgctccttctaccacaagctgaagagcaagctgaactactggaaggccaaggccctgtgggccaagctggacaagaggggcagccacaaggactacaagaagggcaaggcctgcaccaacaccaagtgcctgatcatcggggccggcccctgtggcctgaggacagccatcgacctgagcctgctgggcgccaaggtggtggtgattgagaagagagatgccttcagcagaaataatgtgctgcacctgtggcccttcaccatccatgacctgcggggcctgggcgccaagaagttctacggcaagttctgtgccggggccatcgaccacatcagcatccggcagctgcagctgatcctgctgaaggtggccctgatcctgggcatcgagatccacgtgaatgtggagttccagggcctcatccagcccccagaggaccaggagaatgaaagaattggctggagggccctggtgcaccccaagacccaccctgtgtctgaatatgaatttgaggtgatcattggaggagatggaagaagaaacaccctggagggcttccggaggaaggagttccggggcaagctggccatcgccatcacagccaacttcatcaacagaaacaccacagctgaggccaaggtggaggagatcagcggcgtggccttcatcttcaaccagaagttcttccaggagctgcgggaggccaccggcatcgacctggagaacatcgtgtactacaaggatgacacccactactttgtgatgacagccaagaagcagagcctgctggacaagggcgtcatcctgcatgactatgctgacacagagctgctgctgagccgggagaatgtggaccaggaggccctgctgtcctatgcccgggaggccgctgacttcagcacccagcagcagctgcccagcctggactttgccatcaaccactacggccagccagatgtggccatgtttgacttcacctgcatgtatgcctctgaaaatgctgccctggtgcgggagcagaatggccaccagctgctggtggccctggtgggggacagcctgctggagcccttctggcccatgggcactggaattgcccggggcttcctggccgccatggattctgcctggatggtgcgctcctggagcctgggcaccagccccctggaggtgctggccgagcgggagagcatctaccgcctgctgccccagaccaccccagaaaatgtgtccaagaacttcagccagtacagcattgatcctgtgacccgctaccccaacatcaacgtgaacttcctgcggcccagccaggtgcgccacctgtatgacaccggggagaccaaggacatccacctggagatggagagcctggtgaacagcaggaccacccccaagctgaccagaaatgaatctgtggcccggagcagcaagctgctgggctggtgccagaggcagacagatggctacgccggcgtgaatgtgacagacctgaccatgtcctggaagagcggcctggccctgtgtgccatcatccaccgctacagaccagacctgattgactttgacagcctggatgagcagaatgtggagaagaacaaccagctggcctttgatattgctgagaaggagctgggcatcagccccatcatgaccgggaaggagatggcctctgtgggggagccagacaagctgtccatggtgatgtacctgacccagttctatgagatgttcaaggacagcctgcccagcagtgacaccctggacctgaatgctgaggagaaggctgtgctgattgccagcaccaggagccccatctccttcctgagcaagctgggccagaccatcagcaggaagaggagccccaaggacaagaaggagaaggacctggatggagctgggaagaggaggaagaccagccagagcgaggaggaggaggccccccggggccacagaggagagcggcccaccctggtgtccaccctgacagacaggaggatggatgtggccgtgggcaaccagaacaaggtgaagtacatggccacccagctgctggccaagtttgaagaaaatgccccagcccagagcatcggcatccggcggcagggctccatgaagaaggagttcccccagaacctgggcggcagtgacacctgctacttctgccagaagagggtgtatgtgatggagcggctgtctgctgagggcaagttcttccacaggagctgcttcaagtgtgagtactgtgccaccaccctgcggctgagcgcctatgcctatgacattgaagatggcaagttctactgcaagccccactactgctaccgcctgagcggctacgcccagaggaagaggcctgctgtggcccccctgagcggcaaggaggccaagggccccctgcaggatggagccaccacagatgccaacggccgggccaatgctgtggccagcagcacagagaggaccccaggcagcggcgtgaatggcctggaggagcccagcatcgccaagaggctgcggggcaccccagagagaattgagctggagaactaccgcctgagcctgcggcaggccgaggccctgcaggaggtgcctgaggagacccaggccgagcacaacctgagctctgtgctggacacaggagcagaagaagatgtggccagccgcagcgccaggagagctgctggccggcccccagccacccggccctag

SEQ ID NO: 159731 - DNA, 2901 bp, Artificial Sequence
  Description of Artificial Sequence: Synthetic coding sequence
atggaggagaggaagcatgagaccatgaacccagcccacgtgctgtttgacagatttgtgcaggccaccacctgcaagggcaccctgaaggccttccaggagctgtgtgaccacctggagctgaagcccaaggactaccgctccttctaccacaagctgaagagcaagctgaactactggaaggccaaggccctgtgggccaagctggacaagaggggcagccacaaggactacaagaagggcaaggcctgcaccaacaccaagtgcctgatcatcggggccggcccctgtggcctgaggacagccatcgacctgagcctgctgggcgccaaggtggtggtgattgagaagagagatgccttcagcagaaataatgtgctgcacctgtggcccttcaccatccatgacctgcggggcctgggcgccaagaagttctacggcaagttctgtgccggggccatcgaccacatcagcatccggcagctgcagctgatcctgctgaaggtggccctgatcctgggcatcgagatccacgtgaatgtggagttccagggcctcatccagcccccagaggaccaggagaatgaaagaattggctggagggccctggtgcaccccaagacccaccctgtgtctgaatatgaatttgaggtgatcattggaggagatggaagaagaaacaccctggagggcttccggaggaaggagttccggggcaagctggccatcgccatcacagccaacttcatcaacagaaacaccacagctgaggccaaggtggaggagatcagcggcgtggccttcatcttcaaccagaagttcttccaggagctgcgggaggccaccggcatcgacctggagaacatcgtgtactacaaggatgacacccactactttgtgatgacagccaagaagcagagcctgctggacaagggcgtcatcctgcatgactatgctgacacagagctgctgctgagccgggagaatgtggaccaggaggccctgctgtcctatgcccgggaggccgctgacttcagcacccagcagcagctgcccagcctggactttgccatcaaccactacggccagccagatgtggccatgtttgacttcacctgcatgtatgcctctgaaaatgctgccctggtgcgggagcagaatggccaccagctgctggtggccctggtgggggacagcctgctggagcccttctggcccatgggcactggaattgcccggggcttcctggccgccatggattctgcctggatggtgcgctcctggagcctgggcaccagccccctggaggtgctggccgagcgggagagcatctaccgcctgctgccccagaccaccccagaaaatgtgtccaagaacttcagccagtacagcattgatcctgtgacccgctaccccaacatcaacgtgaacttcctgcggcccagccaggtgcgccacctgtatgacaccggggagaccaaggacatccacctggagatggagagcctggtgaacagcaggaccacccccaagctgaccagaaatgaatctgtggcccggagcagcaagctgctgggctggtgccagaggcagacagatggctacgccggcgtgaatgtgacagacctgaccatgtcctggaagagcggcctggccctgtgtgccatcatccaccgctacagaccagacctgattgactttgacagcctggatgagcagaatgtggagaagaacaaccagctggcctttgatattgctgagaaggagctgggcatcagccccatcatgaccgggaaggagatggcctctgtgggggagccagacaagctgtccatggtgatgtacctgacccagttctatgagatgttcaaggacagcctgcccagcagtgacaccctggacctgaatgctgaggagaaggctgtgctgattgccagcaccaggagccccatctccttcctgagcaagctgggccagaccatcagcaggaagaggagccccaaggacaagaaggagaaggacctggatggagctgggaagaggaggaagaccagccagagcgaggaggaggaggccccccggggccacagaggagagcggcccaccctggtgtccaccctgacagacaggaggatggatgtggccgtgggcaaccagaacaaggtgaagtacatggccacccagctgctggccaagtttgaagaaaatgccccagcccagagcatcggcatccggcggcagggctccatgaagaaggagttcccccagaacctgggcggcagtgacacctgctacttctgccagaagagggtgtatgtgatggagcggctgtctgctgagggcaagttcttccacaggagctgcttcaagtgtgagtactgtgccaccaccctgcggctgagcgcctatgcctatgacattgaagatggcaagttctactgcaagccccactactgctaccgcctgagcggctacgcccagaggaagaggcctgctgtggcccccctgagcggcaaggaggccaagggccccctgcaggatggagccaccacagatgccaacggccgggccaatgctgtggccagcagcacagagaggaccccaggcagcggcgtgaatggcctggaggagcccagcatcgccaagaggctgcggggcaccccagagagaattgagctggagaactaccgcctgagcctgcggcaggccgaggccctgcaggaggtgcctgaggagacccaggccgagcacaacctgagctctgtgctggacacaggagcagaagaagatgtggccagccgggactgggtgagcccctggctgcccaggatggtgagcaacagctgggcccagatgatccaccccccccagccccccaccgtgctgggcagccagatgtag

SEQ ID NO: 159732 - DNA, 4713 bp, Artificial Sequence
  Description of Artificial Sequence: Synthetic coding sequence
atgtctgacagcctgtggacagccctgagcaacttctccatgcccagcttccctgggggctccatgttccggaggaccaagagctgcaggaccagcaacaggaagagcctcatcctgaccagcaccagccccaccctgccccggccccacagccccctgcccggccacctgggcagcagccccctggacagccccaggaacttcagccccaacaccccagcccacttctcctttgccagcagccggcgggcagatggaagacgctggagcctggccagcctgcccagcagcggctacggcaccaacacccccagcagcacagtgagcagcagctgcagcagccaggagcggctgcaccagctgccctaccagcccaccgtggatgagctgcacttcctgagcaagcacttcggcagcacagagagcatcacagatgaagatggcggccgccgcagccctgctgtgcggcccaggagccgcagcctgagccctggccgcagccccagcagctatgacaatgaaattgtgatgatgaaccacgtgtacaaggagcgcttccccaaggccacagcccagatggaggagaagctgcgggacttcacccgggcctatgagccagacagcgtgctgcccctggctgatggagtgctgtccttcatccaccaccagatcatcgagctggcccgggactgcctgaccaagagcagagatggcctcatcaccaccgtgtacttctatgagctgcaggagaacctggagaagctgctgcaggatgcctatgaaagaagtgagagcctggaggtggcctttgtgacccagctggtgaagaagctgctgatcatcatcagcaggcctgcccggctgctggagtgcctggagttcaaccctgaggagttctaccacctgctggaggccgctgagggccacgccaaggagggccacctggtgaagacagacatcccccgctacatcatccggcagctgggcctgacccgggaccccttcccagatgtggtgcacctggaggagcaggacagcggcggcagcaacaccccagagcaggatgacctgtctgagggccgcagcagcaaggccaagaagcccccaggagaaaatgactttgacaccatcaagctgatcagcaatggagcctatggagctgtgtacctggtgcgccaccgggacacccggcagagatttgccatgaagaagatcaacaagcagaacctgatcctgaggaaccagatccagcaggcctttgtggagcgggacatcctgacctttgctgagaacccctttgtggtgggcatgttctgcagctttgagacccggcggcacctgtgcatggtgatggagtatgtggagggcggggactgtgccaccctgctgaagaacatcggggccctgcctgtggagatggccaggatgtactttgctgagaccgtgctggccctggagtacctgcacaactatggaattgtgcaccgggacctgaagccagacaacctgctgatcacctccatgggccacatcaagctgacagactttggcctgagcaagatgggcctgatgagcctgaccaccaacctgtatgagggccacatcgagaaggatgcccgggagttcctggacaagcaggtgtgtggcaccccagagtacatcgcccctgaggtgatcctgcggcagggctacggcaagcctgtggactggtgggccatgggcatcatcctgtatgagttcctggtgggctgtgtgcccttcttcggggacaccccagaggagctgtttggccaggtgatcagtgatgacatcctgtggccagaaggagatgaggccctgcccacagaggcccagctgctgatcagcagcctgctgcagaccaaccccctggtgcggctgggcgccggcggggcctttgaggtgaagcagcacagcttcttccgggacctggactggacaggcctgctgcggcagaaggccgagttcatcccccacctggagagtgaagatgacaccagctactttgacaccaggagtgaccgctaccaccacgtgaacagctatgatgaagatgacaccacagaggaggagcctgtggagatccggcagttcagcagctgcagcccccgcttcagcaaggtgtacagctccatggagcagctgagccagcacgagcccaagacccctgtggccgctgctggcagcagcaagcgggagcccagcaccaagggccctgaggagaaggtggccggcaagcgggagggcctgggcggcctgaccctgcgggagaagacctggaggggcggcagccctgagatcaagcgcttcagcgccagcgaggccagcttcctggagggggaggccagcccccccctgggcgcccggcggcgcttcagcgccctgctggagcccagccgcttcagcgccccccaggaggatgaagatgaggcccggctgcggcggcccccccggcccagcagtgaccctgctggcagcctggatgcccgggcccccaaggaggagacccagggcgagggcaccagcagcgctggggacagcgaggccacagaccggcccaggcctggggacctgtgcccccccagcaaggatggagatgccagcggcccccgggccaccaatgacctggtgctgcggcgggcccggcaccagcagatgtctggagatgtggccgtggagaagaggcccagcaggactggaggcaaggtgatcaagagcgccagcgccacagccctgtctgtgatgatcccagctgtggacccccacggcagcagccccctggccagccccatgagccccaggagcctgagcagcaaccccagcagccgggacagcagccccagccgggactacagccctgctgtgtctggcctgcggagccccatcaccatccagaggtctgggaagaagtatggcttcaccctgcgggccatccgggtgtacatgggagacacagatgtgtacagcgtgcaccacatcgtgtggcacgtggaggagggcggccctgcccaggaggccggcctgtgtgccggggacctgatcacccacgtgaatggagagcctgtgcacggcatggtgcaccctgaggtggtggagctgatcctgaagagcggcaacaaggtggccgtgaccaccaccccatttgagaacaccagcatcagaattggccctgcccggcgcagcagctacaaggccaagatggcccggaggaacaagaggccttctgccaaggagggccaggagagcaagaagaggagcagcctcttcaggaagatcaccaagcagagcaacctgctgcacaccagccgcagcctgagcagcctgaacagaagcctgagcagcagtgacagcctgcccggcagccccacccacggcctgcctgcccggagccccacccacagctaccgcagcaccccagattctgcctacctgggcgccagcagccagagcagcagccctgccagcagcacccccaacagccctgccagcagcgccagccaccacatccggcccagcaccctgcacggcctgagccccaagctgcaccggcagtacagaagtgcccgctgcaagtctgctggcaacatccccctgagccccctggcccacacccccagccccacccaggccagccccccacccctgcccggccacacagtgggcagcagccacaccacccagagcttccctgccaagctgcacagcagcccccctgtggtgcggccccggcccaagtctgctgagcccccaagaagccccctgctgaagagggtgcagagcgctgagaagctgggcgccagcctgtctgctgacaagaagggggccctgaggaagcacagcctggaggtgggccacccagacttcaggaaggacttccatggagagctggccctgcacagcctggccgagagtgatggagagaccccacctgtggagggcctgggcgccccccggcaggtggccgtgcggcggctgggccggcaggagagccccctgagcctgggcgctgaccccctgctgcctgagggcgccagcaggcctcctgtgagcagcaaggagaaggagagccctggaggagctgaggcctgcaccccaccccgggccaccaccccaggcggccgcaccctggagagagatgtgggctgcaccaggcaccagagcgtgcagacagaagatggcaccggcggcatggcccgggctgtggccaaggccgccctgagccctgtgcaggagcacgagaccggccgccgcagcagcagcggggaggccggcacccccctggtgcccatcgtggtggagcccgcccggcctggggccaaggctgtggtgccccagcccctgggcgctgacagcaagggcctgcaggagcccgcccccctggcccccagcgtgcctgaggccccccggggccgggagcgctgggtgctggaggtggtggaggagaggaccaccctgagcggccccaggagcaagccagccagccccaagctgagccctgagccccagacccccagcctggccccagccaagtgcagcgcccccagcagcgctgtgacccctgtgcccccagccagcctgctgggcagcggcaccaagccccaggtgggcctgaccagccgctgcccagctgaggccgtgcccccagctggcctgaccaagaagggcgtgagcagccctgcccctcctggcccctag

SEQ ID NO: 159733 - DNA, 2178 bp, Artificial Sequence
  Description of Artificial Sequence: Synthetic coding sequence
atgtctgacagcctgtggacagccctgagcaacttctccatgcccagcttccctgggggctccatgttccggaggaccaagagctgcaggaccagcaacaggaagagcctcatcctgaccagcaccagccccaccctgccccggccccacagccccctgcccggccacctgggcagcagccccctggacagccccaggaacttcagccccaacaccccagcccacttctcctttgccagcagccggcgggcagatggaagacgctggagcctggccagcctgcccagcagcggctacggcaccaacacccccagcagcacagtgagcagcagctgcagcagccaggagcggctgcaccagctgccctaccagcccaccgtggatgagctgcacttcctgagcaagcacttcggcagcacagagagcatcacagatgaagatggcggccgccgcagccctgctgtgcggcccaggagccgcagcctgagccctggccgcagccccagcagctatgacaatgaaattgtgatgatgaaccacgtgtacaaggagcgcttccccaaggccacagcccagatggaggagaagctgcgggacttcacccgggcctatgagccagacagcgtgctgcccctggctgatggagtgctgtccttcatccaccaccagatcatcgagctggcccgggactgcctgaccaagagcagagatggcctcatcaccaccgtgtacttctatgagctgcaggagaacctggagaagctgctgcaggatgcctatgaaagaagtgagagcctggaggtggcctttgtgacccagctggtgaagaagctgctgatcatcatcagcaggcctgcccggctgctggagtgcctggagttcaaccctgaggagttctaccacctgctggaggccgctgagggccacgccaaggagggccacctggtgaagacagacatcccccgctacatcatccggcagctgggcctgacccgggaccccttcccagatgtggtgcacctggaggagcaggacagcggcggcagcaacaccccagagcaggatgacctgtctgagggccgcagcagcaaggccaagaagcccccaggagaaaatgactttgacaccatcaagctgatcagcaatggagcctatggagctgtgtacctggtgcgccaccgggacacccggcagagatttgccatgaagaagatcaacaagcagaacctgatcctgaggaaccagatccagcaggcctttgtggagcgggacatcctgacctttgctgagaacccctttgtggtgggcatgttctgcagctttgagacccggcggcacctgtgcatggtgatggagtatgtggagggcggggactgtgccaccctgctgaagaacatcggggccctgcctgtggagatggccaggatgtactttgctgagaccgtgctggccctggagtacctgcacaactatggaattgtgcaccgggacctgaagccagacaacctgctgatcacctccatgggccacatcaagctgacagactttggcctgagcaagatgggcctgatgagcctgaccaccaacctgtatgagggccacatcgagaaggatgcccgggagttcctggacaagcaggtgtgtggcaccccagagtacatcgcccctgaggtgatcctgcggcagggctacggcaagcctgtggactggtgggccatgggcatcatcctgtatgagttcctggtgggctgtgtgcccttcttcggggacaccccagaggagctgtttggccaggtgatcagtgatgacatcctgtggccagaaggagatgaggccctgcccacagaggcccagctgctgatcagcagcctgctgcagaccaaccccctggtgcggctgggcgccggcggggcctttgaggtgaagcagcacagcttcttccgggacctggactggacaggcctgctgcggcagaaggccgagttcatcccccacctggagagtgaagatgacaccagctactttgacaccaggagtgaccgctaccaccacgtgaacagctatgatgaagatgacaccacagaggaggagcctgtggagatccggcagttcagcagctgcagcccccgcttcagcaaggtgtacagcctgcgcatccacatgtacacctacaagtag

SEQ ID NO: 159734 - DNA, 5397 bp, Artificial Sequence
  Description of Artificial Sequence: Synthetic coding sequence
atgaagaggagccgctgccgggaccggccccagcccccacctccagacagaagagaagatggagtgcagagagctgctgagctgagccagagcctgcccccaagaagaagagcccctcctggccggcagaggctggaggagaggactggacctgctggccctgagggcaaggagcaggatgtggtgactggagtgagccccctgctcttcaggaagctgagcaacccagacatcttcagcagcacaggcaaggtgaagctgcagaggcagctgagccaggatgactgcaagctgtggaggggcaacctggccagcagcctgagcggcaagcagctgctgcccctgagcagctctgtgcacagctctgtgggccaggtgacctggcagagcagtggagaggccagcaacctggtgaggatgaggaaccagagcctgggccagagcgcccccagcctgacagctggcctgaaggagctgagcctgccccggcggggcagcttctgcaggaccagcaacaggaagagcctgattgtgaccagcagcaccagccccaccctgccccggccccacagccccctgcacggccacactggaaacagccccctggacagccccaggaacttcagccccaatgccccagcccacttctcctttgtgcctgcccggaggacagatggaagacgctggagcctggccagcctgcccagcagcggctacggcaccaacacccccagcagcacagtgagcagcagctgcagcagccaggagaagctgcaccagctgcccttccagcccacagcagatgagctgcacttcctgaccaagcacttcagcacagaatctgtgcctgatgaggagggccggcagagccctgccatgaggcccaggagccgcagcctgagccctggccgcagccctgtgtcctttgattctgagatcatcatgatgaaccacgtgtacaaggagcgcttccccaaggccacagcccagatggaggagcggctggccgagttcatcagcagcaacaccccagacagcgtgctgcccctggctgatggagccctgtccttcatccaccaccaggtgattgagatggcccgggactgcctggacaagagccgcagcggcctcatcaccagccagtacttctatgagctgcaggacaacctggagaagctgctgcaggatgcccacgagaggtctgagagcagcgaggtggcctttgtgatgcagctggtgaagaagctgatgatcatcatcgcccggcctgcccggctgctggagtgcctggagtttgatcctgaggagttctaccacctgctggaggccgctgagggccacgccaaggagggccagggcatcaagtgtgacatcccccgctacatcgtgtcccagctgggcctgacccgggaccccctggaggagatggcccagctgagcagctgtgacagcccagacaccccagagacagatgacagcattgagggccatggagccagcctgcccagcaagaagacccccagcgaggaggactttgagaccatcaagctgatcagcaatggagcctatggagctgtgttcctggtgcgccacaagagcacccggcagagatttgccatgaagaagatcaacaagcagaacctgatcctgaggaaccagatccagcaggcctttgtggagcgggacatcctgacctttgctgagaacccctttgtggtgtccatgttctgcagctttgacaccaagaggcacctgtgcatggtgatggagtatgtggagggcggggactgtgccaccctgctgaagaacatcggggccctgcctgtggacatggtgcggctgtactttgctgagaccgtgctggccctggagtacctgcacaactatggaattgtgcaccgggacctgaagccagacaacctgctgatcacctccatgggccacatcaagctgacagactttggcctgagcaagattggcctgatgagcctgaccaccaacctgtatgagggccacatcgagaaggatgcccgggagttcctggacaagcaggtgtgtggcaccccagagtacatcgcccctgaggtgatcctgcggcagggctacggcaagcctgtggactggtgggccatgggcatcatcctgtatgagttcctggtgggctgtgtgcccttcttcggggacaccccagaggagctgtttggccaggtgatcagtgatgagatcgtgtggccagaaggagatgaggccctgcccccagatgcccaggacctgaccagcaagctgctgcaccagaaccccctggagcggctgggcactggaagtgcctatgaggtgaagcagcaccccttcttcaccggcctggactggacaggcctgctgcggcagaaggccgagttcatcccccagctggagagtgaagatgacaccagctactttgacaccaggtctgagcgctaccaccacatggattctgaagatgaggaggaggtgtctgaagatggctgcctggagatccggcagttcagcagctgcagcccccgcttcaacaaggtgtacagctccatggagcggctgagcctgctggaggagaggaggaccccaccacccaccaagaggagcctgtctgaggagaaggaggaccacagtgatggcctggccggcctgaagggccgggaccgctcctgggtgattggcagccctgagatcctgaggaagaggctgtctgtgtctgagagcagccacacagaaagtgacagcagcccccccatgacagtgagaagacgctgcagcggcctgctggatgccccccgcttccctgagggccctgaggaggccagcagcaccctgcggcggcagccccaggagggcatctgggtgctgaccccaccttctggagagggcgtgtctggccctgtgacagagcacagcggggagcagaggcccaagctggatgaggaggccgtgggccgcagcagcggcagcagccctgccatggagacccggggccggggcaccagccagctggccgagggcgccacagccaaggccatcagtgacctggccgtgcggcgggcccggcaccggctgctgagcggggacagcacagagaagaggacagcccggcctgtgaacaaggtgatcaagagcgccagcgccacagccctgagcctgctgatccccagcgagcaccacacctgcagccccctggccagccccatgagcccccacagccagagcagcaaccccagcagccgggacagcagccccagccgggacttcctgcctgccctgggctccatgaggcctcccatcatcatccaccgggccggcaagaagtatggcttcaccctgcgggccatccgggtgtacatgggagacagtgatgtgtacacagtgcaccacatggtgtggcacgtggaggatggcggccctgccagcgaggccggcctgcggcagggcgacctgatcacccacgtgaatggagagcctgtgcacggcctggtgcacacagaggtggtggagctgatcctgaagagcggcaacaaggtggccatcagcaccacccccctggagaacaccagcatcaaggtgggccctgccaggaagggcagctacaaggccaagatggcccggcgcagcaagaggagccggggcaaggatggccaggagagcaggaagaggagcagcctcttcaggaagatcaccaagcaggccagcctgctgcacaccagccgcagcctgagcagcctgaacagaagcctgagcagtggagagagcggccctggcagccccacccacagccacagcctgagccccaggagccccacccagggctacagagtgaccccagatgctgtgcacagcgtgggcggcaacagcagccagagcagcagccccagcagctctgtgcccagcagccctgctggcagcggccacacccggcccagcagcctgcacggcctggcccccaagctgcagaggcagtaccgcagccccaggaggaagtctgctggcagcatccccctgagccccctggcccacacccccagccccccaccacccacagccagcccccagaggagccccagccccctgagcggccacgtggcccaggccttccccaccaagctgcacctgagcccccccctgggccggcagctgagccggcccaagtctgctgagccccccaggagccccctgctgaagagggtgcagagcgctgagaagctggccgccgccctggccgccagcgagaagaagctggccaccagcaggaagcacagcctggacctgccccacagcgagctgaagaaggagctgcccccccgggaggtgagccccctggaggtggtgggcgcccggtctgtgctgtctggaaaaggagccctgcctggaaaaggagtgctgcagcctgcccccagccgggccctgggcaccctgcggcaggacagagctgagcggcgggagagcctgcagaagcaggaggccatccgggaggtggacagcagtgaagatgacacagaggagggccctgagaacagccagggcgcccaggagctgagcctggccccccaccctgaggtgtcccagagcgtggcccccaagggggccggggagagcggggaggaggaccccttccccagccgggaccccaggagcctgggccccatggtgcccagcctgctgaccggcatcaccctgggcccccccaggatggagagccccagcggcccccaccggcggctgggcagcccccaggccatcgaggaggccgccagcagcagcagcgctggccccaacctgggccagagcggggccacagaccccatccccccagagggctgctggaaggcccagcacctgcacacccaggccctgacagccctgagccccagcaccagcggcctgacccccaccagcagctgcagcccccccagcagcaccagcggcaagctgtccatgtggagctggaagagcctcatcgagggccctgaccgggccagccccagcaggaaggccaccatggccggcggcctggccaacctgcaggacctggagaacaccaccccagcccagcccaagaacctgagcccccgggagcagggcaagacccagcccccatctgccccccggctggcccaccccagctatgaggaccccagccagggctggctgtgggagagtgaatgtgcccaggccgtgaaggaggaccctgccctgagcatcacccaggtgcctgatgccagcggggaccggcggcaggatgtgccctgccggggctgccccctgacccagaagtctgagcccagcctgcggcggggccaggagcccggcggccaccagaagcaccgggacctggccctggtgcctgatgagctgctgaagcagacctag

SEQ ID NO: 159735 - DNA, 2379 bp, Artificial Sequence
  Description of Artificial Sequence: Synthetic coding sequence
atgttcagccccaccagcgccccagccctcttcctgaccaaggtgcccttctctgctgactgtgccctggccaccagccccctggccatcttcctgaacccccgggcccacagcagccctggcaccccctgcagcagccggcccctgccctggagctgcaggaccagcaacaggaagagcctcatcgtgaccagcagcaccagccccaccctgccccggccccacagccccctgcacggccacacaggcaacagccccctggacagccccaggaacttcagccccaatgccccagcccacttctcctttgtgcctgccaggagaacagatggccgccgctggagcctggccagcctgcccagcagcggctacggcaccaacacccccagcagcacagtgagcagcagctgcagcagccaggagaagctgcaccagctgcccttccagcccacagcagatgagctgcacttcctgaccaagcacttcagcacagagagcgtgcctgatgaggagggccggcagagccctgccatgaggcccaggagccgcagcctgagccctggccgcagccctgtgtcctttgacagcgagatcatcatgatgaaccacgtgtacaaggagcgcttccccaaggccacagcccagatggaggagcggctggccgagttcatcagcagcaacaccccagattctgtgctgcccctggctgatggagccctgtccttcatccaccaccaggtgattgagatggcccgggactgcctggacaagagccgcagcggcctcatcaccagccagtacttctatgagctgcaggacaacctggagaagctgctgcaggatgcccacgagaggtctgagagcagcgaggtggcctttgtgatgcagctggtgaagaagctgatgatcatcatcgcccggcctgcccggctgctggagtgcctggagtttgatcctgaggagttctaccacctgctggaggccgctgagggccacgccaaggagggccagggcatcaagtgtgacatcccccgctacatcgtgtcccagctgggcctgacccgggaccccctggaggagatggcccagctgagcagctgtgacagcccagacaccccagagacagatgacagcattgagggccacggggccagcctgcccagcaagaagaccccatctgaagaagattttgagaccatcaagctgatcagcaatggagcctacggggctgtgttcctggtgcgccacaagagcacccggcagagatttgccatgaagaagatcaacaagcagaacctgatcctgaggaaccagatccagcaggcctttgtggagcgggacatcctgacctttgctgagaacccctttgtggtgtccatgttctgcagctttgacaccaagaggcacctgtgcatggtgatggagtatgtggagggcggggactgtgccaccctgctgaagaacattggagccctgcctgtggacatggtgcggctgtactttgctgagaccgtgctggccctggagtacctgcacaactacggcatcgtgcaccgggacctgaagccagacaacctgctgatcacctccatgggccacatcaagctgacagactttggcctgagcaagattggcctgatgagcctgaccaccaacctgtatgagggccacatcgagaaggatgcccgggagttcctggacaagcaggtgtgtggcaccccagagtacatcgcccctgaggtgatcctgcggcagggctacggcaagcctgtggactggtgggccatgggcatcatcctgtatgagttcctggtgggctgtgtgcccttctttggagacaccccagaggagctgtttggccaggtgatcagtgatgaaattgtgtggccagaaggagatgaggccctgcccccagatgcccaggacctgaccagcaagctgctgcaccagaaccccctggagcggctgggcaccggcagcgcctatgaggtgaagcagcaccccttcttcaccggcctggactggacaggcctgctgcggcagaaggccgagttcatcccccagctggagagtgaagatgacaccagctactttgacaccaggtctgagcgctaccaccacatggacagtgaagatgaggaggaggtgtctgaagatggctgcctggagatccggcagttcagcagctgcagcccccgcttcaacaaggtgtacagctccatggagcggctgagcctgctggaggagaggaggaccccaccacccaccaagaggagcctgtctgaggagaaggaggaccacagtgatggcctggccggcctgaagggccgggaccgctcctgggtgattggcagccctgagcaccaccccagcgcctag

SEQ ID NO: 159736 - DNA, 4827 bp, Artificial Sequence
  Description of Artificial Sequence: Synthetic coding sequence
atgaagaggagccgctgccgggaccggccccagcccccacctccagacagaagagaagatggagtgcagagagctgctgagctgagccagagcctgcccccaagaagaagagcccctcctggccggcagaggctggaggagaggactggacctgctggccctgagggcaaggagcaggatgtggtgactggagtgagccccctgctcttcaggaagctgagcaacccagacatcttcagcagcacaggcaaggtgaagctgcagaggcagctgagccaggatgactgcaagctgtggaggggcaacctggccagcagcctgagcggcaagcagctgctgcccctgagcagctctgtgcacagctctgtgggccaggtgacctggcagagcagtggagaggccagcaacctggtgaggatgaggaaccagagcctgggccagagcgcccccagcctgacagctggcctgaaggagctgagcctgccccggcggggcagcttctgcaggaccagcaacaggaagagcctgattgtgaccagcagcaccagccccaccctgccccggccccacagccccctgcacggccacactggaaacagccccctggacagccccaggaacttcagccccaatgccccagcccacttctcctttgtgcctgcccggaggacagatggaagacgctggagcctggccagcctgcccagcagcggctacggcaccaacacccccagcagcacagtgagcagcagctgcagcagccaggagaagctgcaccagctgcccttccagcccacagcagatgagctgcacttcctgaccaagcacttcagcacagaatctgtgcctgatgaggagggccggcagagccctgccatgaggcccaggagccgcagcctgagccctggccgcagccctgtgtcctttgattctgagatcatcatgatgaaccacgtgtacaaggagcgcttccccaaggcccacgagaggtctgagagcagcgaggtggcctttgtgatgcagctggtgaagaagctgatgatcatcatcgcccggcctgcccggctgctggagtgcctggagtttgatcctgaggagttctaccacctgctggaggccgctgagggccacgccaaggagggccagggcatcaagtgtgacatcccccgctacatcgtgtcccagctgggcctgacccgggaccccctggaggagatggcccagctgagcagctgtgacagcccagacaccccagagacagatgacagcattgagggccatggagccagcctgcccagcaagaagacccccagcgaggaggactttgagaccatcaagctgatcagcaatggagcctatggagctgtgttcctggtgcgccacaagagcacccggcagagatttgccatgaagaagatcaacaagcagaacctgatcctgaggaaccagatccagcaggcctttgtggagcgggacatcctgacctttgctgagaacccctttgtggtgtccatgttctgcagctttgacaccaagaggcacctgtgcatggtgatggagtatgtggagggcggggactgtgccaccctgctgaagaacatcggggccctgcctgtggacatggtgcggctgtactttgctgagaccgtgctggccctggagtacctgcacaactatggaattgtgcaccgggacctgaagccagacaacctgctgatcacctccatgggccacatcaagctgacagactttggcctgagcaagattggcctgatgagcctgaccaccaacctgtatgagggccacatcgagaaggatgcccgggagttcctggacaagcaggtgtgtggcaccccagagtacatcgcccctgaggtgatcctgcggcagggctacggcaagcctgtggactggtgggccatgggcatcatcctgtatgagttcctggtgggctgtgtgcccttcttcggggacaccccagaggagctgtttggccaggtgatcagtgatgagatcgtgtggccagaaggagatgaggccctgcccccagatgcccaggacctgaccagcaagctgctgcaccagaaccccctggagcggctgggcactggaagtgcctatgaggtgaagcagcaccccttcttcaccggcctggactggacaggcctgctgcggcagaaggccgagttcatcccccagctggagagtgaagatgacaccagctactttgacaccaggtctgagcgctaccaccacatggattctgaagatgaggaggaggtgtctgaagatggctgcctggagatccggcagttcagcagctgcagcccccgcttcaacaaggtgtacagctccatggagcggctgagcctgctggaggagaggaggaccccaccacccaccaagaggagcctgtctgaggagaaggaggaccacagtgatggcctggccggcctgaagggccgggaccgctcctgggtgattggcagccctgagatcctgaggaagaggctgtctgtgtctgagagcagccacacagaaagtgacagcagcccccccatgacagtgagaagacgctgcagcggcctgctggatgccccccgcttccctgagggccctgaggaggccagcagcaccctgcggcggcagccccaggagggcatctgggtgctgaccccaccttctggagagggcgtgtctggccctgtgacagagcacagcggggagcagaggcccaagctggatgaggaggccgtgggccgcagcagcggcagcagccctgccatggagacccggggccggggcaccagccagctggccgagggcgccacagccaaggccatcagtgacctggccgtgcggcgggcccggcaccggctgctgagcggggacagcacagagaagaggacagcccggcctgtgaacaaggtgatcaagagcgccagcgccacagccctgagcctgctgatccccagcgagcaccacacctgcagccccctggccagccccatgagcccccacagccagagcagcaaccccagcagccgggacagcagcccctacggcttcaccctgcgggccatccgggtgtacatgggagacagtgatgtgtacacagtgcaccacatggtgtggcacgtggaggatggcggccctgccagcgaggccggcctgcggcagggcgacctgatcacccacgtgaatggagagcctgtgcacggcctggtgcacacagaggtggtggagctgatcctgaagagcggcaacaaggtggccatcagcaccacccccctggagaacaccagcatcaaggtgggccctgccaggaagggcagctacaaggccaagatggcccggcgcagcaagaggagccggggcaaggatggccaggagagcaggaagaggagcagcctcttcaggaagatcaccaagcaggccagcctgctgcacaccagccgcagcctgagcagcctgaacagaagcctgagcagcggggagagcggccctggcagccccacccacagccacagcctgagccccaggagccccacccagggctacagagtgaccccagatgctgtgcacagcgagctgagccggcccaagtctgctgagccccccaggagccccctgctgaagagggtgcagagcgctgagaagctggccgccgccctggccgccagcgagaagaagctggccaccagcaggaagcacagcctggacctgccccacagcgagctgaagaaggagctgcccccccgggaggtgagccccctggaggtggtgggcgcccggtctgtgctgtctggaaaaggagccctgcctggaaaaggagtgctgcagcctgcccccagccgggccctgggcaccctgcggcaggacagagctgagcggcgggagagcctgcagaagcaggaggccatccgggaggtggacagcagtgaagatgacacagaggagggccctgagaacagccagggcgcccaggagctgagcctggccccccaccctgaggtgtcccagagcgtggcccccaagggggccggggagagcggggaggaggaccccttccccagccgggaccccaggagcctgggccccatggtgcccagcctgctgaccggcatcaccctgggcccccccaggatggagagccccagcggcccccaccggcggctgggcagcccccaggccatcgaggaggccgccagcagcagcagcgctggccccaacctgggccagagcggggccacagaccccatccccccagagggctgctggaaggcccagcacctgcacacccaggccctgacagccctgagccccagcaccagcggcctgacccccaccagcagctgcagcccccccagcagcaccagcggcaagctgtccatgtggagctggaagagcctcatcgagggccctgaccgggccagccccagcaggaaggccaccatggccggcggcctggccaacctgcaggacctggagaacaccaccccagcccagcccaagaacctgagcccccgggagcagggcaagacccagcccccatctgccccccggctggcccaccccagctatgaggaccccagccagggctggctgtgggagagtgaatgtgcccaggccgtgaaggaggaccctgccctgagcatcacccaggtgcctgatgccagcggggaccggcggcaggatgtgccctgccggggctgccccctgacccagaagtctgagcccagcctgcggcggggccaggagcccggcggccaccagaagcaccgggacctggccctggtgcctgatgagctgctgaagcagacctag

SEQ ID NO: 159737 - DNA, 1893 bp, Artificial Sequence
  Description of Artificial Sequence: Synthetic coding sequence
atgaggcccaggagccgcagcctgagccctggccgcagccctgtgtcctttgattctgagatcatcatgatgaaccacgtgtacaaggagcgcttccccaaggccacagcccagatggaggagcggctggccgagttcatcagcagcaacaccccagacagcgtgctgcccctggctgatggagccctgtccttcatccaccaccaggtgattgagatggcccgggactgcctggacaagagccgcagcggcctcatcaccagccagtacttctatgagctgcaggacaacctggagaagctgctgcaggatgaatttgatcctgaggagttctaccacctgctggaggccgctgagggccacgccaaggagggccagggcatcaagtgtgacatcccccgctacatcgtgtcccagctgggcctgacccgggaccccctggaggagatggcccagctgagcagctgtgacagcccagacaccccagagacagatgacagcattgagggccatggagccagcctgcccagcaagaagacccccagcgaggaggactttgagaccatcaagctgatcagcaatggagcctatggagctgtgttcctggtgcgccacaagagcacccggcagagatttgccatgaagaagatcaacaagcagaacctgatcctgaggaaccagatccagcaggcctttgtggagcgggacatcctgacctttgctgagaacccctttgtggtgtccatgttctgcagctttgacaccaagaggcacctgtgcatggtgatggagtatgtggagggcggggactgtgccaccctgctgaagaacatcggggccctgcctgtggacatggtgcggctgtactttgctgagaccgtgctggccctggagtacctgcacaactatggaattgtgcaccgggacctgaagccagacaacctgctgatcacctccatgggccacatcaagctgacagactttggcctgagcaagattggcctgatgagcctgaccaccaacctgtatgagggccacatcgagaaggatgcccgggagttcctggacaagcaggtgtgtggcaccccagagtacatcgcccctgaggtgatcctgcggcagggctacggcaagcctgtggactggtgggccatgggcatcatcctgtatgagttcctggtgggctgtgtgcccttcttcggggacaccccagaggagctgtttggccaggtgatcagtgatgagatcgtgtggccagaaggagatgaggccctgcccccagatgcccaggacctgaccagcaagctgctgcaccagaaccccctggagcggctgggcactggaagtgcctatgaggtgaagcagcaccccttcttcaccggcctggactggacaggcctgctgcggcagaaggccgagttcatcccccagctggagagtgaagatgacaccagctactttgacaccaggtctgagcgctaccaccacatggattctgaagatgaggaggaggtgtctgaagatggctgcctggagatccggcagttcagcagctgcagcccccgcttcaacaaggtgtacagctccatggagcggctgagcctgctggaggagaggaggaccccaccacccaccaagaggagcctgtctgaggagaaggaggaccacagtgatggcctggccggcctgaagggccgggaccgctcctgggtgattggcagccctgagatcctgaggaagaggctgtctgtgtctgagagcagcctgctgaaggtggccggccggcccagcaccttcagccagcacttcggcacccacccccaccagcagctgctgagcagccagctgcacctgtgggaggccgagcacgtggtgctggagatcccctactag

SEQ ID NO: 159738 - DNA, 1035 bp, Artificial Sequence
  Description of Artificial Sequence: Synthetic coding sequence
atggatgacagcagcatcctgcggcggcggggcctgcagaaggagctgagcctgccccggcggggcagcttctgcaggaccagcaacaggaagagcctcatcgtgaccagcagcaccagccccaccctgccccggccccacagccccctgcacggccacacaggcaacagccccctggacagccccaggaacttcagccccaatgccccagcccacttctcctttgtgcctgcccggagccacagccacagagctgacagaacagatggaagacgctggagcctggccagcctgcccagcagcggctacggcaccaacacccccagcagcacagtgagcagcagctgcagcagccaggagaagctgcaccagctgcccttccagcccacagcagatgagctgcacttcctgaccaagcacttcagcacagaatctgtgcctgatgaggagggccggcagagccctgccatgaggcctgcccccagccgggccctgggcaccctgcggcaggacagagctgagcggcgggagagcctgcagaagcaggaggccatccgggaggtggacagcagtgaagatgacacagaggagggccctgagaacagccagggcgcccaggagctgagcctggccccccaccctgaggtgtcccagagcgtggcccccaagggagctggggagagcggggaggaggaccccttccccagccgggaccccaggagcctgggccccatggtgcccagcctgctgaccggcatcaccctgggcccccccaggatggagagccccagcggcccccaccggcggctgggcagcccccaggccatcgaggaggccgccagcagcagcagcgctggccccaacctgggccagagcggggccacagaccccatccccccagagggctgctggaaggcccagcacctgcacacccaggccctgacagccctgagccccagcaccagcggcctggcccacctgatgaggatcccagcccgggccggctacggcagcctgtctgtgcacaagcagtag

SEQ ID NO: 159739 - DNA, 3930 bp, Artificial Sequence
  Description of Artificial Sequence: Synthetic coding sequence
atggatgagagcagcctgctgcggcggcggggcctgcagaaggagctgagcctgccccggcggggccggggctgccgcagcggcaacaggaagagcctggtggtgggcacccccagccccaccctgagccggcccctgagccccctgtctgtgcccacagctggcagcagccccctggacagccccaggaacttctctgctgccagcgccctgaacttcccctttgccaggagagcagatggccgccgctggagcctggccagcctgcccagcagcggctacggcaccaacacccccagcagcaccctgagcagcagcagcagcagccgggagcggctgcaccagctgcccttccagcccaccccagatgagctgcacttcctgagcaagcacttccgcagcagtgaaaatgtgctggatgaggagggcggccgcagcccccggctgcggcccaggagccgcagcctgagccctggccgggccaccggcacctttgacaatgaaattgtgatgatgaaccacgtgtaccgggagcgcttccccaaggccacagcccagatggagggccgcctgcaggagttcctgacagcctatgcccctggggcccggctggccctggctgatggagtgctgggcttcatccaccaccagatcgtggagctggcccgggactgcctggccaagtctggagagaacctggtgaccagccgctacttcctggagatgcaggagaagctggagcggctgctgcaggatgcccacgagaggagtgacagcgaggaggtgtccttcatcgtgcagctggtgaggaagctgctgatcatcatcagcaggcctgcccggctgctggagtgcctggagtttgatcctgaggagttctaccacctgctggaggccgctgagggccacgcccgggagggccagggcatcaagacagacctgccccagtacatcatcggccagctgggcctggccaaggaccccctggaggagatggtgcccctgagccacctggaggaggagcagcccccagcccctgagagccctgagagccgggccctggtgggccagagcaggaggaagccctgtgagagtgactttgagaccatcaagctgatcagcaatggagcctacggggctgtgtacctggtgcgccaccgggacacccggcagagatttgccatcaagaagatcaacaagcagaacctgatcctgaggaaccagatccagcaggtgtttgtggagcgggacatcctgacctttgctgagaacccctttgtggtgtccatgttctgcagctttgagaccaggaggcacctgtgcatggtgatggagtatgtggagggcggggactgtgccaccctgctgaagaacatgggccccctgcctgtggacatggcccggctgtactttgctgagaccgtgctggccctggagtacctgcacaactacggcatcgtgcaccgggacctgaagccagacaacctgctgatcaccagcctgggccacatcaagctgacagactttggcctgagcaagattggcctgatgtccatggccaccaacctgtatgagggccacatcgagaaggatgcccgggagttcatcgacaagcaggtgtgtggcaccccagagtacatcgcccctgaggtgatcttccggcagggctacggcaagcctgtggactggtgggccatgggcgtggtgctgtatgagttcctggtgggctgtgtgcccttctttggagacaccccagaggagctgtttggccaggtggtgtctgatgagatcatgtggccagaaggagatgaggccctgcctgcagatgcccaggacctgatcacccggctgctgcggcagagccccctggaccggctgggcaccggcggcacccatgaggtgaagcagcaccccttcttcctggccctggactgggccggcctgctgcggcacaaggccgagtttgtgccccagctggaggccgaggatgacaccagctactttgacaccaggtctgagcgctaccgccacctgggctctgaagatgatgagaccaatgatgaggagagcagcacagagatcccccagttcagcagctgcagccaccgcttcagcaaggtgtacagcagcagcgagttcctggccgtgcagcccacccccacctttgctgagaggagcttctctgaagatcgggaggagggctgggagaggtctgaggtggactatggccggcggctgtctgctgacatccggctgcgctcctggaccagcagcggcagcagctgccagagcagcagcagccagcctgagcggggccccagccccagcctgctgaacaccatcagcctggacaccatgcccaagtttgccttcagcagtgaagatgaaggagtgggccctggccctgctggccccaagaggcctgtgttcatcctgggggagccagaccccccacctgctgccacccctgtgatgcccaagcccagcagcctgtctgctgacacagctgccctgagccacgcccggctgcggagcaacagcatcggggcccggcacagcaccccccggcccctggatgctggccggggccggcggctgggcggcccccgggaccctgcccctgagaagagccgggccagcagcagcggcggcagcggcggcggcagcggcggccgggtgcccaagagcgcctctgtgtctgccctgagcctcatcatcacagcagatgatggcagcggcggccccctgatgagccccctgagccccaggagcctgagcagcaaccccagcagccgggacagcagccccagccgggaccccagccctgtgtgtggcagcctgcggccccccatcgtcatccacagcagcggcaagaagtatggcttcagcctgcgggccatccgggtgtacatgggagacagtgatgtgtacacagtgcaccacgtggtgtggagcgtggaggatggcagccctgcccaggaggccggcctgcgggccggggacctgatcacccacatcaatggagagagcgtgctgggcctggtgcacatggatgtggtggagctgctgctgaagagcggcaacaagatcagcctgcggaccacagccctggagaacaccagcatcaaggtgggccctgccaggaagaatgtggccaagggccgcatggcccggcgcagcaagaggagcagaagaagagagacccaggacaggaggaagagcctcttcaagaagatcagcaagcagacctctgtgctgcacaccagccgctccttcagcagcggcctgcaccacagcctgagcagcagcgagagcctgcccggcagccccacccacagcctgagccccagccccaccaccccctgccgcagccctgccccagatgtgcctgctgacaccacagccagccccccatctgccagccccagcagcagcagccctgccagccctgctgctgctggccacacccggcccagcagcctgcacggcctggccgccaagctgggccccccccggcccaagacaggaagaaggaagagcaccagcagcatcccccccagccccctggcctgcccccccatcagcgcccccccacccaggagccccagccccctgcccggccaccccccagccccagcccggagcccccggctgcggcggggccagagcgctgacaagctgggcactggagagcggctggatggagaggccggccgccgcacccggggccctgaggccgagctggtggtgatgaggcggctgcacctgtctgaaagaagagacagcttcaagaagcaggaggccgtgcaggaggtgtcctttgatgagccccaggaggaggccaccggcctgcccacctctgtgccccagattgctgtggagggggaggaggccgtgcctgtggccctgggccccaccggccgggactag

SEQ ID NO: 159740 - DNA, 2523 bp, Artificial Sequence
  Description of Artificial Sequence: Synthetic coding sequence
atggaccccacagctggcagcaagaaggagcccggcggcggggccgccacagaggagggcgtgaacagaattgctgtgcccaagcccccatccattgaggagttcagcatcgtgaagcccatcagcagaggagccttcggcaaggtgtacctgggccagaagggcggcaagctgtatgctgtgaaggtggtgaagaaggctgacatgatcaacaagaacatgacccaccaggtgcaggccgagagagatgccctggccctgagcaagagccccttcatcgtgcacctgtactacagcctgcagagcgccaacaacgtgtacctggtgatggagtacctgattggaggagatgtgaagagcctgctgcacatctacggctactttgatgaggagatggctgtgaagtacatcagcgaggtggccctggccctggactacctgcaccgccacggcatcatccaccgggacctgaagccagacaacatgctgatcagcaatgaaggccacatcaagctgacagactttggcctgagcaaggtgaccctgaacagagacatcaacatgatggacatcctgaccacccccagcatggccaagccccggcaggactacagcaggaccccaggccaggtgctgagcctcatcagcagcctgggcttcaacacccccatcgccgagaagaaccaggaccctgccaacatcctgagcgcctgcctgtctgagaccagccagctgagccagggcctggtgtgccccatgtctgtggaccagaaggacaccaccccctacagcagcaagctgctgaagagctgcctggagaccgtggccagcaaccctggcatgcctgtgaagtgcctgaccagcaacctgctgcagagcaggaagaggctggccaccagcagcgccagcagccagagccacaccttcatcagctctgtggagagcgagtgccacagcagccccaagtgggagaaggactgccaggagagtgatgaggccctgggccccaccatgatgtcctggaatgctgtggagaagctgtgtgccaagagcgccaatgccatcgagaccaagggcttcaacaagaaggacctggagctggccctgagccccatccacaacagcagcgccctgcccaccaccggccgcagctgtgtgaacctggccaagaagtgcttcagcggggaggtgtcctgggaggccgtggagctggatgtgaacaacatcaacatggacacagacaccagccagctgggcttccaccagagcaaccagtgggccgtggacagcggcggcatcagcgaggagcacctgggcaagaggagcctgaagaggaactttgagctggtggacagcagcccctgcaagaagatcatccagaacaagaagacctgtgtggagtacaagcacaatgagatgaccaactgctacaccaaccagaacacaggcctgactgtggaggtgcaggacctgaagctgtctgtgcacaagagccagcagaatgactgtgccaacaaggaaaatattgtgaacagcttcacagacaagcagcagaccccagagaagctgcccatccccatgattgccaagaacctgatgtgtgagctggatgaggactgtgagaagaacagcaagagggactacctgagcagcagcttcctgtgcagtgatgatgaccgggccagcaagaacatctccatgaacagcgacagcagcttccctggcatcagcatcatggagagccccctggagagccagcccctggacagcgacaggagcatcaaggagagcagctttgaggagagcaacatcgaggaccccctgattgtgaccccagactgccaggagaagaccagccccaagggcgtggagaacccagctgtgcaggagagcaaccagaagatgctgggcccccccctggaggtgctgaagaccctggccagcaagagaaatgctgtggccttccgctccttcaacagccacatcaatgccagcaacaacagcgagcccagcaggatgaacatgaccagcctggatgccatggacatcagctgtgcctacagcggcagctaccccatggccatcacccccacccagaagagaagaagctgcatgccccaccagacccccaaccagatcaagagcggcaccccctaccgcacccccaagtctgtgcggcggggcgtggcccctgtggatgatggccgcatcctgggcaccccagactacctggcccctgagctgctgctgggccgggcccatgacatcccctggccagagggggaggagaagctgagtgacaatgcccagagcgctgtggagatcctgctgaccattgatgacaccaagagagctggcatgaaggagctgaagaggcaccccctcttcagtgatgtggactgggagaacctgcagcaccagaccatgcccttcatcccccagccagatgatgaaacagacaccagctactttgaggccaggaacacagcccagcacctgactgtgtctggcttcagcctgtag

SEQ ID NO: 159741 - DNA, 2640 bp, Artificial Sequence
  Description of Artificial Sequence: Synthetic coding sequence
atggaccccacagctggcagcaagaaggagcccggcggcggggccgccacagaggagggcgtgaacagaattgctgtgcccaagcccccatccattgaggagttcagcatcgtgaagcccatcagcagaggagccttcggcaaggtgtacctgggccagaagggcggcaagctgtatgctgtgaaggtggtgaagaaggctgacatgatcaacaagaacatgacccaccaggtgcaggccgagagagatgccctggccctgagcaagagccccttcatcgtgcacctgtactacagcctgcagagcgccaacaacgtgtacctggtgatggagtacctgattggaggagatgtgaagagcctgctgcacatctacggctactttgatgaggagatggctgtgaagtacatcagcgaggtggccctggccctggactacctgcaccgccacggcatcatccaccgggacctgaagccagacaacatgctgatcagcaatgaaggccacatcaagctgacagactttggcctgagcaaggtgaccctgaacagagacatcaacatgatggacatcctgaccacccccagcatggccaagccccggcaggactacagcaggaccccaggccaggtgctgagcctcatcagcagcctgggcttcaacacccccatcgccgagaagaaccaggaccctgccaacatcctgagcgcctgcctgtctgagaccagccagctgagccagggcctggtgtgccccatgtctgtggaccagaaggacaccaccccctacagcagcaagctgctgaagagctgcctggagaccgtggccagcaaccctggcatgcctgtgaagtgcctgaccagcaacctgctgcagagcaggaagaggctggccaccagcagcgccagcagccagagccacaccttcatcagctctgtggagagcgagtgccacagcagccccaagtgggagaaggactgccaggagagtgatgaggccctgggccccaccatgatgtcctggaatgctgtggagaagctgtgtgccaagagcgccaatgccatcgagaccaagggcttcaacaagaaggacctggagctggccctgagccccatccacaacagcagcgccctgcccaccaccggccgcagctgtgtgaacctggccaagaagtgcttcagcggggaggtgtcctgggaggccgtggagctggatgtgaacaacatcaacatggacacagacaccagccagctgggcttccaccagagcaaccagtgggccgtggacagcggcggcatcagcgaggagcacctgggcaagaggagcctgaagaggaactttgagctggtggacagcagcccctgcaagaagatcatccagaacaagaagacctgtgtggagtacaagcacaatgagatgaccaactgctacaccaaccagaacacaggcctgactgtggaggtgcaggacctgaagctgtctgtgcacaagagccagcagaatgactgtgccaacaaggaaaatattgtgaacagcttcacagacaagcagcagaccccagagaagctgcccatccccatgattgccaagaacctgatgtgtgagctggatgaggactgtgagaagaacagcaagagggactacctgagcagcagcttcctgtgcagtgatgatgaccgggccagcaagaacatctccatgaacagcgacagcagcttccctggcatcagcatcatggagagccccctggagagccagcccctggacagcgacaggagcatcaaggagagcagctttgaggagagcaacatcgaggaccccctgattgtgaccccagactgccaggagaagaccagccccaagggcgtggagaacccagctgtgcaggagagcaaccagaagatgctgggcccccccctggaggtgctgaagaccctggccagcaagagaaatgctgtggccttccgctccttcaacagccacatcaatgccagcaacaacagcgagcccagcaggatgaacatgaccagcctggatgccatggacatcagctgtgcctacagcggcagctaccccatggccatcacccccacccagaagagaagaagctgcatgccccaccagcagacccccaaccagatcaagagcggcaccccctaccgcacccccaagtctgtgagaagaggagtggcccctgtggatgatggccgcatcctgggcaccccagactacctggcccctgagctgctgctgggccgggcccacggccctgctgtggactggtgggccctgggcgtgtgcctgtttgagttcctgaccggcatcccccccttcaatgatgagaccccccagcaggtgttccagaacatcctgaagagggacatcccctggccagagggggaggagaagctgagtgacaatgcccagagcgctgtggagatcctgctgaccattgatgacaccaagagagctggcatgaaggagctgaagaggcaccccctcttcagtgatgtggactgggagaacctgcagcaccagaccatgcccttcatcccccagccagatgatgaaacagacaccagctactttgaggccaggaacacagcccagcacctgactgtgtctggcttcagcctgtag

SEQ ID NO: 159742 - DNA, 2637 bp, Artificial Sequence
  Description of Artificial Sequence: Synthetic coding sequence
atggaccccacagctggcagcaagaaggagcccggcggcggggccgccacagaggagggcgtgaacagaattgctgtgcccaagcccccatccattgaggagttcagcatcgtgaagcccatcagcagaggagccttcggcaaggtgtacctgggccagaagggcggcaagctgtatgctgtgaaggtggtgaagaaggctgacatgatcaacaagaacatgacccaccaggtgcaggccgagagagatgccctggccctgagcaagagccccttcatcgtgcacctgtactacagcctgcagagcgccaacaacgtgtacctggtgatggagtacctgattggaggagatgtgaagagcctgctgcacatctacggctactttgatgaggagatggctgtgaagtacatcagcgaggtggccctggccctggactacctgcaccgccacggcatcatccaccgggacctgaagccagacaacatgctgatcagcaatgaaggccacatcaagctgacagactttggcctgagcaaggtgaccctgaacagagacatcaacatgatggacatcctgaccacccccagcatggccaagccccggcaggactacagcaggaccccaggccaggtgctgagcctcatcagcagcctgggcttcaacacccccatcgccgagaagaaccaggaccctgccaacatcctgagcgcctgcctgtctgagaccagccagctgagccagggcctggtgtgccccatgtctgtggaccagaaggacaccaccccctacagcagcaagctgctgaagagctgcctggagaccgtggccagcaaccctggcatgcctgtgaagtgcctgaccagcaacctgctgcagagcaggaagaggctggccaccagcagcgccagcagccagagccacaccttcatcagctctgtggagagcgagtgccacagcagccccaagtgggagaaggactgccaggagagtgatgaggccctgggccccaccatgatgtcctggaatgctgtggagaagctgtgtgccaagagcgccaatgccatcgagaccaagggcttcaacaagaaggacctggagctggccctgagccccatccacaacagcagcgccctgcccaccaccggccgcagctgtgtgaacctggccaagaagtgcttcagcggggaggtgtcctgggaggccgtggagctggatgtgaacaacatcaacatggacacagacaccagccagctgggcttccaccagagcaaccagtgggccgtggacagcggcggcatcagcgaggagcacctgggcaagaggagcctgaagaggaactttgagctggtggacagcagcccctgcaagaagatcatccagaacaagaagacctgtgtggagtacaagcacaatgagatgaccaactgctacaccaaccagaacacaggcctgactgtggaggtgcaggacctgaagctgtctgtgcacaagagccagcagaatgactgtgccaacaaggaaaatattgtgaacagcttcacagacaagcagcagaccccagagaagctgcccatccccatgattgccaagaacctgatgtgtgagctggatgaggactgtgagaagaacagcaagagggactacctgagcagcagcttcctgtgcagtgatgatgaccgggccagcaagaacatctccatgaacagcgacagcagcttccctggcatcagcatcatggagagccccctggagagccagcccctggacagcgacaggagcatcaaggagagcagctttgaggagagcaacatcgaggaccccctgattgtgaccccagactgccaggagaagaccagccccaagggcgtggagaacccagctgtgcaggagagcaaccagaagatgctgggcccccccctggaggtgctgaagaccctggccagcaagagaaatgctgtggccttccgctccttcaacagccacatcaatgccagcaacaacagcgagcccagcaggatgaacatgaccagcctggatgccatggacatcagctgtgcctacagcggcagctaccccatggccatcacccccacccagaagagaagaagctgcatgccccaccagacccccaaccagatcaagagcggcaccccctaccgcacccccaagtctgtgcggcggggcgtggcccctgtggatgatggccgcatcctgggcaccccagactacctggcccctgagctgctgctgggccgggcccacggccctgctgtggactggtgggccctgggcgtgtgcctgtttgagttcctgaccggcatcccccccttcaatgatgagaccccccagcaggtgttccagaacatcctgaagagggacatcccctggccagagggggaggagaagctgagtgacaatgcccagagcgctgtggagatcctgctgaccattgatgacaccaagagagctggcatgaaggagctgaagaggcaccccctcttcagtgatgtggactgggagaacctgcagcaccagaccatgcccttcatcccccagccagatgatgaaacagacaccagctactttgaggccaggaacacagcccagcacctgactgtgtctggcttcagcctgtag

SEQ ID NO: 159743 - DNA, 17817 bp, Artificial Sequence
  Description of Artificial Sequence: Synthetic coding sequence
atgcagaagggcctgctggaccaggacaccggcctggtgctgctggagagccaggtgatcatgagcggcctgattgcccctgagactggagagaacctgagcctggaggagggcatcgccaggaacctgatcaacccccagatgtaccagcagctgcgggagctgcaggatgccctggccctgatcagccggctgacagagagccggggccccctgtctgtggtggaggccatcgagaagaggatcatcagcgagaccgtgggcctgaagatcctggaggcccacctggccaccggcggcttcagcctgagccccagcgagaactgcatcaacctggaggaggccttccaccagggcctcatcagcgcctggctgcacagcgtgctggagagctacctgcggaccagcaagaacctgattgaccccaacacagctgagaagattggcctgctggacctgatgcagcgctgcatcgtgcaccaggagagcggcttcaagctgctgcctgtgaagcagctggccggcggcatggtgtccctgaagagcggcaggaaggtgtccatcttccgggctgtgcaggagggcctgattgaccggcaggtgacagtgcggctgctggaggcccagctgtttgctgggggcatcgtggaccccaggacaggccaccggctgactgtggaggaggccgtgcgccacaacctgattgaccaggacatggcctgtgccatcctgatccggcagctgcagacaggaggcatcatcgacacagtgacaggccagaggctgaccattgatgaagctgtgtccaatgacctggtggccgccaagatcgccctggtgatcctggagagcctgtggagcttcatgggcctgctgtggccagagagcggggagatcctgcccatcacagatgccctggagcagggcatcgtgtccacagagctggcccacaagatcctgagcaaccggcagcacatcaaggccctcttcctgcctgccaccacagagatcctgtcctggaagaaggccatcgagagcggcatcctggaccgggacctggccaacaacctgaagagcatctgcatcccagatgtgatgccccacatgcagctggccgacagcgctgagcagaacatcaaccctggagctgctgtgctgccctgcagcaagagccaccccaaggccacagccagccagagcgagaacctgctcttccagctgatgacccacagctacatcaacgtgcagaatggccagaggctgctgctgctggacaaggagctgatggagaccctgaccagcagagatgagtaccagaccagcccccccaaggtggtggagatcggccaccagaggcagaagaccccagagggcctgcaggagagcgccaacgtgaagatcagcggcaccttcagcagcggctggacagtgcggctgcctgagttccagttcagcagccagaacaaggagtacccagaccgggaggactgcaccacagagaagggcaagaagaccaccgtggagacagaggacagctctgtggagaaccctgagcaggacctgtttgtggagcagaaggagaggaaccccaacattgatgccctgaaggtgatcaacaaggtgaagctggaggtgcagaggcagctgattggcacccagcgggaggaccagacagctgtgtctgtgcgggagaatgccagccggggccacctgctgaccatccccccagctgaggccgagggcgtgcccctggtggtggacaaggatgtgttttctgtggagacccccaagaaggagcaccagcccctgaggaacaccagcttcacctgccagaatgagcaggcccacaccctggagacagagtacatccatgatgaaacaggaggcagccacatcaagccccagagcaagaagctgcaggtgcaggtgaagaagaccctgggcatcaagctggagctgaagtcagaaacagatggaaatgtgcaccccctggacaagaaggagatgctgaagaagaccttcctggccaaggatgaccacaaggagagccaggaggcccagaacattgctgggggctccatgatgatgtctgagaagacagatgaagaagattctggccgggagatcttcctgagctgcagccaccccctggagctgctggaggaggccaccctgaatgtgctgagcgcccagctgctggatggcggcatcttccacgagcagacaggccagaagctgctgctgaatgaggccatcagccggggcatcgtgcccagccacacagctgtgaagctgatggagaagctgaacatgttccagggcttctttgacagccagacctgtgagagcctgaccacagaggaggtgatcaatgaaggcctgatggatgagaagctgctgcacaacgtgctgatggctgacaaggccatctctggagtgctggaccccaggacccagaccctgtgcagcgtgaaggatgctgtgacagtgggcctgctggacaaggagacagccacccgcatcctggagcggcaggtggtgactggaggcatcatcgacctgaagaggggcaagaaggtgtctgtgaccctggccagcaccctgggcctggtggatgtggccgaccagcctgagctgatcaacctggagaaggccagcaagggcagagatgctgagaagacagtgcgggagcggctcatcagcctgcagatggagaccaccggcctgattgatcctgacagcaaggcccccctgactgtggtgcagagcattgaccggggcctgctggagcgggaggaggccgtgcggctgctgaccaagcaggtggtggatggcggcatcatccaccacatcagcggcatgaggctgtctgtggacaatgccttccgccacggcctgattggagaggacctggccgagaagctgaagagggtggagaacctgaacatccaccagatcttcaaccctgagaccaaggagaacatcagcctgcccaaggccatcaagctggacctgatcaccagtgacctgaagcgggagatccaggaggtgcaggccttcaccggcaactttgtggacctgatcagcggccagaggctgaccctggccgaggccaagaaggagggcctgctgaccaatgaggccgtgctgagccctggcatgatgcacggcatcgtggaccctgagaactgccgcatcgtgccctacagcgagctggtgaagaagtgcaagattgacatcgagagcggccagcgctacctggaggtgatccccttcagtgacatcaaggatggagtgtctgacaaggtgctgaccctgagccaggccatccagctgggcaaggtggactttgccagcaccctgaaggtgctggaggcccaggccaacacaggaggcatcatcgacacagccaccgggaagaggctgaccctggccagcgccctggaggagaagctggtggatgagaacatggtgcgcatcatcgccagccaccaggtgctgaatggaggcatcgtggacatcttcagtgaccagagggtgaccctggtggaggccatcgagaagaggctcatcagccctgagctggccaacatgatccagattgacagcagcgagttcagtgaccaccgggcccagatcgagaagcaggagggcatcgaggtgtgtgccctgcagaatgagttcctgggcaaggacatgctgattgcctgcaaccagacagctgagatgagctgcaacaaggtggaggagagcgagcggctcttccaggtggagaaccagagcgcccaggagaaggtgaaggtgcgggtgtctgatggagagcaggccaagaagagccgggagatcagcctgaaggagtttggctgcaaggaccagaggaagcccaggatgagcagtgatgccaaggagttcatcagcatcatcaacccccacaacctgaagggcaagagcctgggccaggtgtccctgacccacccctacagtgaatgtgacttcaagctgaaggaggtggccaggaacaacatgggaaatgacaccaatgaggagcaggagaaggctgtgaccaagattgagatcatcagccacatgaagcagagcaccagctgcctggacagcgaggagatccgggagaaccagggcgaggtgatcctggaggtgcaggagacctactgtgagaccagcggcaagctgcccagcgagcaggtgctgcagcagcccatgaatgcccgggtgaagagcaagcgggagaagcgggaggtgattgtggaggagagcatccgcacctgcaagccagccttcctgtctgaggagaagctgtaccaggagacagccatcagagatgaacatgacagccacatcaagagccagccccgggagatgaccagcagcgagaagggcaaggaggccgacacagagatgggcttcagcatcaccttcaagattgaggagagcagcagccaggtggtgccccagggcatctctgtgaagcacctggatgccctgaccctcttcagcagcaagcaggccaatgaaggcaaggtgaacaacctgagcctgtgcctgaccctgaagccagaggagaacctgagccgggagatcgcctgtggggcccagagcgagcccttcccctgcatgacccccaggcctgagggcctgcactaccaggagagtgatggcaaggcccaggtgacaggccccagccagatcagcaagacagacaagagcttccagggcaccacccggcaggagaccaactaccaggacagctgggtgaccagcaagaccaaggagaccaagcaccagatcagcagcagcaatgaatgcaaggagaagagctaccaggaggtgtcctttgatcctgcccggggcctgaagctggaggagatcaccgtgtccaggccagacagcaaggaggtgcgctacctggagttcagtgacaggaaggacctgcaccaccagggcagcaagagtgatgacaagctgtgtggcaccctgaagtcagaaattgccacccaggagctgactggagagaagttcctggagatggccaaccccaacgtggccggcctggaggccggcagcattgaggacatcgtgacccagaggggcagccgggtgctgggcagcttcctgcctgagaagctgttcaagggcgtgtcccagaaggaaaatacaggccagcagaatgccatcatcagccccaccgtgctggagaccagcgaggagaagacagtgtccctgactgtgtgcagcgctgtgaagacagagaagaccccccaggagaagctgcgggagagccctggcagcgagcagacccccttcatgacagcccctgagggcaaaggaaatggaggagtgaaccctgagcccttccgggccacccagaatgtgttcacccggcagctgtgcctggagcatgatgagaagctggtgtcctacctgagcctgctgaggaacatcgagatgaggaccaagcagatccagcccctggagctgaacctggccgagctgcaggacctgctgtgccaggccaaggtgctggagcgggagctgaaggacctgaccaccctggtgtcccaggagctggagtgtgtgaaccagatcatcatcagccagccccaggaggtgcctgcccagctgctgaaggccctggagaaggatgccaagaacctgcagaagagcctgagctctgtgtctgacacctggaacagccggctgctgcacttccagaatgctgtggagattgagaagaccaaggtgctgaaccagcacacccagctggagggccgcctgcaggacctgcgggcctgggtgggcaacaagaacctgatcctgaacagcaagggcagcaacagcgagattgatgtggacagcctgaacctgtgcctgcagcagtatgaggacctgaagcagcccatggccgagaggaaggcccagctggatgccctggcctttgacatccagttcttcatcagcgagcacgcccaggacctgagcccccagcagaaccggcagatgctgcggctgctgaatgagctgcagaggagcttccaggacatcctggagcagacagctgcccaggtggatgccctgcagggccacctgcagcagatggagcaggaggccctggtgaagaccctgcagaagcagcagaacacctgccaccagcagctggaggacctgtgctcctgggtgggccaggccgagcgggccctggccggccaccagggccgcaccacccagcaggacctgagcgccctgcagaagaaccagagcgacctgaaggacctgcaggatgacatccagaacagagccaccagctttgccaccgtggtgaaggacatcgagggcttcatggaggagaaccagaccaagctgagcccccgggagctgacagccctgcgggagaagctgcaccaggccaaggagcagtatgaggccctgcaggaggagaccagggtggcccagaaggagctggaggaggccgtgaccagcgccctgcagcaggagacagagaagagcaaggccgccaaggagctggccgagaacaagaagaagattgatgccctgctggactgggtgacctctgtgggcagcagcggcggccagctgctgaccaacctgcccggcatggagcagctgagcggggccagcctggagaagggggccctggacaccacagatggctacatgggcgtgaaccaggcccctgagaagctggacaagcagtgtgagatgatgaaggcccggcaccaggagctgctgagccagcagcagaacttcatcctggccacccagagcgcccaggccttcctggaccagcacggccacaacctgaccccagaggagcagcagatgctgcagcagaagctgggggagctgaaggagcagtacagcaccagcctggcccagagcgaggccgagctgaagcaggtgcagaccctgcaggatgagctgcagaagttcctgcaggaccacaaggagtttgagagctggctggagaggtctgagaaggagctggagaacatgcacaagggcggcagcagccctgagaccctgcccagcctgctgaagaggcagggcagcttctctgaagatgtgatcagccacaagggggacctgcgctttgtgaccatcagcggccagaaggtgctggacatggagaacagcttcaaggagggcaaggagcccagcgagatcggcaacctggtgaaggacaagctgaaggatgccacagagcgctacacagccctgcacagcaagtgcacccggctgggcagccacctgaacatgctgctgggccagtaccaccagttccagaacagcgctgacagcctgcaggcctggatgcaggcctgtgaggccaacgtggagaagctgctgagtgacacagtggccagtgaccccggggtgctgcaggagcagctggccaccaccaagcagctgcaggaggagctggccgagcaccaggtgcctgtggagaagctgcagaaggtggcccgggacatcatggagattgaaggagagcccgccccagaccaccgccacgtgcaggagaccacagacagcatcctgagccacttccagagcctgagctacagcctggccgagaggagcagcctgctgcagaaggccatcgcccagagccagagcgtgcaggagagcctggagagcctgctgcagagcattggagaggtggagcagaacctggagggcaagcaggtgagcagcctgagcagcggggtcatccaggaggccctggccaccaacatgaagctgaagcaggacatcgcccggcagaagagcagcctggaggccacccgggagatggtgacccgcttcatggagacagctgacagcaccacagctgctgtgctgcagggcaagctggccgaggtgtcccagagatttgagcagctgtgcctgcagcagcaggagaaggagagcagcctgaagaagctgctgccccaggccgagatgtttgagcacctgagcggcaagctgcagcagttcatggagaacaagagcaggatgctggccagcggcaaccagcctgaccaggacatcacccacttcttccagcagatccaggagctgaacctggagatggaggaccagcaggagaacctggacaccctggagcacctggtgacagagctgagcagctgtggctttgccctggacctgtgccagcaccaggacagagtgcagaacctgaggaaggacttcacagagctgcagaagacagtgaaggagcgggagaaggatgccagcagctgccaggagcagctggatgagttcaggaagctggtgaggaccttccagaagtggctgaaggagacagagggcagcatccccccaacagagacctccatgtctgccaaggagctggagaagcagatcgagcacctgaagagcctgctggatgactgggccagcaagggcaccctggtggaggagatcaactgcaagggcaccagcctggagaacctgatcatggagatcacagccccagacagccagggcaagacaggcagcatcctgcccagcgtgggcagctctgtgggctctgtgaatggctaccacacctgcaaggacctgacagagatccagtgtgacatgtctgatgtgaacctgaagtatgagaagctgggcggcgtgctgcacgagcggcaggagagcctgcaggccatcctgaacaggatggaggaggtgcacaaggaggccaacagcgtgctgcagtggctggagagcaaggaggaggtgctgaagtccatggatgccatgagcagccccaccaagacagaaacagtgaaggcccaggccgagagcaacaaggccttcctggccgagctggagcagaacagccccaagatccagaaggtgaaggaggccctggccggcctgctggtgacctaccccaacagccaggaggccgagaactggaagaagatccaggaggagctgaacagccgctgggagcgggccacagaggtgacagtggcccggcagaggcagctggaggagagcgccagccacctggcctgcttccaggccgctgagagccagctgcggccctggctgatggagaaggagctgatgatgggcgtgctgggccccctgagcattgaccccaacatgctgaatgcccagaagcagcaggtgcagttcatgctgaaggagtttgaggcccggcggcagcagcacgagcagctgaatgaagctgcccagggcatcctgactggacctggagatgtgtccctgagcaccagccaggtgcagaaggagctgcagagcatcaaccagaagtgggtggagctgacagacaagctgaacagccgcagcagccagattgaccaggccatcgtgaagagcacccagtaccaggagctgctgcaggacctgtctgagaaggtgcgggctgtgggccagaggctgtctgtgcagagcgccatcagcacccagcctgaggccgtgaagcagcagctggaggagaccagcgagatccgcagtgacctggagcagctggaccacgaggtgaaggaggcccagaccctgtgtgatgagctgtctgtgctgattggagagcagtacctgaaggatgagctgaagaagaggctggagaccgtggccctgcccctgcagggcctggaggacctggccgctgaccgcatcaaccggctgcaggccgccctggccagcacccagcagttccagcagatgtttgatgagctgcggacctggctggatgacaagcagagccagcaggccaagaactgccccatcagcgccaagctggagcggctgcagagccagctgcaggagaatgaggagttccagaagagcctgaaccagcacagcggcagctatgaggtgattgtggccgagggggagagcctgctgctgtctgtgcccccaggagaggagaagaggaccctgcagaaccagctggtggagctgaagaaccactgggaggagctgagcaagaagacagctgaccggcagagccggctgaaggactgcatgcagaaggcccagaagtaccagtggcacgtggaggacctggtgccctggattgaggactgcaaggccaagatgtctgagctgcgggtgaccctggaccctgtgcagctggagagcagcctgctgcggagcaaggccatgctgaatgaggtggagaagagaagaagcctgctggagatcctgaacagcgctgctgacatcctgatcaacagcagcgaggctgatgaagatggcatcagagatgagaaggccggcatcaaccagaacatggatgctgtgacagaggagctgcaggccaagacaggcagcctggaggagatgacccagaggctgcgggagttccaggagagcttcaagaacatcgagaagaaggtggagggcgccaagcaccagctggagatctttgatgccctgggcagccaggcctgcagcaacaagaacctggagaagctgcgggcccagcaggaggtgctgcaggccctggagccccaggtggactacctgaggaacttcacccagggcctggtggaggatgccccagatggcagtgatgccagccagctgctgcaccaggccgaggtggcccagcaggagttcctggaggtgaagcagagggtgaacagcggctgtgtgatgatggagaacaagctggagggcatcggccagttccactgccgggtgcgggagatgttcagccagctggccgacctggatgatgagctggatggcatgggcgccatcggccgggacacagacagcctgcagagccagattgaagatgtgcggctcttcctgaacaagatccacgtgctgaagctggacatcgaggccagcgaggccgagtgccgccacatgctggaggaggagggcaccctggacctgctgggcctgaagcgggagctggaggccctgaacaagcagtgtgggaagctgacagagcggggcaaggcccggcaggagcagctggagctgaccctgggccgggtggaggacttctacaggaagctgaagggcctgaatgatgccaccacagctgctgaggaggccgaggccctgcagtgggtggtgggcacagaggtggagatcatcaaccagcagctggccgacttcaagatgttccagaaggagcaggtggaccccctgcagatgaagctgcagcaggtgaatggcctgggccagggcctcatccagagcgctgggaaggactgtgatgtgcagggcctggagcatgacatggaggagatcaatgcccgctggaacaccctgaacaagaaggtggcccagagaattgcccagctgcaggaggccctgctgcactgcggcaagttccaggatgccctggagcccctgctgtcctggctggccgacacagaggagctgattgccaaccagaagcccccatctgctgagtacaaggtggtgaaggcccagatccaggagcagaagctgctgcagaggctgctggatgacaggaaggccaccgtggacatgctgcaggccgagggcggccgcatcgcccagagcgctgagctggccgaccgggagaagatcaccggccagctggagagcctggagagccgctggacagagctgctgagcaaggctgctgcccggcagaagcagctggaggacatcctggtgctggccaagcagttccacgagacagctgagcccatcagtgacttcctgtctgtgacagagaagaagctggccaacagcgagcctgtgggcacccagacagccaagatccagcagcagatcatccgccacaaggccctggaggaggacattgaaaatcatgccacagatgtgcaccaggccgtgaagattggccagagcctgagcagcctgaccagccctgctgagcagggcgtgctgtctgagaagattgacagcctgcaggcccgctacagcgagatccaggaccgctgctgcaggaaggccgccctgctggaccaggccctgagcaatgcccggctgtttggagaagatgaggtggaggtgctgaactggctggccgaggtggaggacaagctgagctctgtgtttgtgaaggacttcaagcaggatgtgctgcaccggcagcacgccgaccacctggccctgaatgaggagatcgtgaacaggaagaagaatgtggaccaggccatcaagaatggccaggccctgctgaagcagaccactggagaggaggtgctgctgatccaggagaagctggatggcatcaagaccaggtatgctgacatcaccgtgaccagcagcaaggccctgcggaccctggagcaggcccggcagctggccaccaagttccagagcacctatgaggagctgaccggctggctgcgggaggtggaggaggagctggccaccagcggcggccagagccccaccggggagcagatcccccagttccagcagaggcagaaggagctgaagaaggaggtgatggagcaccggctggtgctggacacagtgaatgaggtgtcccgggccctgctggagctggtgccctggagggcccgggagggcctggacaagctggtgtctgatgccaatgagcagtacaagctggtgtctgacaccatcggccagagggtggatgaaattgatgctgccatccagaggagccagcagtatgagcaggccgcagatgctgagctggcctgggtggccgagaccaagaggaagctgatggccctgggccccatccggctggagcaggaccagaccacagcccagctgcaggtgcagaaggccttcagcattgacatcatccgccacaaggacagcatggatgagctgttcagccacaggtctgagatcttcggcacctgtggggaggagcagaagacagtgctgcaggagaagacagagagcctcatccagcagtatgaggccatcagcctgctgaacagcgagagatatgcccggctggagcgggcccaggtgctggtgaaccagttctgggagacctatgaggagctgagcccctggattgaggagacccgggccctgattgcccagctgcccagccctgccatcgaccacgagcagctgcggcagcagcaggaggagatgaggcagctgcgggagagcattgctgagcacaagccccacatcgacaagctgctgaagattggcccccagctgaaggagctgaaccctgaggagggggagatggtggaggagaagtaccagaaggccgagaacatgtatgcccagatcaaggaggaggtgcggcagagggccctggccctggatgaggccgtgtcccagagcacccagatcacagagttccatgacaagattgagcccatgctggagaccctggagaacctgagcagccggctgaggatgcctcctctcatcccagctgaggtggacaagatccgggagtgcatcagtgacaacaagagcgccaccgtggagctggagaagctgcagcccagctttgaggccctgaagagaagaggagaggagctgattggccgcagccagggcgctgacaaggacctggccgccaaggagatccaggacaagctggaccagatggtgttcttctgggaggacatcaaggcccgggcagaggagcgggagatcaagttcctggatgtgctggagctggccgagaagttctggtatgacatggccgccctgctgaccaccatcaaggacacccaggacatcgtgcatgacctggagagccctggcatcgaccccagcatcatcaagcagcaggtggaggccgctgagaccatcaaggaggagacagatggcctgcacgaggagctggagttcatccgcatcctgggcgctgacctgatctttgcctgtggggagacagagaagccagaggtgaggaagagcattgatgagatgaacaatgcctgggagaacctgaacaagacctggaaggagcggctggagaagctggaggatgccatgcaggccgctgtgcagtaccaggacaccctgcaggccatgtttgactggctggacaacacagtcatcaagctgtgcaccatgcctcctgtgggcacagacctgaacacagtgaaggaccagctgaatgagatgaaggagttcaaggtggaggtgtaccagcagcagatcgagatggagaagctgaaccaccagggcgagctgatgctgaagaaggccacagatgaaacagaccgggacatcatccgggagcccctgacagagctgaagcacctgtgggagaacctgggggagaagatcgcccaccggcagcacaagctggagggcgccctgctggccctgggccagttccagcacgccctggaggagctgatgtcctggctgacccacacagaggagctgctggatgcccagaggcccatcagcggggaccccaaggtgattgaggtggagctggccaagcaccacgtgctgaagaatgatgtgctggcccaccaggccaccgtggagaccgtgaacaaggctggaaatgagctgctggagagcagcgctggagatgatgccagcagcctgcggagccggctggaggccatgaaccagtgctgggagagcgtgctgcagaagacagaggagcgggagcagcagctgcagagcaccctgcagcaggcccagggcttccacagcgagattgaggacttcctgctggagctgaccaggatggagagccagctgagcgccagcaagcccactggaggcctgcctgagacagcccgggagcagctggacacccacatggagctgtacagccagctgaaggccaaggaggagacctacaaccagctgctggacaagggccgcctgatgctgctgagcagagatgacagcggcagcggcagcaagacagagcagagcgtggccctgctggagcagaagtggcacgtggtgagcagcaagatggaggagaggaagagcaagctggaggaggccctgaacctggccacagagttccagaacagcctgcaggagttcatcaactggctgaccctggccgagcagagcctgaacatcgccagcccccccagcctcatcctgaacacagtgctgagccagatcgaggagcacaaggtgtttgccaatgaggtgaatgcccaccgggaccagatcatcgagctggaccagacaggcaaccagctgaagttcctgagccagaagcaggatgtggtgctgatcaagaacctgctggtgtctgtgcagagccgctgggagaaggtggtgcagaggagcattgaaagaggccgcagcctggatgatgccaggaagagggccaagcagttccacgaggcctggaagaagctgattgactggctggaggatgctgagagccacctggacagcgagctggagatcagcaatgaccctgacaagatcaagctgcagctgagcaagcacaaggagttccagaagaccctgggcggcaagcagcctgtgtatgacaccaccatcagaacaggccgggccctgaaggagaagaccctgctgcctgaggacagccagaagctggacaacttcctgggggaggtgcgggacaagtgggacacagtgtgtgggaagtctgtggagcggcagcacaagctggaggaggccctgctcttcagcggccagttcatggatgccctgcaggccctggtggactggctgtacaaggtggagccccagctggccgaggaccagcctgtgcatggagacctggacctggtgatgaacctgatggatgcccacaaggtgttccagaaggagctgggcaagaggactggaacagtgcaggtgctgaagaggagcggccgggagctgattgagaacagcagagatgacaccacctgggtgaagggccagctgcaggagctgagcacccgctgggacacagtgtgcaagctgtctgtgtccaagcagagccggctggagcaggccctgaagcaggccgaggtgttccgggacacagtgcacatgctgctggagtggctgtctgaggccgagcagaccctgcgcttccggggggccctgcctgatgacacagaggccctgcagagcctgattgacacccacaaggagttcatgaagaaggtggaggagaagagggtggatgtgaacagcgctgtggccatgggagaggtgatcctggccgtgtgccacccagactgcatcaccaccatcaagcactggatcaccatcatccgggccaggtttgaggaggtgctgacctgggccaagcagcaccagcagaggctggagacagccctgtctgagctggtggccaatgctgagctgctggaggagctgctggcctggatccagtgggccgagaccaccctcatccagagggaccaggagcccatcccccagaacatcgacagagtgaaggccctgattgctgagcaccagaccttcatggaggagatgaccaggaagcagccagatgtggacagagtgaccaagacctacaagaggaagaacatcgagcccacccacgcccccttcatcgagaagagccgcagcggcggcaggaagagcctgagccagcccaccccaccacccatgcccatcctgagccagagcgaggccaagaacccccgcatcaaccagctgagcgcccgctggcagcaggtgtggctgctggccctggagcggcagaggaagctgaatgatgccctggaccggctggaggagctgaaggagtttgccaactttgattttgatgtgtggaggaagaagtacatgcgctggatgaaccacaagaagagccgggtgatggacttcttcagaagaattgacaaggaccaggacggcaagatcacccggcaggagttcattgatggcatcctggccagcaagttccccaccaccaagctggagatgacagctgtggccgacatctttgacagagatggagatggctacatcgactactatgaatttgtggccgccctgcaccccaacaaggatgcctaccggcccaccacagatgctgacaagattgaagatgaggtgacccggcaggtggcccagtgcaagtgtgccaagcgcttccaggtggagcagatcggggagaacaagtaccgcttcttcctgggcaaccagtttggagacagccagcagctgcggctggtgcgcatcctgcggagcacagtgatggtgcgggtgggcggcggctggatggccctggatgagttcctggtgaagaatgacccctgccgggcccggggccgcaccaacatcgagctgcgggagaagttcatcctgcctgagggcgccagccagggcatgacccccttccgcagccggggccgccgcagcaagcccagcagccgggccgccagccccaccaggagcagcagcagcgccagccagagcaaccacagctgcacctccatgcccagcagccctgccaccccagccagcggcaccaaggtgatccccagcagcggcagcaagctgaagaggcccacccccaccttccacagcagcaggaccagcctggccggggacaccagcaacagcagcagccctgccagcactggagccaagaccaacagagctgaccccaagaagagcgccagccggcccggcagccgggccggcagccgggccggcagccgggccagcagcagaagaggaagtgatgccagtgactttgacctgctggagacccagagcgcctgcagcgacaccagcgagagcagcgctgctgggggccagggcaacagccggcggggcctgaacaagcccagcaagatccccaccatgagcaagaagaccaccacagccagccccaggaccccaggccccaagaggtag

SEQ ID NO: 159744 - DNA, 16293 bp, Artificial Sequence
  Description of Artificial Sequence: Synthetic coding sequence
atgagcagcagtgatgaggagaccctgtctgagaggagctgccgctctgagaggagctgccgctctgagaggagctacagaagtgagaggagcggcagcctgagcccctgccccccaggggacaccctgccctggaacctgcccctgcacgagcagaagaagaggaagagccaggacagcgtgctggaccctgctgagagagctgtggtgcgggtggctgatgagcgggacagagtgcagaagaagaccttcaccaagtgggtgaacaagcacctgatgaaggtgaggaagcacatcaatgacctgtatgaggacctgagagatggccacaacctgatcagcctgctggaggtgctgagcggcatcaagctgccccgggagaagggccgcatgaggttccaccggctgcagaatgtgcagatcgccctggacttcctgaagcagaggcaggtgaagctggtgaacatcagaaatgatgacatcacagatggcaaccccaagctgaccctgggcctcatctggaccatcatcctgcacttccagatcagtgacatctacatcagcggggagagcggggacatgtctgccaaggagaagctgctgctgtggacccagaaggtgacagctggctacacaggcatcaagtgcaccaacttcagcagctgctggagcgatggcaagatgtttaatgccctgatccaccgctacagaccagacctggtggacatggagcgggtgcagatccagagcaaccgggagaacctggagcaggcctttgaggtggccgagcggctgggcgtgacccggctgctggatgctgaagatgtggatgtgcccagcccagatgagaagagcgtcatcacctacgtgagcagcatctatgatgccttccccaaggtgcctgagggcggggagggcatcagcgccacagaggtggacagccgctggcaggagtaccagagccgggtggacagcctcatcccctggatcaagcagcacaccatcctgatgtctgacaagaccttcccccagaaccctgtggagctgaaggccctgtacaaccagtacatccacttcaaggagacagagatcctggccaaggagcgggagaagggccgcatcgaggagctgtacaagctgctggaggtgtggattgaatttggccgcatcaagctgccccagggctaccaccccaatgatgtggaggaggagtggggcaagctgatcatcgagatgctggagcgggagaagagcctgcggcctgctgtggagcggctggagctgctgctgcagatcgccaacaagatccagaatggagccctgaactgtgaggagaagctgaccctggccaagaacaccctgcaggctgatgctgcccacctggagagcggccagcctgtgcagtgtgagagtgatgtgatcatgtacatccaggagtgtgagggcctcatccggcagctgcaggtggacctgcagatcctgagagatgagaactactaccagctggaggagctggccttccgggtgatgaggctgcaggatgagctggtgaccctgcggctggagtgcaccaacctgtacaggaagggccacttcaccagcctggagctggtgccccccagcaccctgaccaccacccacctgaaggccgagcccctgaccaaggccacccacagcagcagcacctcctggttcaggaagcccatgaccagggctgagctggtggccatcagcagcagtgaagatgagggcaacctgcgctttgtgtatgagctgctgtcctgggtggaggagatgcagatgaagctggagcgggcagagtggggcaatgacctgcccagcgtggagctgcagctggagacccagcagcacatccacacctctgtggaggagctgggcagctctgtgaaggaggcccggctgtatgagggcaagatgagccagaacttccacaccagctatgcagagaccctgggcaagctggagacccagtactgcaagctgaaggagaccagcagcttcaggatgaggcacctgcagagcctgcacaagtttgtgtcccgggccacagctgagctgatctggctgaatgagaaggaggaggaggagctggcctatgactggagcgacaacaacagcaacatcagcgccaagaggaactacttcagcgagctgaccatggagctggaggagaagcaggatgtgttccgcagcctgcaggacacagctgagctgctgagcctggagaaccacccagccaagcagacagtggaggcctacagcgctgctgtgcagagccagctgcagtggatgaagcagctgtgcctgtgtgtggagcagcacgtgaaggagaacacagcctacttccagttcttcagtgatgcccgggagctggagagcttcctgaggaacctgcaggacagcatcaagaggaagtacagctgtgaccacaacaccagcctgagccggctggaggacctgctgcaggacagcatggatgagaaggagcagctgatccagagcaagagctctgtggccagcctggtgggccgcagcaagaccatcgtgcagctgaagcccaggagcccagaccacgtgctgaagaacaccatctctgtgaaggctgtgtgtgactaccggcagatcgagatcaccatctgcaagaatgatgaatgtgtgctggaggacaacagccagaggaccaagtggaaggtgatcagccccactggaaatgaggccatggtgcccagcgtgtgcttcctgatccccccacccaacaaggatgccatcgagatggccagccgggtggagcagagctaccagaaggtgatggccctgtggcaccagctgcacgtgaacaccaagagcctcatctcctggaactacctgaggaaggacctggacctggtgcagacctggaacctggagaagctgcggagcagcgcccctggagagtgccaccagatcatgaagaacctgcaggcccactatgaggacttcctgcaggacagccgggacagcgtgctcttctctgtggccgaccggctgcggctggaggaggaggtggaggcctgcaaggcccgcttccagcacctgatgaagtccatggagaatgaagacaaggaggagaccgtggccaagatgtacatcagcgagctgaagaacatccggctgcggctggaggagtatgagcagagggtggtgaagaggatccagagcctggccagcagcaggacagacagagatgcctggcaggacaatgccctgagaattgctgagcaggagcacacccaggaggacctgcagcagctgcggagtgacctggatgctgtgtccatgaagtgtgacagcttcctgcaccagagccccagcagcagctctgtgcccaccctgcggtctgagctgaacctgctggtggagaagatggaccacgtgtatggcctgagcacagtgtacctgaacaagctgaagacagtggatgtgattgtgcgcagcatccaggatgctgagctgctggtgaagggctatgagatcaagctgagccaggaggaggtggtgctggccgacctgagcgccctggaggcccactggagcaccctgcggcactggctgagtgatgtgaaggacaagaacagcgtcttctctgtgctggatgaggagatcgccaaggccaaggtggtggccgagcagatgagccggctgaccccagagaggaacctggacctggagcgctaccaggagaagggcagccagctgcaggagcgctggcacagggtcatcgcccagctggagatccggcagagcgagctggagagcatccaggaggtgctgggggactaccgggcctgccacggcaccctcatcaagtggattgaggagaccacagcccagcaggagatgatgaagccaggccaggccgaggacagccgggtgctgtctgagcagctgagccagcagacagccctgtttgctgagattgaaagaaaccagaccaagctggaccagtgccagaagttcagccagcagtacagcaccatcgtgaaggactatgagctgcagctgatgacctacaaggcctttgtggagagccagcagaagagccctgggaagagaagaaggatgctgagcagcagtgatgccatcacccaggagttcatggacctgcggacccgctacacagccctggtgaccctgaccacccagcacgtgaagtacatcagtgatgccctgcggcggctggaggaggaggagaaggtggtggaggaggagaagcaggagcacgtggagaaggtgaaggagctgctgggctgggtgtccaccctggccaggaacacccagggcaaggccaccagcagcgagaccaaggagagcacagacatcgagaaggccatcctggagcagcaggtgctgtctgaggagctgaccaccaagaaggagcaggtgtctgaggccatcaagaccagccagatcttcctggccaagcacggccacaagctgtctgagaaggagaagaagcagatcagcgagcagctgaatgccctgaacaaggcctaccatgacctgtgtgatggcagcgccaaccagctgcagcagctgcagagccagctggcccaccagacagagcagaagaccctgcagaagcagcagaacacctgccaccagcagctggaggacctgtgctcctgggtgggccaggccgagcgggccctggccggccaccagggccgcaccacccagcaggacctgagcgccctgcagaagaaccagagcgacctgaaggacctgcaggatgacatccagaacagagccaccagctttgccaccgtggtgaaggacatcgagggcttcatggaggagaaccagaccaagctgagcccccgggagctgacagccctgcgggagaagctgcaccaggccaaggagcagtatgaggccctgcaggaggagaccagggtggcccagaaggagctggaggaggccgtgaccagcgccctgcagcaggagacagagaagagcaaggccgccaaggagctggccgagaacaagaagaagattgatgccctgctggactgggtgacctctgtgggcagcagcggcggccagctgctgaccaacctgcccggcatggagcagctgagcggggccagcctggagaagggggccctggacaccacagatggctacatgggcgtgaaccaggcccctgagaagctggacaagcagtgtgagatgatgaaggcccggcaccaggagctgctgagccagcagcagaacttcatcctggccacccagagcgcccaggccttcctggaccagcacggccacaacctgaccccagaggagcagcagatgctgcagcagaagctgggggagctgaaggagcagtacagcaccagcctggcccagagcgaggccgagctgaagcaggtgcagaccctgcaggatgagctgcagaagttcctgcaggaccacaaggagtttgagagctggctggagaggtctgagaaggagctggagaacatgcacaagggcggcagcagccctgagaccctgcccagcctgctgaagaggcagggcagcttctctgaagatgtgatcagccacaagggggacctgcgctttgtgaccatcagcggccagaaggtgctggacatggagaacagcttcaaggagggcaaggagcccagcgagatcggcaacctggtgaaggacaagctgaaggatgccacagagcgctacacagccctgcacagcaagtgcacccggctgggcagccacctgaacatgctgctgggccagtaccaccagttccagaacagcgctgacagcctgcaggcctggatgcaggcctgtgaggccaacgtggagaagctgctgagtgacacagtggccagtgaccccggggtgctgcaggagcagctggccaccaccaagcagctgcaggaggagctggccgagcaccaggtgcctgtggagaagctgcagaaggtggcccgggacatcatggagattgaaggagagcccgccccagaccaccgccacgtgcaggagaccacagacagcatcctgagccacttccagagcctgagctacagcctggccgagaggagcagcctgctgcagaaggccatcgcccagagccagagcgtgcaggagagcctggagagcctgctgcagagcattggagaggtggagcagaacctggagggcaagcaggtgagcagcctgagcagcggggtcatccaggaggccctggccaccaacatgaagctgaagcaggacatcgcccggcagaagagcagcctggaggccacccgggagatggtgacccgcttcatggagacagctgacagcaccacagctgctgtgctgcagggcaagctggccgaggtgtcccagagatttgagcagctgtgcctgcagcagcaggagaaggagagcagcctgaagaagctgctgccccaggccgagatgtttgagcacctgagcggcaagctgcagcagttcatggagaacaagagcaggatgctggccagcggcaaccagcctgaccaggacatcacccacttcttccagcagatccaggagctgaacctggagatggaggaccagcaggagaacctggacaccctggagcacctggtgacagagctgagcagctgtggctttgccctggacctgtgccagcaccaggacagagtgcagaacctgaggaaggacttcacagagctgcagaagacagtgaaggagcgggagaaggatgccagcagctgccaggagcagctggatgagttcaggaagctggtgaggaccttccagaagtggctgaaggagacagagggcagcatccccccaacagagacctccatgtctgccaaggagctggagaagcagatcgagcacctgaagagcctgctggatgactgggccagcaagggcaccctggtggaggagatcaactgcaagggcaccagcctggagaacctgatcatggagatcacagccccagacagccagggcaagacaggcagcatcctgcccagcgtgggcagctctgtgggctctgtgaatggctaccacacctgcaaggacctgacagagatccagtgtgacatgtctgatgtgaacctgaagtatgagaagctgggcggcgtgctgcacgagcggcaggagagcctgcaggccatcctgaacaggatggaggaggtgcacaaggaggccaacagcgtgctgcagtggctggagagcaaggaggaggtgctgaagtccatggatgccatgagcagccccaccaagacagaaacagtgaaggcccaggccgagagcaacaaggccttcctggccgagctggagcagaacagccccaagatccagaaggtgaaggaggccctggccggcctgctggtgacctaccccaacagccaggaggccgagaactggaagaagatccaggaggagctgaacagccgctgggagcgggccacagaggtgacagtggcccggcagaggcagctggaggagagcgccagccacctggcctgcttccaggccgctgagagccagctgcggccctggctgatggagaaggagctgatgatgggcgtgctgggccccctgagcattgaccccaacatgctgaatgcccagaagcagcaggtgcagttcatgctgaaggagtttgaggcccggcggcagcagcacgagcagctgaatgaagctgcccagggcatcctgactggacctggagatgtgtccctgagcaccagccaggtgcagaaggagctgcagagcatcaaccagaagtgggtggagctgacagacaagctgaacagccgcagcagccagattgaccaggccatcgtgaagagcacccagtaccaggagctgctgcaggacctgtctgagaaggtgcgggctgtgggccagaggctgtctgtgcagagcgccatcagcacccagcctgaggccgtgaagcagcagctggaggagaccagcgagatccgcagtgacctggagcagctggaccacgaggtgaaggaggcccagaccctgtgtgatgagctgtctgtgctgattggagagcagtacctgaaggatgagctgaagaagaggctggagaccgtggccctgcccctgcagggcctggaggacctggccgctgaccgcatcaaccggctgcaggccgccctggccagcacccagcagttccagcagatgtttgatgagctgcggacctggctggatgacaagcagagccagcaggccaagaactgccccatcagcgccaagctggagcggctgcagagccagctgcaggagaatgaggagttccagaagagcctgaaccagcacagcggcagctatgaggtgattgtggccgagggggagagcctgctgctgtctgtgcccccaggagaggagaagaggaccctgcagaaccagctggtggagctgaagaaccactgggaggagctgagcaagaagacagctgaccggcagagccggctgaaggactgcatgcagaaggcccagaagtaccagtggcacgtggaggacctggtgccctggattgaggactgcaaggccaagatgtctgagctgcgggtgaccctggaccctgtgcagctggagagcagcctgctgcggagcaaggccatgctgaatgaggtggagaagagaagaagcctgctggagatcctgaacagcgctgctgacatcctgatcaacagcagcgaggctgatgaagatggcatcagagatgagaaggccggcatcaaccagaacatggatgctgtgacagaggagctgcaggccaagacaggcagcctggaggagatgacccagaggctgcgggagttccaggagagcttcaagaacatcgagaagaaggtggagggcgccaagcaccagctggagatctttgatgccctgggcagccaggcctgcagcaacaagaacctggagaagctgcgggcccagcaggaggtgctgcaggccctggagccccaggtggactacctgaggaacttcacccagggcctggtggaggatgccccagatggcagtgatgccagccagctgctgcaccaggccgaggtggcccagcaggagttcctggaggtgaagcagagggtgaacagcggctgtgtgatgatggagaacaagctggagggcatcggccagttccactgccgggtgcgggagatgttcagccagctggccgacctggatgatgagctggatggcatgggcgccatcggccgggacacagacagcctgcagagccagattgaagatgtgcggctcttcctgaacaagatccacgtgctgaagctggacatcgaggccagcgaggccgagtgccgccacatgctggaggaggagggcaccctggacctgctgggcctgaagcgggagctggaggccctgaacaagcagtgtgggaagctgacagagcggggcaaggcccggcaggagcagctggagctgaccctgggccgggtggaggacttctacaggaagctgaagggcctgaatgatgccaccacagctgctgaggaggccgaggccctgcagtgggtggtgggcacagaggtggagatcatcaaccagcagctggccgacttcaagatgttccagaaggagcaggtggaccccctgcagatgaagctgcagcaggtgaatggcctgggccagggcctcatccagagcgctgggaaggactgtgatgtgcagggcctggagcatgacatggaggagatcaatgcccgctggaacaccctgaacaagaaggtggcccagagaattgcccagctgcaggaggccctgctgcactgcggcaagttccaggatgccctggagcccctgctgtcctggctggccgacacagaggagctgattgccaaccagaagcccccatctgctgagtacaaggtggtgaaggcccagatccaggagcagaagctgctgcagaggctgctggatgacaggaaggccaccgtggacatgctgcaggccgagggcggccgcatcgcccagagcgctgagctggccgaccgggagaagatcaccggccagctggagagcctggagagccgctggacagagctgctgagcaaggctgctgcccggcagaagcagctggaggacatcctggtgctggccaagcagttccacgagacagctgagcccatcagtgacttcctgtctgtgacagagaagaagctggccaacagcgagcctgtgggcacccagacagccaagatccagcagcagatcatccgccacaaggccctggaggaggacattgaaaatcatgccacagatgtgcaccaggccgtgaagattggccagagcctgagcagcctgaccagccctgctgagcagggcgtgctgtctgagaagattgacagcctgcaggcccgctacagcgagatccaggaccgctgctgcaggaaggccgccctgctggaccaggccctgagcaatgcccggctgtttggagaagatgaggtggaggtgctgaactggctggccgaggtggaggacaagctgagctctgtgtttgtgaaggacttcaagcaggatgtgctgcaccggcagcacgccgaccacctggccctgaatgaggagatcgtgaacaggaagaagaatgtggaccaggccatcaagaatggccaggccctgctgaagcagaccactggagaggaggtgctgctgatccaggagaagctggatggcatcaagaccaggtatgctgacatcaccgtgaccagcagcaaggccctgcggaccctggagcaggcccggcagctggccaccaagttccagagcacctatgaggagctgaccggctggctgcgggaggtggaggaggagctggccaccagcggcggccagagccccaccggggagcagatcccccagttccagcagaggcagaaggagctgaagaaggaggtgatggagcaccggctggtgctggacacagtgaatgaggtgtcccgggccctgctggagctggtgccctggagggcccgggagggcctggacaagctggtgtctgatgccaatgagcagtacaagctggtgtctgacaccatcggccagagggtggatgaaattgatgctgccatccagaggagccagcagtatgagcaggccgcagatgctgagctggcctgggtggccgagaccaagaggaagctgatggccctgggccccatccggctggagcaggaccagaccacagcccagctgcaggtgcagaaggccttcagcattgacatcatccgccacaaggacagcatggatgagctgttcagccacaggtctgagatcttcggcacctgtggggaggagcagaagacagtgctgcaggagaagacagagagcctcatccagcagtatgaggccatcagcctgctgaacagcgagagatatgcccggctggagcgggcccaggtgctggtgaaccagttctgggagacctatgaggagctgagcccctggattgaggagacccgggccctgattgcccagctgcccagccctgccatcgaccacgagcagctgcggcagcagcaggaggagatgaggcagctgcgggagagcattgctgagcacaagccccacatcgacaagctgctgaagattggcccccagctgaaggagctgaaccctgaggagggggagatggtggaggagaagtaccagaaggccgagaacatgtatgcccagatcaaggaggaggtgcggcagagggccctggccctggatgaggccgtgtcccagagcacccaggtgtcccagttccatgacaagattgagcccatgctggagaccctggagaacctgagcagccggctgaggatgcctcctctcatcccagctgaggtggacaagatccgggagtgcatcagtgacaacaagagcgccaccgtggagctggagaagctgcagcccagctttgaggccctgaagagaagaggagaggagctgattggccgcagccagggcgctgacaaggacctggccgccaaggagatccaggacaagctggaccagatggtgttcttctgggaggacatcaaggcccgggcagaggagcgggagatcaagttcctggatgtgctggagctggccgagaagttctggtatgacatggccgccctgctgaccaccatcaaggacacccaggacatcgtgcatgacctggagagccctggcatcgaccccagcatcatcaagcagcaggtggaggccgctgagaccatcaaggaggagacagatggcctgcacgaggagctggagttcatccgcatcctgggcgctgacctgatctttgcctgtggggagacagagaagccagaggtgaggaagagcattgatgagatgaacaatgcctgggagaacctgaacaagacctggaaggagcggctggagaagctggaggatgccatgcaggccgctgtgcagtaccaggacaccctgcaggccatgtttgactggctggacaacacagtcatcaagctgtgcaccatgcctcctgtgggcacagacctgaacacagtgaaggaccagctgaatgagatgaaggagttcaaggtggaggtgtaccagcagcagatcgagatggagaagctgaaccaccagggcgagctgatgctgaagaaggccacagatgaaacagaccgggacatcatccgggagcccctgacagagctgaagcacctgtgggagaacctgggggagaagatcgcccaccggcagcacaagctggagggcgccctgctggccctgggccagttccagcacgccctggaggagctgatgtcctggctgacccacacagaggagctgctggatgcccagaggcccatcagcggggaccccaaggtgattgaggtggagctggccaagcaccacgtgctgaagaatgatgtgctggcccaccaggccaccgtggagaccgtgaacaaggctggaaatgagctgctggagagcagcgctggagatgatgccagcagcctgcggagccggctggaggccatgaaccagtgctgggagagcgtgctgcagaagacagaggagcgggagcagcagctgcagagcaccctgcagcaggcccagggcttccacagcgagattgaggacttcctgctggagctgaccaggatggagagccagctgagcgccagcaagcccactggaggcctgcctgagacagcccgggagcagctggacacccacatggagctgtacagccagctgaaggccaaggaggagacctacaaccagctgctggacaagggccgcctgatgctgctgagcagagatgacagcggcagcggcagcaagacagagcagagcgtggccctgctggagcagaagtggcacgtggtgagcagcaagatggaggagaggaagagcaagctggaggaggccctgaacctggccacagagttccagaacagcctgcaggagttcatcaactggctgaccctggccgagcagagcctgaacatcgccagcccccccagcctcatcctgaacacagtgctgagccagatcgaggagcacaaggtgtttgccaatgaggtgaatgcccaccgggaccagatcatcgagctggaccagacaggcaaccagctgaagttcctgagccagaagcaggatgtggtgctgatcaagaacctgctggtgtctgtgcagagccgctgggagaaggtggtgcagaggagcattgaaagaggccgcagcctggatgatgccaggaagagggccaagcagttccacgaggcctggaagaagctgattgactggctggaggatgctgagagccacctggacagcgagctggagatcagcaatgaccctgacaagatcaagctgcagctgagcaagcacaaggagttccagaagaccctgggcggcaagcagcctgtgtatgacaccaccatcagaacaggccgggccctgaaggagaagaccctgctgcctgaggacagccagaagctggacaacttcctgggggaggtgcgggacaagtgggacacagtgtgtgggaagtctgtggagcggcagcacaagctggaggaggccctgctcttcagcggccagttcatggatgccctgcaggccctggtggactggctgtacaaggtggagccccagctggccgaggaccagcctgtgcatggagacctggacctggtgatgaacctgatggatgcccacaaggtgttccagaaggagctgggcaagaggactggaacagtgcaggtgctgaagaggagcggccgggagctgattgagaacagcagagatgacaccacctgggtgaagggccagctgcaggagctgagcacccgctgggacacagtgtgcaagctgtctgtgtccaagcagagccggctggagcaggccctgaagcaggccgaggtgttccgggacacagtgcacatgctgctggagtggctgtctgaggccgagcagaccctgcgcttccggggggccctgcctgatgacacagaggccctgcagagcctgattgacacccacaaggagttcatgaagaaggtggaggagaagagggtggatgtgaacagcgctgtggccatgggagaggtgatcctggccgtgtgccacccagactgcatcaccaccatcaagcactggatcaccatcatccgggccaggtttgaggaggtgctgacctgggccaagcagcaccagcagaggctggagacagccctgtctgagctggtggccaatgctgagctgctggaggagctgctggcctggatccagtgggccgagaccaccctcatccagagggaccaggagcccatcccccagaacatcgacagagtgaaggccctgattgctgagcaccagaccttcatggaggagatgaccaggaagcagccagatgtggacagagtgaccaagacctacaagaggaagaacatcgagcccacccacgcccccttcatcgagaagagccgcagcggcggcaggaagagcctgagccagcccaccccaccacccatgcccatcctgagccagagcgaggccaagaacccccgcatcaaccagctgagcgcccgctggcagcaggtgtggctgctggccctggagcggcagaggaagctgaatgatgccctggaccggctggaggagctgaaggagtttgccaactttgattttgatgtgtggaggaagaagtacatgcgctggatgaaccacaagaagagccgggtgatggacttcttcagaagaattgacaaggaccaggacggcaagatcacccggcaggagttcattgatggcatcctggccagcaagttccccaccaccaagctggagatgacagctgtggccgacatctttgacagagatggagatggctacatcgactactatgaatttgtggccgccctgcaccccaacaaggatgcctaccggcccaccacagatgctgacaagattgaagatgaggtgacccggcaggtggcccagtgcaagtgtgccaagcgcttccaggtggagcagatcggggagaacaagtacagatttggagacagccagcagctgcggctggtgcgcatcctgcggagcacagtgatggtgcgggtgggcggcggctggatggccctggatgagttcctggtgaagaatgacccctgccgggcccggggccgcaccaacatcgagctgcgggagaagttcatcctgcctgagggcgccagccagggcatgacccccttccgcagccggggccgccgcagcaagcccagcagccgggccgccagccccaccaggagcagcagcagcgccagccagagcaaccacagctgcacctccatgcccagcagccctgccaccccagccagcggcaccaaggtgatccccagcagcggcagcaagctgaagaggcccacccccaccttccacagcagcaggaccagcctggccggggacaccagcaacagcagcagccctgccagcactggagccaagaccaacagagctgaccccaagaagagcgccagccggcccggcagccgggccggcagccgggccggcagccgggccagcagcagaagaggaagtgatgccagtgactttgacctgctggagacccagagcgcctgcagcgacaccagcgagagcagcgctgctgggggccagggcaacagccggcggggcctgaacaagcccagcaagatccccaccatgagcaagaagaccaccacagccagccccaggaccccaggccccaagaggtag

SEQ ID NO: 159745 - DNA, 16293 bp, Artificial Sequence
  Description of Artificial Sequence: Synthetic coding sequence
atgagcagcagtgatgaggagaccctgtctgagaggagctgccgctctgagaggagctgccgctctgagaggagctacagaagtgagaggagcggcagcctgagcccctgccccccaggggacaccctgccctggaacctgcccctgcacgagcagaagaagaggaagagccaggacagcgtgctggaccctgctgagagagctgtggtgcgggtggctgatgagcgggacagagtgcagaagaagaccttcaccaagtgggtgaacaagcacctgatgaaggtgaggaagcacatcaatgacctgtatgaggacctgagagatggccacaacctgatcagcctgctggaggtgctgagcggcatcaagctgccccgggagaagggccgcatgaggttccaccggctgcagaatgtgcagatcgccctggacttcctgaagcagaggcaggtgaagctggtgaacatcagaaatgatgacatcacagatggcaaccccaagctgaccctgggcctcatctggaccatcatcctgcacttccagatcagtgacatctacatcagcggggagagcggggacatgtctgccaaggagaagctgctgctgtggacccagaaggtgacagctggctacacaggcatcaagtgcaccaacttcagcagctgctggagcgatggcaagatgtttaatgccctgatccaccgctacagaccagacctggtggacatggagcgggtgcagatccagagcaaccgggagaacctggagcaggcctttgaggtggccgagcggctgggcgtgacccggctgctggatgctgaagatgtggatgtgcccagcccagatgagaagagcgtcatcacctacgtgagcagcatctatgatgccttccccaaggtgcctgagggcggggagggcatcagcgccacagaggtggacagccgctggcaggagtaccagagccgggtggacagcctcatcccctggatcaagcagcacaccatcctgatgtctgacaagaccttcccccagaaccctgtggagctgaaggccctgtacaaccagtacatccacttcaaggagacagagatcctggccaaggagcgggagaagggccgcatcgaggagctgtacaagctgctggaggtgtggattgaatttggccgcatcaagctgccccagggctaccaccccaatgatgtggaggaggagtggggcaagctgatcatcgagatgctggagcgggagaagagcctgcggcctgctgtggagcggctggagctgctgctgcagatcgccaacaagatccagaatggagccctgaactgtgaggagaagctgaccctggccaagaacaccctgcaggctgatgctgcccacctggagagcggccagcctgtgcagtgtgagagtgatgtgatcatgtacatccaggagtgtgagggcctcatccggcagctgcaggtggacctgcagatcctgagagatgagaactactaccagctggaggagctggccttccgggtgatgaggctgcaggatgagctggtgaccctgcggctggagtgcaccaacctgtacaggaagggccacttcaccagcctggagctggtgccccccagcaccctgaccaccacccacctgaaggccgagcccctgaccaaggccacccacagcagcagcacctcctggttcaggaagcccatgaccagggctgagctggtggccatcagcagcagtgaagatgagggcaacctgcgctttgtgtatgagctgctgtcctgggtggaggagatgcagatgaagctggagcgggcagagtggggcaatgacctgcccagcgtggagctgcagctggagacccagcagcacatccacacctctgtggaggagctgggcagctctgtgaaggaggcccggctgtatgagggcaagatgagccagaacttccacaccagctatgcagagaccctgggcaagctggagacccagtactgcaagctgaaggagaccagcagcttcaggatgaggcacctgcagagcctgcacaagtttgtgtcccgggccacagctgagctgatctggctgaatgagaaggaggaggaggagctggcctatgactggagcgacaacaacagcaacatcagcgccaagaggaactacttcagcgagctgaccatggagctggaggagaagcaggatgtgttccgcagcctgcaggacacagctgagctgctgagcctggagaaccacccagccaagcagacagtggaggcctacagcgctgctgtgcagagccagctgcagtggatgaagcagctgtgcctgtgtgtggagcagcacgtgaaggagaacacagcctacttccagttcttcagtgatgcccgggagctggagagcttcctgaggaacctgcaggacagcatcaagaggaagtacagctgtgaccacaacaccagcctgagccggctggaggacctgctgcaggacagcatggatgagaaggagcagctgatccagagcaagagctctgtggccagcctggtgggccgcagcaagaccatcgtgcagctgaagcccaggagcccagaccacgtgctgaagaacaccatctctgtgaaggctgtgtgtgactaccggcagatcgagatcaccatctgcaagaatgatgaatgtgtgctggaggacaacagccagaggaccaagtggaaggtgatcagccccactggaaatgaggccatggtgcccagcgtgtgcttcctgatccccccacccaacaaggatgccatcgagatggccagccgggtggagcagagctaccagaaggtgatggccctgtggcaccagctgcacgtgaacaccaagagcctcatctcctggaactacctgaggaaggacctggacctggtgcagacctggaacctggagaagctgcggagcagcgcccctggagagtgccaccagatcatgaagaacctgcaggcccactatgaggacttcctgcaggacagccgggacagcgtgctcttctctgtggccgaccggctgcggctggaggaggaggtggaggcctgcaaggcccgcttccagcacctgatgaagtccatggagaatgaagacaaggaggagaccgtggccaagatgtacatcagcgagctgaagaacatccggctgcggctggaggagtatgagcagagggtggtgaagaggatccagagcctggccagcagcaggacagacagagatgcctggcaggacaatgccctgagaattgctgagcaggagcacacccaggaggacctgcagcagctgcggagtgacctggatgctgtgtccatgaagtgtgacagcttcctgcaccagagccccagcagcagctctgtgcccaccctgcggtctgagctgaacctgctggtggagaagatggaccacgtgtatggcctgagcacagtgtacctgaacaagctgaagacagtggatgtgattgtgcgcagcatccaggatgctgagctgctggtgaagggctatgagatcaagctgagccaggaggaggtggtgctggccgacctgagcgccctggaggcccactggagcaccctgcggcactggctgagtgatgtgaaggacaagaacagcgtcttctctgtgctggatgaggagatcgccaaggccaaggtggtggccgagcagatgagccggctgaccccagagaggaacctggacctggagcgctaccaggagaagggcagccagctgcaggagcgctggcacagggtcatcgcccagctggagatccggcagagcgagctggagagcatccaggaggtgctgggggactaccgggcctgccacggcaccctcatcaagtggattgaggagaccacagcccagcaggagatgatgaagccaggccaggccgaggacagccgggtgctgtctgagcagctgagccagcagacagccctgtttgctgagattgaaagaaaccagaccaagctggaccagtgccagaagttcagccagcagtacagcaccatcgtgaaggactatgagctgcagctgatgacctacaaggcctttgtggagagccagcagaagagccctgggaagagaagaaggatgctgagcagcagtgatgccatcacccaggagttcatggacctgcggacccgctacacagccctggtgaccctgaccacccagcacgtgaagtacatcagtgatgccctgcggcggctggaggaggaggagaaggtggtggaggaggagaagcaggagcacgtggagaaggtgaaggagctgctgggctgggtgtccaccctggccaggaacacccagggcaaggccaccagcagcgagaccaaggagagcacagacatcgagaaggccatcctggagcagcaggtgctgtctgaggagctgaccaccaagaaggagcaggtgtctgaggccatcaagaccagccagatcttcctggccaagcacggccacaagctgtctgagaaggagaagaagcagatcagcgagcagctgaatgccctgaacaaggcctaccatgacctgtgtgatggcagcgccaaccagctgcagcagctgcagagccagctggcccaccagacagagcagaagaccctgcagaagcagcagaacacctgccaccagcagctggaggacctgtgctcctgggtgggccaggccgagcgggccctggccggccaccagggccgcaccacccagcaggacctgagcgccctgcagaagaaccagagcgacctgaaggacctgcaggatgacatccagaacagagccaccagctttgccaccgtggtgaaggacatcgagggcttcatggaggagaaccagaccaagctgagcccccgggagctgacagccctgcgggagaagctgcaccaggccaaggagcagtatgaggccctgcaggaggagaccagggtggcccagaaggagctggaggaggccgtgaccagcgccctgcagcaggagacagagaagagcaaggccgccaaggagctggccgagaacaagaagaagattgatgccctgctggactgggtgacctctgtgggcagcagcggcggccagctgctgaccaacctgcccggcatggagcagctgagcggggccagcctggagaagggggccctggacaccacagatggctacatgggcgtgaaccaggcccctgagaagctggacaagcagtgtgagatgatgaaggcccggcaccaggagctgctgagccagcagcagaacttcatcctggccacccagagcgcccaggccttcctggaccagcacggccacaacctgaccccagaggagcagcagatgctgcagcagaagctgggggagctgaaggagcagtacagcaccagcctggcccagagcgaggccgagctgaagcaggtgcagaccctgcaggatgagctgcagaagttcctgcaggaccacaaggagtttgagagctggctggagaggtctgagaaggagctggagaacatgcacaagggcggcagcagccctgagaccctgcccagcctgctgaagaggcagggcagcttctctgaagatgtgatcagccacaagggggacctgcgctttgtgaccatcagcggccagaaggtgctggacatggagaacagcttcaaggagggcaaggagcccagcgagatcggcaacctggtgaaggacaagctgaaggatgccacagagcgctacacagccctgcacagcaagtgcacccggctgggcagccacctgaacatgctgctgggccagtaccaccagttccagaacagcgctgacagcctgcaggcctggatgcaggcctgtgaggccaacgtggagaagctgctgagtgacacagtggccagtgaccccggggtgctgcaggagcagctggccaccaccaagcagctgcaggaggagctggccgagcaccaggtgcctgtggagaagctgcagaaggtggcccgggacatcatggagattgaaggagagcccgccccagaccaccgccacgtgcaggagaccacagacagcatcctgagccacttccagagcctgagctacagcctggccgagaggagcagcctgctgcagaaggccatcgcccagagccagagcgtgcaggagagcctggagagcctgctgcagagcattggagaggtggagcagaacctggagggcaagcaggtgagcagcctgagcagcggggtcatccaggaggccctggccaccaacatgaagctgaagcaggacatcgcccggcagaagagcagcctggaggccacccgggagatggtgacccgcttcatggagacagctgacagcaccacagctgctgtgctgcagggcaagctggccgaggtgtcccagagatttgagcagctgtgcctgcagcagcaggagaaggagagcagcctgaagaagctgctgccccaggccgagatgtttgagcacctgagcggcaagctgcagcagttcatggagaacaagagcaggatgctggccagcggcaaccagcctgaccaggacatcacccacttcttccagcagatccaggagctgaacctggagatggaggaccagcaggagaacctggacaccctggagcacctggtgacagagctgagcagctgtggctttgccctggacctgtgccagcaccaggacagagtgcagaacctgaggaaggacttcacagagctgcagaagacagtgaaggagcgggagaaggatgccagcagctgccaggagcagctggatgagttcaggaagctggtgaggaccttccagaagtggctgaaggagacagagggcagcatccccccaacagagacctccatgtctgccaaggagctggagaagcagatcgagcacctgaagagcctgctggatgactgggccagcaagggcaccctggtggaggagatcaactgcaagggcaccagcctggagaacctgatcatggagatcacagccccagacagccagggcaagacaggcagcatcctgcccagcgtgggcagctctgtgggctctgtgaatggctaccacacctgcaaggacctgacagagatccagtgtgacatgtctgatgtgaacctgaagtatgagaagctgggcggcgtgctgcacgagcggcaggagagcctgcaggccatcctgaacaggatggaggaggtgcacaaggaggccaacagcgtgctgcagtggctggagagcaaggaggaggtgctgaagtccatggatgccatgagcagccccaccaagacagaaacagtgaaggcccaggccgagagcaacaaggccttcctggccgagctggagcagaacagccccaagatccagaaggtgaaggaggccctggccggcctgctggtgacctaccccaacagccaggaggccgagaactggaagaagatccaggaggagctgaacagccgctgggagcgggccacagaggtgacagtggcccggcagaggcagctggaggagagcgccagccacctggcctgcttccaggccgctgagagccagctgcggccctggctgatggagaaggagctgatgatgggcgtgctgggccccctgagcattgaccccaacatgctgaatgcccagaagcagcaggtgcagttcatgctgaaggagtttgaggcccggcggcagcagcacgagcagctgaatgaagctgcccagggcatcctgactggacctggagatgtgtccctgagcaccagccaggtgcagaaggagctgcagagcatcaaccagaagtgggtggagctgacagacaagctgaacagccgcagcagccagattgaccaggccatcgtgaagagcacccagtaccaggagctgctgcaggacctgtctgagaaggtgcgggctgtgggccagaggctgtctgtgcagagcgccatcagcacccagcctgaggccgtgaagcagcagctggaggagaccagcgagatccgcagtgacctggagcagctggaccacgaggtgaaggaggcccagaccctgtgtgatgagctgtctgtgctgattggagagcagtacctgaaggatgagctgaagaagaggctggagaccgtggccctgcccctgcagggcctggaggacctggccgctgaccgcatcaaccggctgcaggccgccctggccagcacccagcagttccagcagatgtttgatgagctgcggacctggctggatgacaagcagagccagcaggccaagaactgccccatcagcgccaagctggagcggctgcagagccagctgcaggagaatgaggagttccagaagagcctgaaccagcacagcggcagctatgaggtgattgtggccgagggggagagcctgctgctgtctgtgcccccaggagaggagaagaggaccctgcagaaccagctggtggagctgaagaaccactgggaggagctgagcaagaagacagctgaccggcagagccggctgaaggactgcatgcagaaggcccagaagtaccagtggcacgtggaggacctggtgccctggattgaggactgcaaggccaagatgtctgagctgcgggtgaccctggaccctgtgcagctggagagcagcctgctgcggagcaaggccatgctgaatgaggtggagaagagaagaagcctgctggagatcctgaacagcgctgctgacatcctgatcaacagcagcgaggctgatgaagatggcatcagagatgagaaggccggcatcaaccagaacatggatgctgtgacagaggagctgcaggccaagacaggcagcctggaggagatgacccagaggctgcgggagttccaggagagcttcaagaacatcgagaagaaggtggagggcgccaagcaccagctggagatctttgatgccctgggcagccaggcctgcagcaacaagaacctggagaagctgcgggcccagcaggaggtgctgcaggccctggagccccaggtggactacctgaggaacttcacccagggcctggtggaggatgccccagatggcagtgatgccagccagctgctgcaccaggccgaggtggcccagcaggagttcctggaggtgaagcagagggtgaacagcggctgtgtgatgatggagaacaagctggagggcatcggccagttccactgccgggtgcgggagatgttcagccagctggccgacctggatgatgagctggatggcatgggcgccatcggccgggacacagacagcctgcagagccagattgaagatgtgcggctcttcctgaacaagatccacgtgctgaagctggacatcgaggccagcgaggccgagtgccgccacatgctggaggaggagggcaccctggacctgctgggcctgaagcgggagctggaggccctgaacaagcagtgtgggaagctgacagagcggggcaaggcccggcaggagcagctggagctgaccctgggccgggtggaggacttctacaggaagctgaagggcctgaatgatgccaccacagctgctgaggaggccgaggccctgcagtgggtggtgggcacagaggtggagatcatcaaccagcagctggccgacttcaagatgttccagaaggagcaggtggaccccctgcagatgaagctgcagcaggtgaatggcctgggccagggcctcatccagagcgctgggaaggactgtgatgtgcagggcctggagcatgacatggaggagatcaatgcccgctggaacaccctgaacaagaaggtggcccagagaattgcccagctgcaggaggccctgctgcactgcggcaagttccaggatgccctggagcccctgctgtcctggctggccgacacagaggagctgattgccaaccagaagcccccatctgctgagtacaaggtggtgaaggcccagatccaggagcagaagctgctgcagaggctgctggatgacaggaaggccaccgtggacatgctgcaggccgagggcggccgcatcgcccagagcgctgagctggccgaccgggagaagatcaccggccagctggagagcctggagagccgctggacagagctgctgagcaaggctgctgcccggcagaagcagctggaggacatcctggtgctggccaagcagttccacgagacagctgagcccatcagtgacttcctgtctgtgacagagaagaagctggccaacagcgagcctgtgggcacccagacagccaagatccagcagcagatcatccgccacaaggccctggaggaggacattgaaaatcatgccacagatgtgcaccaggccgtgaagattggccagagcctgagcagcctgaccagccctgctgagcagggcgtgctgtctgagaagattgacagcctgcaggcccgctacagcgagatccaggaccgctgctgcaggaaggccgccctgctggaccaggccctgagcaatgcccggctgtttggagaagatgaggtggaggtgctgaactggctggccgaggtggaggacaagctgagctctgtgtttgtgaaggacttcaagcaggatgtgctgcaccggcagcacgccgaccacctggccctgaatgaggagatcgtgaacaggaagaagaatgtggaccaggccatcaagaatggccaggccctgctgaagcagaccactggagaggaggtgctgctgatccaggagaagctggatggcatcaagaccaggtatgctgacatcaccgtgaccagcagcaaggccctgcggaccctggagcaggcccggcagctggccaccaagttccagagcacctatgaggagctgaccggctggctgcgggaggtggaggaggagctggccaccagcggcggccagagccccaccggggagcagatcccccagttccagcagaggcagaaggagctgaagaaggaggtgatggagcaccggctggtgctggacacagtgaatgaggtgtcccgggccctgctggagctggtgccctggagggcccgggagggcctggacaagctggtgtctgatgccaatgagcagtacaagctggtgtctgacaccatcggccagagggtggatgaaattgatgctgccatccagaggagccagcagtatgagcaggccgcagatgctgagctggcctgggtggccgagaccaagaggaagctgatggccctgggccccatccggctggagcaggaccagaccacagcccagctgcaggtgcagaaggccttcagcattgacatcatccgccacaaggacagcatggatgagctgttcagccacaggtctgagatcttcggcacctgtggggaggagcagaagacagtgctgcaggagaagacagagagcctcatccagcagtatgaggccatcagcctgctgaacagcgagagatatgcccggctggagcgggcccaggtgctggtgaaccagttctgggagacctatgaggagctgagcccctggattgaggagacccgggccctgattgcccagctgcccagccctgccatcgaccacgagcagctgcggcagcagcaggaggagatgaggcagctgcgggagagcattgctgagcacaagccccacatcgacaagctgctgaagattggcccccagctgaaggagctgaaccctgaggagggggagatggtggaggagaagtaccagaaggccgagaacatgtatgcccagatcaaggaggaggtgcggcagagggccctggccctggatgaggccgtgtcccagagcacccagatcacagagttccatgacaagattgagcccatgctggagaccctggagaacctgagcagccggctgaggatgcctcctctcatcccagctgaggtggacaagatccgggagtgcatcagtgacaacaagagcgccaccgtggagctggagaagctgcagcccagctttgaggccctgaagagaagaggagaggagctgattggccgcagccagggcgctgacaaggacctggccgccaaggagatccaggacaagctggaccagatggtgttcttctgggaggacatcaaggcccgggcagaggagcgggagatcaagttcctggatgtgctggagctggccgagaagttctggtatgacatggccgccctgctgaccaccatcaaggacacccaggacatcgtgcatgacctggagagccctggcatcgaccccagcatcatcaagcagcaggtggaggccgctgagaccatcaaggaggagacagatggcctgcacgaggagctggagttcatccgcatcctgggcgctgacctgatctttgcctgtggggagacagagaagccagaggtgaggaagagcattgatgagatgaacaatgcctgggagaacctgaacaagacctggaaggagcggctggagaagctggaggatgccatgcaggccgctgtgcagtaccaggacaccctgcaggccatgtttgactggctggacaacacagtcatcaagctgtgcaccatgcctcctgtgggcacagacctgaacacagtgaaggaccagctgaatgagatgaaggagttcaaggtggaggtgtaccagcagcagatcgagatggagaagctgaaccaccagggcgagctgatgctgaagaaggccacagatgaaacagaccgggacatcatccgggagcccctgacagagctgaagcacctgtgggagaacctgggggagaagatcgcccaccggcagcacaagctggagggcgccctgctggccctgggccagttccagcacgccctggaggagctgatgtcctggctgacccacacagaggagctgctggatgcccagaggcccatcagcggggaccccaaggtgattgaggtggagctggccaagcaccacgtgctgaagaatgatgtgctggcccaccaggccaccgtggagaccgtgaacaaggctggaaatgagctgctggagagcagcgctggagatgatgccagcagcctgcggagccggctggaggccatgaaccagtgctgggagagcgtgctgcagaagacagaggagcgggagcagcagctgcagagcaccctgcagcaggcccagggcttccacagcgagattgaggacttcctgctggagctgaccaggatggagagccagctgagcgccagcaagcccactggaggcctgcctgagacagcccgggagcagctggacacccacatggagctgtacagccagctgaaggccaaggaggagacctacaaccagctgctggacaagggccgcctgatgctgctgagcagagatgacagcggcagcggcagcaagacagagcagagcgtggccctgctggagcagaagtggcacgtggtgagcagcaagatggaggagaggaagagcaagctggaggaggccctgaacctggccacagagttccagaacagcctgcaggagttcatcaactggctgaccctggccgagcagagcctgaacatcgccagcccccccagcctcatcctgaacacagtgctgagccagatcgaggagcacaaggtgtttgccaatgaggtgaatgcccaccgggaccagatcatcgagctggaccagacaggcaaccagctgaagttcctgagccagaagcaggatgtggtgctgatcaagaacctgctggtgtctgtgcagagccgctgggagaaggtggtgcagaggagcattgaaagaggccgcagcctggatgatgccaggaagagggccaagcagttccacgaggcctggaagaagctgattgactggctggaggatgctgagagccacctggacagcgagctggagatcagcaatgaccctgacaagatcaagctgcagctgagcaagcacaaggagttccagaagaccctgggcggcaagcagcctgtgtatgacaccaccatcagaacaggccgggccctgaaggagaagaccctgctgcctgaggacagccagaagctggacaacttcctgggggaggtgcgggacaagtgggacacagtgtgtgggaagtctgtggagcggcagcacaagctggaggaggccctgctcttcagcggccagttcatggatgccctgcaggccctggtggactggctgtacaaggtggagccccagctggccgaggaccagcctgtgcatggagacctggacctggtgatgaacctgatggatgcccacaaggtgttccagaaggagctgggcaagaggactggaacagtgcaggtgctgaagaggagcggccgggagctgattgagaacagcagagatgacaccacctgggtgaagggccagctgcaggagctgagcacccgctgggacacagtgtgcaagctgtctgtgtccaagcagagccggctggagcaggccctgaagcaggccgaggtgttccgggacacagtgcacatgctgctggagtggctgtctgaggccgagcagaccctgcgcttccggggggccctgcctgatgacacagaggccctgcagagcctgattgacacccacaaggagttcatgaagaaggtggaggagaagagggtggatgtgaacagcgctgtggccatgggagaggtgatcctggccgtgtgccacccagactgcatcaccaccatcaagcactggatcaccatcatccgggccaggtttgaggaggtgctgacctgggccaagcagcaccagcagaggctggagacagccctgtctgagctggtggccaatgctgagctgctggaggagctgctggcctggatccagtgggccgagaccaccctcatccagagggaccaggagcccatcccccagaacatcgacagagtgaaggccctgattgctgagcaccagaccttcatggaggagatgaccaggaagcagccagatgtggacagagtgaccaagacctacaagaggaagaacatcgagcccacccacgcccccttcatcgagaagagccgcagcggcggcaggaagagcctgagccagcccaccccaccacccatgcccatcctgagccagagcgaggccaagaacccccgcatcaaccagctgagcgcccgctggcagcaggtgtggctgctggccctggagcggcagaggaagctgaatgatgccctggaccggctggaggagctgaaggagtttgccaactttgattttgatgtgtggaggaagaagtacatgcgctggatgaaccacaagaagagccgggtgatggacttcttcagaagaattgacaaggaccaggacggcaagatcacccggcaggagttcattgatggcatcctggccagcaagttccccaccaccaagctggagatgacagctgtggccgacatctttgacagagatggagatggctacatcgactactatgaatttgtggccgccctgcaccccaacaaggatgcctaccggcccaccacagatgctgacaagattgaagatgaggtgacccggcaggtggcccagtgcaagtgtgccaagcgcttccaggtggagcagatcggggagaacaagtacagatttggagacagccagcagctgcggctggtgcgcatcctgcggagcacagtgatggtgcgggtgggcggcggctggatggccctggatgagttcctggtgaagaatgacccctgccgggcccggggccgcaccaacatcgagctgcgggagaagttcatcctgcctgagggcgccagccagggcatgacccccttccgcagccggggccgccgcagcaagcccagcagccgggccgccagccccaccaggagcagcagcagcgccagccagagcaaccacagctgcacctccatgcccagcagccctgccaccccagccagcggcaccaaggtgatccccagcagcggcagcaagctgaagaggcccacccccaccttccacagcagcaggaccagcctggccggggacaccagcaacagcagcagccctgccagcactggagccaagaccaacagagctgaccccaagaagagcgccagccggcccggcagccgggccggcagccgggccggcagccgggccagcagcagaagaggaagtgatgccagtgactttgacctgctggagacccagagcgcctgcagcgacaccagcgagagcagcgctgctgggggccagggcaacagccggcggggcctgaacaagcccagcaagatccccaccatgagcaagaagaccaccacagccagccccaggaccccaggccccaagaggtag

SEQ ID NO: 159746 - DNA, 3189 bp, Artificial Sequence
  Description of Artificial Sequence: Synthetic coding sequence
atgggcaacagcctgggctgcttcaaggagcccaaggagagcatcgccatccctgagaaggcccccatcagccccaagaagagggtgcgcttcaagaggcgctggaggggcaagaagatccccaccccagaggccagccaccaggaggagaccagcgagggcactggagtcatcgaggagacagagaccctgaccaagctgacagagagcctgcagaaggaggatggagtgggcggcgtggagcacaccccaccagacatcctgctgcccggggacagcgcccccaacagccgggtggtggaccggggcatgattgtgcaggtgaaggagcgcttccagggcgaggtgcagacagcccacctgctgctggagaatgaatcttctgtggccggcggcgtgtgggacagcctggaggagggcatgaccgtcatcgcccacctgctggacaacccagctgagaggaactgtgagaagtctgtgtcccagctggtggagttccccaggacagccagctgcagcagcagagctgtgctgctgcccctgcagggcgagacagctgtggagaagggcaacatccagaggggcttccgcagctgtgccctgcccaggacagactaccccacagacaagggcaaccaggagcagttcagcgagggctggagcgtggaggagggcaccaagtctgtgtctggggccccccagacagcctcctggatcattgaatgttctgtgagcagcctgctgctggaccagcccggcggccagaggagaacagagcccagccacgtgggccaggtgcccccccaggacagccggctgcccaccagccagagcgacctgagcatctctggagtgacagtgtccatcctgcccagcagcagcggctacggcagtgatggcccccacatccacggcatccagcccaaggacacagagcctgagaagagcagcaccagcttctctgaagaagatggcaccctgagcctggaggccagccacacccccagctggggcctggaggagatcagtgacatctacatcagcggggagagcggggacatgtctgccaaggagaagctgctgctgtggacccagaaggtgacagctggctacacaggcatcaagtgcaccaacttcagcagctgctggagcgatggcaagatgtttaatgccctgatccaccgctacagaccagacctggtggacatggagcgggtgcagatccagagcaaccgggagaacctggagcaggcctttgaggtggccgagcggctgggcgtgacccggctgctggatgctgaagatgtggatgtgcccagcccagatgagaagagcgtcatcacctacgtgagcagcatctatgatgccttccccaaggtgcctgagggcggggagggcatcagcgccacagaggtggacagccgctggcaggagtaccagagccgggtggacagcctcatcccctggatcaagcagcacaccatcctgatgtctgacaagaccttcccccagaaccctgtggagctgaaggccctgtacaaccagtacatccacttcaaggagacagagatcctggccaaggagcgggagaagggccgcatcgaggagctgtacaagctgctggaggtgtggattgaatttggccgcatcaagctgccccagggctaccaccccaatgatgtggaggaggagtggggcaagctgatcatcgagatgctggagcgggagaagagcctgcggcctgctgtggagcggctggagctgctgctgcagatcgccaacaagatccagaatggagccctgaactgtgaggagaagctgaccctggccaagaacaccctgcaggctgatgctgcccacctggagagcggccagcctgtgcagtgtgagagtgatgtgatcatgtacatccaggagtgtgagggcctcatccggcagctgcaggtggacctgcagatcctgagagatgagaactactaccagctggaggagctggccttccgggtgatgaggctgcaggatgagctggtgaccctgcggctggagtgcaccaacctgtacaggaagggccacttcaccagcctggagctggtgccccccagcaccctgaccaccacccacctgaaggccgagcccctgaccaaggccacccacagcagcagcacctcctggttcaggaagcccatgaccagggctgagctggtggccatcagcagcagtgaagatgagggcaacctgcgctttgtgtatgagctgctgtcctgggtggaggagatgcagatgaagctggagcgggcagagtggggcaatgacctgcccagcgtggagctgcagctggagacccagcagcacatccacacctctgtggaggagctgggcagctctgtgaaggaggcccggctgtatgagggcaagatgagccagaacttccacaccagctatgcagagaccctgggcaagctggagacccagtactgcaagctgaaggagaccagcagcttcaggatgaggcacctgcagagcctgcacaagtttgtgtcccgggccacagctgagctgatctggctgaatgagaaggaggaggaggagctggcctatgactggagcgacaacaacagcaacatcagcgccaagaggaactacttcagcgagctgaccatggagctggaggagaagcaggatgtgttccgcagcctgcaggacacagctgagctgctgagcctggagaaccacccagccaagcagacagtggaggcctacagcgctgctgtgcagagccagctgcagtggatgaagcagctgtgcctgtgtgtggagcagcacgtgaaggagaacacagcctacttccagttcttcagtgatgcccgggagctggagagcttcctgaggaacctgcaggacagcatcaagaggaagtacagctgtgaccacaacaccagcctgagccggctggaggacctgctgcaggacagcatgttccaggatgagaaggagcagctgatccagagcaagagctctgtggccagcctggtgggccgcagcaagaccatcgtgcagctgaagcccaggagcccagaccacgtgctgaagaacaccatctctgtgaaggctgtgtgtgactaccggcagatcgagggccgcaccatcctgtctgagggctacggccccctggccagcgctgcctgctag

SEQ ID NO: 159747 - DNA, 22167 bp, Artificial Sequence
  Description of Artificial Sequence: Synthetic coding sequence
atgagcagcagtgatgaggagaccctgtctgagaggagctgccgctctgagaggagctgccgctctgagaggagctacagaagtgagaggagcggcagcctgagcccctgccccccaggggacaccctgccctggaacctgcccctgcacgagcagaagaagaggaagagccaggacagcgtgctggaccctgctgagagagctgtggtgcgggtggctgatgagcgggacagagtgcagaagaagaccttcaccaagtgggtgaacaagcacctgatgaaggtgaggaagcacatcaatgacctgtatgaggacctgagagatggccacaacctgatcagcctgctggaggtgctgagcggcatcaagctgccccgggagaagggccgcatgaggttccaccggctgcagaatgtgcagatcgccctggacttcctgaagcagaggcaggtgaagctggtgaacatcagaaatgatgacatcacagatggcaaccccaagctgaccctgggcctcatctggaccatcatcctgcacttccagatcagtgacatctacatcagcggggagagcggggacatgtctgccaaggagaagctgctgctgtggacccagaaggtgacagctggctacacaggcatcaagtgcaccaacttcagcagctgctggagcgatggcaagatgtttaatgccctgatccaccgctacagaccagacctggtggacatggagcgggtgcagatccagagcaaccgggagaacctggagcaggcctttgaggtggccgagcggctgggcgtgacccggctgctggatgctgaagatgtggatgtgcccagcccagatgagaagagcgtcatcacctacgtgagcagcatctatgatgccttccccaaggtgcctgagggcggggagggcatcagcgccacagaggtggacagccgctggcaggagtaccagagccgggtggacagcctcatcccctggatcaagcagcacaccatcctgatgtctgacaagaccttcccccagaaccctgtggagctgaaggccctgtacaaccagtacatccacttcaaggagacagagatcctggccaaggagcgggagaagggccgcatcgaggagctgtacaagctgctggaggtgtggattgaatttggccgcatcaagctgccccagggctaccaccccaatgatgtggaggaggagtggggcaagctgatcatcgagatgctggagcgggagaagagcctgcggcctgctgtggagcggctggagctgctgctgcagatcgccaacaagatccagaatggagccctgaactgtgaggagaagctgaccctggccaagaacaccctgcaggctgatgctgcccacctggagagcggccagcctgtgcagtgtgagagtgatgtgatcatgtacatccaggagtgtgagggcctcatccggcagctgcaggtggacctgcagatcctgagagatgagaactactaccagctggaggagctggccttccgggtgatgaggctgcaggatgagctggtgaccctgcggctggagtgcaccaacctgtacaggaagggccacttcaccagcctggagctggtgccccccagcaccctgaccaccacccacctgaaggccgagcccctgaccaaggccacccacagcagcagcacctcctggttcaggaagcccatgaccagggctgagctggtggccatcagcagcagtgaagatgagggcaacctgcgctttgtgtatgagctgctgtcctgggtggaggagatgcagatgaagctggagcgggcagagtggggcaatgacctgcccagcgtggagctgcagctggagacccagcagcacatccacacctctgtggaggagctgggcagctctgtgaaggaggcccggctgtatgagggcaagatgagccagaacttccacaccagctatgcagagaccctgggcaagctggagacccagtactgcaagctgaaggagaccagcagcttcaggatgaggcacctgcagagcctgcacaagtttgtgtcccgggccacagctgagctgatctggctgaatgagaaggaggaggaggagctggcctatgactggagcgacaacaacagcaacatcagcgccaagaggaactacttcagcgagctgaccatggagctggaggagaagcaggatgtgttccgcagcctgcaggacacagctgagctgctgagcctggagaaccacccagccaagcagacagtggaggcctacagcgctgctgtgcagagccagctgcagtggatgaagcagctgtgcctgtgtgtggagcagcacgtgaaggagaacacagcctacttccagttcttcagtgatgcccgggagctggagagcttcctgaggaacctgcaggacagcatcaagaggaagtacagctgtgaccacaacaccagcctgagccggctggaggacctgctgcaggacagcatggatgagaaggagcagctgatccagagcaagagctctgtggccagcctggtgggccgcagcaagaccatcgtgcagctgaagcccaggagcccagaccacgtgctgaagaacaccatctctgtgaaggctgtgtgtgactaccggcagatcgagatcaccatctgcaagaatgatgaatgtgtgctggaggacaacagccagaggaccaagtggaaggtgatcagccccactggaaatgaggccatggtgcccagcgtgtgcttcctgatccccccacccaacaaggatgccatcgagatggccagccgggtggagcagagctaccagaaggtgatggccctgtggcaccagctgcacgtgaacaccaagagcctcatctcctggaactacctgaggaaggacctggacctggtgcagacctggaacctggagaagctgcggagcagcgcccctggagagtgccaccagatcatgaagaacctgcaggcccactatgaggacttcctgcaggacagccgggacagcgtgctcttctctgtggccgaccggctgcggctggaggaggaggtggaggcctgcaaggcccgcttccagcacctgatgaagtccatggagaatgaagacaaggaggagaccgtggccaagatgtacatcagcgagctgaagaacatccggctgcggctggaggagtatgagcagagggtggtgaagaggatccagagcctggccagcagcaggacagacagagatgcctggcaggacaatgccctgagaattgctgagcaggagcacacccaggaggacctgcagcagctgcggagtgacctggatgctgtgtccatgaagtgtgacagcttcctgcaccagagccccagcagcagctctgtgcccaccctgcggtctgagctgaacctgctggtggagaagatggaccacgtgtatggcctgagcacagtgtacctgaacaagctgaagacagtggatgtgattgtgcgcagcatccaggatgctgagctgctggtgaagggctatgagatcaagctgagccaggaggaggtggtgctggccgacctgagcgccctggaggcccactggagcaccctgcggcactggctgagtgatgtgaaggacaagaacagcgtcttctctgtgctggatgaggagatcgccaaggccaaggtggtggccgagcagatgagccggctgaccccagagaggaacctggacctggagcgctaccaggagaagggcagccagctgcaggagcgctggcacagggtcatcgcccagctggagatccggcagagcgagctggagagcatccaggaggtgctgggggactaccgggcctgccacggcaccctcatcaagtggattgaggagaccacagcccagcaggagatgatgaagccaggccaggccgaggacagccgggtgctgtctgagcagctgagccagcagacagccctgtttgctgagattgaaagaaaccagaccaagctggaccagtgccagaagttcagccagcagtacagcaccatcgtgaaggactatgagctgcagctgatgacctacaaggcctttgtggagagccagcagaagagccctgggaagagaagaaggatgctgagcagcagtgatgccatcacccaggagttcatggacctgcggacccgctacacagccctggtgaccctgaccacccagcacgtgaagtacatcagtgatgccctgcggcggctggaggaggaggagaaggtggtggaggaggagaagcaggagcacgtggagaaggtgaaggagctgctgggctgggtgtccaccctggccaggaacacccagggcaaggccaccagcagcgagaccaaggagagcacagacatcgagaaggccatcctggagcagcaggtgctgtctgaggagctgaccaccaagaaggagcaggtgtctgaggccatcaagaccagccagatcttcctggccaagcacggccacaagctgtctgagaaggagaagaagcagatcagcgagcagctgaatgccctgaacaaggcctaccatgacctgtgtgatggcagcgccaaccagctgcagcagctgcagagccagctggcccaccagacagagcagaaggagtgcagagctgtggccggggtcatcgacctgggcaccgtggagatcttccccatcttcaaggccatgcagaagggcctgctggaccaggacaccggcctggtgctgctggagagccaggtgatcatgagcggcctcatcgcccctgagaccggggagaacctgagcctggaggagggcatcgccaggaacctgatcaacccccagatgtaccagcagctgcgggagctgcaggatgccctggccctgatcagccggctgacagagagccggggccccctgtctgtggtggaggccatcgagaagaggatcatcagcgagaccgtgggcctgaagatcctggaggcccacctggccactggaggcttcagcctgagccccagcgagaactgcatcaacctggaggaggccttccaccagggcctcatcagcgcctggctgcacagcgtgctggagagctacctgcggaccagcaagaacctgattgaccccaacacagctgagaagattggcctgctggacctgatgcagcgctgcatcgtgcaccaggagagcggcttcaagctgctgcctgtgaagcagctggccggcggcatggtgtccctgaagagcggcaggaaggtgtccatcttccgggctgtgcaggagggcctgattgaccggcaggtgacagtgcggctgctggaggcccagctgtttgctgggggcatcgtggaccccaggacaggccaccggctgactgtggaggaggccgtgcgccacaacctgattgaccaggacatggcctgtgccatcctgatccggcagctgcagacaggaggcatcatcgacacagtgacaggccagaggctgaccattgatgaggccgtgtccaatgacctggtggccgccaagatcgccctggtgatcctggagagcctgtggagcttcatgggcctgctgtggccagagagcggggagatcctgcccatcacagatgccctggagcagggcatcgtgtccacagagctggcccacaagatcctgagcaaccggcagcacatcaaggccctcttcctgcctgccaccacagagatcctgtcctggaagaaggccattgaaagtggcatcctggaccgggacctggccaacaacctgaagagcatctgcatcccagatgtgatgccccacatgcagctggccgacagcgctgagcagaacatcaaccctggagctgctgtgctgccctgcagcaagagccaccccaaggccacagccagccagagcgagaacctgctcttccagctgatgacccacagctacatcaacgtgcagaatggccagaggctgctgctgctggacaaggagctgatggagaccctgaccagcagagatgagtaccagaccagcccccccaaggtggtggagatcggccaccagaggcagaagaccccagagggcctgcaggagagcgccaacgtgaagatcagcggcaccttcagcagcggctggacagtgcggctgcctgagttccagttcagcagccagaacaaggagtacccagaccgggaggactgcaccacagagaagggcaagaagaccaccgtggagacagaggacagctctgtggagaaccctgagcaggacctgtttgtggagcagaaggagaggaaccccaacattgatgccctgaaggtgatcaacaaggtgaagctggaggtgcagaggcagctgattggcacccagcgggaggaccagacagctgtgtctgtgagagaaaatgccagccggggccacctgctgaccatccccccagctgaggccgagggcgtgcccctggtggtggacaaggatgtgttttctgtggagacccccaagaaggagcaccagcccctgaggaacaccagcttcacctgccagaatgagcaggcccacaccctggagacagagtacatccatgatgagaccggcggcagccacatcaagccccagagcaagaagctgcaggtgcaggtgaagaagaccctgggcatcaagctggagctgaagtcagaaacagatggaaatgtgcaccccctggacaagaaggagatgctgaagaagaccttcctggccaaggatgaccacaaggagagccaggaggcccagaacattgctgggggctccatgatgatgtctgagaagacagatgaggaggacagcggccgggagatcttcctgagctgcagccaccccctggagctgctggaggaggccaccctgaatgtgctgagcgcccagctgctggatggcggcatcttccacgagcagacaggccagaagctgctgctgaatgaggccatcagccggggcatcgtgcccagccacacagctgtgaagctgatggagaagctgaacatgttccagggcttctttgacagccagacctgtgagagcctgaccacagaggaggtgatcaatgaaggcctgatggatgagaagctgctgcacaacgtgctgatggctgacaaggccatcagcggcgtgctggaccccaggacccagaccctgtgcagcgtgaaggatgctgtgacagtgggcctgctggacaaggagacagccacccgcatcctggagcggcaggtggtgactggaggcatcatcgacctgaagaggggcaagaaggtgtctgtgaccctggccagcaccctgggcctggtggatgtggccgaccagcctgagctgatcaacctggagaaggccagcaagggcagagatgctgagaagacagtgcgggagcggctcatcagcctgcagatggagaccaccggcctgattgatcctgacagcaaggcccccctgactgtggtgcagagcattgaccggggcctgctggagcgggaggaggccgtgcggctgctgaccaagcaggtggtggatggcggcatcatccaccacatcagcggcatgaggctgtctgtggacaatgccttcagacatggcctcatcggggaggacctggccgagaagctgaagagggtggagaacctgaacatccaccagatcttcaaccctgagaccaaggagaacatcagcctgcccaaggccatcaagctggacctgatcaccagtgacctgaagcgggagatccaggaggtgcaggccttcaccggcaactttgtggacctgatcagcggccagaggctgaccctggccgaggccaagaaggagggcctgctgaccaatgaagctgtgctgagccctggcatgatgcatggaattgtggaccctgagaactgcagaattgtgccctacagcgagctggtgaagaagtgcaagattgatattgaaagtggccagcgctacctggaggtgatccccttcagtgacatcaaggatggagtgtctgacaaggtgctgaccctgagccaggccatccagctgggcaaggtggactttgccagcaccctgaaggtgctggaggcccaggccaacacaggaggcatcatcgacacagccaccgggaagaggctgaccctggccagcgccctggaggagaagctggtggatgagaacatggtgcgcatcatcgccagccaccaggtgctgaatggaggcatcgtggacatcttcagtgaccagagggtgaccctggtggaggccatcgagaagaggctcatcagccctgagctggccaacatgatccagattgacagcagcgagttcagtgaccaccgggcccagatcgagaagcaggagggcatcgaggtgtgtgccctgcagaatgagttcctgggcaaggacatgctgattgcctgcaaccagacagctgagatgagctgcaacaaggtggaggagagcgagcggctcttccaggtggagaaccagagcgcccaggagaaggtgaaggtgcgggtgtctgatggagagcaggccaagaagagccgggagatcagcctgaaggagtttggctgcaaggaccagaggaagcccaggatgagcagtgatgccaaggagttcatcagcatcatcaacccccacaacctgaagggcaagagcctgggccaggtgtccctgacccacccctacagtgaatgtgacttcaagctgaaggaggtggccaggaacaacatgggaaatgacaccaatgaggagcaggagaaggctgtgaccaagattgagatcatcagccacatgaagcagagcaccagctgcctggacagcgaggagatccgggagaaccagggcgaggtgatcctggaggtgcaggagacctactgtgagaccagcggcaagctgcccagcgagcaggtgctgcagcagcccatgaatgcccgggtgaagagcaagcgggagaagcgggaggtgattgtggaggagagcatccgcacctgcaagccagccttcctgtctgaggagaagctgtaccaggagacagccatcagagatgaacatgacagccacatcaagagccagccccgggagatgaccagcagcgagaagggcaaggaggccgacacagagatgggcttcagcatcaccttcaagattgaggagagcagcagccaggtggtgccccagggcatctctgtgaagcacctggatgccctgaccctcttcagcagcaagcaggccaatgaaggcaaggtgaacaacctgagcctgtgcctgaccctgaagccagaggagaacctgagccgggagatcgcctgtggggcccagagcgagcccttcccctgcatgacccccaggcctgagggcctgcactaccaggagagtgatggcaaggcccaggtgacaggccccagccagatcagcaagacagacaagagcttccagggcaccacccggcaggagaccaactaccaggacagctgggtgaccagcaagaccaaggagaccaagcaccagatcagcagcagcaatgaatgcaaggagaagagctaccaggaggtgtcctttgatcctgcccggggcctgaagctggaggagatcaccgtgtccaggccagacagcaaggaggtgcgctacctggagttcagtgacaggaaggacctgcaccaccagggcagcaagagtgatgacaagctgtgtggcaccctgaagtctgagatcgccacccaggagctgaccggggagaagttcctggagatggccaaccccaacgtggccggcctggaggccggcagcattgaagatattgtgacccagaggggcagccgggtgctgggcagcttcctgcctgagaagctgttcaagggcgtgtcccagaaggagaacacaggccagcagaatgccatcatcagccccaccgtgctggagaccagcgaggagaagacagtgtccctgactgtgtgcagcgctgtgaagacagagaagaccccccaggagaagctgcgggagagccctggcagcgagcagacccccttcatgacagcccctgagggcaaaggaaatggaggagtgaaccctgagcccttccgggccacccagaatgtgttcacccggcagctgtgcctggagcatgatgagaagctggtgtcctacctgagcctgctgagaaatattgagatgaggaccaagcagatccagcccctggagctgaacctggccgagctgcaggacctgctgtgccaggccaaggtgctggagcgggagctgaaggacctgaccaccctggtgtcccaggagctggagtgtgtgaaccagatcatcatcagccagccccaggaggtgcctgcccagctgctgaaggccctggagaaggatgccaagaacctgcagaagagcctgagctctgtgtctgacacctggaacagccggctgctgcacttccagaatgctgtggagattgagaagaccaaggtgctgaaccagcacacccagctggagggccgcctgcaggacctgcgggcctgggtgggcaacaagaacctgatcctgaacagcaagggcagcaacagcgagattgatgtggacagcctgaacctgtgcctgcagcagtatgaggacctgaagcagcccatggccgagaggaaggcccagctggatgccctggcctttgacatccagttcttcatcagcgagcacgcccaggacctgagcccccagcagaaccggcagatgctgcggctgctgaatgagctgcagaggagcttccaggacatcctggagcagacagctgcccaggtggatgccctgcagggccacctgcagcagatggagcaggaggccctggtgaagaccctgcagaagcagcagaacacctgccaccagcagctggaggacctgtgctcctgggtgggccaggccgagcgggccctggccggccaccagggccgcaccacccagcaggacctgagcgccctgcagaagaaccagagcgacctgaaggacctgcaggatgacatccagaacagagccaccagctttgccaccgtggtgaaggacatcgagggcttcatggaggagaaccagaccaagctgagcccccgggagctgacagccctgcgggagaagctgcaccaggccaaggagcagtatgaggccctgcaggaggagaccagggtggcccagaaggagctggaggaggccgtgaccagcgccctgcagcaggagacagagaagagcaaggccgccaaggagctggccgagaacaagaagaagattgatgccctgctggactgggtgacctctgtgggcagcagcggcggccagctgctgaccaacctgcccggcatggagcagctgagcggggccagcctggagaagggggccctggacaccacagatggctacatgggcgtgaaccaggcccctgagaagctggacaagcagtgtgagatgatgaaggcccggcaccaggagctgctgagccagcagcagaacttcatcctggccacccagagcgcccaggccttcctggaccagcacggccacaacctgaccccagaggagcagcagatgctgcagcagaagctgggggagctgaaggagcagtacagcaccagcctggcccagagcgaggccgagctgaagcaggtgcagaccctgcaggatgagctgcagaagttcctgcaggaccacaaggagtttgagagctggctggagaggtctgagaaggagctggagaacatgcacaagggcggcagcagccctgagaccctgcccagcctgctgaagaggcagggcagcttctctgaagatgtgatcagccacaagggggacctgcgctttgtgaccatcagcggccagaaggtgctggacatggagaacagcttcaaggagggcaaggagcccagcgagatcggcaacctggtgaaggacaagctgaaggatgccacagagcgctacacagccctgcacagcaagtgcacccggctgggcagccacctgaacatgctgctgggccagtaccaccagttccagaacagcgctgacagcctgcaggcctggatgcaggcctgtgaggccaacgtggagaagctgctgagtgacacagtggccagtgaccccggggtgctgcaggagcagctggccaccaccaagcagctgcaggaggagctggccgagcaccaggtgcctgtggagaagctgcagaaggtggcccgggacatcatggagattgaaggagagcccgccccagaccacagacatgtgcaggagaccacagacagcatcctgagccacttccagagcctgagctacagcctggccgagaggagcagcctgctgcagaaggccatcgcccagagccagagcgtgcaggagagcctggagagcctgctgcagagcatcggggaggtggagcagaacctggagggcaagcaggtgagcagcctgagcagtggagtcatccaggaggccctggccaccaacatgaagctgaagcaggacatcgcccggcagaagagcagcctggaggccacccgggagatggtgacccgcttcatggagacagctgacagcaccacagctgctgtgctgcagggcaagctggccgaggtgtcccagagatttgagcagctgtgcctgcagcagcaggagaaggagagcagcctgaagaagctgctgccccaggccgagatgtttgagcacctgagcggcaagctgcagcagttcatggagaacaagagcaggatgctggccagcggcaaccagcctgaccaggacatcacccacttcttccagcagatccaggagctgaacctggagatggaggaccagcaggagaacctggacaccctggagcacctggtgacagagctgagcagctgtggctttgccctggacctgtgccagcaccaggacagagtgcagaacctgaggaaggacttcacagagctgcagaagacagtgaaggagcgggagaaggatgccagcagctgccaggagcagctggatgagttcaggaagctggtgaggaccttccagaagtggctgaaggagacagagggcagcatccccccaacagagacctccatgtctgccaaggagctggagaagcagatcgagcacctgaagagcctgctggatgactgggccagcaagggcaccctggtggaggagatcaactgcaagggcaccagcctggagaacctgatcatggagatcacagccccagacagccagggcaagacaggcagcatcctgcccagcgtgggcagctctgtgggctctgtgaatggctaccacacctgcaaggacctgacagagatccagtgtgacatgtctgatgtgaacctgaagtatgagaagctgggcggcgtgctgcacgagcggcaggagagcctgcaggccatcctgaacaggatggaggaggtgcacaaggaggccaacagcgtgctgcagtggctggagagcaaggaggaggtgctgaagtccatggatgccatgagcagccccaccaagacagagaccgtgaaggcccaggccgagagcaacaaggccttcctggccgagctggagcagaacagccccaagatccagaaggtgaaggaggccctggccggcctgctggtgacctaccccaacagccaggaggccgagaactggaagaagatccaggaggagctgaacagccgctgggagcgggccacagaggtgacagtggcccggcagaggcagctggaggagagcgccagccacctggcctgcttccaggccgctgagagccagctgcggccctggctgatggagaaggagctgatgatgggcgtgctgggccccctgagcattgaccccaacatgctgaatgcccagaagcagcaggtgcagttcatgctgaaggagtttgaggcccggcggcagcagcacgagcagctgaatgaggccgcccagggcatcctgaccggccctggagatgtgtccctgagcaccagccaggtgcagaaggagctgcagagcatcaaccagaagtgggtggagctgacagacaagctgaacagccgcagcagccagattgaccaggccatcgtgaagagcacccagtaccaggagctgctgcaggacctgtctgagaaggtgcgggctgtgggccagaggctgtctgtgcagagcgccatcagcacccagcctgaggccgtgaagcagcagctggaggagaccagcgagatccgcagtgacctggagcagctggaccacgaggtgaaggaggcccagaccctgtgtgatgagctgtctgtgctgattggagagcagtacctgaaggatgagctgaagaagaggctggagaccgtggccctgcccctgcagggcctggaggacctggccgctgaccgcatcaaccggctgcaggccgccctggccagcacccagcagttccagcagatgtttgatgagctgcggacctggctggatgacaagcagagccagcaggccaagaactgccccatcagcgccaagctggagcggctgcagagccagctgcaggagaatgaggagttccagaagagcctgaaccagcacagcggcagctatgaagtcatcgtggccgagggggagagcctgctgctgtctgtgcccccaggagaggagaagaggaccctgcagaaccagctggtggagctgaagaaccactgggaggagctgagcaagaagacagctgaccggcagagccggctgaaggactgcatgcagaaggcccagaagtaccagtggcacgtggaggacctggtgccctggattgaggactgcaaggccaagatgtctgagctgcgggtgaccctggaccctgtgcagctggagagcagcctgctgcggagcaaggccatgctgaatgaggtggagaagaggaggagcctgctggagatcctgaacagcgctgctgacatcctgatcaacagcagcgaggctgatgaagatggcatcagagatgagaaggccggcatcaaccagaacatggatgctgtgacagaggagctgcaggccaagacaggcagcctggaggagatgacccagaggctgcgggagttccaggagagcttcaagaacatcgagaagaaggtggagggcgccaagcaccagctggagatctttgatgccctgggcagccaggcctgcagcaacaagaacctggagaagctgcgggcccagcaggaggtgctgcaggccctggagccccaggtggactacctgaggaacttcacccagggcctggtggaggatgccccagatggcagtgatgccagccagctgctgcaccaggccgaggtggcccagcaggagttcctggaggtgaagcagagggtgaacagcggctgtgtgatgatggagaacaagctggagggcatcggccagttccactgccgggtgcgggagatgttcagccagctggccgacctggatgatgagctggatggcatgggcgccatcggccgggacacagacagcctgcagagccagattgaagatgtgcggctcttcctgaacaagatccacgtgctgaagctggacatcgaggccagcgaggctgaatgtcgccacatgctggaggaggagggcaccctggacctgctgggcctgaagcgggagctggaggccctgaacaagcagtgtgggaagctgacagagcggggcaaggcccggcaggagcagctggagctgaccctgggccgggtggaggacttctacaggaagctgaagggcctgaatgatgccaccacagctgctgaggaggccgaggccctgcagtgggtggtgggcacagaggtggagatcatcaaccagcagctggccgacttcaagatgttccagaaggagcaggtggaccccctgcagatgaagctgcagcaggtgaatggcctgggccagggcctcatccagagcgctgggaaggactgtgatgtgcagggcctggagcatgacatggaggagatcaatgcccgctggaacaccctgaacaagaaggtggcccagagaattgcccagctgcaggaggccctgctgcactgtgggaagttccaggatgccctggagcccctgctgtcctggctggccgacacagaggagctgattgccaaccagaagccacccagcgctgagtacaaggtggtgaaggcccagatccaggagcagaagctgctgcagaggctgctggatgacaggaaggccaccgtggacatgctgcaggccgagggcggcagaattgcccagagcgctgagctggccgaccgggagaagatcaccggccagctggagagcctggagagccgctggacagagctgctgagcaaggccgccgcccggcagaagcagctggaggacatcctggtgctggccaagcagttccatgaaacagctgagcccatcagtgacttcctgtctgtgacagagaagaagctggccaacagcgagcctgtgggcacccagacagccaagatccagcagcagatcatccgccacaaggccctgaatgaggagatcgtgaacaggaagaagaatgtggaccaggccatcaagaatggccaggccctgctgaagcagaccactggagaggaggtgctgctgatccaggagaagctggatggcatcaagaccaggtatgctgacatcaccgtgaccagcagcaaggccctgcggaccctggagcaggcccggcagctggccaccaagttccagagcacctatgaggagctgaccggctggctgcgggaggtggaggaggagctggccaccagcggcggccagagccccaccggggagcagatcccccagttccagcagaggcagaaggagctgaagaaggaggtgatggagcaccggctggtgctggacacagtgaatgaggtgtcccgggccctgctggagctggtgccctggagggcccgggagggcctggacaagctggtgtctgatgccaatgagcagtacaagctggtgtctgacaccatcggccagagggtggatgaaattgatgctgccatccagaggagccagcagtatgagcaggccgcagatgctgagctggcctgggtggccgagaccaagaggaagctgatggccctgggccccatccggctggagcaggaccagaccacagcccagctgcaggtgcagaaggccttcagcattgacatcatccgccacaaggacagcatggatgagctgttcagccacaggtctgagatcttcggcacctgtggggaggagcagaagacagtgctgcaggagaagacagagagcctcatccagcagtatgaggccatcagcctgctgaacagcgagagatatgcccggctggagcgggcccaggtgctggtgaaccagttctgggagacctatgaggagctgagcccctggattgaggagacccgggccctgattgcccagctgcccagccctgccatcgaccacgagcagctgcggcagcagcaggaggagatgaggcagctgcgggagagcattgctgagcacaagccccacatcgacaagctgctgaagattggcccccagctgaaggagctgaaccctgaggagggggagatggtggaggagaagtaccagaaggccgagaacatgtatgcccagatcaaggaggaggtgcggcagagggccctggccctggatgaggccgtgtcccagagcacccagatcacagagttccatgacaagattgagcccatgctggagaccctggagaacctgagcagccggctgaggatgcctcctctcatcccagctgaggtggacaagatccgggagtgcatcagtgacaacaagagcgccaccgtggagctggagaagctgcagcccagctttgaggccctgaagagaagaggagaggagctgattggccgcagccagggcgctgacaaggacctggccgccaaggagatccaggacaagctggaccagatggtgttcttctgggaggacatcaaggcccgggcagaggagcgggagatcaagttcctggatgtgctggagctggccgagaagttctggtatgacatggccgccctgctgaccaccatcaaggacacccaggacatcgtgcatgacctggagagccctggcatcgaccccagcatcatcaagcagcaggtggaggccgctgagaccatcaaggaggagacagatggcctgcacgaggagctggagttcatccgcatcctgggcgctgacctgatctttgcctgtggggagacagagaagccagaggtgaggaagagcattgatgagatgaacaatgcctgggagaacctgaacaagacctggaaggagcggctggagaagctggaggatgccatgcaggccgctgtgcagtaccaggacaccctgcaggccatgtttgactggctggacaacacagtcatcaagctgtgcaccatgcctcctgtgggcacagacctgaacacagtgaaggaccagctgaatgagatgaaggagttcaaggtggaggtgtaccagcagcagatcgagatggagaagctgaaccaccagggcgagctgatgctgaagaaggccacagatgaaacagaccgggacatcatccgggagcccctgacagagctgaagcacctgtgggagaacctgggggagaagatcgcccaccggcagcacaagctggagggcgccctgctggccctgggccagttccagcacgccctggaggagctgatgtcctggctgacccacacagaggagctgctggatgcccagaggcccatcagcggggaccccaaggtgattgaggtggagctggccaagcaccacgtgctgaagaatgatgtgctggcccaccaggccaccgtggagaccgtgaacaaggctggaaatgagctgctggagagcagcgctggagatgatgccagcagcctgcggagccggctggaggccatgaaccagtgctgggagagcgtgctgcagaagacagaggagcgggagcagcagctgcagagcaccctgcagcaggcccagggcttccacagcgagattgaggacttcctgctggagctgaccaggatggagagccagctgagcgccagcaagcccactggaggcctgcctgagacagcccgggagcagctggacacccacatggagctgtacagccagctgaaggccaaggaggagacctacaaccagctgctggacaagggccgcctgatgctgctgagcagagatgacagcggcagcggcagcaagacagagcagagcgtggccctgctggagcagaagtggcacgtggtgagcagcaagatggaggagaggaagagcaagctggaggaggccctgaacctggccacagagttccagaacagcctgcaggagttcatcaactggctgaccctggccgagcagagcctgaacatcgccagcccccccagcctcatcctgaacacagtgctgagccagatcgaggagcacaaggtgtttgccaatgaggtgaatgcccaccgggaccagatcatcgagctggaccagacaggcaaccagctgaagttcctgagccagaagcaggatgtggtgctgatcaagaacctgctggtgtctgtgcagagccgctgggagaaggtggtgcagaggagcattgaaagaggccgcagcctggatgatgccaggaagagggccaagcagttccacgaggcctggaagaagctgattgactggctggaggatgctgagagccacctggacagcgagctggagatcagcaatgaccctgacaagatcaagctgcagctgagcaagcacaaggagttccagaagaccctgggcggcaagcagcctgtgtatgacaccaccatcagaacaggccgggccctgaaggagaagaccctgctgcctgaggacagccagaagctggacaacttcctgggggaggtgcgggacaagtgggacacagtgtgtgggaagtctgtggagcggcagcacaagctggaggaggccctgctcttcagcggccagttcatggatgccctgcaggccctggtggactggctgtacaaggtggagccccagctggccgaggaccagcctgtgcatggagacctggacctggtgatgaacctgatggatgcccacaaggtgttccagaaggagctgggcaagaggactggaacagtgcaggtgctgaagaggagcggccgggagctgattgagaacagcagagatgacaccacctgggtgaagggccagctgcaggagctgagcacccgctgggacacagtgtgcaagctgtctgtgtccaagcagagccggctggagcaggccctgaagcaggccgaggtgttccgggacacagtgcacatgctgctggagtggctgtctgaggccgagcagaccctgcgcttccggggggccctgcctgatgacacagaggccctgcagagcctgattgacacccacaaggagttcatgaagaaggtggaggagaagagggtggatgtgaacagcgctgtggccatgggagaggtgatcctggccgtgtgccacccagactgcatcaccaccatcaagcactggatcaccatcatccgggccaggtttgaggaggtgctgacctgggccaagcagcaccagcagaggctggagacagccctgtctgagctggtggccaatgctgagctgctggaggagctgctggcctggatccagtgggccgagaccaccctcatccagagggaccaggagcccatcccccagaacatcgacagagtgaaggccctgattgctgagcaccagaccttcatggaggagatgaccaggaagcagccagatgtggacagagtgaccaagacctacaagaggaagaacatcgagcccacccacgcccccttcatcgagaagagccgcagcggcggcaggaagagcctgagccagcccaccccaccacccatgcccatcctgagccagagcgaggccaagaacccccgcatcaaccagctgagcgcccgctggcagcaggtgtggctgctggccctggagcggcagaggaagctgaatgatgccctggaccggctggaggagctgaaggagtttgccaactttgattttgatgtgtggaggaagaagtacatgcgctggatgaaccacaagaagagccgggtgatggacttcttcagaagaattgacaaggaccaggacggcaagatcacccggcaggagttcattgatggcatcctggccagcaagttccccaccaccaagctggagatgacagctgtggccgacatctttgacagagatggagatggctacatcgactactatgaatttgtggccgccctgcaccccaacaaggatgcctaccggcccaccacagatgctgacaagattgaagatgaggtgacccggcaggtggcccagtgcaagtgtgccaagcgcttccaggtggagcagatcggggagaacaagtacagatttggagacagccagcagctgcggctggtgcgcatcctgcggagcacagtgatggtgcgggtgggcggcggctggatggccctggatgagttcctggtgaagaatgacccctgccgggcccggggccgcaccaacatcgagctgcgggagaagttcatcctgcctgagggcgccagccagggcatgacccccttccgcagccggggccgccgcagcaagcccagcagccgggccgccagccccaccaggagcagcagcagcgccagccagagcaaccacagctgcacctccatgcccagcagccctgccaccccagccagcggcaccaaggtgatccccagcagcggcagcaagctgaagaggcccacccccaccttccacagcagcaggaccagcctggccggggacaccagcaacagcagcagccctgccagcactggagccaagaccaacagagctgaccccaagaagagcgccagccggcccggcagccgggccggcagccgggccggcagccgggccagcagcagaagaggaagtgatgccagtgactttgacctgctggagacccagagcgcctgcagcgacaccagcgagagcagcgctgctgggggccagggcaacagccggcggggcctgaacaagcccagcaagatccccaccatgagcaagaagaccaccacagccagccccaggaccccaggccccaagaggtag

SEQ ID NO: 159748 - DNA, 1155 bp, Artificial Sequence
  Description of Artificial Sequence: Synthetic coding sequence
atcaccagcccctgggccccccggcccagctgcagcagcccctgggccatgagcagcagtgatgaggagaccctgtctgagaggagctgccgctctgagaggagctgccgctctgagaggagctacagaagtgagaggagcggcagcctgagcccctgccccccaggggacaccctgccctggaacctgcccctgcacgagcagaagaagaggaagagccaggacagcgtgctggaccctgctgagagagctgtggtgcgggtggctgatgagcgggacagagtgcagaagaagaccttcaccaagtgggtgaacaagcacctgatgaaggtgaggaagcacatcaatgacctgtatgaggacctgagagatggccacaacctgatcagcctgctggaggtgctgagcggcatcaagctgccccgggagaagggccgcatgaggttccaccggctgcagaatgtgcagatcgccctggacttcctgaagcagaggcaggtgaagctggtgaacatcagaaatgatgacatcacagatggcaaccccaagctgaccctgggcctcatctggaccatcatcctgcacttccagatcagtgacatctacatcagcggggagagcggggacatgtctgccaaggagaagctgctgctgtggacccagaaggtgacagctggctacacaggcatcaagtgcaccaacttcagcagctgctggagcgatggcaagatgtttaatgccctgatccaccgctacagaccagacctggtggacatggagcgggtgcagatccagagcaaccgggagaacctggagcaggcctttgaggtggccgagcggctgggcgtgacccggctgctggatgctgaagatgtggatgtgcccagcccagatgagaagagcgtcatcacctacgtgagcagcatctatgatgccttccccaaggtgcctgagggcggggagggcatcagcgccacagaggtggacagccgctggcaggagtaccagagccgggtggacagcctcatcccctggatcaagcagcacaccatcctgatgtctgacaagaccttcccccagaaccctgtggagctgaaggccctgtacaaccagtacatccacttcaaggagacagagatcctggccaaggagtag

SEQ ID NO: 159749 - DNA, 603 bp, Artificial Sequence
  Description of Artificial Sequence: Synthetic coding sequence
atgcccctgctggacagcagctacctgccccccaccatcttcatcctgacccacgtgctgggcgtggccggcgtgctgtactggaagagacatgcccggggccgggcagatgagcgggacagagtgcagaagaagaccttcaccaagtgggtgaacaagcacctgatgaaggtgaggaagcacatcaatgacctgtatgaggacctgagagatggccacaacctgatcagcctgctggaggtgctgagcggcatcaagctgccccgggagaagggccgcatgaggttccaccggctgcagaatgtgcagatcgccctggacttcctgaagcagaggcaggtgaagctggtgaacatcagaaatgatgacatcacagatggcaaccccaagctgaccctgggcctcatctggaccatcatcctgcacttccagatcagtgacatctacatctctggagagagcggggacatgtctgccaaggagaagctgctgctgtggacccagaaggtgacagctggctacacaggcatcaagtgcaccaacttcagcagctgctggagcgatggcaagatgtttaatgccctgatccaccgctacagatag

SEQ ID NO: 159750 - DNA, 15903 bp, Artificial Sequence
  Description of Artificial Sequence: Synthetic coding sequence
atgagcagcagtgatgaggagaccctgtctgagaggagctgccgctctgagaggagctgccgctctgagaggagctacagaagtgagaggagcggcagcctgagcccctgccccccaggggacaccctgccctggaacctgcccctgcacgagcagaagaagaggaagagccaggacagcgtgctggaccctgctgagagagctgtggtgcgggtggctgatgagcgggacagagtgcagaagaagaccttcaccaagtgggtgaacaagcacctgatgaaggtgaggaagcacatcaatgacctgtatgaggacctgagagatggccacaacctgatcagcctgctggaggtgctgagcggcatcaagctgccccgggagaagggccgcatgaggttccaccggctgcagaatgtgcagatcgccctggacttcctgaagcagaggcaggtgaagctggtgaacatcagaaatgatgacatcacagatggcaaccccaagctgaccctgggcctcatctggaccatcatcctgcacttccagatcagtgacatctacatcagcggggagagcggggacatgtctgccaaggagaagctgctgctgtggacccagaaggtgacagctggctacacaggcatcaagtgcaccaacttcagcagctgctggagcgatggcaagatgtttaatgccctgatccaccgctacagaccagacctggtggacatggagcgggtgcagatccagagcaaccgggagaacctggagcaggcctttgaggtggccgagcggctgggcgtgacccggctgctggatgctgaagatgtggatgtgcccagcccagatgagaagagcgtcatcacctacgtgagcagcatctatgatgccttccccaaggtgcctgagggcggggagggcatcagcgccacagaggtggacagccgctggcaggagtaccagagccgggtggacagcctcatcccctggatcaagcagcacaccatcctgatgtctgacaagaccttcccccagaaccctgtggagctgaaggccctgtacaaccagtacatccacttcaaggagacagagatcctggccaaggagcgggagaagggccgcatcgaggagctgtacaagctgctggaggtgtggattgaatttggccgcatcaagctgccccagggctaccaccccaatgatgtggaggaggagtggggcaagctgatcatcgagatgctggagcgggagaagagcctgcggcctgctgtggagcggctggagctgctgctgcagatcgccaacaagatccagaatggagccctgaactgtgaggagaagctgaccctggccaagaacaccctgcaggctgatgctgcccacctggagagcggccagcctgtgcagtgtgagagtgatgtgatcatgtacatccaggagtgtgagggcctcatccggcagctgcaggtggacctgcagatcctgagagatgagaactactaccagctggaggagctggccttccgggtgatgaggctgcaggatgagctggtgaccctgcggctggagtgcaccaacctgtacaggaagggccacttcaccagcctggagctggtgccccccagcaccctgaccaccacccacctgaaggccgagcccctgaccaaggccacccacagcagcagcacctcctggttcaggaagcccatgaccagggctgagctggtggccatcagcagcagtgaagatgagggcaacctgcgctttgtgtatgagctgctgtcctgggtggaggagatgcagatgaagctggagcgggcagagtggggcaatgacctgcccagcgtggagctgcagctggagacccagcagcacatccacacctctgtggaggagctgggcagctctgtgaaggaggcccggctgtatgagggcaagatgagccagaacttccacaccagctatgcagagaccctgggcaagctggagacccagtactgcaagctgaaggagaccagcagcttcaggatgaggcacctgcagagcctgcacaagtttgtgtcccgggccacagctgagctgatctggctgaatgagaaggaggaggaggagctggcctatgactggagcgacaacaacagcaacatcagcgccaagaggaactacttcagcgagctgaccatggagctggaggagaagcaggatgtgttccgcagcctgcaggacacagctgagctgctgagcctggagaaccacccagccaagcagacagtggaggcctacagcgctgctgtgcagagccagctgcagtggatgaagcagctgtgcctgtgtgtggagcagcacgtgaaggagaacacagcctacttccagttcttcagtgatgcccgggagctggagagcttcctgaggaacctgcaggacagcatcaagaggaagtacagctgtgaccacaacaccagcctgagccggctggaggacctgctgcaggacagcatggatgagaaggagcagctgatccagagcaagagctctgtggccagcctggtgggccgcagcaagaccatcgtgcagctgaagcccaggagcccagaccacgtgctgaagaacaccatctctgtgaaggctgtgtgtgactaccggcagatcgagatcaccatctgcaagaatgatgaatgtgtgctggaggacaacagccagaggaccaagtggaaggtgatcagccccactggaaatgaggccatggtgcccagcgtgtgcttcctgatccccccacccaacaaggatgccatcgagatggccagccgggtggagcagagctaccagaaggtgatggccctgtggcaccagctgcacgtgaacaccaagagcctcatctcctggaactacctgaggaaggacctggacctggtgcagacctggaacctggagaagctgcggagcagcgcccctggagagtgccaccagatcatgaagaacctgcaggcccactatgaggacttcctgcaggacagccgggacagcgtgctcttctctgtggccgaccggctgcggctggaggaggaggtggaggcctgcaaggcccgcttccagcacctgatgaagtccatggagaatgaagacaaggaggagaccgtggccaagatgtacatcagcgagctgaagaacatccggctgcggctggaggagtatgagcagagggtggtgaagaggatccagagcctggccagcagcaggacagacagagatgcctggcaggacaatgccctgagaattgctgagcaggagcacacccaggaggacctgcagcagctgcggagtgacctggatgctgtgtccatgaagtgtgacagcttcctgcaccagagccccagcagcagctctgtgcccaccctgcggtctgagctgaacctgctggtggagaagatggaccacgtgtatggcctgagcacagtgtacctgaacaagctgaagacagtggatgtgattgtgcgcagcatccaggatgctgagctgctggtgaagggctatgagatcaagctgagccaggaggaggtggtgctggccgacctgagcgccctggaggcccactggagcaccctgcggcactggctgagtgatgtgaaggacaagaacagcgtcttctctgtgctggatgaggagatcgccaaggccaaggtggtggccgagcagatgagccggctgaccccagagaggaacctggacctggagcgctaccaggagaagggcagccagctgcaggagcgctggcacagggtcatcgcccagctggagatccggcagagcgagctggagagcatccaggaggtgctgggggactaccgggcctgccacggcaccctcatcaagtggattgaggagaccacagcccagcaggagatgatgaagccaggccaggccgaggacagccgggtgctgtctgagcagctgagccagcagacagccctgtttgctgagattgaaagaaaccagaccaagctggaccagtgccagaagttcagccagcagtacagcaccatcgtgaaggactatgagctgcagctgatgacctacaaggcctttgtggagagccagcagaagagccctgggaagagaagaaggatgctgagcagcagtgatgccatcacccaggagttcatggacctgcggacccgctacacagccctggtgaccctgaccacccagcacgtgaagtacatcagtgatgccctgcggcggctggaggaggaggagaaggtggtggaggaggagaagcaggagcacgtggagaaggtgaaggagctgctgggctgggtgtccaccctggccaggaacacccagggcaaggccaccagcagcgagaccaaggagagcacagacatcgagaaggccatcctggagcagcaggtgctgtctgaggagctgaccaccaagaaggagcaggtgtctgaggccatcaagaccagccagatcttcctggccaagcacggccacaagctgtctgagaaggagaagaagcagatcagcgagcagctgaatgccctgaacaaggcctaccatgacctgtgtgatggcagcgccaaccagctgcagcagctgcagagccagctggcccaccagacagagcagaagaccctgcagaagcagcagaacacctgccaccagcagctggaggacctgtgctcctgggtgggccaggccgagcgggccctggccggccaccagggccgcaccacccagcaggacctgagcgccctgcagaagaaccagagcgacctgaaggacctgcaggatgacatccagaacagagccaccagctttgccaccgtggtgaaggacatcgagggcttcatggaggagaaccagaccaagctgagcccccgggagctgacagccctgcgggagaagctgcaccaggccaaggagcagtatgaggccctgcaggaggagaccagggtggcccagaaggagctggaggaggccgtgaccagcgccctgcagcaggagacagagaagagcaaggccgccaaggagctggccgagaacaagaagaagattgatgccctgctggactgggtgacctctgtgggcagcagcggcggccagctgctgaccaacctgcccggcatggagcagctgagcggggccagcctggagaagggggccctggacaccacagatggctacatgggcgtgaaccaggcccctgagaagctggacaagcagtgtgagatgatgaaggcccggcaccaggagctgctgagccagcagcagaacttcatcctggccacccagagcgcccaggccttcctggaccagcacggccacaacctgaccccagaggagcagcagatgctgcagcagaagctgggggagctgaaggagcagtacagcaccagcctggcccagagcgaggccgagctgaagcaggtgcagaccctgcaggatgagctgcagaagttcctgcaggaccacaaggagtttgagagctggctggagaggtctgagaaggagctggagaacatgcacaagggcggcagcagccctgagaccctgcccagcctgctgaagaggcagggcagcttctctgaagatgtgatcagccacaagggggacctgcgctttgtgaccatcagcggccagaaggtgctggacatggagaacagcttcaaggagggcaaggagcccagcgagatcggcaacctggtgaaggacaagctgaaggatgccacagagcgctacacagccctgcacagcaagtgcacccggctgggcagccacctgaacatgctgctgggccagtaccaccagttccagaacagcgctgacagcctgcaggcctggatgcaggcctgtgaggccaacgtggagaagctgctgagtgacacagtggccagtgaccccggggtgctgcaggagcagctggccaccaccaagcagctgcaggaggagctggccgagcaccaggtgcctgtggagaagctgcagaaggtggcccgggacatcatggagattgaaggagagcccgccccagaccaccgccacgtgcaggagaccacagacagcatcctgagccacttccagagcctgagctacagcctggccgagaggagcagcctgctgcagaaggccatcgcccagagccagagcgtgcaggagagcctggagagcctgctgcagagcattggagaggtggagcagaacctggagggcaagcaggtgagcagcctgagcagcggggtcatccaggaggccctggccaccaacatgaagctgaagcaggacatcgcccggcagaagagcagcctggaggccacccgggagatggtgacccgcttcatggagacagctgacagcaccacagctgctgtgctgcagggcaagctggccgaggtgtcccagagatttgagcagctgtgcctgcagcagcaggagaaggagagcagcctgaagaagctgctgccccaggccgagatgtttgagcacctgagcggcaagctgcagcagttcatggagaacaagagcaggatgctggccagcggcaaccagcctgaccaggacatcacccacttcttccagcagatccaggagctgaacctggagatggaggaccagcaggagaacctggacaccctggagcacctggtgacagagctgagcagctgtggctttgccctggacctgtgccagcaccaggacagagtgcagaacctgaggaaggacttcacagagctgcagaagacagtgaaggagcgggagaaggatgccagcagctgccaggagcagctggatgagttcaggaagctggtgaggaccttccagaagtggctgaaggagacagagggcagcatccccccaacagagacctccatgtctgccaaggagctggagaagcagatcgagcacctgaagagcctgctggatgactgggccagcaagggcaccctggtggaggagatcaactgcaagggcaccagcctggagaacctgatcatggagatcacagccccagacagccagggcaagacagacctgacagagatccagtgtgacatgtctgatgtgaacctgaagtatgagaagctgggcggcgtgctgcacgagcggcaggagagcctgcaggccatcctgaacaggatggaggaggtgcacaaggaggccaacagcgtgctgcagtggctggagagcaaggaggaggtgctgaagtccatggatgccatgagcagccccaccaagacagagaccgtgaaggcccaggccgagagcaacaaggccttcctggccgagctggagcagaacagccccaagatccagaaggtgaaggaggccctggccggcctgctggtgacctaccccaacagccaggaggccgagaactggaagaagatccaggaggagctgaacagccgctgggagcgggccacagaggtgacagtggcccggcagaggcagctggaggagagcgccagccacctggcctgcttccaggccgctgagagccagctgcggccctggctgatggagaaggagctgatgatgggcgtgctgggccccctgagcattgaccccaacatgctgaatgcccagaagcagcaggtgcagttcatgctgaaggagtttgaggcccggcggcagcagcacgagcagctgaatgaggccgcccagggcatcctgaccggccctggagatgtgtccctgagcaccagccaggtgcagaaggagctgcagagcatcaaccagaagtgggtggagctgacagacaagctgaacagccgcagcagccagattgaccaggccatcgtgaagagcacccagtaccaggagctgctgcaggacctgtctgagaaggtgcgggctgtgggccagaggctgtctgtgcagagcgccatcagcacccagcctgaggccgtgaagcagcagctggaggagaccagcgagatccgcagtgacctggagcagctggaccacgaggtgaaggaggcccagaccctgtgtgatgagctgtctgtgctgattggagagcagtacctgaaggatgagctgaagaagaggctggagaccgtggccctgcccctgcagggcctggaggacctggccgctgaccgcatcaaccggctgcaggccgccctggccagcacccagcagttccagcagatgtttgatgagctgcggacctggctggatgacaagcagagccagcaggccaagaactgccccatcagcgccaagctggagcggctgcagagccagctgcaggagaatgaggagttccagaagagcctgaaccagcacagcggcagctatgaagtcatcgtggccgagggggagagcctgctgctgtctgtgcccccaggagaggagaagaggaccctgcagaaccagctggtggagctgaagaaccactgggaggagctgagcaagaagacagctgaccggcagagccggctgaaggactgcatgcagaaggcccagaagtaccagtggcacgtggaggacctggtgccctggattgaggactgcaaggccaagatgtctgagctgcgggtgaccctggaccctgtgcagctggagagcagcctgctgcggagcaaggccatgctgaatgaggtggagaagaggaggagcctgctggagatcctgaacagcgctgctgacatcctgatcaacagcagcgaggctgatgaagatggcatcagagatgagaaggccggcatcaaccagaacatggatgctgtgacagaggagctgcaggccaagacaggcagcctggaggagatgacccagaggctgcgggagttccaggagagcttcaagaacatcgagaagaaggtggagggcgccaagcaccagctggagatctttgatgccctgggcagccaggcctgcagcaacaagaacctggagaagctgcgggcccagcaggaggtgctgcaggccctggagccccaggtggactacctgaggaacttcacccagggcctggtggaggatgccccagatggcagtgatgccagccagctgctgcaccaggccgaggtggcccagcaggagttcctggaggtgaagcagagggtgaacagcggctgtgtgatgatggagaacaagctggagggcatcggccagttccactgccgggtgcgggagatgttcagccagctggccgacctggatgatgagctggatggcatgggcgccatcggccgggacacagacagcctgcagagccagattgaagatgtgcggctcttcctgaacaagatccacgtgctgaagctggacatcgaggccagcgaggctgaatgtcgccacatgctggaggaggagggcaccctggacctgctgggcctgaagcgggagctggaggccctgaacaagcagtgtgggaagctgacagagcggggcaaggcccggcaggagcagctggagctgaccctgggccgggtggaggacttctacaggaagctgaagggcctgaatgatgccaccacagctgctgaggaggccgaggccctgcagtgggtggtgggcacagaggtggagatcatcaaccagcagctggccgacttcaagatgttccagaaggagcaggtggaccccctgcagatgaagctgcagcaggtgaatggcctgggccagggcctcatccagagcgctgggaaggactgtgatgtgcagggcctggagcatgacatggaggagatcaatgcccgctggaacaccctgaacaagaaggtggcccagagaattgcccagctgcaggaggccctgctgcactgtgggaagttccaggatgccctggagcccctgctgtcctggctggccgacacagaggagctgattgccaaccagaagccacccagcgctgagtacaaggtggtgaaggcccagatccaggagcagaagctgctgcagaggctgctggatgacaggaaggccaccgtggacatgctgcaggccgagggcggcagaattgcccagagcgctgagctggccgaccgggagaagatcaccggccagctggagagcctggagagccgctggacagagctgctgagcaaggccgccgcccggcagaagcagctggaggacatcctggtgctggccaagcagttccatgaaacagctgagcccatcagtgacttcctgtctgtgacagagaagaagctggccaacagcgagcctgtgggcacccagacagccaagatccagcagcagatcatccgccacaaggccctgaatgaggagatcgtgaacaggaagaagaatgtggaccaggccatcaagaatggccaggccctgctgaagcagaccactggagaggaggtgctgctgatccaggagaagctggatggcatcaagaccaggtatgctgacatcaccgtgaccagcagcaaggccctgcggaccctggagcaggcccggcagctggccaccaagttccagagcacctatgaggagctgaccggctggctgcgggaggtggaggaggagctggccaccagcggcggccagagccccaccggggagcagatcccccagttccagcagaggcagaaggagctgaagaaggaggtgatggagcaccggctggtgctggacacagtgaatgaggtgtcccgggccctgctggagctggtgccctggagggcccgggagggcctggacaagctggtgtctgatgccaatgagcagtacaagctggtgtctgacaccatcggccagagggtggatgaaattgatgctgccatccagaggagccagcagtatgagcaggccgcagatgctgagctggcctgggtggccgagaccaagaggaagctgatggccctgggccccatccggctggagcaggaccagaccacagcccagctgcaggtgcagaaggccttcagcattgacatcatccgccacaaggacagcatggatgagctgttcagccacaggtctgagatcttcggcacctgtggggaggagcagaagacagtgctgcaggagaagacagagagcctcatccagcagtatgaggccatcagcctgctgaacagcgagagatatgcccggctggagcgggcccaggtgctggtgaaccagttctgggagacctatgaggagctgagcccctggattgaggagacccgggccctgattgcccagctgcccagccctgccatcgaccacgagcagctgcggcagcagcaggaggagatgaggcagctgcgggagagcattgctgagcacaagccccacatcgacaagctgctgaagattggcccccagctgaaggagctgaaccctgaggagggggagatggtggaggagaagtaccagaaggccgagaacatgtatgcccagatcaaggaggaggtgcggcagagggccctggccctggatgaggccgtgtcccagagcacccaggtgtcccagttccatgacaagattgagcccatgctggagaccctggagaacctgagcagccggctgaggatgcctcctctcatcccagctgaggtggacaagatccgggagtgcatcagtgacaacaagagcgccaccgtggagctggagaagctgcagcccagctttgaggccctgaagagaagaggagaggagctgattggccgcagccagggcgctgacaaggacctggccgccaaggagatccaggacaagctggaccagatggtgttcttctgggaggacatcaaggcccgggcagaggagcgggagatcaagttcctggatgtgctggagctggccgagaagttctggtatgacatggccgccctgctgaccaccatcaaggacacccaggacatcgtgcatgacctggagagccctggcatcgaccccagcatcatcaagcagcaggtggaggccgctgagaccatcaaggaggagacagatggcctgcacgaggagctggagttcatccgcatcctgggcgctgacctgatctttgcctgtggggagacagagaagccagaggtgaggaagagcattgatgagatgaacaatgcctgggagaacctgaacaagacctggaaggagcggctggagaagctggaggatgccatgcaggccgctgtgcagtaccaggacaccctgcaggccatgtttgactggctggacaacacagtcatcaagctgtgcaccatgcctcctgtgggcacagacctgaacacagtgaaggaccagctgaatgagatgaaggagttcaaggtggaggtgtaccagcagcagatcgagatggagaagctgaaccaccagggcgagctgatgctgaagaaggccacagatgaaacagaccgggacatcatccgggagcccctgacagagctgaagcacctgtgggagaacctgggggagaagatcgcccaccggcagcacaagctggagggcgccctgctggccctgggccagttccagcacgccctggaggagctgatgtcctggctgacccacacagaggagctgctggatgcccagaggcccatcagcggggaccccaaggtgattgaggtggagctggccaagcaccacgtgctgaagaatgatgtgctggcccaccaggccaccgtggagaccgtgaacaaggctggaaatgagctgctggagagcagcgctggagatgatgccagcagcctgcggagccggctggaggccatgaaccagtgctgggagagcgtgctgcagaagacagaggagcgggagcagcagctgcagagcaccctgcagcaggcccagggcttccacagcgagattgaggacttcctgctggagctgaccaggatggagagccagctgagcgccagcaagcccactggaggcctgcctgagacagcccgggagcagctggacacccacatggagctgtacagccagctgaaggccaaggaggagacctacaaccagctgctggacaagggccgcctgatgctgctgagcagagatgacagcggcagcggcagcaagacagagcagagcgtggccctgctggagcagaagtggcacgtggtgagcagcaagatggaggagaggaagagcaagctggaggaggccctgaacctggccacagagttccagaacagcctgcaggagttcatcaactggctgaccctggccgagcagagcctgaacatcgccagcccccccagcctcatcctgaacacagtgctgagccagatcgaggagcacaaggtgtttgccaatgaggtgaatgcccaccgggaccagatcatcgagctggaccagacaggcaaccagctgaagttcctgagccagaagcaggatgtggtgctgatcaagaacctgctggtgtctgtgcagagccgctgggagaaggtggtgcagaggagcattgaaagaggccgcagcctggatgatgccaggaagagggccaagcagttccacgaggcctggaagaagctgattgactggctggaggatgctgagagccacctggacagcgagctggagatcagcaatgaccctgacaagatcaagctgcagctgagcaagcacaaggagttccagaagaccctgggcggcaagcagcctgtgtatgacaccaccatcagaacaggccgggccctgaaggagaagaccctgctgcctgaggacagccagaagctggacaacttcctgggggaggtgcgggacaagtgggacacagtgtgtgggaagtctgtggagcggcagcacaagctggaggaggccctgctcttcagcggccagttcatggatgccctgcaggccctggtggactggctgtacaaggtggagccccagctggccgaggaccagcctgtgcatggagacctggacctggtgatgaacctgatggatgcccacaaggtgttccagaaggagctgggcaagaggactggaacagtgcaggtgctgaagaggagcggccgggagctgattgagaacagcagagatgacaccacctgggtgaagggccagctgcaggagctgagcacccgctgggacacagtgtgcaagctgtctgtgtccaagcagagccggctggagcaggccctgaagcaggccgaggtgttccgggacacagtgcacatgctgctggagtggctgtctgaggccgagcagaccctgcgcttccggggggccctgcctgatgacacagaggccctgcagagcctgattgacacccacaaggagttcatgaagaaggtggaggagaagagggtggatgtgaacagcgctgtggccatgggagaggtgatcctggccgtgtgccacccagactgcatcaccaccatcaagcactggatcaccatcatccgggccaggtttgaggaggtgctgacctgggccaagcagcaccagcagaggctggagacagccctgtctgagctggtggccaatgctgagctgctggaggagctgctggcctggatccagtgggccgagaccaccctcatccagagggaccaggagcccatcccccagaacatcgacagagtgaaggccctgattgctgagcaccagaccttcatggaggagatgaccaggaagcagccagatgtggacagagtgaccaagacctacaagaggaagaacatcgagcccacccacgcccccttcatcgagaagagccgcagcggcggcaggaagagcctgagccagcccaccccaccacccatgcccatcctgagccagagcgaggccaagaacccccgcatcaaccagctgagcgcccgctggcagcaggtgtggctgctggccctggagcggcagaggaagctgaatgatgccctggaccggctggaggagctgaaggagtttgccaactttgattttgatgtgtggaggaagaagtacatgcgctggatgaaccacaagaagagccgggtgatggacttcttcagaagaattgacaaggaccaggacggcaagatcacccggcaggagttcattgatggcatcctggccagcaagttccccaccaccaagctggagatgacagctgtggccgacatctttgacagagatggagatggctacatcgactactatgaatttgtggccgccctgcaccccaacaaggatgcctaccggcccaccacagatgctgacaagattgaagatgaggtgacccggcaggtggcccagtgcaagtgtgccaagcgcttccaggtggagcagatcggggagaacaagtacagatttggagacagccagcagctgcggctggtgcgcatcctgcggagcacagtgatggtgcgggtgggcggcggctggatggccctggatgagttcctggtgaagaatgacccctgccgggcccggggccgcaccaacatcgagctgcgggagaagttcatcctgcctgagggcgccagccagggcatgacccccttccgcagccggggccgccgcagcaagcccagcagccgggccgccagccccaccaggagcagcagcagcgccagccagagcaaccacagctgcacctccatgcccagcagccctgccaccccagccagcggcaccaaggtgatccccagcagcggcagcaagctgaagaggcccacccccaccttccacagcagcaggaccagcctggccggggacaccagcaacagcagcagccctgccagcactggagccaagaccaacagagctgaccccaagaagagcgccagccggcccggcagccgggccggcagccgggccggcagccgggccagcagcagaagaggaagtgatgccagtgactttgacctgctggagacccagagcgcctgcagcgacaccagcgagagcagcgctgctgggggccagggcaacagccggcggggcctgaacaagcccagcaagatccccaccatgagcaagaagaccaccacagccagccccaggaccccaggccccaagaggtag

SEQ ID NO: 159751 - DNA, 1035 bp, Artificial Sequence
  Description of Artificial Sequence: Synthetic coding sequence
atgacagctgtggccgacatctttgacagagatggagatggctacatcgactactatgaatttgtggccgccctgcaccccaacaaggatgcctaccggcccaccacagatgctgacaagattgaagatgaggtgacccggcaggtggcccagtgcaagtgtgccaagcgcttccaggtggagcagattggagagaacaagtacagatttggagacagccagcagctgcggctggtgcgcatcctgcggagcacagtgatggtgcgggtgggcggcggctggatggccctggatgagttcctggtgaagaatgacccctgccgggcccggggccgcaccaacatcgagctgcgggagaagttcatcctgcctgagggcgccagccagggcatgacccccttccgcagccggggcagaagaagcaagcccagcagcagagctgccagccccaccaggagcagcagcagcgccagccagagcaaccacagctgcacctccatgcccagcagccctgccaccccagccagcggcaccaagaccagcctgcagttcagccgctgctatgacaagccctggctggtgaacagcaaggccggcacccccatccgggacagccacagcccagacctgcagctgcccaccccagaggtgatccccagcagcggcagcaagctgaagaggcccacccccaccttccacagcagcaggaccagcctggccggggacaccagcaacagcagcagccctgccagcactggagccaagaccaacagagctgaccccaagaagagcgccagccggcccggcagccgggccggcagccgggccggcagccgggccagcagcagaagaggaagtgatgccagtgactttgacctgctggagacccagagcgcctgcagcgacaccagcgagagcagcgctgctgggggccagggcaacagccggcggggcctgaacaagcccagcaagatccccaccatgagcaagaagaccaccacagccagccccaggaccccaggccccaagaggtag

SEQ ID NO: 159752 - DNA, 16293 bp, Artificial Sequence; identical to SEQ ID NO: 159745
  Description of Artificial Sequence: Synthetic coding sequence

SEQ ID NO: 159753 - DNA, 8412 bp, Artificial Sequence
  Description of Artificial Sequence: Synthetic coding sequence
atggatggagtggccgagttctctgaatatgtgtctgagaccgtggatgtgcccagcccctttgacctgctggagccccccaccagcggcggcttcctgaagctgagcaagccctgctgctacatcttccctgggggccgcggggacagcgccctgtttgctgtgaatggcttcaacatcctggtggatggcggcagtgacaggaagagctgcttctggaagctggtgcgccacctggacagaattgacagcgtgctgctgacccacatcggggctgacaacctgcccggcatcaatggcctgctgcagaggaaggtggccgagctggaggaggagcagagccagggcagcagcagctacagcgactgggtgaagaacctgatcagccctgagctgggcgtggtgttcttcaacgtgcctgagaagctgcggctgcctgatgccagcaggaaggccaagaggagcattgaggaggcctgcctgaccctgcagcacctgaaccggctgggcatccaggccgagcccctgtacagagtggtgagcaacaccatcgagcccctgaccctcttccacaagatgggcgtgggccgcctggacatgtatgtgctgaaccctgtgaaggacagcaaggagatgcagttcctgatgcagaagtgggccggcaacagcaaggccaagacaggaattgtgctgcccaacgggaaggaggccgagatctctgtgccctacctgaccagcatcacagccctggtggtgtggctgcctgccaaccccacagagaagatcgtgcgggtgctcttccctggaaatgccccccagaacaagatcctggagggcctggagaagctgcggcacctggacttcctgcgctaccctgtggccacccagaaggacctggccagcggggctgtgcccaccaacctgaagcccagcaagatcaagcagagagctgacagcaaggagagcctgaaggccaccaccaagacagctgtgtccaagctggccaagcgggaggaggtggtggaggagggcgccaaggaggcccggtctgagctggccaaggagctggccaagacagagaagaaggccaaggagagcagcgagaagcccccagagaagccagccaagccagagcgggtgaagacagagagcagcgaggccctgaaggccgagaagaggaagctgatcaaggacaaggtgggcaagaagcacctgaaggagaagatcagcaagctggaggagaagaaggacaaggagaagaaggagatcaagaaggagaggaaggagctgaagaaggatgagggcaggaaggaggagaagaaggatgccaagaaggaggagaagaggaaggacaccaagccagagctgaagaagatcagcaagccagacctgaagcccttcaccccagaggtgaggaagaccctgtacaaggccaaggtgcccggccgggtgaagattgacaggagccgggccatccggggggagaaggagctgagcagcgagccccagaccccaccagcccagaagggcaccgtgcccctgcccaccatcagcggccaccgggagctggtgctgagcagccctgaggacctgacccaggactttgaggagatgaagcgggaggagcgggccctgctggccgagcagagggacaccggcctgggggacaagcccttccccctggacacagctgaggagggcccccccagcacagccatccagggcaccccaccttctgtgcccggcctgggccaggaggagcacgtgatgaaggagaaggagctggtgcctgaggtgcctgaggagcagggcagcaaggaccggggcctggacagcggggctgagacagaggaggagaaggacacctgggaggagaagaagcagcgggaggccgagcggctgcctgacagaacagaggcccgggaggagagcgagcctgaggtgaaggaggatgtgattgagaaggccgagctggaggagatggaggaggtgcaccccagtgatgaggaggaggaggatgccaccaaggccgagggcttctaccagaagcacatgcaggagcccctgaaggtgacccccaggagccgggaggcctttggaggccgggagctgggcctgcagggcaaggcccctgagaaggagaccagcctcttcctgagcagcctgaccaccccagctggggccacagaacatgtgtcctacatccaggatgagaccatccctggctacagcgagacagagcagaccatcagtgatgaggagatccatgatgagcctgaggagaggcctgccccaccccgcttccacaccagcacctatgacctgcccggccctgagggcgccggcccctttgaggccagccagcctgctgacagcgctgtgcctgccaccagcggcaaggtgtatggcaccccagagacagagctgacctaccccaccaacatcgtggccgcccccctggccgaggaggagcacgtgagcagcgccaccagcatcacagaatgtgacaagctgagcagctttgccacctctgtggccgaggaccagagcgtggccagcctgacagccccccagacagaggagaccgggaagagcagcctgctgctggacacagtgaccagcatccccagcagcaggacagaggccacccagggcctggactatgtgcccagcgctggcaccatcagccccaccagcagcctggaggaggacaagggcttcaagagccccccctgtgaggacttctctgtgactggagagagcgagaagagaggagagatcatcggcaagggcctgtctggagagagagctgtggaggaggaggaggaggagacagccaacgtggagatgtctgagaagctgtgcagccagtatggcacccctgtgttcagcgcccctggccacgccctgcaccctggagagcccgccctgggggaggccgaggagcgctgcctgagcccagatgacagcacagtgaagatggccagccccccacccagcggcccccccagcgccacccacacccccttccaccagagccctgtggaggagaagtctgagccccaggacttccaggaggccgacagctggggagacaccaagaggaccccaggagtgggcaaggaggatgctgctgaggagaccgtgaagccaggccctgaggagggcaccctggagaaggaggagaaggtgcccccacccaggagcccccaggcccaggaggcccctgtgaacattgatgagggcctgaccggctgcaccatccagctgctgcctgcccaggacaaggccatcgtgtttgagatcatggaggccggggagcccaccggccccatcctgggcgctgaggccctgcccggcggcctgcggaccctgccccaggagcccgggaagccccagaaggatgaggtgctgcgctacccagacaggagcctgagcccagaagatgctgagagcctgtctgtgctgtctgtgcccagcccagacacagccaaccaggagcccacccccaagagcccctgtggcctgacagagcagtacctgcacaaggaccgctggccagaggtgtccccagaggacacccagagcctgagcctgtctgaggagagccccagcaaggagaccagcctggatgtgagcagcaagcagctgagccctgagagcctgggcaccctgcagtttggagagctgaacctgggcaaggaggagatgggccacctgatgcaggccgaggacaccagccaccacacagcccccatgtctgtgcctgagccccacgccgccacagccagccccccaacagatggcaccacccgctacagcgcccagacagacatcacagatgacagcctggacaggaagagccctgccagcagcttcagccacagcaccccatctggaaatggcaagtacctgcccggggccatcaccagcccagatgagcacatcctgaccccagacagcagcttcagcaagagccctgagagcctgcccggccctgccctggaggacatcgccatcaagtgggaggacaaggtgcccggcctgaaggacaggaccagcgagcagaagaaggagcctgagcccaaggatgaggtgctgcagcagaaggacaagaccctggagcacaaggaggtggtggagcccaaggacacagccatctaccagaaggatgaggccctgcacgtgaagaatgaggccgtgaagcagcaggacaaggccctggagcagaagggccgggacctggagcagaaggacacagccctggagcagaaggacaaggccctggagcccaaggacaaggacctggaggagaaggacaaggccctggagcagaaggacaagatccctgaggagaaggacaaggccctggagcagaaggacacagccctggagcagaaggacaaggccctggagcccaaggacaaggacctggagcagaaggacagagtgctggagcagaaggagaagatccctgaggagaaggacaaggccctggaccagaaggtgcgctctgtggagcacaaggcccctgaggacacagtggccgagatgaaggaccgggacctggagcagacagacaaggcccctgagcagaagcaccaggcccaggagcagaaggacaaggtgtctgagaagaaggaccaggccctggagcagaagtactgggccctgggccagaaggatgaggccctggagcagaacatccaggccctggaggagaaccaccagacccaggagcaggagagcctggtgcaggaggacaagaccaggaagcccaagatgctggaggagaagagccctgagaaggtgaaggccatggaggagaagctggaggccctgctggagaagaccaaggccctgggcctggaggagagcctggtgcaggagggccgggcccgggagcaggaggagaagtactggaggggccaggatgtggtgcaggagtggcaggagaccagccccacccgggaggagcctgctggggagcagaaggagctggccccagcctgggaggacaccagccctgagcaggacaaccgctactggagaggaagagaagatgtggccctggagcaggacacctactggagggagctgagctgtgagaggaaggtgtggttcccccatgagctggatggccagggcgcccggccccactacacagaggagcgggagagcaccttcctggatgagggcccagatgatgagcaggaggtgcccctgcgggagcacgccaccaggagcccctgggccagtgacttcaaggacttccaggagagcagcccccagaagggcctggaggtggagcgctggctggccgagagccctgtgggcctgcccccagaggaggaggacaagctgaccaggagcccctttgagatcatcagccccccagccagccccccagagatggtgggccagagggtgcccagcgcccctggccaggagagccccatcccagaccccaagctgatgccccacatgaagaatgagcccaccacccccagctggctggccgacatccccccctgggtgcccaaggaccggcccctgcccccagcccccctgagccctgcccctggcccccccaccccagcccctgagagccacaccccagcccccttctcctggggcacagcagaatatgattctgtggtggccgctgtgcaggagggcgctgctgagctggagggcggcccctacagccccctgggcaaggactacaggaaggccgagggggagcgggaggaggagggccgggcagaggccccagacaagagcagccacagcagcaaggtgcctgaggccagcaagagccacgccaccacagagcctgagcagacagagcctgagcagcgggagcccaccccctacccagatgagaggagcttccagtatgctgacatctatgagcagatgatgctgaccggcctgggccctgcctgccccacccgggagccccccctgggcgctgctggggactggccaccctgcctgagcaccaaggaggccgctgctggaagaaacaccagcgctgagaaggagctgagcagccccatcagccccaagagcctgcagagcgacacccccaccttctcctatgctgccctggccggccccaccgtgccccccaggcctgagcccggccccagcatggagcccagcctgaccccacctgctgtgcccccccgggcccccatcctgagcaagggccccagcccccccctgaatggaaacatcctgagctgcagcccagaccggcgcagccccagccccaaggagagcggccgcagccactgggatgacagcaccagtgacagcgagctggagaagggggcccgggagcagcctgagaaggaggcccagagccccagccccccccaccccatccccatgggcagccccaccctgtggccagagacagaggcccacgtgagcccccccctggacagccacctgggccctgcccggcccagcctggacttccctgccagcgccttcggcttcagcagcctgcagcctgccccaccccagctgcccagccctgctgagcccaggtctgccccctgtggcagcctggccttcagcggggaccgggccctggccctggcccctggcccccccaccaggaccaggcatgatgagtacctggaggtgaccaaggcccccagcctggacagcagcctgccccagctgcccagccccagcagccctggggcccccctgctgagcaacctgcccaggcctgccagccctgccctgtctgagggcagcagcagcgaggccaccacccctgtgatcagctctgtggccgagcgcttcagccccagcctggaggccgctgagcaggagagcggggagctggaccccggcatggagcctgctgcccacagcctgtgggacctgacccccctgagccctgcccccccagccagcctggacctggccctggccccagcccccagcctgcccggggacatgggagatggcatcctgccctgccacctggagtgcagcgaggccgccacagagaagcccagccccttccaggtgcccagcgaggactgtgccgccaacggccccacagagaccagccccaaccccccaggccctgccccagccaaggccgagaatgaggaggccgccgcctgcccagcctgggagcggggggcctggccagagggcgctgagaggagcagcaggccagacaccctgctgagccctgagcagcctgtgtgcccagctgggggcagcggcggcccccccagcagcgccagccctgaggtggaggccggcccccagggctgtgccacagagccccggccccacagaggagagctgagccccagcttcctgaacccccccctgccccccagcattgatgaccgggacctgagcacagaggaggtgcggctggtgggccggggcggcagaagaagagtgggcggccctggcaccaccggcggcccctgccctgtgacagatgagaccccacccaccagcgccagtgacagcggcagcagccagagcgacagtgatgtgcccccagagacagaagaatgtcccagcatcacagctgaggccgccctggacagtgatgaagatggagacttcctgcctgtggacaaggccggcggcgtgtctggcacccaccacccccggcccggccatgaccccccacccctgccccagcctgacccccggcccagcccccccaggccagatgtgtgcatggctgaccctgagggcctgagcagcgagagcggccgggtggagcggctgcgggagaaggagaaggtgcagggccgggtgggcagaagagcccctgggaaggccaagccagccagccctgcccggcggctggacctgcggggcaagaggagccccacccctgggaagggccctgctgaccgggccagccgggccccaccccggcccaggagcaccaccagccaggtgaccccagctgaggagaaggatggccacagccccatgagcaagggcctggtgaatggcctgaaggccggccccatggccctgagcagcaagggcagcagcggggcccctgtgtatgtggacctggcctacatccccaaccactgcagcggcaagacagctgacctggacttcttcagaagagtgcgggccagctactacgtggtgtctggaaatgaccctgccaatggagagcccagcagagctgtgctggatgccctgctggagggcaaggcccagtggggcgagaacctgcaggtgaccctcatccccacccatgacacagaggtgacccgggagtggtaccagcagacccatgagcagcagcagcagctgaatgtgctggtgctggccagcagcagcacagtggtgatgcaggatgagagcttccctgcctgcaagattgagttctag

SEQ ID NO: 159754 - DNA, 9126 bp, Artificial Sequence
  Description of Artificial Sequence: Synthetic coding sequence
atggagacagaagctgagcccgcccggccccatggagtggccatggagaccaccccaggcctgggcctgcggagccctggggcccccctggcccagaacccagctgagctgctgtgtgaggccggggctgctgtggccgccgcccgctgggacctgcagaagcacagcctgctgattgtgattggagacatcggcacagagagccagctgcgggctgtgcgggcccacctggagcagggcatcctgtcctggaacatcgacctgagcagctttgacctgaaccagcagctgcggctcttcatcaccaggcacctggcccacttcagcagcgaggtgaagggccagaggaccctgtgccaccagagcgagatcctggagaccatcatcctggtgaaccccagcgctgacagcatcagcagcgaggtgcaccacctgctgagcagcagcagcgcctacaagctgctgatcctgagcggccagagcctggagcccggcggggacctgatcctgcagagcggcacctacagctatgagaactttgcccaggtgctgcacaaccctgagatcagccagctgctgagcaacagagaccccggcatccaggccttcctgactgtgtcctgcctgggggagggggactggagccacctgggcctgagcagcagccaggagaccctgcacctgcggctgaaccctgagcccaccctgcccaccatggatggagtggccgagttctctgaatatgtgtctgagaccgtggatgtgcccagcccctttgacctgctggagccccccaccagcggcggcttcctgaagctgagcaagccctgctgctacatcttccctgggggccgcggggacagcgccctgtttgctgtgaatggcttcaacatcctggtggatggcggcagtgacaggaagagctgcttctggaagctggtgcgccacctggacagaattgacagcgtgctgctgacccacatcggggctgacaacctgcccggcatcaatggcctgctgcagaggaaggtggccgagctggaggaggagcagagccagggcagcagcagctacagcgactgggtgaagaacctgatcagccctgagctgggcgtggtgttcttcaacgtgcctgagaagctgcggctgcctgatgccagcaggaaggccaagaggagcattgaggaggcctgcctgaccctgcagcacctgaaccggctgggcatccaggccgagcccctgtacagagtggtgagcaacaccatcgagcccctgaccctcttccacaagatgggcgtgggccgcctggacatgtatgtgctgaaccctgtgaaggacagcaaggagatgcagttcctgatgcagaagtgggccggcaacagcaaggccaagacaggaattgtgctgcccaacgggaaggaggccgagatctctgtgccctacctgaccagcatcacagccctggtggtgtggctgcctgccaaccccacagagaagatcgtgcgggtgctcttccctggaaatgccccccagaacaagatcctggagggcctggagaagctgcggcacctggacttcctgcgctaccctgtggccacccagaaggacctggccagcggggctgtgcccaccaacctgaagcccagcaagatcaagcagagagctgacagcaaggagagcctgaaggccaccaccaagacagctgtgtccaagctggccaagcgggaggaggtggtggaggagggcgccaaggaggcccggtctgagctggccaaggagctggccaagacagagaagaaggccaaggagagcagcgagaagcccccagagaagccagccaagccagagcgggtgaagacagagagcagcgaggccctgaaggccgagaagaggaagctgatcaaggacaaggtgggcaagaagcacctgaaggagaagatcagcaagctggaggagaagaaggacaaggagaagaaggagatcaagaaggagaggaaggagctgaagaaggatgagggcaggaaggaggagaagaaggatgccaagaaggaggagaagaggaaggacaccaagccagagctgaagaagatcagcaagccagacctgaagcccttcaccccagaggtgaggaagaccctgtacaaggccaaggtgcccggccgggtgaagattgacaggagccgggccatccggggggagaaggagctgagcagcgagccccagaccccaccagcccagaagggcaccgtgcccctgcccaccatcagcggccaccgggagctggtgctgagcagccctgaggacctgacccaggactttgaggagatgaagcgggaggagcgggccctgctggccgagcagagggacaccggcctgggggacaagcccttccccctggacacagctgaggagggcccccccagcacagccatccagggcaccccaccttctgtgcccggcctgggccaggaggagcacgtgatgaaggagaaggagctggtgcctgaggtgcctgaggagcagggcagcaaggaccggggcctggacagcggggctgagacagaggaggagaaggacacctgggaggagaagaagcagcgggaggccgagcggctgcctgacagaacagaggcccgggaggagagcgagcctgaggtgaaggaggatgtgattgagaaggccgagctggaggagatggaggaggtgcaccccagtgatgaggaggaggaggatgccaccaaggccgagggcttctaccagaagcacatgcaggagcccctgaaggtgacccccaggagccgggaggcctttggaggccgggagctgggcctgcagggcaaggcccctgagaaggagaccagcctcttcctgagcagcctgaccaccccagctggggccacagaacatgtgtcctacatccaggatgagaccatccctggctacagcgagacagagcagaccatcagtgatgaggagatccatgatgagcctgaggagaggcctgccccaccccgcttccacaccagcacctatgacctgcccggccctgagggcgccggcccctttgaggccagccagcctgctgacagcgctgtgcctgccaccagcggcaaggtgtatggcaccccagagacagagctgacctaccccaccaacatcgtggccgcccccctggccgaggaggagcacgtgagcagcgccaccagcatcacagaatgtgacaagctgagcagctttgccacctctgtggccgaggaccagagcgtggccagcctgacagccccccagacagaggagaccgggaagagcagcctgctgctggacacagtgaccagcatccccagcagcaggacagaggccacccagggcctggactatgtgcccagcgctggcaccatcagccccaccagcagcctggaggaggacaagggcttcaagagccccccctgtgaggacttctctgtgactggagagagcgagaagagaggagagatcatcggcaagggcctgtctggagagagagctgtggaggaggaggaggaggagacagccaacgtggagatgtctgagaagctgtgcagccagtatggcacccctgtgttcagcgcccctggccacgccctgcaccctggagagcccgccctgggggaggccgaggagcgctgcctgagcccagatgacagcacagtgaagatggccagccccccacccagcggcccccccagcgccacccacacccccttccaccagagccctgtggaggagaagtctgagccccaggacttccaggaggccgacagctggggagacaccaagaggaccccaggagtgggcaaggaggatgctgctgaggagaccgtgaagccaggccctgaggagggcaccctggagaaggaggagaaggtgcccccacccaggagcccccaggcccaggaggcccctgtgaacattgatgagggcctgaccggctgcaccatccagctgctgcctgcccaggacaaggccatcgtgtttgagatcatggaggccggggagcccaccggccccatcctgggcgctgaggccctgcccggcggcctgcggaccctgccccaggagcccgggaagccccagaaggatgaggtgctgcgctacccagacaggagcctgagcccagaagatgctgagagcctgtctgtgctgtctgtgcccagcccagacacagccaaccaggagcccacccccaagagcccctgtggcctgacagagcagtacctgcacaaggaccgctggccagaggtgtccccagaggacacccagagcctgagcctgtctgaggagagccccagcaaggagaccagcctggatgtgagcagcaagcagctgagccctgagagcctgggcaccctgcagtttggagagctgaacctgggcaaggaggagatgggccacctgatgcaggccgaggacaccagccaccacacagcccccatgtctgtgcctgagccccacgccgccacagccagccccccaacagatggcaccacccgctacagcgcccagacagacatcacagatgacagcctggacaggaagagccctgccagcagcttcagccacagcaccccatctggaaatggcaagtacctgcccggggccatcaccagcccagatgagcacatcctgaccccagacagcagcttcagcaagagccctgagagcctgcccggccctgccctggaggacatcgccatcaagtgggaggacaaggtgcccggcctgaaggacaggaccagcgagcagaagaaggagcctgagcccaaggatgaggtgctgcagcagaaggacaagaccctggagcacaaggaggtggtggagcccaaggacacagccatctaccagaaggatgaggccctgcacgtgaagaatgaggccgtgaagcagcaggacaaggccctggagcagaagggccgggacctggagcagaaggacacagccctggagcagaaggacaaggccctggagcccaaggacaaggacctggaggagaaggacaaggccctggagcagaaggacaagatccctgaggagaaggacaaggccctggagcagaaggacacagccctggagcagaaggacaaggccctggagcccaaggacaaggacctggagcagaaggacagagtgctggagcagaaggagaagatccctgaggagaaggacaaggccctggaccagaaggtgcgctctgtggagcacaaggcccctgaggacacagtggccgagatgaaggaccgggacctggagcagacagacaaggcccctgagcagaagcaccaggcccaggagcagaaggacaaggtgtctgagaagaaggaccaggccctggagcagaagtactgggccctgggccagaaggatgaggccctggagcagaacatccaggccctggaggagaaccaccagacccaggagcaggagagcctggtgcaggaggacaagaccaggaagcccaagatgctggaggagaagagccctgagaaggtgaaggccatggaggagaagctggaggccctgctggagaagaccaaggccctgggcctggaggagagcctggtgcaggagggccgggcccgggagcaggaggagaagtactggaggggccaggatgtggtgcaggagtggcaggagaccagccccacccgggaggagcctgctggggagcagaaggagctggccccagcctgggaggacaccagccctgagcaggacaaccgctactggagaggaagagaagatgtggccctggagcaggacacctactggagggagctgagctgtgagaggaaggtgtggttcccccatgagctggatggccagggcgcccggccccactacacagaggagcgggagagcaccttcctggatgagggcccagatgatgagcaggaggtgcccctgcgggagcacgccaccaggagcccctgggccagtgacttcaaggacttccaggagagcagcccccagaagggcctggaggtggagcgctggctggccgagagccctgtgggcctgcccccagaggaggaggacaagctgaccaggagcccctttgagatcatcagccccccagccagccccccagagatggtgggccagagggtgcccagcgcccctggccaggagagccccatcccagaccccaagctgatgccccacatgaagaatgagcccaccacccccagctggctggccgacatccccccctgggtgcccaaggaccggcccctgcccccagcccccctgagccctgcccctggcccccccaccccagcccctgagagccacaccccagcccccttctcctggggcacagcagaatatgattctgtggtggccgctgtgcaggagggcgctgctgagctggagggcggcccctacagccccctgggcaaggactacaggaaggccgagggggagcgggaggaggagggccgggcagaggccccagacaagagcagccacagcagcaaggtgcctgaggccagcaagagccacgccaccacagagcctgagcagacagagcctgagcagcgggagcccaccccctacccagatgagaggagcttccagtatgctgacatctatgagcagatgatgctgaccggcctgggccctgcctgccccacccgggagccccccctgggcgctgctggggactggccaccctgcctgagcaccaaggaggccgctgctggaagaaacaccagcgctgagaaggagctgagcagccccatcagccccaagagcctgcagagcgacacccccaccttctcctatgctgccctggccggccccaccgtgccccccaggcctgagcccggccccagcatggagcccagcctgaccccacctgctgtgcccccccgggcccccatcctgagcaagggccccagcccccccctgaatggaaacatcctgagctgcagcccagaccggcgcagccccagccccaaggagagcggccgcagccactgggatgacagcaccagtgacagcgagctggagaagggggcccgggagcagcctgagaaggaggcccagagccccagccccccccaccccatccccatgggcagccccaccctgtggccagagacagaggcccacgtgagcccccccctggacagccacctgggccctgcccggcccagcctggacttccctgccagcgccttcggcttcagcagcctgcagcctgccccaccccagctgcccagccctgctgagcccaggtctgccccctgtggcagcctggccttcagcggggaccgggccctggccctggcccctggcccccccaccaggaccaggcatgatgagtacctggaggtgaccaaggcccccagcctggacagcagcctgccccagctgcccagccccagcagccctggggcccccctgctgagcaacctgcccaggcctgccagccctgccctgtctgagggcagcagcagcgaggccaccacccctgtgatcagctctgtggccgagcgcttcagccccagcctggaggccgctgagcaggagagcggggagctggaccccggcatggagcctgctgcccacagcctgtgggacctgacccccctgagccctgcccccccagccagcctggacctggccctggccccagcccccagcctgcccggggacatgggagatggcatcctgccctgccacctggagtgcagcgaggccgccacagagaagcccagccccttccaggtgcccagcgaggactgtgccgccaacggccccacagagaccagccccaaccccccaggccctgccccagccaaggccgagaatgaggaggccgccgcctgcccagcctgggagcggggggcctggccagagggcgctgagaggagcagcaggccagacaccctgctgagccctgagcagcctgtgtgcccagctgggggcagcggcggcccccccagcagcgccagccctgaggtggaggccggcccccagggctgtgccacagagccccggccccacagaggagagctgagccccagcttcctgaacccccccctgccccccagcattgatgaccgggacctgagcacagaggaggtgcggctggtgggccggggcggcagaagaagagtgggcggccctggcaccaccggcggcccctgccctgtgacagatgagaccccacccaccagcgccagtgacagcggcagcagccagagcgacagtgatgtgcccccagagacagaagaatgtcccagcatcacagctgaggccgccctggacagtgatgaagatggagacttcctgcctgtggacaaggccggcggcgtgtctggcacccaccacccccggcccggccatgaccccccacccctgccccagcctgacccccggcccagcccccccaggccagatgtgtgcatggctgaccctgagggcctgagcagcgagagcggccgggtggagcggctgcgggagaaggagaaggtgcagggccgggtgggcagaagagcccctgggaaggccaagccagccagccctgcccggcggctggacctgcggggcaagaggagccccacccctgggaagggccctgctgaccgggccagccgggccccaccccggcccaggagcaccaccagccaggtgaccccagctgaggagaaggatggccacagccccatgagcaagggcctggtgaatggcctgaaggccggccccatggccctgagcagcaagggcagcagcggggcccctgtgtatgtggacctggcctacatccccaaccactgcagcggcaagacagctgacctggacttcttcagaagagtgcgggccagctactacgtggtgtctggaaatgaccctgccaatggagagcccagcagagctgtgctggatgccctgctggagggcaaggcccagtggggcgagaacctgcaggtgaccctcatccccacccatgacacagaggtgacccgggagtggtaccagcagacccatgagcagcagcagcagctgaatgtgctggtgctggccagcagcagcacagtggtgatgcaggatgagagcttccctgcctgcaagattgagttctag

SEQ ID NO: 159755 - DNA, 8418 bp, Artificial Sequence
  Description of Artificial Sequence: Synthetic coding sequence
atggatggagtggccgagttctctgaatatgtgtctgagaccgtggatgtgcccagcccctttgacctgctggagccccccaccagcggcggcttcctgaagctgagcaagccctgctgctacatcttccctgggggccgcggggacagcgccctgtttgctgtgaatggcttcaacatcctggtggatggcggcagtgacaggaagagctgcttctggaagctggtgcgccacctggacagaattgacagcgtgctgctgacccacatcggggctgacaacctgcccggcatcaatggcctgctgcagaggaaggtggccgagctggaggaggagcagagccagggcagcagcagctacagcgactgggtgaagaacctgatcagccctgagctgggcgtggtgttcttcaacgtgcctgagaagctgcggctgcctgatgccagcaggaaggccaagaggagcattgaggaggcctgcctgaccctgcagcacctgaaccggctgggcatccaggccgagcccctgtacagagtggtgagcaacaccatcgagcccctgaccctcttccacaagatgggcgtgggccgcctggacatgtatgtgctgaaccctgtgaaggacagcaaggagatgcagttcctgatgcagaagtgggccggcaacagcaaggccaagacaggaattgtgctgcccaacgggaaggaggccgagatctctgtgccctacctgaccagcatcacagccctggtggtgtggctgcctgccaaccccacagagaagatcgtgcgggtgctcttccctggaaatgccccccagaacaagatcctggagggcctggagaagctgcggcacctggacttcctgcgctaccctgtggccacccagaaggacctggccagcggggctgtgcccaccaacctgaagcccagcaagatcaagcagagagctgacagcaaggagagcctgaaggccaccaccaagacagctgtgtccaagctggccaagcgggaggaggtggtggaggagggcgccaaggaggcccggtctgagctggccaaggagctggccaagacagagaagaaggccaaggagagcagcgagaagcccccagagaagccagccaagccagagcgggtgaagacagagagcagcgaggccctgaaggccgagaagaggaagctgatcaaggacaaggtgggcaagaagcacctgaaggagaagatcagcaagctggaggagaagaaggacaaggagaagaaggagatcaagaaggagaggaaggagctgaagaaggatgagggcaggaaggaggagaagaaggatgccaagaaggaggagaagaggaaggacaccaagccagagctgaagaagatcagcaagccagacctgaagcccttcaccccagaggtgaggaagaccctgtacaaggccaaggtgcccggccgggtgaagattgacaggagccgggccatccggggggagaaggagctgagcagcgagccccagaccccaccagcccagaagggcaccgtgcccctgcccaccatcagcggccaccgggagctggtgctgagcagccctgaggacctgacccaggactttgaggagatgaagcgggaggagcgggccctgctggccgagcagagggacaccggcctgggggacaagcccttccccctggacacagctgaggagggcccccccagcacagccatccagggcaccccaccttctgtgcccggcctgggccaggaggagcacgtgatgaaggagaaggagctggtgcctgaggtgcctgaggagcagggcagcaaggaccggggcctggacagcggggctgagacagaggaggagaaggacacctgggaggagaagaagcagcgggaggccgagcggctgcctgacagaacagaggcccgggaggagagcgagcctgaggtgaaggaggatgtgattgagaaggccgagctggaggagatggaggaggtgcaccccagtgatgaggaggaggaggatgccaccaaggccgagggcttctaccagaagcacatgcaggagcccctgaaggtgacccccaggagccgggaggcctttggaggccgggagctgggcctgcagggcaaggcccctgagaaggagaccagcctcttcctgagcagcctgaccaccccagctggggccacagaacatgtgtcctacatccaggatgagaccatccctggctacagcgagacagagcagaccatcagtgatgaggagatccatgatgagcctgaggagaggcctgccccaccccgcttccacaccagcacctatgacctgcccggccctgagggcgccggcccctttgaggccagccagcctgctgacagcgctgtgcctgccaccagcggcaaggtgtatggcaccccagagacagagctgacctaccccaccaacatcgtggccgcccccctggccgaggaggagcacgtgagcagcgccaccagcatcacagaatgtgacaagctgagcagctttgccacctctgtggccgaggaccagagcgtggccagcctgacagccccccagacagaggagaccgggaagagcagcctgctgctggacacagtgaccagcatccccagcagcaggacagaggccacccagggcctggactatgtgcccagcgctggcaccatcagccccaccagcagcctggaggaggacaagggcttcaagagccccccctgtgaggacttctctgtgactggagagagcgagaagagaggagagatcatcggcaagggcctgtctggagagagagctgtggaggaggaggaggaggagacagccaacgtggagatgtctgagaagctgtgcagccagtatggcacccctgtgttcagcgcccctggccacgccctgcaccctggagagcccgccctgggggaggccgaggagcgctgcctgagcccagatgacagcacagtgaagatggccagccccccacccagcggcccccccagcgccacccacacccccttccaccagagccctgtggaggagaagtctgagccccaggacttccaggaggccgacagctggggagacaccaagaggaccccaggagtgggcaaggaggatgctgctgaggagaccgtgaagccaggccctgaggagggcaccctggagaaggaggagaaggtgcccccacccaggagcccccaggcccaggaggcccctgtgaacattgatgagggcctgaccggctgcaccatccagctgctgcctgcccaggacaaggccatcgtgtttgagatcatggaggccggggagcccaccggccccatcctgggcgctgaggccctgcccggcggcctgcggaccctgccccaggagcccgggaagccccagaaggatgaggtgctgcgctacccagacaggagcctgagcccagaagatgctgagagcctgtctgtgctgtctgtgcccagcccagacacagccaaccaggagcccacccccaagagcccctgtggcctgacagagcagtacctgcacaaggaccgctggccagaggtgtccccagaggacacccagagcctgagcctgtctgaggagagccccagcaaggagaccagcctggatgtgagcagcaagcagctgagccctgagagcctgggcaccctgcagtttggagagctgaacctgggcaaggaggagatgggccacctgatgcaggccgaggacaccagccaccacacagcccccatgtctgtgcctgagccccacgccgccacagccagccccccaacagatggcaccacccgctacagcgcccagacagacatcacagatgacagcctggacaggaagagccctgccagcagcttcagccacagcaccccatctggaaatggcaagtacctgcccggggccatcaccagcccagatgagcacatcctgaccccagacagcagcttcagcaagagccctgagagcctgcccggccctgccctggaggacatcgccatcaagtgggaggacaaggtgcccggcctgaaggacaggaccagcgagcagaagaaggagcctgagcccaaggatgaggtgctgcagcagaaggacaagaccctggagcacaaggaggtggtggagcccaaggacacagccatctaccagaaggatgaggccctgcacgtgaagaatgaggccgtgaagcagcaggacaaggccctggagcagaagggccgggacctggagcagaaggacacagccctggagcagaaggacaaggccctggagcccaaggacaaggacctggaggagaaggacaaggccctggagcagaaggacaagatccctgaggagaaggacaaggccctggagcagaaggacacagccctggagcagaaggacaaggccctggagcccaaggacaaggacctggagcagaaggacagagtgctggagcagaaggagaagatccctgaggagaaggacaaggccctggaccagaaggtgcgctctgtggagcacaaggcccctgaggacacagtggccgagatgaaggaccgggacctggagcagacagacaaggcccctgagcagaagcaccaggcccaggagcagaaggacaaggtgtctgagaagaaggaccaggccctggagcagaagtactgggccctgggccagaaggatgaggccctggagcagaacatccaggccctggaggagaaccaccagacccaggagcaggagagcctggtgcaggaggacaagaccaggaagcccaagatgctggaggagaagagccctgagaaggtgaaggccatggaggagaagctggaggccctgctggagaagaccaaggccctgggcctggaggagagcctggtgcaggagggccgggcccgggagcaggaggagaagtactggaggggccaggatgtggtgcaggagtggcaggagaccagccccacccgggaggagcctgctggggagcagaaggagctggccccagcctgggaggacaccagccctgagcaggacaaccgctactggagaggaagagaagatgtggccctggagcaggacacctactggagggagctgagctgtgagaggaaggtgtggttcccccatgagctggatggccagggcgcccggccccactacacagaggagcgggagagcaccttcctggatgagggcccagatgatgagcaggaggtgcccctgcgggagcacgccaccaggagcccctgggccagtgacttcaaggacttccaggagagcagcccccagaagggcctggaggtggagcgctggctggccgagagccctgtgggcctgcccccagaggaggaggacaagctgaccaggagcccctttgagatcatcagccccccagccagccccccagagatggtgggccagagggtgcccagcgcccctggccaggagagccccatcccagaccccaagctgatgccccacatgaagaatgagcccaccacccccagctggctggccgacatccccccctgggtgcccaaggaccggcccctgcccccagcccccctgagccctgcccctggcccccccaccccagcccctgagagccacaccccagcccccttctcctggggcacagcagaatatgattctgtggtggccgctgtgcaggagggcgctgctgagctggagggcggcccctacagccccctgggcaaggactacaggaaggccgagggggagcgggaggaggagggccgggcagaggccccagacaagagcagccacagcagcaaggtgcctgaggccagcaagagccacgccaccacagagcctgagcagacagagcctgagcagcgggagcccaccccctacccagatgagaggagcttccagtatgctgacatctatgagcagatgatgctgaccggcctgggccctgcctgccccacccgggagccccccctgggcgctgctggggactggccaccctgcctgagcaccaaggaggccgctgctggaagaaacaccagcgctgagaaggagctgagcagccccatcagccccaagagcctgcagagcgacacccccaccttctcctatgctgccctggccggccccaccgtgccccccaggcctgagcccggccccagcatggagcccagcctgaccccacctgctgtgcccccccgggcccccatcctgagcaagggccccagcccccccctgaatggaaacatcctgagctgcagcccagaccggcgcagccccagccccaaggagagcggccgcagccactgggatgacagcaccagtgacagcgagctggagaagggggcccgggagcagcctgagaaggaggcccagagccccagccccccccaccccatccccatgggcagccccaccctgtggccagagacagaggcccacgtgagcccccccctggacagccacctgggccctgcccggcccagcctggacttccctgccagcgccttcggcttcagcagcctgcagcctgccccaccccagctgcccagccctgctgagcccaggtctgccccctgtggcagcctggccttcagcggggaccgggccctggccctggcccctggcccccccaccaggaccaggcatgatgagtacctggaggtgaccaaggcccccagcctggacagcagcctgccccagctgcccagccccagcagccctggggcccccctgctgagcaacctgcccaggcctgccagccctgccctgtctgagggcagcagcagcgaggccaccacccctgtgatcagctctgtggccgagcgcttcagccccagcctggaggccgctgagcaggagagcggggagctggaccccggcatggagcctgctgcccacagcctgtgggacctgacccccctgagccctgcccccccagccagcctggacctggccctggccccagcccccagcctgcccggggacatgggagatggcatcctgccctgccacctggagtgcagcgaggccgccacagagaagcccagccccttccaggtgcccagcgaggactgtgccgccaacggccccacagagaccagccccaaccccccaggccctgccccagccaaggccgagaatgaggaggccgccgcctgcccagcctgggagcggggggcctggccagagggcgctgagaggagcagcaggccagacaccctgctgagccctgagcagcctgtgtgcccagctgggggcagcggcggcccccccagcagcgccagccctgaggtggaggccggcccccagggctgtgccacagagccccggccccacagaggagagctgagccccagcttcctgaacccccccctgccccccagcattgatgaccgggacctgagcacagaggaggtgcggctggtgggccggggcggcagaagaagagtgggcggccctggcaccaccggcggcccctgccctgtgacagatgagaccccacccaccagcgccagtgacagcggcagcagccagagcgacagtgatgtgcccccagagacagaagaatgtcccagcatcacagctgaggccgccctggacagtgatgaagatggagacttcctgcctgtggacaaggccggcggcgtgtctggcacccaccacccccggcccggccatgaccccccacccctgccccagcctgacccccggcccagcccccccaggccagatgtgtgcatggctgaccctgagggcctgagcagcgagagcggccgggtggagcggctgcgggagaaggagaaggtgcagggccgggtgggcagaagagcccctgggaaggccaagccagccagccctgcccggcggctggacctgcggggcaagaggagccccacccctgggaagggccctgctgaccgggccagccgggccccaccccggcccaggagcaccaccagccaggtgaccccagctgaggagaaggatggccacagccccatgagcaagggcctggtgaatggcctgaaggccggccccatggccctgagcagcaagggcagcagcggggcccctgtgtatgtggacctggcctacatccccaaccactgcagcggcaagacagctgacctggacttcttcagaagagtgcgggccagctactacgtggtgtctggaaatgaccctgccaatggagagcccagcagagctgtgctggatgccctgctggagggcaaggcccagtggggcgagaacctgcaggtgtctgtgaccctcatccccacccatgacacagaggtgacccgggagtggtaccagcagacccatgagcagcagcagcagctgaatgtgctggtgctggccagcagcagcacagtggtgatgcaggatgagagcttccctgcctgcaagattgagttctag

SEQ ID NO: 159756 - DNA, 1884 bp, Artificial Sequence
  Description of Artificial Sequence: Synthetic coding sequence
atggatggagtggccgagttctctgaatatgtgtctgagaccgtggatgtgcccagcccctttgacctgctggagccccccaccagcggcggcttcctgaagctgagcaagccctgctgctacatcttccctgggggccgcggggacagcgccctgtttgctgtgaatggcttcaacatcctggtggatggcggcagtgacaggaagagctgcttctggaagctggtgcgccacctggacagaattgacagcgtgctgctgacccacatcggggctgacaacctgcccggcatcaatggcctgctgcagaggaaggtggccgagctggaggaggagcagagccagggcagcagcagctacagcgactgggtgaagaacctgatcagccctgagctgggcgtggtgttcttcaacgtgcctgagaagctgcggctgcctgatgccagcaggaaggccaagaggagcattgaggaggcctgcctgaccctgcagcacctgaaccggctgggcatccaggccgagcccctgtacagagtggtgagcaacaccatcgagcccctgaccctcttccacaagatgggcgtgggccgcctggacatgtatgtgctgaaccctgtgaaggacagcaaggagatgcagttcctgatgcagaagtgggccggcaacagcaaggccaagacaggaattgtgctgcccaacgggaaggaggccgagatctctgtgccctacctgaccagcatcacagccctggtggtgtggctgcctgccaaccccacagagaagatcgtgcgggtgctcttccctggaaatgccccccagaacaagatcctggagggcctggagaagctgcggcacctggacttcctgcgctaccctgtggccacccagaaggacctggccagcggggctgtgcccaccaacctgaagcccagcaagatcaagcagagagctgacagcaaggagagcctgaaggccaccaccaagacagctgtgtccaagctggccaagcgggaggaggtggtggaggagggcgccaaggaggcccggtctgagctggccaaggagctggccaagacagagaagaaggccaaggagagcagcgagaagcccccagagaagccagccaagccagagcgggtgaagacagagagcagcgaggccctgaaggccgagaagaggaagctgatcaaggacaaggtgggcaagaagcacctgaaggagaagatcagcaagctggaggagaagaaggacaaggagaagaaggagatcaagaaggagaggaaggagctgaagaaggatgagggcaggaaggaggagaagaaggatgccaagaaggaggagaagaggaaggacaccaagccagagctgaagaagatcagcaagccagacctgaagcccttcaccccagaggtgaggaagaccctgtacaaggccaaggtgcccggccgggtgaagattgacaggagccgggccatccggggggagaaggagctgagcagcgagccccagaccccaccagcccagaagggcaccgtgcccctgcccaccatcagcggccaccgggagctggtgctgagcagccctgaggacctgacccaggactttgaggagatgaagcgggaggagcgggccctgctggccgagcagagggacaccggcctgggggacaagcccttccccctggacacagctgaggagggcccccccagcacagccatccagggcaccccaccttctgtgcccggcctgggccaggaggagcacgtgatgaaggagaaggagctggtgcctgaggtgcctgaggagcagggcagcaaggaccggggcctggacagcggggctgagacagaggagaagaagaagaagaagaagaagaagaagtag

SEQ ID NO: 159757 - DNA, 1680 bp, Artificial Sequence
  Description of Artificial Sequence: Synthetic coding sequence
atggctgatgagaggaaggatgaggccaaggccccccactggaccagcgcccccctgacagaggccagcgcccacagccaccccccagagatcaaggaccagggcggggccggggagggcctggtgcgcagcgccaacggcttcccctaccgggaggatgaggagggcgccttcggggagcacggcagccagggcacctacagcaacaccaaggaaaatggcatcaacggggagctgaccagcgctgaccgggagacagctgaggaggtgtctgcccgcatcgtgcaggtggtgacagctgaggccgtggccgtgctgaagggggagcaggagaaggaggcccagcacaaggaccagacagctgccctgcccctggccgctgaggagacagccaacctgccccccagccccccacccagccctgccagcgagcagacagtgacagtggaggaggccgccggcggggagagcgccctggcccccagcgtcttcaagcaggccaaggacaaggtgagcaacagcaccctgagcaagatcccagccctgcagggcagcaccaagagcccccgctacagcagcgcctgccccagcaccaccaagagggccaccttcagtgacagcctgctgatccagcccaccagcgctggcagcacagaccggctgccctacagcaagagcggcaacaaggatggagtgaccaagagccctgagaagaggagcagcctgccccggcccagcagcatcctgcccccccggcggggcgtgtctggggacagagatgaaaattccttcagcctgaacagcagcatcagcagcagcgcccggaggaccaccaggtctgagcccatccggcgggccggcaagagcggcaccagcacccccaccaccccaggcagcacagccatcaccccaggcaccccacccagctacagcagcaggaccccaggcaccccaggcacccccagctaccccaggaccccccacaccccaggcacccccaagagcgccatcctggtgcccagcgagaagaaggtggccatcatccgcaccccacccaagagccctgccacccccaagcagctgcggctcatcaaccagcccctgcctgacctgaagaatgtgaagagcaagattggcagcacagacaacatcaagtaccagcccaagggcggccaggtgcgcatcctgaacaagaagattgacttcagcaaggtgcagagccgctgtggcagcaaggacaacatcaagcacagcgctgggggcggcaatgtgcagatcgtgaccaagaagattgacctgagccacgtgaccagcaaatgtggcagcctgaagaacatccgccacaggcctgggggcggccgggtgaagattgaatctgtgaagctggacttcaaggagaaggcccaggccaaggtgggcagcctggacaatgcccaccacgtgcctgggggcggcaatgtgaagattgacagccagaagctgaacttccgggagcacgccaaggcccgggtggaccacggggctgagatcatcacccagagccctggccgcagctctgtggccagcccccggcggctgagcaatgtgagcagcagcggcagcatcaacctgctggagagcccccagctggccaccctggccgaggatgtgacagctgccctggccaagcagggcctgtag

SEQ ID NO: 159758 - DNA, 5484 bp, Artificial Sequence
  Description of Artificial Sequence: Synthetic coding sequence
atggctgatgagaggaaggatgaggccaaggccccccactggaccagcgcccccctgacagaggccagcgcccacagccaccccccagagatcaaggaccagggcggggccggggagggcctggtgcgcagcgccaacggcttcccctaccgggaggatgaggagggcgccttcggggagcacggcagccagggcacctacagcaacaccaaggaaaatggcatcaacggggagctgaccagcgctgaccgggagacagctgaggaggtgtctgcccgcatcgtgcaggtggtgacagctgaggccgtggccgtgctgaagggggagcaggagaaggaggcccagcacaaggaccagacagctgccctgcccctggccgctgaggagacagccaacctgccccccagccccccacccagccctgccagcgagcagacagtgacagtggaggaggacctgctgacagccagcaagatggagttccatgaccagcaggagctgacccccagcacagctgagcccagcgaccagaaggagaaggagagcgagaagcagagcaagccaggagaggacctgaagcatgctgccctggtgtcccagcctgagaccaccaagacctacccagacaagaaggacatgcagggcacagaggaggagaaggcccccctggccctgtttggccacaccctggtggccagcctggaggacatgaagcagaagacagagcccagcctggtggtgcccggcatcgacctgcccaaggagccccccacccccaaggagcagaaggactggttcatcgagatgcccacagaggccaagaaggatgagtggggcctggtggcccccatcagccctggccccctgacccccatgagggagaaggatgtgtttgatgacatccccaagtgggagggcaagcagtttgacagccccatgcccagccccttccagggcggcagcttcaccctgcccctggatgtgatgaagaatgaaattgtgacagagaccagcccctttgccccagccttcctgcagccagatgacaagaagagcctgcagcagaccagcggccctgccacagccaaggacagcttcaagattgaggagccccatgaggccaagccagacaagatggccgaggcccctccttctgaggccatgaccctgcccaaggatgcccacatccctgtggtggaggagcacgtgatgggcaaggtgctggaggaggagaaggaggccatcaaccaggagaccgtgcagcagagggacaccttcaccccatctggccaggagcccatcctgacagagaaggagacagagctgaagctggaggagaagaccaccatcagtgacaaggaggccgtgcccaaggagagcaagccacccaagccagcagatgaggagatcggcatcatccagaccagcacagagcacaccttcagcgagcagaaggaccaggagcccaccacagacatgctgaagcaggacagcttccctgtgtccctggagcaggccgtgacagacagcgccatgaccagcaagaccctggagaaggccatgacagagcccagcgccctgattgagaagagcagcatccaggagctgtttgagatgagggtggatgacaaggacaagattgaaggagtgggcgccgccaccagcgctgagctggacatgcccttctatgaggacaagagcggcatgagcaagtactttgagaccagcgccctgaaggaggaggccaccaagagcattgagcccggcagtgactactatgagctgagtgacacccgggagagcgtgcatgagagcattgacaccatgagccccatgcacaagaatggagacaaggagttccagacaggcaaggagagccagcccagccccccagcccaggaggccggctacagcaccctggcccagagctaccccagcgacctgcctgaggagcccagcagcccccaggagaggatgttcaccatcgaccccaaggtgtatggagagaagagggacctgcacagcaagaacaaggatgacctgaccctgagccgcagcctgggcctgggcggccgcagcgccatcgagcagaggtccatgagcatcaacctgcccatgagctgcctggacagcatcgccctgggcttcaactttggccggggccatgacctgagccccctggccagtgacatcctgaccaacaccagcggctccatggatgaaggagatgactacctgcctgccaccaccccagccctggagaaggccccctgcttccctgtggagagcaaggaggaggagcagatcgagaaggtgaaggccactggagaggagagcacccaggccgagatcagctgtgagagccccttcctggccaaggacttctacaagaatggcaccgtgatggccccagacctgcctgagatgctggacctggccggcaccaggagccggctggcctctgtgtctgcagatgctgaggtggcccggaggaagtctgtgcccagcgagaccgtggtggaggacagcaggacaggcctgccccctgtgacagatgaaaatcatgtgattgtgaagacagacagccagctggaggacctgggctactgtgtgttcaacaagtacacagtgcccctgcccagccctgtgcaggacagcgagaacctgagcggggagagcggcaccttctatgagggcacagatgacaaggtgagaagagacctggccacagacctgagcctgattgaggtgaagctggccgccgccggccgggtgaaggatgagttctctgtggacaaggaggccagcgcccacatcagcggggacaagagcggcctgagcaaggagtttgaccaggagaagaaggccaatgaccggctggacacagtgctggagaagtctgaggagcacgccgacagcaaggagcacgccaagaagacagaggaggccggagatgaaattgagaccttcggcctgggcgtgacctatgagcaggccctggccaaggacctgagcatccccacagatgccagcagcgagaaggccgagaagggcctgagctctgtgcctgagattgctgaggtggagcccagcaagaaggtggagcagggcctggactttgctgtgcagggccagctggatgtgaagatcagtgactttggccagatggccagcggcctgaacattgatgacagaagagccacagagctgaagctggaggccacccaggacatgacccccagcagcaaggccccccaggaggctgatgccttcatgggcgtggagagcggccacatgaaggagggcaccaaggtgtctgaaacagaggtgaaggagaaggtggccaagccagacctggtgcaccaggaggccgtggacaaggaggagagctatgagagcagcggggagcacgagagcctgaccatggagagcctgaaggcagatgagggcaagaaggagaccagccctgagagcagcctcatccaggatgaaattgctgtgaagctgtctgtggagatcccctgccccccagctgtgtctgaggccgacctggccacagatgagcgggcagatgtgcagatggagttcatccagggccccaaggaggagagcaaggagaccccagacatcagcatcacccccagtgatgtggccgagcccctgcacgagaccatcgtgtctgagcctgctgagatccagagcgaggaggaggagattgaggcccagggcgagtatgacaagctgctcttcagaagtgacaccctgcagatcacagacctgggcgtgtctggggcccgggaggagtttgtggagacctgccccagcgagcacaagggcgtgattgaatctgtggtgaccattgaagatgacttcatcaccgtggtgcagaccaccacagatgaaggagagagcggcagccacagcgtgcgctttgctgccctggagcagcctgaggtggagcggcggcccagcccccatgatgaggaggagtttgaggtggaggaggccgctgaggcccaggccgagcccaaggatggcagccctgaggccccagccagccctgagcgggaggaggtggccctgtctgagtacaagacagagacctatgatgactacaaggatgagaccaccattgatgacagcatcatggatgctgacagcctgtgggtggacacccaggatgatgacaggagcatcatgacagagcagctggagaccatccccaaggaggagaaggccgagaaggaggcccggcgcagcagcctggagaagcacaggaaggagaagcccttcaagacaggccggggccgcatcagcaccccagagaggaaggtggccaagaaggagcccagcacagtgtccagagatgaggtgcggaggaagaaggctgtgtacaagaaggccgagctggccaagaagacagaggtgcaggcccacagccccagcaggaagttcatcctgaagccagccatcaagtacacccggcccacccacctgagctgtgtgaagaggaagaccacagctgctggaggagagagcgccctggcccccagcgtcttcaagcaggccaaggacaaggtgtctgatggagtgaccaagagccctgagaagaggagcagcctgccccggcccagcagcatcctgcccccaagaagaggagtgtctggggacagagatgagaacagcttcagcctgaacagcagcatcagcagcagcgcccggaggaccaccaggtctgagcccatcagaagagctgggaagagcggcaccagcacccccaccaccccaggcagcacagccatcaccccaggcaccccacccagctacagcagcaggaccccaggcaccccaggcacccccagctaccccaggaccccccacaccccaggcacccccaagagcgccatcctggtgcccagcgagaagaaggtggccatcatccgcaccccacccaagagccctgccacccccaagcagctgcggctcatcaaccagcccctgcctgacctgaagaatgtgaagagcaagattggcagcacagacaacatcaagtaccagcccaagggcggccaggtgcagatcgtgaccaagaagattgacctgagccacgtgaccagcaaatgtggcagcctgaagaacatccgccacaggcctgggggcggccgggtgaagattgaatctgtgaagctggacttcaaggagaaggcccaggccaaggtgggcagcctggacaatgcccaccacgtgcctgggggcggcaatgtgaagattgacagccagaagctgaacttccgggagcacgccaaggcccgggtggaccacggggctgagatcatcacccagagccctggccgcagctctgtggccagcccccggcggctgagcaatgtgagcagcagcggcagcatcaacctgctggagagcccccagctggccaccctggccgaggatgtgacagctgccctggccaagcagggcctgtag

SEQ ID NO: 159759 - DNA, 1416 bp, Artificial Sequence
  Description of Artificial Sequence: Synthetic coding sequence
atggctgatgagaggaaggatgaggccaaggccccccactggaccagcgcccccctgacagaggccagcgcccacagccaccccccagagatcaaggaccagggcggggccggggagggcctggtgcgcagcgccaacggcttcccctaccgggaggatgaggagggcgccttcggggagcacggcagccagggcacctacagcaacaccaaggaaaatggcatcaacggggagctgaccagcgctgaccgggagacagctgaggaggtgtctgcccgcatcgtgcaggtggtgacagctgaggccgtggccgtgctgaagggggagcaggagaaggaggcccagcacaaggaccagacagctgccctgcccctggccgctgaggagacagccaacctgccccccagccccccacccagccctgccagcgagcagacagtgacagtggaggaggccgccggcggggagagcgccctggcccccagcgtcttcaagcaggccaaggacaaggtgtctgatggagtgaccaagagccctgagaagaggagcagcctgccccggcccagcagcatcctgcccccaagaagaggagtgtctggggacagagatgagaacagcttcagcctgaacagcagcatcagcagcagcgcccggaggaccaccaggtctgagcccatcagaagagctgggaagagcggcaccagcacccccaccaccccaggcagcacagccatcaccccaggcaccccacccagctacagcagcaggaccccaggcaccccaggcacccccagctaccccaggaccccccacaccccaggcacccccaagagcgccatcctggtgcccagcgagaagaaggtggccatcatccgcaccccacccaagagccctgccacccccaagcagctgcggctcatcaaccagcccctgcctgacctgaagaatgtgaagagcaagattggcagcacagacaacatcaagtaccagcccaagggcggccaggtgcagatcgtgaccaagaagattgacctgagccacgtgaccagcaaatgtggcagcctgaagaacatccgccacaggcctgggggcggccgggtgaagattgaatctgtgaagctggacttcaaggagaaggcccaggccaaggtgggcagcctggacaatgcccaccacgtgcctgggggcggcaatgtgaagattgacagccagaagctgaacttccgggagcacgccaaggcccgggtggaccacggggctgagatcatcacccagagccctggccgcagctctgtggccagcccccggcggctgagcaatgtgagcagcagcggcagcatcaacctgctggagagcccccagctggccaccctggccgaggatgtgacagctgccctggccaagcagggcctgtag

SEQ ID NO: 159760 - DNA, 321 bp, Artificial Sequence
  Description of Artificial Sequence: Synthetic coding sequence
atggctgatgagaggaaggatgaggccaaggccccccactggaccagcgcccccctgacagaggccagcgcccacagccaccccccagagatcaaggaccagggcggggccggggagggcctggtgcgcagcgccaacggcttcccctaccgggaggatgaggagggcgccttcggggagcacggcagccagggcacctacagcaacaccaaggaaaatggcatcaacggggagctgaccagcgctgaccgggagacagctgaggaggtgtctgcccgcatcgtgcaggtggtgacagctgaggccgtggccgtgctgtag

SEQ ID NO: 159761 - DNA, 1416 bp, Artificial Sequence; identical to SEQ ID NO: 159759
  Description of Artificial Sequence: Synthetic coding sequence

SEQ ID NO: 159762 - DNA, 5472 bp, Artificial Sequence
  Description of Artificial Sequence: Synthetic coding sequence
atggctgatgagaggaaggatgaggccaaggccccccactggaccagcgcccccctgacagaggccagcgcccacagccaccccccagagatcaaggaccagggcggggccggggagggcctggtgcgcagcgccaacggcttcccctaccgggaggatgaggagggcgccttcggggagcacggcagccagggcacctacagcaacaccaaggaaaatggcatcaacggggagctgaccagcgctgaccgggagacagctgaggaggtgtctgcccgcatcgtgcaggtggtgacagctgaggccgtggccgtgctgaagggggagcaggagaaggaggcccagcacaaggaccagacagctgccctgcccctggccgctgaggagacagccaacctgccccccagccccccacccagccctgccagcgagcagacagtgacagtggaggaggccagcaagatggagttccatgaccagcaggagctgacccccagcacagctgagcccagcgaccagaaggagaaggagagcgagaagcagagcaagccaggagaggacctgaagcatgctgccctggtgtcccagcctgagaccaccaagacctacccagacaagaaggacatgcagggcacagaggaggagaaggcccccctggccctgtttggccacaccctggtggccagcctggaggacatgaagcagaagacagagcccagcctggtggtgcccggcatcgacctgcccaaggagccccccacccccaaggagcagaaggactggttcatcgagatgcccacagaggccaagaaggatgagtggggcctggtggcccccatcagccctggccccctgacccccatgagggagaaggatgtgtttgatgacatccccaagtgggagggcaagcagtttgacagccccatgcccagccccttccagggcggcagcttcaccctgcccctggatgtgatgaagaatgaaattgtgacagagaccagcccctttgccccagccttcctgcagccagatgacaagaagagcctgcagcagaccagcggccctgccacagccaaggacagcttcaagattgaggagccccatgaggccaagccagacaagatggccgaggcccctccttctgaggccatgaccctgcccaaggatgcccacatccctgtggtggaggagcacgtgatgggcaaggtgctggaggaggagaaggaggccatcaaccaggagaccgtgcagcagagggacaccttcaccccatctggccaggagcccatcctgacagagaaggagacagagctgaagctggaggagaagaccaccatcagtgacaaggaggccgtgcccaaggagagcaagccacccaagccagcagatgaggagatcggcatcatccagaccagcacagagcacaccttcagcgagcagaaggaccaggagcccaccacagacatgctgaagcaggacagcttccctgtgtccctggagcaggccgtgacagacagcgccatgaccagcaagaccctggagaaggccatgacagagcccagcgccctgattgagaagagcagcatccaggagctgtttgagatgagggtggatgacaaggacaagattgaaggagtgggcgccgccaccagcgctgagctggacatgcccttctatgaggacaagagcggcatgagcaagtactttgagaccagcgccctgaaggaggaggccaccaagagcattgagcccggcagtgactactatgagctgagtgacacccgggagagcgtgcatgagagcattgacaccatgagccccatgcacaagaatggagacaaggagttccagacaggcaaggagagccagcccagccccccagcccaggaggccggctacagcaccctggcccagagctaccccagcgacctgcctgaggagcccagcagcccccaggagaggatgttcaccatcgaccccaaggtgtatggagagaagagggacctgcacagcaagaacaaggatgacctgaccctgagccgcagcctgggcctgggcggccgcagcgccatcgagcagaggtccatgagcatcaacctgcccatgagctgcctggacagcatcgccctgggcttcaactttggccggggccatgacctgagccccctggccagtgacatcctgaccaacaccagcggctccatggatgaaggagatgactacctgcctgccaccaccccagccctggagaaggccccctgcttccctgtggagagcaaggaggaggagcagatcgagaaggtgaaggccactggagaggagagcacccaggccgagatcagctgtgagagccccttcctggccaaggacttctacaagaatggcaccgtgatggccccagacctgcctgagatgctggacctggccggcaccaggagccggctggcctctgtgtctgcagatgctgaggtggcccggaggaagtctgtgcccagcgagaccgtggtggaggacagcaggacaggcctgccccctgtgacagatgaaaatcatgtgattgtgaagacagacagccagctggaggacctgggctactgtgtgttcaacaagtacacagtgcccctgcccagccctgtgcaggacagcgagaacctgagcggggagagcggcaccttctatgagggcacagatgacaaggtgagaagagacctggccacagacctgagcctgattgaggtgaagctggccgccgccggccgggtgaaggatgagttctctgtggacaaggaggccagcgcccacatcagcggggacaagagcggcctgagcaaggagtttgaccaggagaagaaggccaatgaccggctggacacagtgctggagaagtctgaggagcacgccgacagcaaggagcacgccaagaagacagaggaggccggagatgaaattgagaccttcggcctgggcgtgacctatgagcaggccctggccaaggacctgagcatccccacagatgccagcagcgagaaggccgagaagggcctgagctctgtgcctgagattgctgaggtggagcccagcaagaaggtggagcagggcctggactttgctgtgcagggccagctggatgtgaagatcagtgactttggccagatggccagcggcctgaacattgatgacagaagagccacagagctgaagctggaggccacccaggacatgacccccagcagcaaggccccccaggaggctgatgccttcatgggcgtggagagcggccacatgaaggagggcaccaaggtgtctgaaacagaggtgaaggagaaggtggccaagccagacctggtgcaccaggaggccgtggacaaggaggagagctatgagagcagcggggagcacgagagcctgaccatggagagcctgaaggcagatgagggcaagaaggagaccagccctgagagcagcctcatccaggatgaaattgctgtgaagctgtctgtggagatcccctgccccccagctgtgtctgaggccgacctggccacagatgagcgggcagatgtgcagatggagttcatccagggccccaaggaggagagcaaggagaccccagacatcagcatcacccccagtgatgtggccgagcccctgcacgagaccatcgtgtctgagcctgctgagatccagagcgaggaggaggagattgaggcccagggcgagtatgacaagctgctcttcagaagtgacaccctgcagatcacagacctgggcgtgtctggggcccgggaggagtttgtggagacctgccccagcgagcacaagggcgtgattgaatctgtggtgaccattgaagatgacttcatcaccgtggtgcagaccaccacagatgaaggagagagcggcagccacagcgtgcgctttgctgccctggagcagcctgaggtggagcggcggcccagcccccatgatgaggaggagtttgaggtggaggaggccgctgaggcccaggccgagcccaaggatggcagccctgaggccccagccagccctgagcgggaggaggtggccctgtctgagtacaagacagagacctatgatgactacaaggatgagaccaccattgatgacagcatcatggatgctgacagcctgtgggtggacacccaggatgatgacaggagcatcatgacagagcagctggagaccatccccaaggaggagaaggccgagaaggaggcccggcgcagcagcctggagaagcacaggaaggagaagcccttcaagacaggccggggccgcatcagcaccccagagaggaaggtggccaagaaggagcccagcacagtgtccagagatgaggtgcggaggaagaaggctgtgtacaagaaggccgagctggccaagaagacagaggtgcaggcccacagccccagcaggaagttcatcctgaagccagccatcaagtacacccggcccacccacctgagctgtgtgaagaggaagaccacagctgctggaggagagagcgccctggcccccagcgtcttcaagcaggccaaggacaaggtgtctgatggagtgaccaagagccctgagaagaggagcagcctgccccggcccagcagcatcctgcccccaagaagaggagtgtctggggacagagatgagaacagcttcagcctgaacagcagcatcagcagcagcgcccggaggaccaccaggtctgagcccatcagaagagctgggaagagcggcaccagcacccccaccaccccaggcagcacagccatcaccccaggcaccccacccagctacagcagcaggaccccaggcaccccaggcacccccagctaccccaggaccccccacaccccaggcacccccaagagcgccatcctggtgcccagcgagaagaaggtggccatcatccgcaccccacccaagagccctgccacccccaagcagctgcggctcatcaaccagcccctgcctgacctgaagaatgtgaagagcaagattggcagcacagacaacatcaagtaccagcccaagggcggccaggtgcagatcgtgaccaagaagattgacctgagccacgtgaccagcaaatgtggcagcctgaagaacatccgccacaggcctgggggcggccgggtgaagattgaatctgtgaagctggacttcaaggagaaggcccaggccaaggtgggcagcctggacaatgcccaccacgtgcctgggggcggcaatgtgaagattgacagccagaagctgaacttccgggagcacgccaaggcccgggtggaccacggggctgagatcatcacccagagccctggccgcagctctgtggccagcccccggcggctgagcaatgtgagcagcagcggcagcatcaacctgctggagagcccccagctggccaccctggccgaggatgtgacagctgccctggccaagcagggcctgtag

SEQ ID NO: 159763 - DNA, 2664 bp, Artificial Sequence
  Description of Artificial Sequence: Synthetic coding sequence
atggagaccaccggggaccagggcatcgagggcatggcctacatggatgaaaatagaaacatcaccttcacctgccccaggacccccagcgagctgatcaacaagagcagccccctggaggtgctggagagcgctgcctgtgagaagctgcccacccccaccccccaggtggtgaaggagggggacagcttcccagacaccctggccaagaatggccaggagatcgccccagcccagatcagcaagagcctgatggtggacaactacaccaaggatggagtgcccggccaggagcggcccaagggccccagcgctgtggtgcccagcaccagcactggaggagtggccctgcccatcaccacagccattgaaacagtgaacatccatggagaccacagcctgaagaacaaggccgagctggccgacagcatgaagaatgaggccggcattgatgagggccacgtgattggagagagcgagagcgtgcacagcggggccagcaagcacagcgtggagaaggtgacagagctggccaagggccacctgctgcccggggtgcctgtggaggaccagagcctgcccggggaggcccgggccctggagggctacgccgaccggggcaacttccctgcccaccctgtgaatgaggagaaggagaccaaggagggctctgtggccgtgcagatcccagacctgctggaggacaaggcccagaagctgtccttctgtgaggaccagaatgcccaggacaggaacagcaagggcagtgacagcctgaacaagaaggtggacctgaccctgctgagccccaagtcagaaaatgacaagctgaaggagatcagcctggcctgcaagatcacagagctggagagcgtgtccctgcccaccccagagatccagagcgacttcctgcacagcaaggtggaggcccctccttctgaggtggccgacaccctggtgatcatgacagccagcaagggcgtgcggctgcctgagcccaaggacaagatcctggagaccccccagaagatgacagagaagtctgagagcaagaccccaggagagggcaagaaggaggacaagagcaggatggccgagcccatgaagggctacatgaggcccaccaagagccggggcctgacccccctgctgcccaagagcaccatccaggagcaggagcggcacaagcagctgaagtctgctggcatcgcccggcctgaggagggccggcctgtggtgtctggaactggaaatgacatcaccaccccacccaacaaggagctgccccccagccctgagaagaagaccaagcccctggccaccacccagcctgccaagaccagcaccagcaaggccaagacccagcccaccagcctgcccaagcagcctgcccccaccaccatcggcggcctgaacaagaagcccatgagcctggccagcggcctggtgcctgctgccccacccaagaggcctgctgtggccagcgcccggcccagcatcctgcccagcaaggatgtgaagcccaagcccatcgcagatgccaaggcccctgagaagagggccagccccagcaagccagccagcgccccagccagccgcagcggcagcaagagcacccagacagtggccaagaccaccacagctgctgctgtggccagcacaggccccagcagccgcagccccagcaccctgctgcccaagaagcccacagccatcaagacagagggcaagccagctgaggtgaagaagatgacagccaagtctgtgcctgctgacctgagccggcccaagagcaccagcaccagctccatgaagaagaccaccaccctgtctggaacagccccagctgctggggtggtgcccagccgggtgaaggccacccccatgcccagccggcccagcaccacccccttcatcgacaagaagcccaccagcgccaagcccagcagcaccaccccccggctgagccggctggccaccaacaccagcgccccagacctgaagaatgtgcgcagcaaggtgggcagcacagagaacatcaagcaccagcccggcggcggccgggccaaggtggagaagaagacagaagctgctgccaccaccaggaagccagagagcaatgctgtgaccaagacagctggccccatcgccagcgcccagaagcagcctgctgggaaggtgcagatcgtgtccaagaaggtgtcctacagccacatccagagcaaatgtggcagcaaggacaacatcaagcacgtgcctgggggcggcaatgtgcagatccagaacaagaaggtggacatcagcaaggtgagcagcaaatgtggcagcaaggccaacatcaagcacaagccaggcggcggagatgtgaagattgagagccagaagctgaacttcaaggagaaggcccaggccaaggtgggcagcctggacaacgtgggccacctgcctgctggaggagctgtgaagacagaaggaggcggcagcgaggcccccctgtgccccggccccccagctggggaggagcccgccatcagcgaggccgcccctgaggccggggcccccaccagcgccagcggcctgaatggccaccccaccctgagcggcggcggggaccagcgggaggcccagaccctggacagccagatccaggagaccagcatctag

SEQ ID NO: 159764 - DNA, 1392 bp, Artificial Sequence
  Description of Artificial Sequence: Synthetic coding sequence
atctgtgaggagcctgtggccaagaagcgggaggagctggcccacttcagcaacagcagcagcaacagcggcaagaaggagctgggcacagctggcctgtacctgcacagcaagctggagcagatccctgagggcagcagcaaggagaagggccaggaggacttcagcgagaccagaattgacagctgcagccaggtgtgccagagaggagagaagcagcccggccagacagccctggccggcaagaaggagattgaggtgacagccacccagagcacccccagcttcctgtttgagaagcccccaagagatggcatcgcccggcctgaggagggccggcctgtggtgtctggaactggaaatgacatcaccaccccacccaacaaggagctgccccccagccctgagaagaagaccaagcccatcgcagatgccaaggcccctgagaagagggccagccccagcaagccagccagcgccccagccagccgcagcggcagcaagagcacccagacagtggccaagaccaccacagctgctgctgtggccagcacaggccccagcagccgcagccccagcaccctgctgcccaagaagcccacagccatcaagacagagggcaagccagctgaggtgaagaagatgacagccaagtctgtgcctgctgacctgagccggcccaagagcaccagcaccagctccatgaagaagaccaccaccctgagcggcacagccccagctgctggggtggtgcccagccgggtgaaggccacccccatgcccagccggcccagcaccacccccttcatcgacaagaagcccaccagcgccaagcccagcagcaccaccccccggctgagccggctggccaccaacaccagcgccccagacctgaagaatgtgcgcagcaaggtgggcagcacagagaacatcaagcaccagcccggcggcggccgggtgcagatcgtgtccaagaaggtgtcctacagccacatccagagcaaatgtggcagcaaggacaacatcaagcacgtgcctgggggcggcaatgtgcagatccagaacaagaaggtggacatcagcaaggtgagcagcaaatgtggcagcaaggccaacatcaagcacaagccaggcggcggagatgtgaagattgagagccagaagctgaacttcaaggagaaggcccaggccaaggtgggcagcctggacaacgtgggccacctgcctgctgggggcgctgtgaagattgagacctaccgcctgaccttccgggccaatgcccgggccaggacagaccatggagctgacatcgtgtccaggcctccccacttccctgggggccccaacagcggcagccgggtgctgggccccctgagcagagctgtgcactag

SEQ ID NO: 159765 - DNA, 3459 bp, Artificial Sequence
  Description of Artificial Sequence: Synthetic coding sequence
atggctgacctgagcctggctgatgccctgacagagcccagcccagacattgaaggagagatcaagagggacttcatcgccaccctggaggccgaggcctttgatgatgtggtgggggagaccgtgggcaagacagactacatccccctgctggatgtggatgagaagacaggcaacagcgagagcaagaagaagccctgcagcgagaccagccagatcgaggacacccccagcagcaagcccaccctgctggccaacggcggccatggagtggagggcagtgacaccaccggcagccccacagagttcctggaggagaagatggcctaccaggagtaccccaacagccagaactggccagaggacaccaacttctgcttccagcctgagcaggtggtggaccccatccagacagaccccttcaagatgtaccatgatgatgacctggccgacctggtgttccccagcagcgccacagctgacaccagcatctttgctggccagaatgaccccctgaaggacagctatggcatgagcccctgcaacacagctgtggtgccccagggctggagcgtggaggccctgaacagcccccacagcgagagctttgtgtccccagaggccgtggccgagcccccccagcccacagctgtgcccctggagctggccaaggagattgagatggccagcgaggagcggcccccagcccaggccctggagatcatgatgggcctgaagaccacagacatggcccccagcaaggagacagagatggccctggccaaggacatggccctggccaccaagacagaggtggccctggccaaggacatggagagccccaccaagctggatgtgaccctggccaaggacatgcagcccagcatggagagtgacatggccctggtgaaggacatggagctgcccacagagaaggaggtggccctggtgaaggatgtgcgctggcccacagaaacagatgtgagcagcgccaagaatgtggtgctgcccacagaaacagaggtggccccagccaaggatgtgaccctgctgaaggagacagagcgggccagccccatcaagatggacctggcccccagcaaggacatgggcccccccaaggagaacaagaaggagacagagcgggccagccccatcaagatggacctggcccccagcaaggacatgggcccccccaaggagaacaagatcgtgcctgccaaggacctggtgctgctgtctgaaattgaggtggcccaggccaatgacatcatcagcagcacagagatcagcagcgctgagaaggtggccctgagcagcgagacagaggtggccctggcccgggacatgaccctgcccccagagaccaacgtcatcctgaccaaggacaaggccctgcccctggaggccgaggtggcccctgtgaaggacatggcccagctgcctgagacagagatcgccccagccaaggatgtggcccccagcacagtgaaggaggtgggcctgctgaaggacatgagccccctgtctgaaacagagatggccctgggcaaggatgtgaccccacctcctgagacagaggtggtgctgatcaagaatgtgtgcctgcccccagagatggaggtggccctgacagaggaccaggtgcctgccctgaagacagaggcccccctggccaaggatggagtgctgaccctggccaacaacgtgaccccagccaaggatgtgccccccctgtctgaaacagaggccacccctgtgcccatcaaggacatggagatcgcccagacccagaagggcatcagcgaggacagccacctggagagcctgcaggatgtgggccagagcgctgcccccaccttcatgatcagccctgagaccgtgactggaacaggcaagaagtgcagcctgcctgcagaagaagattctgtgctggagaagctgggggagaggaagccctgcaacagccagcccagcgagctgagcagcgagaccagcggcatcgcccggcctgaggagggccggcctgtggtgtctggaactggaaatgacatcaccaccccacccaacaaggagctgccccccagccctgagaagaagaccaagcccctggccaccacccagcctgccaagaccagcaccagcaaggccaagacccagcccaccagcctgcccaagcagcctgcccccaccaccatcggcggcctgaacaagaagcccatgagcctggccagcggcctggtgcctgctgccccacccaagaggcctgctgtggccagcgcccggcccagcatcctgcccagcaaggatgtgaagcccaagcccatcgcagatgccaaggcccctgagaagagggccagccccagcaagccagccagcgccccagccagccgcagcggcagcaagagcacccagacagtggccaagaccaccacagctgctgctgtggccagcacaggccccagcagccgcagccccagcaccctgctgcccaagaagcccacagccatcaagacagagggcaagccagctgaggtgaagaagatgacagccaagtctgtgcctgctgacctgagccggcccaagagcaccagcaccagctccatgaagaagaccaccaccctgagcggcacagccccagctgctggggtggtgcccagccgggtgaaggccacccccatgcccagccggcccagcaccacccccttcatcgacaagaagcccaccagcgccaagcccagcagcaccaccccccggctgagccggctggccaccaacaccagcgccccagacctgaagaatgtgcgcagcaaggtgggcagcacagagaacatcaagcaccagcccggcggcggccgggccaaggtggagaagaagacagaggccgccgccaccaccaggaagccagagagcaatgctgtgaccaagacagctggccccatcgccagcgcccagaagcagcctgctgggaaggtgcagatcgtgtccaagaaggtgtcctacagccacatccagagcaaatgtggcagcaaggacaacatcaagcacgtgcctgggggcggcaatgtgcagatccagaacaagaaggtggacatcagcaaggtgagcagcaaatgtggcagcaaggccaacatcaagcacaagccaggcggcggagatgtgaagattgagagccagaagctgaacttcaaggagaaggcccaggccaaggtgggcagcctggacaacgtgggccacctgcctgctgggggcgctgtgaagacagagggcggcggcagcgaggcccccctgtgccccggccccccagctggggaggagcccgccatcagcgaggccgcccctgaggccggggcccccaccagcgccagcggcctgaatggccaccccaccctgagcggcggcggggaccagcgggaggcccagaccctggacagccagatccaggagaccagcatctag

SEQ ID NO: 159766 - DNA, 2139 bp, Artificial Sequence
  Description of Artificial Sequence: Synthetic coding sequence
atggagaccaccggggaccagggcatcgagggcatggcctacatggatgaaaatagaaacatcaccttcacctgccccaggacccccagcgagctgatcaacaagagcagccccctggaggtgctggagagcgctgcctgtgagaagctgcccacccccaccccccaggtggtgaaggagggggacagcttcccagacaccctggccaagaatggccaggagatcgccccagcccagatcagcaagagcctgatggtggacaactacaccaaggatggagtgcccggccaggagcggcccaagggccccagcgctgtggtgcccagcaccagcactggaggagtggccctgcccatcaccacagccattgaaacagtgaacatccatggagaccacagcctgaagaacaaggccgagctggccgacagcatgaagaatgaggccggcattgatgagggccacgtgattggagagagcgagagcgtgcacagcggggccagcaagcacagcgtggagaaggtgacagagctggccaagggccacctgctgcccggggtgcctgtggaggaccagagcctgcccggggaggcccgggccctggagggctacgccgaccggggcaacttccctgcccaccctgtgaatgaggagaaggagaccaaggagggctctgtggccgtgcagatcccagacctgctggaggacaaggcccagaagctgtccttctgtgaggaccagaatgcccaggacaggaacagcaagggcagtgacagcctgaacaagaaggtggacctgaccctgctgagccccaagtcagaaaatgacaagctgaaggagatcagcctggcctgcaagatcacagagctggagagcgtgtccctgcccaccccagagatccagagcgacttcctgcacagcaaggtggaggcccctccttctgaggtggccgacaccctggtgatcatgacagccagcaagggcgtgcggctgcctgagcccaaggacaagatcctggagaccccccagaagatgacagagaagtctgagagcaagaccccaggagagggcaagaaggaggacaagagcaggatggccgagcccatgaagggctacatgaggcccaccaagagccggggcctgacccccctgctgcccaagagcaccatccaggagcaggagcggcacaagcagctgaagtctgctggcatcgcccggcctgaggagggccggcctgtggtgtctggaactggaaatgacatcaccaccccacccaacaaggagctgccccccagccctgagaagaagaccaagcccctggccaccacccagcctgccaagaccagcaccagcaaggccaagacccagcccaccagcctgcccaagcagcctgcccccaccaccatcggcggcctgaacaagaagcccatgagcctggccagcggcctggtgcctgctgccccacccaagaggcctgctgtggccagcgcccggcccagcatcctgcccagcaaggatgtgaagcccaagcccatcgcagatgccaaggcccctgagaagagggccagccccagcaagccagccagcgccccagccagccgcagcggcagcaagagcacccagacagtggccaagaccaccacagctgctgctgtggccagcacaggccccagcagccgcagccccagcaccctgctgcccaagaagcccacagccatcaagacagagggcaagccagctgaggtgaagaagatgacagccaagtctgtgcctgctgacctgagccggcccaagagcaccagcaccagctccatgaagaagaccaccaccctgtctggaacagccccagctgctggggtggtgcccagccgggtgaaggccacccccatgcccagccggcccagcaccacccccttcatcgacaagaagcccaccagcgccaagcccagcagcaccaccccccggctgagccggctggccaccaacaccagcgccccagacctgaagaatgtgcgcagcaaggccaaggtggagaagaagacagaggccgccgccaccaccaggaagccagagagcaatgctgtgaccaagacagctggccccatcgccagcgcccagaagcagcctgctgggaaggtgtag

SEQ ID NO: 159767 - DNA, 2436 bp, Artificial Sequence
  Description of Artificial Sequence: Synthetic coding sequence
atggctgacctgagcctggctgatgccctgacagagcccagcccagacattgaaggagagatcaagagggacttcatcgccaccctggaggccgaggcctttgatgatgtggtgggggagaccgtgggcaagacagactacatccccctgctggatgtggatgagaagacaggcaacagcgagagcaagaagaagccctgcagcgagaccagccagatcgaggacacccccagcagcaagcccaccctgctggccaacggcggccatggagtggagggcagtgacaccaccggcagccccacagagttcctggaggagaagatggcctaccaggagtaccccaacagccagaactggccagaggacaccaacttctgcttccagcctgagcaggtggtggaccccatccagacagaccccttcaagatgtaccatgatgatgacctggccgacctggtgttccccagcagcgccacagctgacaccagcatctttgctggccagaatgaccccctgaaggacagctatggcatgagcccctgcaacacagctgtggtgccccagggctggagcgtggaggccctgaacagcccccacagcgagagctttgtgtccccagaggccgtggccgagcccccccagcccacagctgtgcccctggagctggccaaggagattgagatggccagcgaggagcggcccccagcccaggccctggagatcatgatgggcctgaagaccacagacatggcccccagcaaggagacagagatggccctggccaaggacatggccctggccaccaagacagaggtggccctggccaaggacatggagagccccaccaagctggatgtgaccctggccaaggacatgcagcccagcatggagagtgacatggccctggtgaaggacatggagctgcccacagagaaggaggtggccctggtgaaggatggagtgcggctgcctgagcccaaggacaagatcctggagaccccccagaagatgacagagaagtctgagagcaagaccccaggagagggcaagaaggaggacaagagcaggatggccgagcccatgaagggctacatgaggcccaccaagagccggggcctgacccccctgctgcccaagagcaccatccaggagcaggagcggcacaagcagctgaagtctgctggcatcgcccggcctgaggagggccggcctgtggtgtctggaactggaaatgacatcaccaccccacccaacaaggagctgccccccagccctgagaagaagaccaagcccctggccaccacccagcctgccaagaccagcaccagcaaggccaagacccagcccaccagcctgcccaagcagcctgcccccaccaccatcggcggcctgaacaagaagcccatgagcctggccagcggcctggtgcctgctgccccacccaagaggcctgctgtggccagcgcccggcccagcatcctgcccagcaaggatgtgaagcccaagcccatcgcagatgccaaggcccctgagaagagggccagccccagcaagccagccagcgccccagccagccgcagcggcagcaagagcacccagacagtggccaagaccaccacagctgctgctgtggccagcacaggccccagcagccgcagccccagcaccctgctgcccaagaagcccacagccatcaagacagagggcaagccagctgaggtgaagaagatgacagccaagtctgtgcctgctgacctgagccggcccaagagcaccagcaccagctccatgaagaagaccaccaccctgagcggcacagccccagctgctggggtggtgcccagccgggtgaaggccacccccatgcccagccggcccagcaccacccccttcatcgacaagaagcccaccagcgccaagcccagcagcaccaccccccggctgagccggctggccaccaacaccagcgccccagacctgaagaatgtgcgcagcaaggtgggcagcacagagaacatcaagcaccagcccggcggcggccgggtgcagatccagaacaagaaggtggacatcagcaaggtgagcagcaaatgtggcagcaaggccaacatcaagcacaagccaggcggcggagatgtgaagattgagagccagaagctgaacttcaaggagaaggcccaggccaaggtgggcagcctggacaacgtgggccacctgcctgctggaggagctgtgaagacagaaggaggcggcagcgaggcccccctgtgccccggccccccagctggggaggagcccgccatcagcgaggccgcccctgaggccggggcccccaccagcgccagcggcctgaatggccaccccaccctgagcggcggcggggaccagcgggaggcccagaccctggacagccagatccaggagaccagcatctag

SEQ ID NO: 159768 - DNA, 3408 bp, Artificial Sequence
  Description of Artificial Sequence: Synthetic coding sequence
atggctgacctgagcctggctgatgccctgacagagcccagcccagacattgaaggagagatcaagagggacttcatcgccaccctggaggccgaggcctttgatgatgtggtgggggagaccgtgggcaagacagactacatccccctgctggatgtggatgagaagacaggcaacagcgagagcaagaagaagccctgcagcgagaccagccagatcgaggacacccccagcagcaagcccaccctgctggccaacggcggccatggagtggagggcagtgacaccaccggcagccccacagagttcctggaggagaagatggcctaccaggagtaccccaacagccagaactggccagaggacaccaacttctgcttccagcctgagcaggtggtggaccccatccagacagaccccttcaagatgtaccatgatgatgacctggccgacctggtgttccccagcagcgccacagctgacaccagcatctttgctggccagaatgaccccctgaaggacagctatggcatgagcccctgcaacacagctgtggtgccccagggctggagcgtggaggccctgaacagcccccacagcgagagctttgtgtccccagaggccgtggccgagcccccccagcccacagctgtgcccctggagctggccaaggagattgagatggccagcgaggagcggcccccagcccaggccctggagatcatgatgggcctgaagaccacagacatggcccccagcaaggagacagagatggccctggccaaggacatggccctggccaccaagacagaggtggccctggccaaggacatggagagccccaccaagctggatgtgaccctggccaaggacatgcagcccagcatggagagtgacatggccctggtgaaggacatggagctgcccacagagaaggaggtggccctggtgaaggatgtgcgctggcccacagaaacagatgtgagcagcgccaagaatgtggtgctgcccacagaaacagaggtggccccagccaaggatgtgaccctgctgaaggagacagagcgggccagccccatcaagatggacctggcccccagcaaggacatgggcccccccaaggagaacaagaaggagacagagcgggccagccccatcaagatggacctggcccccagcaaggacatgggcccccccaaggagaacaagatcgtgcctgccaaggacctggtgctgctgtctgaaattgaggtggcccaggccaatgacatcatcagcagcacagagatcagcagcgctgagaaggtggccctgagcagcgagacagaggtggccctggcccgggacatgaccctgcccccagagaccaacgtcatcctgaccaaggacaaggccctgcccctggaggccgaggtggcccctgtgaaggacatggcccagctgcctgagacagagatcgccccagccaaggatgtggcccccagcacagtgaaggaggtgggcctgctgaaggacatgagccccctgtctgaaacagagatggccctgggcaaggatgtgaccccacctcctgagacagaggtggtgctgatcaagaatgtgtgcctgcccccagagatggaggtggccctgacagaggaccaggtgcctgccctgaagacagaggcccccctggccaaggatggagtgctgaccctggccaacaacgtgaccccagccaaggatgtgccccccctgtctgaaacagaggccacccctgtgcccatcaaggacatggagatcgcccagacccagaagggcatcagcgaggacagccacctggagagcctgcaggatgtgggccagagcgctgcccccaccttcatgatcagccctgagaccgtgactggaacaggcaagaagtgcagcctgcctgcagaagaagattctgtgctggagaagctgggggagaggaagccctgcaacagccagcccagcgagctgagcagcgagaccagcggcatcgcccggcctgaggagggccggcctgtggtgtctggaactggaaatgacatcaccaccccacccaacaaggagctgccccccagccctgagaagaagaccaagcccctggccaccacccagcctgccaagaccagcaccagcaaggccaagacccagcccaccagcctgcccaagcagcctgcccccaccaccatcggcggcctgaacaagaagcccatgagcctggccagcggcctggtgcctgctgccccacccaagaggcctgctgtggccagcgcccggcccagcatcctgcccagcaaggatgtgaagcccaagcccatcgcagatgccaaggcccctgagaagagggccagccccagcaagccagccagcgccccagccagccgcagcggcagcaagagcacccagacagtggccaagaccaccacagctgctgctgtggccagcacaggccccagcagccgcagccccagcaccctgctgcccaagaagcccacagccatcaagacagagggcaagccagctgaggtgaagaagatgacagccaagtctgtgcctgctgacctgagccggcccaagagcaccagcaccagctccatgaagaagaccaccaccctgagcggcacagccccagctgctggggtggtgcccagccgggtgaaggccacccccatgcccagccggcccagcaccacccccttcatcgacaagaagcccaccagcgccaagcccagcagcaccaccccccggctgagccggctggccaccaacaccagcgccccagacctgaagaatgtgcgcagcaaggtgggcagcacagagaacatcaagcaccagcccggcggcggccgggccaaggtggagaagaagacagaggccgccgccaccaccaggaagccagagagcaatgctgtgaccaagacagctggccccatcgccagcgcccagaagcagcctgctgggaaggtgcagatcgtgtccaagaaggtgtcctacagccacatccagagcaaatgtggcagcaaggacaacatcaagcacgtgcctgggggcggcaatgtgcagatccagaacaagaaggtggacatcagcaaggtgagcagcaaatgtggcagcaaggccaacatcaagcacaagccaggcggcggagatgtgaagattgagagccagaagctgaacttcaaggagaaggcccaggccaaggtgggcagcctggacaacgtgggccacctgcctgctgggggcgctgtgaagattgagacctaccgcctgaccttccgggccaatgcccgggccaggacagaccatggagctgacatcgtgtccaggcctccccacttccctgggggccccaacagcggcagccgggtgctgggccccctgagcagagctgtgcactag

SEQ ID NO: 159769 - DNA, 2487 bp, Artificial Sequence
  Description of Artificial Sequence: Synthetic coding sequence
atgagcctgagtgacaagcagacagccagcctgacagctgcctacggccagctgagcaagggcaagccagcagaatgtaggatggacagccccaaggagatcagccaggccggctttgagtggcagaggacagagggcaagctgaatgaaattggcctgaatgtgtccatggatggccagcccaaggatggcctggtgaagaatgccagcttcctggagcagaacaagctgtgcttctttgagggcaagctggacaaggagctgagcattgagatgcaggacaaggactgccaggaggccagcggccacctggagagccgctacgtgatcagcgagacctgccaccccctggagggcaacagcgtgcaccagaagaccagcgagttccacctgggcctcatcgagggccctgacaagaacaagaccatccctgtgcagggcaaggtggccggcaagaatggcctggagaccaagagccagagcgacctggacttccctggagctgctgacatccccaccaggtatgtgaaggagcaggagacctctgtgtggaaccccagcttccaccctgtggcccagggcagcctgggcagccgggaggccaccccaggagagatggagaacagcatcaccccaggctgccctgtgattggagtggtgaatgacaacagcgagcagctgaagtgtgagagccccctgctggtgtccctggcccacccagcccccatcatcgagcacagccccaccaccatcccccccatcaccatggtgttcacccaggagcacctgaatgccagctgccacatccgggaccatgacaaggagctggagaagctgagcagcacagaggaggccgtgctgaaccaggccccccagcagaagaaggctgtgcggcgggccctgtctgaatgtagccacctgtctgtgcccccagctgtgaacctggccgacaagtacccagagctgcctgcccgggaggagcccagcagcggcctgctgcccccacccagcagccccatgcccagccccaccccaggcaagctgggcgccccagccatgaagaggtccatgacagtgggggaggagcagacagccagctacaagctgagccctgggaagctgcccatcctgagcaccaaggagatcccccccttcatctgtgaggagcctgtggccaagaagcgggaggagctggcccacttcagcaacagcagcagcaacagcggcaagaaggagctgggcacagctggcctgtacctgcacagcaagctggagcagatccctgagggcagcagcaaggagaagggccaggaggacttcagcgagaccagaattgacagctgcagccaggtgtgccagagaggagagaagcagcccggccagacagccctggccggcaagaaggagattgaggtgacagccacccagagcacccccagcttcctgtttgagaagcccccaagagatggcatcgcccggcctgaggagggccggcctgtggtgtctggaactggaaatgacatcaccaccccacccaacaaggagctgccccccagccctgagaagaagaccaagcccatcgcagatgccaaggcccctgagaagagggccagccccagcaagccagccagcgccccagccagccgcagcggcagcaagagcacccagacagtggccaagaccaccacagctgctgctgtggccagcacaggccccagcagccgcagccccagcaccctgctgcccaagaagcccacagctgacctgagccggcccaagagcaccagcaccagctccatgaagaagaccaccaccctgtctggaacagccccagctgctggggtggtgcccagccgggtgaaggccacccccatgcccagccggcccagcaccacccccttcatcgacaagaagcccaccagcgccaagcccagcagcaccaccccccggctgagccggctggccaccaacaccagcgccccagacctgaagaatgtgcgcagcaaggtgggcagcacagagaacatcaagcaccagcccggcggcggccgggtgcagatcgtgtccaagaaggtgtcctacagccacatccagagcaaatgtggcagcaaggacaacatcaagcacgtgcctgggggcggcaatgtgcagatccagaacaagaaggtggacatcagcaaggtgagcagcaaatgtggcagcaaggccaacatcaagcacaagccaggcggcggagatgtgaagattgagagccagaagctgaacttcaaggagaaggcccaggccaaggtgggcagcctggacaacgtgggccacctgcctgctggaggagctgtgaagattgagacctaccgcctgaccttccgggccaatgcccgggccaggacagaccacggggctgacatcgtgtcccggcccccccacttccctgggggccccaacagcggcagccgggtgctgggccccctgagcagagctgtgcactag

SEQ ID NO: 159770 - DNA, 6894 bp, Artificial Sequence
  Description of Artificial Sequence: Synthetic coding sequence
atggctgacctgagcctggctgatgccctgacagagcccagcccagacattgaaggagagatcaagagggacttcatcgccaccctggaggccgaggcctttgatgatgtggtgggggagaccgtgggcaagacagactacatccccctgctggatgtggatgagaagacaggcaacagcgagagcaagaagaagccctgcagcgagaccagccagatcgaggacctgcccctgcccccccacccagccagcctgtccttccacctgcccctggacacccccagcagcaagcccaccctgctggccaatggaggccacggcgtggagggcagtgacaccaccggcagccccacagagttcctggaggagaagatggcctaccaggagtaccccaacagccagaactggccagaggacaccaacttctgcttccagcctgagcaggtggtggaccccatccagacagaccccttcaagatgtaccatgatgatgacctggccgacctggtgttccccagcagcgccacagctgacaccagcatctttgctggccagaatgaccccctgaaggacagctatggcatgagcccctgcaacacagctgtggtgccccagggctggagcgtggaggccctgaacagcccccacagcgagagctttgtgtccccagaggccgtggccgagcccccccagcccacagctgtgcccctggagctggccaaggagattgagatggccagcgaggagcggcccccagcccaggccctggagatcatgatgggcctgaagaccacagacatggcccccagcaaggagacagagatggccctggccaaggacatggccctggccaccaagacagaggtggccctggccaaggacatggagagccccaccaagctggatgtgaccctggccaaggacatgcagcccagcatggagagtgacatggccctggtgaaggacatggagctgcccacagagaaggaggtggccctggtgaaggatgtgcgctggcccacagaaacagatgtgtcctctgccaagaatgtggtgctgcccacagaaacagaggtggccccagccaaggatgtgaccctgctgaaggagacagagcgggccagccccatcaagatggacctggcccccagcaaggacatgggcccccccaaggagaacaagaaggagacagagcgggccagccccatcaagatggacctggcccccagcaaggacatgggcccccccaaggagaacaagatcgtgcctgccaaggacctggtgctgctgtctgaaattgaggtggcccaggccaatgacatcatcagcagcacagagatcagcagcgctgagaaggtggccctgagcagcgagacagaggtggccctggcccgggacatgaccctgcccccagagaccaacgtcatcctgaccaaggacaaggccctgcccctggaggccgaggtggcccctgtgaaggacatggcccagctgcctgagacagaaattgccccagccaaggatgtggcccccagcacagtgaaggaggtgggcctgctgaaggacatgagccccctgtctgaaacagagatggccctgggcaaggatgtgaccccacctcctgagacagaggtggtgctgatcaagaatgtgtgcctgcccccagagatggaggtggccctgacagaggaccaggtgcctgccctgaagacagaggcccccctggccaaggatggagtgctgaccctggccaacaacgtgaccccagccaaggatgtgccccccctgtctgaaacagaggccacccctgtgcccatcaaggacatggagatcgcccagacccagaagggcatcagcgaggacagccacctggagagcctgcaggatgtgggccagagcgctgcccccaccttcatgatcagccctgagaccgtgacaggcaccgggaagaagtgcagcctgcctgctgaggaggacagcgtgctggagaagctgggggagaggaagccctgcaacagccagcccagcgagctgagcagcgagaccagcgccaacttcatgtactgcggcaccccacccacccaggccaagcaggtgtgccggcccagcgacagaagaagcacccggcccaagccagcccgggtgcccccagagctgctgggcggcagccccccctggaagaccctggaccaccggctgggccactgcagcctgtctgagagcggctgggtgtctggcagcagcagctgtggcggccctggcaaccagaggaagagcatccacgtggacagcctggagccccagagggacctgggccgggaggcctgggacatcgagagcacccccatcatgatgaagaagaagaagaagaagcccaagcagaagcgctacagccagccccgggccggcggccccagtgatgatgacaatgctgacaagcccaagggccacccctttgctgctgacacccagaagagcggcgtgctgcccagccagcccaccaccatgggcacagaatatggcctggtgtctggagagaacctgaagagagaatgtctggtgaacagcagcgctgcccggctggtggccgagaactttgtgtctgagagcctgcgcatccccctgtaccccagcgaggaggcccccaagacagccatcagcagccagagcaagctgcgggtggaggaggagagcaagagcaacaagtctgtgctgcagaaccaggacaagaagctgctgaagcagcacgagtacaagccccagcctgccccccacctgaagacccctgtggacaagagccagagcgtgggccccctgaacctgaagggccccctggccgaggtgtctgcctacaacgtggagacccccctggacatccggctgaaggagggctgcagccccttcctggaccaggaggtgatgggcgtggtgtccaagcccacagctgccaaggagatccccaacctggtgcccaccctcatcgccagcaaccccctggagtgcaacctgaaggagggcaacaatgaaagcaagatgaccaagctgcagaatgtgaagctgaaggagttccctgagggcgctgaggaggacaaggagctgaagaaggaggccttccccaatgaaaggcaggagatcagcatcttcaccagcgagcagctgcagggccaggtgctggtgcaggtgcctggggtggagaatgagcccttcaagaggatggctggagatggcaagagcaggaagggccggggcagcagcggcaagatgaggacagacagcggcaaggtgaaggccaagtctgagctgcccttcctgctggacagccagaaggatggccgggctgtgctgatccccagcgagcctgtgtccaagacagagggcatgaccacccaggacaagtctgaggagctgggcctgaacagcagcaagcagcccggcaccaaggctgacctgacagaagctgtggtgatgggagagcccaaggagatgacccagcccaaggtggccggcaccatgcaggccctgatccccctggagagcggcagcggcatgacccagaccagcggcgtgtccacagaaacaggagatgtggtgaaggacatgggcgtgaacaaccagagcaaggagggccgctgcccctggaaggaccacgaggccgccccctggatcagcgagaagcccaagaagagaggaaatgaaggcaagagcaagaagttcaagaacaactacagcacccagcctgccaggatggagaggaaggaggagatcctgaaccccccatttgagggcaaggatggagacaccggcagcatcccccacaagagcaaggagatcggcttcaccttccccaagatgcatgacagcagcttcagccacaccccagacacccccaccgtggaggccgtggacaggaagggcggcaacttccaggtgaactttgtggagctgggcaccctgggggagaacaagatcagcacagtgaaggccagcacagtgacagagcccccagccaaggtgacagatgtgtcctgccaggagcagatccagggcgccggctttgtgcccagcgtggtgtctgaggagaacaagacagatgctgccaaccgctacacagctgtggccgacaagcccagcaagaggagcaatgatggcaagagcaagaaggtgaagaacagcagccctgagaagcacatcctggagaacaagattgatgccaccaagatccacgtgcccatggagaccaccggggaccagggcatcgagggcatggcctacatggatgaaaatagaaacatcaccttcacctgccccaggacccccagcgagctgatcaacaagagcagccccctggaggtgctggagagcgctgcctgtgagaagctgcccacccccaccccccaggtggtgaaggagggggacagcttcccagacaccctggccaagaatggccaggagatcgccccagcccagatcagcaagagcctgatggtggacaactacaccaaggatggagtgcccggccaggagcggcccaagggccccagcgctgtggtgcccagcaccagcactggaggagtggccctgcccatcaccacagccattgaaacagtgaacatccatggagaccacagcctgaagaacaaggccgagctggccgacagcatgaagaatgaggccggcattgatgagggccacgtgattggagagagcgagagcgtgcacagcggggccagcaagcacagcgtggagaaggtgacagagctggccaagggccacctgctgcccggggtgcctgtggaggaccagagcctgcccggggaggcccgggccctggagggctacgccgaccggggcaacttccctgcccaccctgtgaatgaggagaaggagaccaaggagggctctgtggccgtgcagatcccagacctgctggaggacaaggcccagaagctgtccttctgtgaggaccagaatgcccaggacaggaacagcaagggcagtgacagcctgaacaagaaggtggacctgaccctgctgagccccaagtcagaaaatgacaagctgaaggagatcagcctggcctgcaagatcacagagctggagagcgtgtccctgcccaccccagagatccagagcgacttcctgcacagcaaggtggaggcccctccttctgaggtggccgacaccctggtgatcatgacagccagcaagggcgtgcggctgcctgagcccaaggacaagatcctggagaccccccagaagatgacagagaagtctgagagcaagaccccaggagagggcaagaaggaggacaagagcaggatggccgagcccatgaagggctacatgaggcccaccaagagccggggcctgacccccctgctgcccaagagcaccatccaggagcaggagcggcacaagcagctgaagtctgctggcatcgcccggcctgaggagggccggcctgtggtgtctggaactggaaatgacatcaccaccccacccaacaaggagctgccccccagccctgagaagaagaccaagcccctggccaccacccagcctgccaagaccagcaccagcaaggccaagacccagcccaccagcctgcccaagcagcctgcccccaccaccatcggcggcctgaacaagaagcccatgagcctggccagcggcctggtgcctgctgccccacccaagaggcctgctgtggccagcgcccggcccagcatcctgcccagcaaggatgtgaagcccaagcccatcgcagatgccaaggcccctgagaagagggccagccccagcaagccagccagcgccccagccagccgcagcggcagcaagagcacccagacagtggccaagaccaccacagctgctgctgtggccagcacaggccccagcagccgcagccccagcaccctgctgcccaagaagcccacagccatcaagacagagggcaagccagctgaggtgaagaagatgacagccaagtctgtgcctgctgacctgagccggcccaagagcaccagcaccagctccatgaagaagaccaccaccctgtctggaacagccccagctgctggggtggtgcccagccgggtgaaggccacccccatgcccagccggcccagcaccacccccttcatcgacaagaagcccaccagcgccaagcccagcagcaccaccccccggctgagccggctggccaccaacaccagcgccccagacctgaagaatgtgcgcagcaaggtgggcagcacagagaacatcaagcaccagcccggcggcggccgggccaaggtggagaagaagacagaagctgctgccaccaccaggaagccagagagcaatgctgtgaccaagacagctggccccatcgccagcgcccagaagcagcctgctgggaaggtgcagatcgtgtccaagaaggtgtcctacagccacatccagagcaaatgtggcagcaaggacaacatcaagcacgtgcctgggggcggcaatgtgcagatccagaacaagaaggtggacatcagcaaggtgagcagcaaatgtggcagcaaggccaacatcaagcacaagccaggcggcggagatgtgaagattgagagccagaagctgaacttcaaggagaaggcccaggccaaggtgggcagcctggacaacgtgggccacctgcctgctggaggagctgtgaagacagaaggaggcggcagcgaggcccccctgtgccccggccccccagctggggaggagcccgccatcagcgaggccgcccctgaggccggggcccccaccagcgccagcggcctgaatggccaccccaccctgagcggcggcggggaccagcgggaggcccagaccctggacagccagatccaggagaccagcatctag

SEQ ID NO: 159771 - DNA, 750 bp, Artificial Sequence
  Description of Artificial Sequence: Synthetic coding sequence
atgacagccaagtctgtgcctgctgacctgagccggcccaagagcaccagcaccagctccatgaagaagaccaccaccctgagcggcacagccccagctgctggggtggtgcccagccgggtgaaggccacccccatgcccagccggcccagcaccacccccttcatcgacaagaagcccaccagcgccaagcccagcagcaccaccccccggctgagccggctggccaccaacaccagcgccccagacctgaagaatgtgcgcagcaaggtgggcagcacagagaacatcaagcaccagcccggcggcggccgggtgcagatcgtgtccaagaaggtgtcctacagccacatccagagcaaatgtggcagcaaggacaacatcaagcacgtgcctgggggcggcaatgtgcagatccagaacaagaaggtggacatcagcaaggtgagcagcaaatgtggcagcaaggccaacatcaagcacaagccaggcggcggagatgtgaagattgagagccagaagctgaacttcaaggagaaggcccaggccaaggtgggcagcctggacaacgtgggccacctgcctgctgggggcgctgtgaagattgagacctaccgcctgaccttccgggccaatgcccgggccaggacagaccatggagctgacatcgtgtccaggcctccccacttccctgggggccccaacagcggcagccgggtgctgggccccctgagcagagctgtgcactag

SEQ ID NO: 159772 - DNA, 300 bp, Artificial Sequence
  Description of Artificial Sequence: Synthetic coding sequence
atggctgacctgagcctggctgatgccctgacagagcccagcccagacattgaaggagagatcaagagggacttcatcgccaccctggaggccgaggcctttgatgatgtggtgggggagaccgtgggcaagacagactacatccccctgctggatgtggatgagaagacaggcaacagcgagagcaagaagaagccctgcagcgagaccagccagatcgaggacacccccagcagcaagcccaccctgctggccaacggcggccatggagtggagggcagtgacaccacagaggcctag

SEQ ID NO: 159773 - DNA, 2277 bp, Artificial Sequence
  Description of Artificial Sequence: Synthetic coding sequence
atggccgagccccggcaggagtttgaggtgatggaggaccatgctggcacctacggcctgggggacaggaaggaccagggcggctacaccatgcaccaggaccaggagggggacacagatgctggcctgaaggagagccccctgcagacccccacagaagatggcagcgaggagcccggcagcgagaccagtgatgccaagagcacccccacagcagaagatgtgacagcccccctggtggatgaaggagcccctgggaagcaggccgccgcccagccccacacagagatccctgagggcaccacagctgaggaggccggcatcggggacacccccagcctggaggatgaggccgccggccacgtgacccaggagcctgagagcggcaaggtggtgcaggagggcttcctgcgggagcccggccccccaggcctgagccaccagctgatgagcggcatgcctggggcccccctgctgcctgagggcccccgggaggccacccggcagcccagcggcactggacctgaggacacagagggcggcagacatgcccctgagctgctgaagcaccagctgctgggggacctgcaccaggagggcccccccctgaagggggccggcggcaaggagcggcccggcagcaaggaggaggtggatgaggacagagatgtggatgagagcagcccccaggacagcccccccagcaaggccagccctgcccaggacggccggcccccccagacagctgcccgggaggccaccagcatccctggcttccctgctgagggcgccatccccctgcctgtggacttcctgagcaaggtgtccacagagatcccagccagcgagccagatggccccagcgtgggccgggccaagggccaggatgcccccctggagttcaccttccacgtggagatcacccccaacgtgcagaaggagcaggcccacagcgaggagcacctgggccgggccgccttccctggggcccctggagagggccctgaggcccggggccccagcctgggggaggacaccaaggaggccgacctgcctgagcccagcgagaagcagcctgctgctgccccccggggcaagcctgtgtcccgggtgccccagctgaaggccaggatggtgtccaagagcaaggatggcaccggcagtgatgacaagaaggccaagaccagcaccaggagcagcgccaagaccctgaagaaccggccctgcctgagccccaagcaccccaccccaggcagcagtgaccccctcatccagcccagcagccctgctgtgtgcccagagccccccagcagccccaagtatgtgtcctctgtgaccagcaggacaggcagcagcggggccaaggagatgaagctgaagggagcagatggcaagaccaagatcgccacccccaggggggccgcccctcctggccagaagggccaggccaatgccacccgcatcccagccaagaccccaccagcccccaagaccccacccagcagcggggagccccccaagagcggggacaggagcggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcatcaacaagaagctggacctgagcaatgtgcagagcaaatgtggcagcaaggacaacatcaagcacgtgcctgggggcggctctgtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttcagagaaaatgccaaggccaagacagaccatggagctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 159774 - DNA, 1152 bp, Artificial Sequence
  Description of Artificial Sequence: Synthetic coding sequence
atggccgagccccggcaggagtttgaggtgatggaggaccatgctggcacctacggcctgggggacaggaaggaccagggcggctacaccatgcaccaggaccaggagggggacacagatgctggcctgaaggccgaggaggccggcatcggggacacccccagcctggaggatgaggccgccggccacgtgacccaggccaggatggtgtccaagagcaaggatggcactggaagtgatgacaagaaggccaagggagcagatggcaagaccaagatcgccaccccaagaggagctgcccctcctggccagaagggccaggccaatgccacccgcatcccagccaagaccccaccagcccccaagaccccacccagcagtggagagccccccaagagcggggacagaagtggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcatcaacaagaagctggacctgagcaatgtgcagagcaaatgtggcagcaaggacaacatcaagcacgtgcctgggggcggctctgtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttccgggagaatgccaaggccaagacagaccacggggctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 159775 - DNA, 1239 bp, Artificial Sequence
  Description of Artificial Sequence: Synthetic coding sequence
atggccgagccccggcaggagtttgaggtgatggaggaccatgctggcacctacggcctgggggacaggaaggaccagggcggctacaccatgcaccaggaccaggagggggacacagatgctggcctgaaggagagccccctgcagacccccacagaagatggcagcgaggagcccggcagcgagaccagtgatgccaagagcacccccacagctgaggccgaggaggccggcattggagacacccccagcctggaggatgaagctgctggccacgtgacccaggccaggatggtgtccaagagcaaggatggcaccggcagtgatgacaagaaggccaagggagcagatggcaagaccaagatcgccacccccaggggggccgcccctcctggccagaagggccaggccaatgccacccgcatcccagccaagaccccaccagcccccaagaccccacccagcagcggggagccccccaagagcggggacaggagcggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcatcaacaagaagctggacctgagcaatgtgcagagcaaatgtggcagcaaggacaacatcaagcacgtgcctgggggcggctctgtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttcagagaaaatgccaaggccaagacagaccatggagctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 159776 - DNA, 2331 bp, Artificial Sequence
  Description of Artificial Sequence: Synthetic coding sequence
atggccgagccccggcaggagtttgaggtgatggaggaccatgctggcacctacggcctgggggacaggaaggaccagggcggctacaccatgcaccaggaccaggagggggacacagatgctggcctgaaggagagccccctgcagacccccacagaagatggcagcgaggagcccggcagcgagaccagtgatgccaagagcacccccacagcagaagatgtgacagcccccctggtggatgaaggagcccctgggaagcaggccgccgcccagccccacacagagatccctgagggcaccacagctgaggaggccggcatcggggacacccccagcctggaggatgaggccgccggccacgtgacccaggagcctgagagcggcaaggtggtgcaggagggcttcctgcgggagcccggccccccaggcctgagccaccagctgatgagcggcatgcctggggcccccctgctgcctgagggcccccgggaggccacccggcagcccagcggcactggacctgaggacacagagggcggcagacatgcccctgagctgctgaagcaccagctgctgggggacctgcaccaggagggcccccccctgaagggggccggcggcaaggagcggcccggcagcaaggaggaggtggatgaggacagagatgtggatgagagcagcccccaggacagcccccccagcaaggccagccctgcccaggacggccggcccccccagacagctgcccgggaggccaccagcatccctggcttccctgctgagggcgccatccccctgcctgtggacttcctgagcaaggtgtccacagagatcccagccagcgagccagatggccccagcgtgggccgggccaagggccaggatgcccccctggagttcaccttccacgtggagatcacccccaacgtgcagaaggagcaggcccacagcgaggagcacctgggccgggccgccttccctggggcccctggagagggccctgaggcccggggccccagcctgggggaggacaccaaggaggccgacctgcctgagcccagcgagaagcagcctgctgctgccccccggggcaagcctgtgtcccgggtgccccagctgaaggccaggatggtgtccaagagcaaggatggcaccggcagtgatgacaagaaggccaagaccagcaccaggagcagcgccaagaccctgaagaaccggccctgcctgagccccaagcaccccaccccaggcagcagtgaccccctcatccagcccagcagccctgctgtgtgcccagagccccccagcagccccaagtatgtgtcctctgtgaccagcaggacaggcagcagcggggccaaggagatgaagctgaagggagcagatggcaagaccaagatcgccacccccaggggggccgcccctcctggccagaagggccaggccaatgccacccgcatcccagccaagaccccaccagcccccaagaccccacccagcagcgccaccaagcaggtgcagaggaggcctcctcctgctggccccaggtctgagcggggggagccccccaagagcggggacaggagcggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcatcaacaagaagctggacctgagcaatgtgcagagcaaatgtggcagcaaggacaacatcaagcacgtgcctgggggcggctctgtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttcagagaaaatgccaaggccaagacagaccatggagctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 159777 - DNA, 951 bp, Artificial Sequence
  Description of Artificial Sequence: Synthetic coding sequence
atgctgcgggccctgcagcagaggaagcgggaggccggcatcggggacacccccagcctggaggatgaggccgccggccacgtgacccaggccaggatggtgtccaagagcaaggatggcactggaagtgatgacaagaaggccaagggagcagatggcaagaccaagatcgccaccccaagaggagctgcccctcctggccagaagggccaggccaatgccacccgcatcccagccaagaccccaccagcccccaagaccccacccagcagtggagagccccccaagagcggggacagaagtggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttcagagaaaatgccaaggccaagacagaccatggagctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 159778 - DNA, 1326 bp, Artificial Sequence
  Description of Artificial Sequence: Synthetic coding sequence
atggccgagccccggcaggagtttgaggtgatggaggaccatgctggcacctacggcctgggggacaggaaggaccagggcggctacaccatgcaccaggaccaggagggggacacagatgctggcctgaaggagagccccctgcagacccccacagaagatggcagcgaggagcccggcagcgagaccagtgatgccaagagcacccccacagcagaagatgtgacagcccccctggtggatgaaggagcccctgggaagcaggccgccgcccagccccacacagagatccctgagggcaccacagctgaggaggccggcatcggggacacccccagcctggaggatgaggccgccggccacgtgacccaggccaggatggtgtccaagagcaaggatggcactggaagtgatgacaagaaggccaagggagcagatggcaagaccaagatcgccaccccaagaggagctgcccctcctggccagaagggccaggccaatgccacccgcatcccagccaagaccccaccagcccccaagaccccacccagcagtggagagccccccaagagcggggacagaagtggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcatcaacaagaagctggacctgagcaatgtgcagagcaaatgtggcagcaaggacaacatcaagcacgtgcctgggggcggctctgtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttccgggagaatgccaaggccaagacagaccacggggctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 159779 - DNA, 1080 bp, Artificial Sequence
  Description of Artificial Sequence: Synthetic coding sequence
atggccgagccccggcaggagtttgaggtgatggaggaccatgctggcacctacggcctgggggacaggaaggaccagggcggctacaccatgcaccaggaccaggagggggacacagatgctggcctgaaggagagccccctgcagacccccacagaagatggcagcgaggagcccggcagcgagaccagtgatgccaagagcacccccacagctgaggccaggatggtgtccaagagcaaggatggcaccggcagtgatgacaagaaggccaagggagcagatggcaagaccaagatcgccacccccaggggggccgcccctcctggccagaagggccaggccaatgccacccgcatcccagccaagaccccaccagcccccaagaccccacccagcagcggggagccccccaagagcggggacaggagcggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttccgggagaatgccaaggccaagacagaccacggggctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 159780 - DNA, 2331 bp, Artificial Sequence; identical to SEQ ID NO: 159776
  Description of Artificial Sequence: Synthetic coding sequence

SEQ ID NO: 159781 - DNA, 1239 bp, Artificial Sequence; identical to SEQ ID NO: 159775
  Description of Artificial Sequence: Synthetic coding sequence

SEQ ID NO: 159782 - DNA, 795 bp, Artificial Sequence
  Description of Artificial Sequence: Synthetic coding sequence
acccgggaggccgagggcgcagatggcaagaccaagatcgccacccccaagggccaggccaatgccacccgcatcccagccaagaccccaccagcccccaagaccccacccagcagtggagagccccccaagagcggggacagaagtggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttcagagaaaatgccaaggccaagacagaccatggagctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 159783 - DNA, 1059 bp, Artificial Sequence
  Description of Artificial Sequence: Synthetic coding sequence
atggccgagccccggcaggagtttgaggtgatggaggaccatgctggcacctacggcctgggggacaggaaggaccagggcggctacaccatgcaccaggaccaggagggggacacagatgctggcctgaaggccgaggaggccggcatcggggacacccccagcctggaggatgaggccgccggccacgtgacccaggccaggatggtgtccaagagcaaggatggcactggaagtgatgacaagaaggccaagggagcagatggcaagaccaagatcgccaccccaagaggagctgcccctcctggccagaagggccaggccaatgccacccgcatcccagccaagaccccaccagcccccaagaccccacccagcagtggagagccccccaagagcggggacagaagtggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttcagagaaaatgccaaggccaagacagaccatggagctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 159784 - DNA, 1233 bp, Artificial Sequence
  Description of Artificial Sequence: Synthetic coding sequence
atggccgagccccggcaggagtttgaggtgatggaggaccatgctggcacctacggcctgggggacaggaaggaccagggcggctacaccatgcaccaggaccaggagggggacacagatgctggcctgaaggagagccccctgcagacccccacagaagatggcagcgaggagcccggcagcgagaccagtgatgccaagagcacccccacagcagaagatgtgacagcccccctggtggatgaaggagcccctgggaagcaggccgccgcccagccccacacagagatccctgagggcaccacagctgaggaggccggcatcggggacacccccagcctggaggatgaggccgccggccacgtgacccaggccaggatggtgtccaagagcaaggatggcactggaagtgatgacaagaaggccaagggagcagatggcaagaccaagatcgccaccccaagaggagctgcccctcctggccagaagggccaggccaatgccacccgcatcccagccaagaccccaccagcccccaagaccccacccagcagtggagagccccccaagagcggggacagaagtggctacagcagccctggcagccctggcaccccaggcagccgcagcaggacccccagcctgcccaccccacccacccgggagcccaagaaggtggccgtggtgaggaccccacccaagagccccagcagcgccaagagccggctgcagacagcccctgtgcccatgccagacctgaagaatgtgaagagcaagattggcagcacagagaacctgaagcaccagcccggcggcggcaaggtgcagatcgtgtacaagcctgtggacctgagcaaggtgaccagcaaatgtggcagcctgggcaacatccaccacaagccaggcggcggccaggtggaggtgaagtctgagaagctggacttcaaggacagagtgcagagcaagattggcagcctggacaacatcacccacgtgcctgggggcggcaacaagaagattgagacccacaagctgaccttcagagaaaatgccaaggccaagacagaccatggagctgagatcgtgtacaagagccctgtggtgtctggggacaccagccccaggcacctgagcaatgtgagcagcacaggcagcattgacatggtggacagcccccagctggccaccctggctgatgaggtgtctgccagcctggccaagcagggcctgtag

SEQ ID NO: 159785 - DNA, 807 bp, Artificial Sequence
  Description of Artificial Sequence: Synthetic coding sequence
atggctgtgaatgtgtacagcacctctgtgaccagtgacaacctgagcagacatgacatgctggcctggatcaatgaaagcctgcagctgaacctgaccaagattgagcagctgtgcagcggggccgcctactgccagttcatggacatgctgtttcctggcagcatcgccctgaagaaggtgaagttccaggccaagctggagcacgagtacatccagaacttcaagatcctgcaggccggcttcaagaggatgggcgtggacaagatcatccctgtggacaagctggtgaagggcaagttccaggacaactttgaatttgtgcagtggttcaagaagttctttgatgccaactatgatggcaaggactatgaccctgtggccgcccggcagggccaggagacagctgtggcccccagcctggtggccccagccctgaacaagcccaagaagcccctgaccagcagcagcgctgccccccagaggcccatcagcacccagaggacagctgctgcccccaaggccggccctggggtggtgaggaagaaccctggggtgggcaatggagatgatgaagctgctgagctgatgcagcaggtgaatgtgctgaagctgactgtggaggacctggagaaggagcgggacttctactttgggaagctgaggaacatcgagctgatctgccaggagaatgaaggagaaaatgaccctgtgctgcagagaattgtggacatcctgtatgccacagatgagggctttgtgatcccagatgaaggaggcccccaggaggagcaggaggagtactag

SEQ ID NO: 159786 - DNA, 984 bp, Artificial Sequence
  Description of Artificial Sequence: Synthetic coding sequence
atgcctggccccacccagaccctgagccccaatggagagaacaacaatgacatcatccaggacaacaacggcaccatcatccccttcaggaagcacacagtgcggggggagaggagctacagctggggcatggctgtgaatgtgtacagcaccagcatcacccaggagaccatgagcagacatgacatcatcgcctgggtgaatgacatcgtgtccctgaactacaccaaggtggagcagctgtgcagcggggccgcctactgccagttcatggacatgctgtttcctggctgcatcagcctgaagaaggtgaagttccaggccaagctggagcacgagtacatccacaacttcaagctgctgcaggccagcttcaagaggatgaatgtggacaaggtgattcctgtggagaagctggtgaagggccgcttccaggacaacctggacttcatccagtggttcaagaagttctatgatgccaactatgatggcaaggagtatgaccctgtggaggcccggcagggccaggatgccatccccccaccagaccccggggagcagatcttcaacctgcccaagaagagccaccacgccaacagccccacagctggagctgccaagagcagccctgctgccaagccaggcagcacccccagccggcccagcagcgccaagagggccagcagcagcggcagcgccagcaagagtgacaaggacctggagacccaggtgatccagctgaatgagcaggtgcacagcctgaagctggccctggagggcgtggagaaggagcgggacttctactttgggaagctgcgggagattgagctgctgtgccaggagcacggccaggagaatgatgacctggtgcagaggctgatggacatcctgtatgccagcgaggagcacgagggccacacagaggagcctgaggccgaggagcaggcccacgagcagcagcccccccagcaggaggagtactag

SEQ ID NO: 159787 - DNA, 855 bp, Artificial Sequence
  Description of Artificial Sequence: Synthetic coding sequence
atggctgtgaatgtgtacagcaccagcatcacccaggagaccatgagcagacatgacatcatcgcctgggtgaatgacatcgtgtccctgaactacaccaaggtggagcagctgtgcagcggggccgcctactgccagttcatggacatgctgtttcctggctgcatcagcctgaagaaggtgaagttccaggccaagctggagcacgagtacatccacaacttcaagctgctgcaggccagcttcaagaggatgaatgtggacaaggtgattcctgtggagaagctggtgaagggccgcttccaggacaacctggacttcatccagtggttcaagaagttctatgatgccaactatgatggcaaggagtatgaccctgtggaggcccggcagggccaggatgccatccccccaccagaccctggagagcagatcttcaacctgcccaagaagagccaccacgccaacagccccacagctggggccgccaagagcagccctgctgccaagccaggcagcacccccagccggcccagcagcgccaagagggccagcagcagcggcagcgccagcaagagtgacaaggacctggagacccaggtgatccagctgaatgagcaggtgcacagcctgaagctggccctggagggcgtggagaaggagcgggacttctactttgggaagctgcgggagattgagctgctgtgccaggagcacggccaggagaatgatgacctggtgcagaggctgatggacatcctgtatgccagcgaggagcacgagggccacacagaggagcctgaggccgaggagcaggcccacgagcagcagcccccccagcaggaggagtactag

SEQ ID NO: 159788 - DNA, 948 bp, Artificial Sequence
  Description of Artificial Sequence: Synthetic coding sequence
atgaagcagaacagagaccagaagtgccctgtgtcccagaggaacagcagcttccagcagcccggcaggaagccaggctgcagctcctggggcatggctgtgaatgtgtacagcaccagcatcacccaggagaccatgagcagacatgacatcatcgcctgggtgaatgacatcgtgtccctgaactacaccaaggtggagcagctgtgcagcggggccgcctactgccagttcatggacatgctgtttcctggctgcatcagcctgaagaaggtgaagttccaggccaagctggagcacgagtacatccacaacttcaagctgctgcaggccagcttcaagaggatgaatgtggacaaggtgattcctgtggagaagctggtgaagggccgcttccaggacaacctggacttcatccagtggttcaagaagttctatgatgccaactatgatggcaaggagtatgaccctgtggaggcccggcagggccaggatgccatccccccaccagaccccggggagcagatcttcaacctgcccaagaagagccaccacgccaacagccccacagctggagctgccaagagcagccctgctgccaagccaggcagcacccccagccggcccagcagcgccaagagggccagcagcagcggcagcgccagcaagagtgacaaggacctggagacccaggtgatccagctgaatgagcaggtgcacagcctgaagctggccctggagggcgtggagaaggagcgggacttctactttgggaagctgcgggagattgagctgctgtgccaggagcacggccaggagaatgatgacctggtgcagaggctgatggacatcctgtatgccagcgaggagcacgagggccacacagaggagcctgaggccgaggagcaggcccacgagcagcagcccccccagcaggaggagtactag

SEQ ID NO: 159789 - DNA, 825 bp, Artificial Sequence
  Description of Artificial Sequence: Synthetic coding sequence
atggcccggaccaccaccaccagcagccgcatcatcaccggccccagcttcctgagcggcagcacccagtgtgccggctctgtgcccaccggggccgcctactgccagttcatggacatgctgtttcctggctgcatcagcctgaagaaggtgaagttccaggccaagctggagcacgagtacatccacaacttcaagctgctgcaggccagcttcaagaggatgaatgtggacaaggtgattcctgtggagaagctggtgaagggccgcttccaggacaacctggacttcatccagtggttcaagaagttctatgatgccaactatgatggcaaggagtatgaccctgtggaggcccggcagggccaggatgccatccccccaccagaccctggagagcagatcttcaacctgcccaagaagagccaccacgccaacagccccacagctggggccgccaagagcagccctgctgccaagccaggcagcacccccagccggcccagcagcgccaagagggccagcagcagcggcagcgccagcaagagtgacaaggacctggagacccaggtgatccagctgaatgagcaggtgcacagcctgaagctggccctggagggcgtggagaaggagcgggacttctactttgggaagctgcgggagattgagctgctgtgccaggagcacggccaggagaatgatgacctggtgcagaggctgatggacatcctgtatgccagcgaggagcacgagggccacacagaggagcctgaggccgaggagcaggcccacgagcagcagcccccccagcaggaggagtactag

SEQ ID NO: 159790 - DNA, 1005 bp, Artificial Sequence; identical to SEQ ID NO: 158659
  Description of Artificial Sequence: Synthetic coding sequence

SEQ ID NO: 159791 - DNA, 801 bp, Artificial Sequence
  Description of Artificial Sequence: Synthetic coding sequence
atggctgtgaatgtgtacagcacctctgtgaccagcgagaacctgagcagacatgacatgctggcctgggtgaatgacagcctgcacctgaactacaccaagattgagcagctgtgcagcggggccgcctactgccagttcatggacatgctgtttcctggctgtgtgcacctgaggaaggtgaagttccaggccaagctggagcacgagtacatccacaacttcaaggtgctgcaggccgccttcaagaagatgggcgtggacaagatcatccctgtggagaagctggtgaagggcaagttccaggacaactttgagttcatccagtggttcaagaagttctttgatgccaactatgatggcaaggactacaaccccctgctggcccggcagggccaggatgtggcccccccacccaaccctgtgccccagaggaccagccccaccggccccaagaacatgcagaccagcggccgcctgagcaatgtggccccaccctgcatcctgaggaagaaccccccatctgccagaaatggaggccatgaaacagatgcccagatcctggagctgaaccagcagctggtggacctgaagctgactgtggatggcctggagaaggagcgggacttctacttcagcaagctgcgggacatcgagctgatctgccaggagcatgaaagtgagaacagccctgtgatcagcggcatcatcggcatcctgtatgccacagaggagggctttgcccccccagaagatgatgaaattgaggagcaccagcaggaggaccaggatgagtactag

SEQ ID NO: 159792 - DNA, 801 bp, Artificial Sequence; identical to SEQ ID NO: 159791
  Description of Artificial Sequence: Synthetic coding sequence

SEQ ID NO: 159793 - DNA, 657 bp, Artificial Sequence
  Description of Artificial Sequence: Synthetic coding sequence
atggctgtgaatgtgtacagcacctctgtgaccagcgagaacctgagcagacatgacatgctggcctgggtgaatgacagcctgcacctgaactacaccaagattgagcagctgtgcagcggggccgcctactgccagttcatggacatgctgtttcctggctgtgtgcacctgaggaaggtgaagttccaggccaagctggagcacgagtacatccacaacttcaaggtgctgcaggccgccttcaagaagatgggcgtggacaagatcatccctgtggagaagctggtgaagggcaagttccaggacaactttgagttcatccagtggttcaagaagttctttgatgccaactatgatggcaaggactacaaccccctgctggcccggcagggccaggatgtggcccccccacccaaccctggggaccagatcttcaacaagagcaagaagctgattggaacagctgtgccccagaggaccagccccaccggccccaagaacatgcagaccagcggccgcctgagcaatgtggccccaccctgcatcctgaggaagaacccccccagcgccagaaatggaggccacgagacagatgcccagatcctggagctgaaccagcagctggtggacctgaagctgactgtggatggatag

SEQ ID NO: 159794 - DNA, 2004 bp, Artificial Sequence
  Description of Artificial Sequence: Synthetic coding sequence
atggagaccctggagagcgagctgacctgccccatctgcctggagctgtttgaggaccccctgctgctgccctgtgcccacagcctgtgcttcaactgtgcccaccgcatcctggtgagccactgtgccaccaatgaatctgtggagagcatcacagccttccagtgccccacctgcagacatgtgatcaccctgagccagaggggcctggatggcctgaagagaaatgtgaccctgcagaacatcatcgaccgcttccagaaggcctctgtgtctggccccaacagccccagcgagacccggcgggagcgggcctttgatgccaacaccatgaccagcgctgagaaggtgctgtgccagttctgtgaccaggaccctgcccaggatgctgtgaagacctgtgtgacctgtgaggtgtcctactgtgatgagtgcctgaaggccacccaccccaacaagaagcccttcaccggccacaggctcatcgagcccatcccagacagccacatccggggcctgatgtgcctggagcatgaagatgagaaggtgaacatgtactgtgtgacagatgaccagctgatctgtgccctgtgcaagctggtgggccgccaccgggaccaccaggtggccgccctgtctgaaagatatgacaagctgaagcagaacctggagagcaacctgaccaacctgatcaagaggaacacagagctggagaccctgctggccaagctgatccagacctgccagcacgtggaggtgaatgccagccggcaggaggccaagctgacagaagaatgtgacctgctgattgagatcatccagcagaggcggcagatcatcggcaccaagatcaaggagggcaaggtgatgaggctgaggaagctggcccagcagatcgccaactgcaagcagtgcatcgagaggtctgccagcctcatcagccaggccgagcacagcctgaaggaaaatgaccacgcccgcttcctgcagacagccaagaacatcacagagcgggtgtccatggccacagccagcagccaggtgctgatccctgagatcaacctgaatgacacctttgacacctttgccctggacttcagccgggagaagaagctgctggagtgcctggactacctgacagcccccaacccccccaccatccgggaggagctgtgcacagccagctatgacaccatcaccgtgcactggaccagtgatgatgagttctctgtggtgtcctatgagctgcagtacaccatcttcaccggccaggccaacgtggtgtccctgtgcaacagcgctgacagctggatgattgtgcccaacatcaagcagaaccactacacagtgcacggcctgcagagcggcaccaagtacatcttcatggtgaaggccatcaaccaggccggcagccgcagcagcgagcccgggaagctgaagaccaacagccagcccttcaagctggaccccaagagcgcccacaggaagctgaaggtgtcccatgacaacctgactgtggagagagatgagagcagcagcaagaagagccacaccccagagcgcttcaccagccagggcagctatggagtggccggaaatgtgttcatcgacagcggccgccactactgggaggtggtgatcagcggcagcacctggtacgccatcggcctggcctacaagagcgcccccaagcatgagtggattggcaagaacagcgcctcctgggccctgtgccgctgcaacaacaactgggtggtgcgccacaacagcaaggagatccccattgaaccagccccccacctgcggcgggtgggcatcctgctggactatgacaatggcagcatcgccttctatgatgccctgaacagcatccacctgtacacctttgatgtggcctttgcccagcctgtgtgccccaccttcaccgtgtggaacaagtgcctgaccatcatcaccggcctgcccatcccagaccacctggactgcacagagcagctgccctag

SEQ ID NO: 159795 - DNA, 2004 bp, Artificial Sequence; identical to SEQ ID NO: 159794
  Description of Artificial Sequence: Synthetic coding sequence

SEQ ID NO: 159796 - DNA, 2004 bp, Artificial Sequence; identical to SEQ ID NO: 159794
  Description of Artificial Sequence: Synthetic coding sequence

SEQ ID NO: 159797 - DNA, 1659 bp, Artificial Sequence
  Description of Artificial Sequence: Synthetic coding sequence
atggagaccctggagagcgagctgacctgccccatctgcctggagctgtttgaggaccccctgctgctgccctgtgcccacagcctgtgcttcaactgtgcccaccgcatcctggtgagccactgtgccaccaatgaatctgtggagagcatcacagccttccagtgccccacctgcagacatgtgatcaccctgagccagaggggcctggatggcctgaagagaaatgtgaccctgcagaacatcatcgaccgcttccagaaggcctctgtgtctggccccaacagccccagcgagacccggcgggagcgggcctttgatgccaacaccatgaccagcgctgagaaggtgctgtgccagttctgtgaccaggaccctgcccaggatgctgtgaagacctgtgtgacctgtgaggtgtcctactgtgatgagtgcctgaaggccacccaccccaacaagaagcccttcaccggccacaggctcatcgagcccatcccagacagccacatccggggcctgatgtgcctggagcatgaagatgagaaggtgaacatgtactgtgtgacagatgaccagctgatctgtgccctgtgcaagctggtgggccgccaccgggaccaccaggtggccgccctgtctgaaagatatgacaagctgaagcagaacctggagagcaacctgaccaacctgatcaagaggaacacagagctggagaccctgctggccaagctgatccagacctgccagcacgtggaggtgaatgccagccggcaggaggccaagctgacagaagaatgtgacctgctgattgagatcatccagcagaggcggcagatcatcggcaccaagatcaaggagggcaaggtgatgaggctgaggaagctggcccagcagatcgccaactgcaagcagtgcatcgagaggtctgccagcctcatcagccaggccgagcacagcctgaaggaaaatgaccacgcccgcttcctgcagacagccaagaacatcacagagcgggtgtccatggccacagccagcagccaggtgctgatccctgagatcaacctgaatgacacctttgacacctttgccctggacttcagccgggagaagaagctgctggagtgcctggactacctgacagcccccaacccccccaccatccgggaggagctgtgcacagccagctatgacaccatcaccgtgcactggaccagtgatgatgagttctctgtggtgtcctatgagctgcagtacaccatcttcaccggccaggccaacgtggtgtccctgtgcaacagcgctgacagctggatgattgtgcccaacatcaagcagaaccactacacagtgcacggcctgcagagcggcaccaagtacatcttcatggtgaaggccatcaaccaggccggcagccgcagcagcgagcccgggaagctgaagaccaacagccagcccttcaagctggaccccaagagcgcccacaggaagctgaaggtgtcccatgacaacctgactgtggagagagatgagagcagcagcaagaagagccacaccccagagcgcttcaccagccagggcagctatggagtggccggaaatgtgttcatcgacagcggccgccactactgggaggtggtgatcagcggcagcacctggtag

SEQ ID NO: 159798 - DNA, 2004 bp, Artificial Sequence; identical to SEQ ID NO: 159794
  Description of Artificial Sequence: Synthetic coding sequence

SEQ ID NO: 159799 - DNA, 2004 bp, Artificial Sequence; identical to SEQ ID NO: 159794
  Description of Artificial Sequence: Synthetic coding sequence

SEQ ID NO: 159800 - DNA, 1452 bp, Artificial Sequence
  Description of Artificial Sequence: Synthetic coding sequence
atggagaccctggagagcgagctgacctgccccatctgcctggagctgtttgaggaccccctgctgctgccctgtgcccacagcctgtgcttcaactgtgcccaccgcatcctggtgagccactgtgccaccaatgaatctgtggagagcatcacagccttccagtgccccacctgcagacatgtgatcaccctgagccagaggggcctggatggcctgaagagaaatgtgaccctgcagaacatcatcgaccgcttccagaaggcctctgtgtctggccccaacagccccagcgagacccggcgggagcgggcctttgatgccaacaccatgaccagcgctgagaaggtgctgtgccagttctgtgaccaggaccctgcccaggatgctgtgaagacctgtgtgacctgtgaggtgtcctactgtgatgagtgcctgaaggccacccaccccaacaagaagcccttcaccggccacaggctcatcgagcccatcccagacagccacatccggggcctgatgtgcctggagcatgaagatgagaaggtgaacatgtactgtgtgacagatgaccagctgatctgtgccctgtgcaagctggtgggccgccaccgggaccaccaggtggccgccctgtctgaaagatatgacaagctgaagcagaacctggagagcaacctgaccaacctgatcaagaggaacacagagctggagaccctgctggccaagctgatccagacctgccagcacgtggaggtgaatgccagccggcaggaggccaagctgacagaagaatgtgacctgctgattgagatcatccagcagaggcggcagatcatcggcaccaagatcaaggagggcaaggtgatgaggctgaggaagctggcccagcagatcgccaactgcaagcagtgcatcgagaggtctgccagcctcatcagccaggccgagcacagcctgaaggaaaatgaccacgcccgcttcctgcagacagccaagaacatcacagagcgggtgtccatggccacagccagcagccaggtgctgatccctgagatcaacctgaatgacacctttgacacctttgccctggacttcagccgggagaagaagctgctggagtgcctggactacctgacagcccccaacccccccaccatccgggaggagctgtgcacagccagctatgacaccatcaccgtgcactggaccagtgatgatgagttctctgtggtgtcctatgagctgcagtacaccatcttcaccggccaggccaacgtggtgtccctgtgcaacagcgctgacagctggatgattgtgcccaacatcaagcagaaccactacacagtgcacggcctgcagagcggcaccaagtacatcttcatggtgaaggccatcaaccaggccggcagccgcagcagcgagcccgggaagctgaagaccaacagctag

SEQ ID NO: 159801 - DNA, 594 bp, Artificial Sequence
  Description of Artificial Sequence: Synthetic coding sequence
atggagaccctggagagcgagctgacctgccccatctgcctggagctgtttgaggaccccctgctgctgccctgtgcccacagcctgtgcttcaactgtgcccaccgcatcctggtgagccactgtgccaccaatgaatctgtggagagcatcacagccttccagtgccccacctgcagacatgtgatcaccctgagccagaggggcctggatggcctgaagagaaatgtgaccctgcagaacatcatcgaccgcttccagaaggcctctgtgtctggccccaacagccccagcgagacccggcgggagcgggcctttgatgccaacaccatgaccagcgctgagaaggtgctgtgccagttctgtgaccaggaccctgcccaggatgctgtgaagacctgtgtgacctgtgaggtgtcctactgtgatgagtgcctgaaggccacccaccccaacaagaagcccttcaccggccacaggctcatcgagcccatcccagacagccacatccggggcctgatgtgcctggagcatgaagatgagaaggtgaacatgtactgtgtgacagatgaccagctgatctgtgccctgtag

SEQ ID NO: 159802 - DNA, 2004 bp, Artificial Sequence; identical to SEQ ID NO: 159794
  Description of Artificial Sequence: Synthetic coding sequence

SEQ ID NO: 159803 - DNA, 1854 bp, Artificial Sequence
  Description of Artificial Sequence: Synthetic coding sequence
atggagaccctggagagcgagctgacctgccccatctgcctggagctgtttgaggaccccctgctgctgccctgtgcccacagcctgtgcttcaactgtgcccaccgcatcctggtgagccactgtgccaccaatgaatctgtggagagcatcacagccttccagtgccccacctgcagacatgtgatcaccctgagccagaggggcctggatggcctgaagagaaatgtgaccctgcagaacatcatcgaccgcttccagaaggcctctgtgtctggccccaacagccccagcgagaccagcgctgagaaggtgctgtgccagttctgtgaccaggaccctgcccaggatgctgtgaagacctgtgtgacctgtgaggtgtcctactgtgatgagtgcctgaaggccacccaccccaacaagaagcccttcaccggccacaggctcatcgagcccatcccagacagccacatccggggcctgatgtgcctggagcatgaagatgagaagcagaacctggagagcaacctgaccaacctgatcaagaggaacacagagctggagaccctgctggccaagctgatccagacctgccagcacgtggaggtgaatgccagccggcaggaggccaagctgacagaagaatgtgacctgctgattgagatcatccagcagaggcggcagatcatcggcaccaagatcaaggagggcaaggtgatgaggctgaggaagctggcccagcagatcgccaactgcaagcagtgcatcgagaggtctgccagcctcatcagccaggccgagcacagcctgaaggaaaatgaccacgcccgcttcctgcagacagccaagaacatcacagagcgggtgtccatggccacagccagcagccaggtgctgatccctgagatcaacctgaatgacacctttgacacctttgccctggacttcagccgggagaagaagctgctggagtgcctggactacctgacagcccccaacccccccaccatccgggaggagctgtgcacagccagctatgacaccatcaccgtgcactggaccagtgatgatgagttctctgtggtgtcctatgagctgcagtacaccatcttcaccggccaggccaacgtggtgtccctgtgcaacagcgctgacagctggatgattgtgcccaacatcaagcagaaccactacacagtgcacggcctgcagagcggcaccaagtacatcttcatggtgaaggccatcaaccaggccggcagccgcagcagcgagcccgggaagctgaagaccaacagccagcccttcaagctggaccccaagagcgcccacaggaagctgaaggtgtcccatgacaacctgactgtggagagagatgagagcagcagcaagaagagccacaccccagagcgcttcaccagccagggcagctatggagtggccggaaatgtgttcatcgacagcggccgccactactgggaggtggtgatcagcggcagcacctggtacgccatcggcctggcctacaagagcgcccccaagcatgagtggattggcaagaacagcgcctcctgggccctgtgccgctgcaacaacaactgggtggtgcgccacaacagcaaggagatccccattgaaccagccccccacctgcggcgggtgggcatcctgctggactatgacaatggcagcatcgccttctatgatgccctgaacagcatccacctgtacacctttgatgtggcctttgcccagcctgtgtgccccaccttcaccgtgtggaacaagtgcctgaccatcatcaccggcctgcccatcccagaccacctggactgcacagagcagctgccctag

SEQ ID NO: 159804 - DNA, 2208 bp, Artificial Sequence
  Description of Artificial Sequence: Synthetic coding sequence
atgggagagagccctgcctctgtggtgctgaatgccagcggcggcctcttcagcctgaagatggagaccctggagagcgagctgacctgccccatctgcctggagctgtttgaggaccccctgctgctgccctgtgcccacagcctgtgcttcagctgtgcccaccgcatcctggtgagcagctgcagcagcggggagagcattgagcccatcacagccttccagtgccccacctgccgctacgtgatcagcctgaaccaccggggcctggatggcctgaagagaaatgtgaccctgcagaacatcatcgaccgcttccagaaggcctctgtgtctggccccaacagccccagcgagagcagaagagagaggacctaccggcccaccacagccatgagcagcgagagaattgcctgccagttctgtgagcaggaccccccaagagatgctgtgaagacctgcatcacctgtgaggtgtcctactgtgaccgctgcctgcgggccacccaccccaacaagaagcccttcaccagccaccggctggtggagcctgtgcctgacacccacctgcggggcatcacctgcctggaccatgaaaatgagaaggtgaacatgtactgtgtgtctgatgaccagctgatctgtgccctgtgcaagctggtgggccgccaccgggaccaccaggtggccagcctgaatgacagatttgagaagctgaagcagaccctggagatgaacctgaccaacctggtgaagagaaattctgagctggagaaccagatggccaagctgatccagatctgccagcaggtggaggtgaacacagccatgcatgaggccaagctgatggaggagtgtgatgagctggtggagatcatccagcagaggaagcagatgattgctgtgaagatcaaggagaccaaggtgatgaagctgaggaagctggcccagcaggtggccaactgccggcagtgcctggagaggagcacagtgctgatcaaccaggccgagcacatcctgaaggaaaatgaccaggcccgcttcctgcagagcgccaagaacattgctgagcgggtggccatggccacagccagcagccaggtgctgatcccagacatcaacttcaatgatgcctttgagaactttgccctggacttcagccgggagaagaagctgctggagggcctggactacctgacagcccccaacccccccagcatccgggaggagctgtgcacagccagccatgacaccatcaccgtgcactggatcagtgatgatgagttcagcatcagcagctatgagctgcagtacaccatcttcaccggccaggccaacttcatcagcaagtcctggtgctcctggggcctgtggccagagatcaggaagtgcaaggaggccgtgtcctgcagccggctggccggggccccccggggcctgtacaacagcgtggacagctggatgattgtgcccaacatcaagcagaaccactacacagtgcacggcctgcagagcggcacccgctacatcttcatcgtgaaggccatcaaccaggccggcagcaggaacagcgagcccacccggctgaagaccaacagccagcccttcaagctggaccccaagatgacccacaagaagctgaagatcagcaatgatggcctgcagatggagaaggatgagagcagcctgaagaagagccacaccccagagcgcttctctggaacaggctgctacggggctgctggcaacatcttcatcgacagcggctgccactactgggaggtggtgatgggcagcagcacctggtacgccatcggcatcgcctacaagagcgcccccaagaatgagtggattggcaagaatgccagctcctgggtgttcagccgctgcaacagcaactttgtggtgcgccacaacaacaaggagatgctggtggatgtgcccccccacctgaagaggctgggcgtgctgctggactatgacaacaacatgctgtccttctatgaccctgccaacagcctgcacctgcacacctttgatgtgaccttcatcctgcctgtgtgccccaccttcaccatctggaacaagagcctgatgatcctgagcggcctgcctgccccagacttcatcgactacccagagcggcaggagtgcaactgccggccccaggagagcccctacgtgtctggcatgaagacctgccactag

SEQ ID NO: 159805 - DNA, 2118 bp, Artificial Sequence
  Description of Artificial Sequence: Synthetic coding sequence
atgggagagagccctgcctctgtggtgctgaatgccagcggcggcctcttcagcctgaagatggagaccctggagagcgagctgacctgccccatctgcctggagctgtttgaggaccccctgctgctgccctgtgcccacagcctgtgcttcagctgtgcccaccgcatcctggtgagcagctgcagcagcggggagagcattgagcccatcacagccttccagtgccccacctgccgctacgtgatcagcctgaaccaccggggcctggatggcctgaagagaaatgtgaccctgcagaacatcatcgaccgcttccagaaggcctctgtgtctggccccaacagccccagcgagagcagaagagagaggacctaccggcccaccacagccatgagcagcgagagaattgcctgccagttctgtgagcaggaccccccaagagatgctgtgaagacctgcatcacctgtgaggtgtcctactgtgaccgctgcctgcgggccacccaccccaacaagaagcccttcaccagccaccggctggtggagcctgtgcctgacacccacctgcggggcatcacctgcctggaccatgaaaatgagaaggtgaacatgtactgtgtgtctgatgaccagctgatctgtgccctgtgcaagctggtgggccgccaccgggaccaccaggtggccagcctgaatgacagatttgagaagctgaagcagaccctggagatgaacctgaccaacctggtgaagagaaattctgagctggagaaccagatggccaagctgatccagatctgccagcaggtggaggtgaacacagccatgcatgaggccaagctgatggaggagtgtgatgagctggtggagatcatccagcagaggaagcagatgattgctgtgaagatcaaggagaccaaggtgatgaagctgaggaagctggcccagcaggtggccaactgccggcagtgcctggagaggagcacagtgctgatcaaccaggccgagcacatcctgaaggaaaatgaccaggcccgcttcctgcagagcgccaagaacattgctgagcgggtggccatggccacagccagcagccaggtgctgatcccagacatcaacttcaatgatgcctttgagaactttgccctggacttcagccgggagaagaagctgctggagggcctggactacctgacagcccccaacccccccagcatccgggaggagctgtgcacagccagccatgacaccatcaccgtgcactggatcagtgatgatgagttcagcatcagcagctatgagctgcagtacaccatcttcaccggccaggccaacttcatcagcctgtacaacagcgtggacagctggatgattgtgcccaacatcaagcagaaccactacacagtgcacggcctgcagagcggcacccgctacatcttcatcgtgaaggccatcaaccaggccggcagcaggaacagcgagcccacccggctgaagaccaacagccagcccttcaagctggaccccaagatgacccacaagaagctgaagatcagcaatgatggcctgcagatggagaaggatgagagcagcctgaagaagagccacaccccagagcgcttctctggaacaggctgctacggggctgctggcaacatcttcatcgacagcggctgccactactgggaggtggtgatgggcagcagcacctggtacgccatcggcatcgcctacaagagcgcccccaagaatgagtggattggcaagaatgccagctcctgggtgttcagccgctgcaacagcaactttgtggtgcgccacaacaacaaggagatgctggtggatgtgcccccccacctgaagaggctgggcgtgctgctggactatgacaacaacatgctgtccttctatgaccctgccaacagcctgcacctgcacacctttgatgtgaccttcatcctgcctgtgtgccccaccttcaccatctggaacaagagcctgatgatcctgagcggcctgcctgccccagacttcatcgactacccagagcggcaggagtgcaactgccggccccaggagagcccctacgtgtctggcatgaagacctgccactag

SEQ ID NO: 159806 - DNA, 660 bp, Artificial Sequence
  Description of Artificial Sequence: Synthetic coding sequence
atggagaccctggagagcgagctgacctgccccatctgcctggagctgtttgaggaccccctgctgctgccctgtgcccacagcctgtgcttcagctgtgcccaccgcatcctggtgagcagctgcagcagcggggagagcattgagcccatcacagccttccagtgccccacctgccgctacgtgatcagcctgaaccaccggggcctggatggcctgaagagaaatgtgaccctgcagaacatcatcgaccgcttccagaaggcctctgtgtctggccccaacagccccagcgagagcagaagagagaggacctaccggcccaccacagccatgagcagcgagagaattgcctgccagttctgtgagcaggaccccccaagagatgctgtgaagacctgcatcacctgtgaggtgtcctactgtgaccgctgcctgcgggccacccaccccaacaagaagcccttcaccagccaccggctggtggagcctgtgcctgacacccacctgcggggcatcacctgcctggaccatgaaaatgagaaggtgaacatgtactgtgtgtctgatgaccagctgatctgtgccctgtgcaagctggtgggccgccaccgggaccaccaggtggccagcctgaatgacagatttgagaagctgtag

SEQ ID NO: 159807 - DNA, 1407 bp, Artificial Sequence
  Description of Artificial Sequence: Synthetic coding sequence
atggagccccagcctggaggagcccggagctgccggcggggggcccctgggggcgcctgtgagctgggccctgctgctgaggccgcccccatgagcctggccatccacagcaccaccggcaccaggtatgacctggccgtgcccccagatgagaccgtggagggcctgaggaagaggctgagccagaggctgaaggtgcccaaggagcggctggccctgctgcacaaggacacccggctgagcagcggcaagctgcaggagtttggagtgggagatggcagcaagctgaccctggtgcccaccgtggaggccggcctgatgagccaggccagcaggcctgagcagagcgtgatgcaggccctggagagcctgacagagacccaggtgtctgacttcctgagcggccgcagccccctgaccctggccctgcgggtgggggaccacatgatgtttgtgcagctgcagctggccgcccagcacgcccccctgcagcacagacatgtgctggccgctgctgctgctgctgctgctgcccggggggaccccagcatcgccagccctgtgagcagcccctgcaggcctgtgtcctctgctgcccgggtgccccctgtgcccaccagccccagccctgccagccccagccccatcacagctggcagcttccgcagccatgctgccagcaccacctgcccagagcagatggactgcagccccacagccagcagcagcgccagccctggggccagcaccaccagcacccctggggccagccctgcccccaggagcaggaagccaggagctgtgattgagagctttgtgaaccacgcccctggggtcttcagcggcaccttcagcggcaccctgcaccccaactgccaggacagcagcggccggccccggcgggacatcggcaccatcctgcagatcctgaatgacctgctgagcgccaccaggcactaccagggcatgccacccagcctggcccagctgcgctgccacgcccagtgcagccctgccagccctgccccagacctggcccccaggaccaccagctgtgagaagctgacagctgcccccagcgccagcctgctgcagggccagagccagatccgcatgtgcaagcccccaggggaccggctgcggcagacagagaacagagccacccgctgcaaggtggagcggctgcagctgctgctgcagcagaagaggctgcggaggaaggccaggagagatgcccggggcccctaccactggagccccagcaggaaggccggccgcagtgacagcagcagcagcggcggcggcggcagccccagcgaggccagcggcctgggcctggactttgaagattctgtgtggaagccagaggtgaacccagacatcaagtcagaatttgtggtggcctag

SEQ ID NO: 159808 - DNA, 771 bp, Artificial Sequence
  Description of Artificial Sequence: Synthetic coding sequence
atgggagagcccagccgggaggagtacaagatccagagctttgatgctgagacccagcagctgctgaagacagccctgaaggtggcctgctttgaaacagaagatggagagtacagcgtgtgccagaggagctacagcaactgcagccggctgatgcccagccgctgcaacacccagtacagagatcctggagctgtggacctggagaaggtggccaacgtgattgtggaccacagcctgcaggactgtgtgttcagcaaggaggccggccgcatgtgctacgccatcatccaggccgagagcaagcaggccggccagagcgtcttccggcggggcctgctgaaccggctgcagcaggagtaccaggcccgggagcagctgcgggcccggagcctgcagggctgggtgtgctacgtgaccttcatctgcaacatctttgactacctgcgggtgaacaacatgcccatgatggccctggtgaaccctgtgtatgactgcctcttccggctggcccagcctgacagcctgagcaaggaggaggaggtggactgcctggtgctgcagctgcaccgggtgggggagcagctggagaagatgaatggccagaggatggatgagctgtttgtgctgatcagagatggcttcctgctgcccaccggcctgagcagcctggcccagctgctgctgctggagatcatcgagttccgggccgccggctggaagaccaccccagctgcccacaagtactactacagcgaggtgtctgactag

SEQ ID NO: 159809 - DNA, 669 bp, Artificial Sequence
  Description of Artificial Sequence: Synthetic coding sequence
atgggagagcccagccgggaggagtacaagatccagagctttgatgctgagacccagcagctgctgaagacagccctgaaggaccctggagctgtggacctggagaaggtggccaacgtgattgtggaccacagcctgcaggactgtgtgttcagcaaggaggccggccgcatgtgctacgccatcatccaggccgagagcaagcaggccggccagagcgtcttccggcggggcctgctgaaccggctgcagcaggagtaccaggcccgggagcagctgcgggcccggagcctgcagggctgggtgtgctacgtgaccttcatctgcaacatctttgactacctgcgggtgaacaacatgcccatgatggccctggtgaaccctgtgtatgactgcctcttccggctggcccagcctgacagcctgagcaaggaggaggaggtggactgcctggtgctgcagctgcaccgggtgggggagcagctggagaagatgaatggccagaggatggatgagctgtttgtgctgatcagagatggcttcctgctgcccaccggcctgagcagcctggcccagctgctgctgctggagatcatcgagttccgggccgccggctggaagaccaccccagctgcccacaagtactactacagcgaggtgtctgactag

SEQ ID NO: 159810 - DNA, 792 bp, Artificial Sequence
  Description of Artificial Sequence: Synthetic coding sequence
atgggagagcccagccgggaggagtacaagatccagagctttgatgctgagacccagcagctgctgaagacagccctgaaggcccccagcctggagtgcaccgtggcctgctttgaaacagaagatggagagtacagcgtgtgccagaggagctacagcaactgcagccggctgatgcccagccgctgcaacacccagtacagagaccccggggctgtggacctggagaaggtggccaacgtcatcgtggaccacagcctgcaggactgtgtgttcagcaaggaggccggccgcatgtgctacgccatcatccaggccgagagcaagcaggccggccagagcgtcttcagaagaggcctgctgaaccggctgcagcaggagtaccaggcccgggagcagctgcgggcccggagcctgcagggctgggtgtgctacgtgaccttcatctgcaacatctttgactacctgcgggtgaacaacatgcccatgatggccctggtgaaccctgtgtatgactgcctcttccggctggcccagcctgacagcctgagcaaggaggaggaggtggactgcctggtgctgcagctgcaccgggtgggggagcagctggagaagatgaatggccagaggatggatgagctgtttgtgctgatcagagatggcttcctgctgcccaccggcctgagcagcctggcccagctgctgctgctggagatcatcgagttccgggctgctggctggaagaccaccccagctgcccacaagtactactacagcgaggtgtctgactag

SEQ ID NO: 159811 - DNA, 1164 bp, Artificial Sequence
  Description of Artificial Sequence: Synthetic coding sequence
atgccccggccccggctgctggccgccctgtgtggggccctgctgtgtgcccccagcctgctggtggccctggacatctgcagcaagaacccctgccacaacggcggcctgtgtgaggagatcagccaggaggtgagaggagatgtgttccccagctacacctgcacctgcctgaagggctacgccggcaaccactgtgagaccaagtgtgtggagcccctgggcctggagaatggaaatattgccaacagccagattgctgccagctctgtgcgggtgaccttcctgggcctgcagcactgggtgcctgagctggcccggctgaacagagctggcatggtgaatgcctggacccccagcagcaatgatgacaacccctggatccaggtgaacctgctgcggaggatgtgggtgactggagtggtgacccagggcgccagccggctggccagccatgagtacctgaaggccttcaaggtggcctacagcctgaatggacatgaatttgacttcatccatgatgtgaacaagaagcacaaggagtttgtgggcaactggaacaagaatgctgtgcacgtgaacctgtttgagacccctgtggaggcccagtatgtgcggctgtaccccaccagctgccacacagcctgcaccctgcgctttgagctgctgggctgtgagctgaatggctgtgccaaccccctgggcctgaagaacaacagcatcccagacaagcagatcacagccagcagcagctacaagacctggggcctgcacctgttctcctggaaccccagctatgcccggctggacaagcagggcaacttcaatgcctgggtggccggcagctatggaaatgaccagtggctgcaggtggacctgggcagcagcaaggaggtgacaggcatcatcacccagggcgccaggaactttggatctgtgcagtttgtggccagctacaaggtggcctacagcaatgattctgccaactggacagagtaccaggaccccaggacaggcagcagcaagatcttccctggcaactgggacaaccacagccacaagaagaacctgtttgagacccccatcctggcccgctacgtgcgcatcctgcctgtggcctggcacaaccgcatcgccctgcggctggagctgctgggctgctag

SEQ ID NO: 159812 - DNA, 1140 bp, Artificial Sequence
  Description of Artificial Sequence: Synthetic coding sequence
atgtggcccttccctgagggcggcaacaccatccccatcctgcacacagacatctgcagcaagaacccctgccacaacggcggcctgtgtgaggagatcagccaggaggtgagaggagatgtgttccccagctacacctgcacctgcctgaagggctacgccggcaaccactgtgagaccaagtgtgtggagcccctgggcctggagaatggaaatattgccaacagccagattgctgccagctctgtgcgggtgaccttcctgggcctgcagcactgggtgcctgagctggcccggctgaacagagctggcatggtgaatgcctggacccccagcagcaatgatgacaacccctggatccaggtgaacctgctgcggaggatgtgggtgactggagtggtgacccagggcgccagccggctggccagccatgagtacctgaaggccttcaaggtggcctacagcctgaatggacatgaatttgacttcatccatgatgtgaacaagaagcacaaggagtttgtgggcaactggaacaagaatgctgtgcacgtgaacctgtttgagacccctgtggaggcccagtatgtgcggctgtaccccaccagctgccacacagcctgcaccctgcgctttgagctgctgggctgtgagctgaatggctgtgccaaccccctgggcctgaagaacaacagcatcccagacaagcagatcacagccagcagcagctacaagacctggggcctgcacctgttctcctggaaccccagctatgcccggctggacaagcagggcaacttcaatgcctgggtggccggcagctatggaaatgaccagtggctgcaggtggacctgggcagcagcaaggaggtgacaggcatcatcacccagggcgccaggaactttggatctgtgcagtttgtggccagctacaaggtggcctacagcaatgattctgccaactggacagagtaccaggaccccaggacaggcagcagcaagatcttccctggcaactgggacaaccacagccacaagaagaacctgtttgagacccccatcctggcccgctacgtgcgcatcctgcctgtggcctggcacaaccgcatcgccctgcggctggagctgctgggctgctag

SEQ ID NO: 159813 - DNA, 1008 bp, Artificial Sequence
  Description of Artificial Sequence: Synthetic coding sequence
atgccccggccccggctgctggccgccctgtgtggggccctgctgtgtgcccccagcctgctggtggccctggacatctgcagcaagaacccctgccacaacggcggcctgtgtgaggagatcagccaggaggtgagaggagatgtgttccccagctacacctgcacctgcctgaagggctacgccggcaaccactgtgagaccaagtgtgtggagcccctgggcctggagaatggaaatattgccaacagccagattgctgccagctctgtgcgggtgaccttcctgggcctgcagcactgggtgcctgagctggcccggctgaacagagctggcatggtgaatgcctggacccccagcagcaatgatgacaacccctggatccaggtgaacctgctgcggaggatgtgggtgactggagtggtgacccagggcgccagccggctggccagccatgagtacctgaaggccttcaaggtggcctacagcctgaatggacatgaatttgacttcatccatgatgtgaacaagaagcacaaggagtttgtgggcaactggaacaagaatgctgtgcacgtgaacctgtttgagacccctgtggaggcccagtatgtgcggctgtaccccaccagctgccacacagcctgcaccctgcgctttgagctgctgggctgtgagctgaatggctgtgccaaccccctgggcctgaagaacaacagcatcccagacaagcagatcacagccagcagcagctacaagacctggggcctgcacctgttctcctggaaccccagctatgcccggctggacaagcagggcaacttcaatgcctgggtggccggcagctatggaaatgaccagtggctgcagatcttccctggcaactgggacaaccacagccacaagaagaacctgtttgagacccccatcctggcccgctacgtgcgcatcctgcctgtggcctggcacaaccgcatcgccctgcggctggagctgctgggctgctag

SEQ ID NO: 159814 - DNA, 1929 bp, Artificial Sequence
  Description of Artificial Sequence: Synthetic coding sequence
atgccctgtggggaggactggctgagccaccccctgggcatcgtgcagggcttctttgcccagaatggagtgaacccagactgggagaagaaggtgattgagtacttcaaggagaagctgaaggagaacaatgcccccaagtgggtgcccagcctgaatgaggtgcccctgcactacctgaagcccaacagctttgtgaagttccgctgcatgatccaggacatgtttgatcctgagttctacatgggcgtgtatgaaacagtgaaccagaacaccaaggcccacgtgctgcactttgggaagtacagagatgtggctgaatgtggcccccagcaggagctggacctgaacagccccaggaacaccaccctggagcggcagaccttctactgtgtgcctgtgcctggagagagcacctgggtgaaggaggcctacgtgaatgccaaccaggcccgggtgagccccagcaccagctacacccccagccgccacaagaggagctatgaagatgatgatgacatggacctgcagcccaacaagcagaaggaccagcacgccggggcccggcaggccggctctgtgggcggcctgcagtggtgtggggagcccaagaggctggagacagaggccagcacaggccagcagctgaacagcctgaacctgagcagcccctttgacctgaacttccccctgcccggggagaagggccctgcctgcctggtgaaggtgtatgaggactgggactgcttcaaggtgaatgacatcctggagctgtatggcatcctgtctgtggaccctgtgctgagcatcctgaacaatgatgaaagagatgccagcgccctgctggaccccatggagtgcacagacacagctgaggagcagagggtgcacagccccccagccagcctggtgccccgcatccacgtgatcctggcccagaagctgcagcacatcaaccccctgctgcctgcctgcctgaacaaggaggagagcaagacctgcaagtttgtgtcctccttcatgtctgagctgagccctgtgcgggcagagctgctgggcttcctgacccacgccctgctgggggacagcctggccgctgagtacctgatcctgcacctgatcagcacagtgtacaccaggagagatgtgctgcccctgggcaagttcaccgtgaacctgagcggctgccccaggaacagcaccttcacagagcacctgtaccgcatcatccagcacctggtgcctgccagcttccggctgcagatgaccatcgagaacatgaaccacctgaagttcatcccccacaaggactacacagccaaccggctggtgtctggcctgctgcagctgcccagcaacaccagcctggtgattgatgagaccctgctggagcagggccagctggacaccccaggagtgcacaacgtgacagccctgagcaacctgatcacctggcagaaggtggactatgacttctcctaccaccagatggagttcccctgcaacatcaacgtgttcatcaccagcgagggccgcagcctgctgcctgctgactgccagatccacctgcagccccagctgatcccccccaacatggaggagtacatgaacagcctgctgtctgctgtgctgcccagcgtgctgaacaagttccgcatctacctgaccctgctgcgcttcctggagtacagcatcagtgatgagatcaccaaggctgtggaggatgactttgtggagatgaggaagaatgacccccagagcatcacagcagatgacctgcaccagctgctggtggtggcccgctgcctgagcctgtctgctggccagaccaccctgagccgggagcgctggctgcgggccaagcagctggagagcctgcggaggacccggctgcagcagcagaagtgtgtgaatggaaatgagctgtag

SEQ ID NO: 159815 - DNA, 1923 bp, Artificial Sequence
  Description of Artificial Sequence: Synthetic coding sequence
atgccctgtggggaggactggctgagccaccccctgggcatcgtgcagggcttctttgcccagaatggagtgaacccagactgggagaagaaggtgattgagtacttcaaggagaagctgaaggagaacaatgcccccaagtgggtgcccagcctgaatgaggtgcccctgcactacctgaagcccaacagctttgtgaagttccgctgcatgatccaggacatgtttgatcctgagttctacatgggcgtgtatgaaacagtgaaccagaacaccaaggcccacgtgctgcactttgggaagtacagagatgtggctgaatgtggcccccagcaggagctggacctgaacagccccaggaacaccaccctggagcggcagaccttctactgtgtgcctgtgcctggagagagcacctgggtgaaggaggcctacgtgaatgccaaccaggcccgggtgagccccagcaccagctacacccccagccgccacaagaggagctatgaagatgatgatgacatggacctgcagcccaacaagcagaaggaccagcacgccggggcccggcaggccggctctgtgggcggcctgcagtggtgtggggagcccaagaggctggagacagaggccagcacaggccagcagctgaacagcctgaacctgagcagcccctttgacctgaacttccccctgcccggggagaagggccctgcctgcctggtgaaggtgtatgaggactgggactgcttcaaggtgaatgacatcctggagctgtatggcatcctgtctgtggaccctgtgctgagcatcctgaacaatgatgaaagagatgccagcgccctgctggaccccatggagtgcacagacacagctgaggagcagagggtgcacagccccccagccagcctggtgccccgcatccacgtgatcctggcccagaagctgcagcacatcaaccccctgctgcctgcctgcctgaacaaggaggagagcaagacctttgtgtcctccttcatgtctgagctgagccctgtgcgggcagagctgctgggcttcctgacccacgccctgctgggggacagcctggccgctgagtacctgatcctgcacctgatcagcacagtgtacaccaggagagatgtgctgcccctgggcaagttcaccgtgaacctgagcggctgccccaggaacagcaccttcacagagcacctgtaccgcatcatccagcacctggtgcctgccagcttccggctgcagatgaccatcgagaacatgaaccacctgaagttcatcccccacaaggactacacagccaaccggctggtgtctggcctgctgcagctgcccagcaacaccagcctggtgattgatgagaccctgctggagcagggccagctggacaccccaggagtgcacaacgtgacagccctgagcaacctgatcacctggcagaaggtggactatgacttctcctaccaccagatggagttcccctgcaacatcaacgtgttcatcaccagcgagggccgcagcctgctgcctgctgactgccagatccacctgcagccccagctgatcccccccaacatggaggagtacatgaacagcctgctgtctgctgtgctgcccagcgtgctgaacaagttccgcatctacctgaccctgctgcgcttcctggagtacagcatcagtgatgagatcaccaaggctgtggaggatgactttgtggagatgaggaagaatgacccccagagcatcacagcagatgacctgcaccagctgctggtggtggcccgctgcctgagcctgtctgctggccagaccaccctgagccgggagcgctggctgcgggccaagcagctggagagcctgcggaggacccggctgcagcagcagaagtgtgtgaatggaaatgagctgtag

SEQ ID NO: 159816 - DNA, 2628 bp, Artificial Sequence
  Description of Artificial Sequence: Synthetic coding sequence
atggatgaggaggaggacaacctgagcctgctgacagccctgctggaggagaatgaaagtgccctggactgcaacagcgaggagaacaacttcctgaccagagaaaatggagagccagatgcctttgatgagctgtttgatgctgatggagatggagagagctacacagaggaggctgatgatggagagaccggggagaccagagatgagaaggagaacctggccaccctgtttggagacatggaggacctgacagatgaggaggaggtgcctgccagccagagcacagaaaatagagtgctgcctgccccagccccccggcgggagaagaccaatgaggagctgcaggaggagctgaggaacctgcaggagcagatgaaggccctgcaggagcagctgaaggtgaccaccatcaagcagacagccagccctgcccggctgcagaagagccctgtggagaagagcccccggccccccctgaaggagaggagagtgcagaggatccaggagagcacctgcttctctgctgagctggatgtgcctgccctgcccaggaccaagagggtggcccggacccccaaggccagccccccagaccccaagagcagcagcagcaggatgaccagcgcccccagccagcccctgcagaccatcagcaggaacaagcccagcggcatcacccggggccagatcgtgggcaccccaggcagcagcggggagaccacccagcccatctgtgtggaggccttcagcggcctgcggctgcggcggccccgggtgagcagcacagagatgaacaagaagatgacaggcaggaagctgatccggctgagccagatcaaggagaagatggcccgggagaagctggaggagattgactgggtgacctttggagtcatcctgaagaaggtgaccccccagagcgtgaacagcggcaagaccttcagcatctggaagctgaatgacctgcgggacctgacccagtgtgtgtccctcttcctgtttggagaggtgcacaaggccctgtggaagacagagcagggcaccgtggtgggcatcctgaatgccaaccccatgaagcccaaggatggcagcgaggaggtgtgcctgagcattgaccacccccagaaggtgctgatcatgggagaggccctggacctgggcacctgcaaggccaagaagaagaatggagagccctgcacccagacagtgaacctgcgggactgtgagtactgccagtaccacgtgcaggcccagtacaagaagctgagcgccaagagagctgacctgcagagcaccttcagcggcggccgcatccccaagaagtttgcccggcggggcaccagcctgaaggagcggctgtgccaggacggcttctactatggaggagtgagcagcgccagctatgctgccagcattgctgctgctgtggcccccaagaagaagatccagaccaccctgagcaacctggtggtgaagggcaccaacctgatcatccaggagacccggcagaagctgggcatcccccagaagagcctgagctgcagcgaggagttcaaggagctgatggacctgcccacctgtggggccaggaacctgaagcagcacctggccaaggccacagccagcggcatcatgggcagccccaagccagccatcaagagcatcagcgccagcgccctgctgaagcagcagaagcagaggatgctggagatgagaagaaggaagtctgaggagatccagaagcgcttcctgcagagcagcagcgaggtggagagccctgctgtgcccagcagcagccggcagcccccagcccagccccccaggacaggcagcgagttcccccggctggagggcgccccagccaccatgacccccaagctgggccggggcgtgctggagggagatgatgtgctcttctatgatgagagccccccaccccggcccaagctgagcgccctggccgaggccaagaagctggccgccatcaccaagctgcgggccaagggccaggtgctgaccaagaccaaccccaacagcatcaagaagaagcagaaggacccccaggacatcctggaggtgaaggagcgggtggagaagaacaccatgttcagcagccaggctgaagatgagctggagcccgccaggaagaagagaagagagcagctggcctacctggagagcgaggagttccagaagatcctgaaggccaagagcaagcacacaggcatcctgaaggaggccgaggccgagatgcaggagcgctactttgagcccctggtgaagaaggagcagatggaggagaagatgaggaacatccgggaggtgaagtgccgggtggtgacctgcaagacctgtgcctacacccacttcaagctgctggagacctgtgtgtctgagcagcacgagtaccactggcatgatggagtgaagcgcttcttcaagtgcccctgtggcaacagaagcatcagcctggaccggctgcccaacaagcactgcagcaactgtggcctgtacaagtgggagagagatggcatgctgaaggagaagacaggccccaagattggaggagagaccctgctgcccagaggagaggagcacgccaagttcctgaacagcctgaagtag

SEQ ID NO: 159817 - DNA, 2568 bp, Artificial Sequence
  Description of Artificial Sequence: Synthetic coding sequence
atggatgaggaggaggacaacctgagcctgctgacagccctgctggaggagaatgaaagtgccctggactgcaacagcgaggagaacaacttcctgaccagagaaaatggagagccagatgcctttgatgagctgtttgatgctgatggagatggagagagctacacagaggaggctgatgatggagagaccggggagaccagagatgagaaggagaacctggccaccctgtttggagacatggaggacctgacagatgaggaggaggtgcctgccagccagagcacagaaaatagagtgctgcctgccccagccccccggcgggagaagaccaatgaggagctgcaggaggagctgaggaacctgcaggagcagatgaaggccctgcaggagcagctgaaggtgaccaccatcaagcagacagccagccctgcccggctgcagaagagccctgagaagagccccaggcctcccctgaaggagcggcgggtgcagaggatccaggagagcacctgcttctctgctgagctggatgtgcctgccctgcccaggaccaagagggtggcccggacccccaaggccagccccccagaccccaagagcagcagcagcaggatgaccagcgcccccagccagcccctgcagaccatcagcaggaacaagcccagcggcatcacccggggccagatcgtgggcaccccaggcagcagtggagagaccacccagcccatctgtgtggaggccttcagcggcctgcggctgcggcggccccgggtgagcagcacagagatgaacaagaagatgactggaaggaagctgatccggctgagccagatcaaggagaagatggcccgggagaagctggaggagattgactgggtgaccttcggggtcatcctgaagaaggtgaccccccagagcgtgaacagcggcaagaccttcagcatctggaagctgaatgacctgcgggacctgacccagtgtgtgtccctcttcctgtttggagaggtgcacaaggccctgtggaagacagagcagggcaccgtggtgggcatcctgaatgccaaccccatgaagcccaaggatggcagcgaggaggtgtgcctgagcattgaccacccccagaaggtgctgatcatgggagaggccctggacctgggcacctgcaaggccaagaagaagaatggagagccctgcacccagacagtgaacctgcgggactgtgagtactgccagtaccacgtgcaggcccagtacaagaagctgagcgccaagagagctgacctgcagagcaccttcagcggcggccgcatccccaagaagtttgcccggcggggcaccagcctgaaggagcggctgtgccaggacggcttctactacggcggcgtgtcctctgccagctatgctgccagcattgctgctgctgtggcccccaagaagaagatccagaccaccctgagcaacctggtggtgaagggcaccaacctgatcatccaggagacccggcagaagctgggcatcccccagaagagcctgagctgcagcgaggagttcaaggagctgatggacctgcccacctgtggggccaggaacctgaagcagcacctggccaaggccacagccagcggcatcatgggcagccccaagccagccatcaagagcatcagcgccagcgccctgctgaagcagcagaagcagaggatgctggagatgagaagaaggaagtctgaggagatccagaagcgcttcctgcagagcagcagcgaggtggagagccctgctgtgcccagcagcagccggcagcccccagcccagccccccaggactggaagtgagttcccccggctggagggcgccccagccaccatgacccccaagctgggccggggcgtgctggagggagatgatgtgctcttctatgatgagagccccccaccccggcccaagctgagcgccctggccgaggccaagaagctggccgccatcaccaagctgcgggccaagggccaggtgctgaccaagaccaaccccaacagcatcaagaagaagcagaaggacccccaggacatcctggaggtgaaggagcgggtggagaagaacaccatgttcagcagccaggccgaggatgagctggagcccgccaggaagaagaggcgggagcagctggcctacctggagagcgaggagttccagaagatcctgaaggccaagagcaagcacacaggcatcctgaaggaggccgaggccgagatgcaggagcgctactttgagcccctggtgaagaaggagcagatggaggagaagatgaggaacatccgggaggtgaagtgccgggtggtgacctgcaagacctgtgcctacacccacttcaagctgctggagacctgtgtgtctgagcagcacgagtaccactggcatgatggagtgaagcgcttcttcaagtgcccctgtggcaacagaagcatcagcctggaccggctgcccaacaagcactgcagcaactgtggcctgtacaagtgggagagagatggcatgctgaaggtgtgccacctgcggaccaacttctag

SEQ ID NO: 159818 - DNA, 2625 bp, Artificial Sequence
  Description of Artificial Sequence: Synthetic coding sequence
atggatgaggaggaggacaacctgagcctgctgacagccctgctggaggagaatgaaagtgccctggactgcaacagcgaggagaacaacttcctgaccagagaaaatggagagccagatgcctttgatgagctgtttgatgctgatggagatggagagagctacacagaggaggctgatgatggagagaccggggagaccagagatgagaaggagaacctggccaccctgtttggagacatggaggacctgacagatgaggaggaggtgcctgccagccagagcacagaaaatagagtgctgcctgccccagccccccggcgggagaagaccaatgaggagctgcaggaggagctgaggaacctgcaggagcagatgaaggccctgcaggagcagctgaaggtgaccaccatcaagcagacagccagccctgcccggctgcagaagagccctgagaagagccccaggcctcccctgaaggagcggcgggtgcagaggatccaggagagcacctgcttctctgctgagctggatgtgcctgccctgcccaggaccaagagggtggcccggacccccaaggccagccccccagaccccaagagcagcagcagcaggatgaccagcgcccccagccagcccctgcagaccatcagcaggaacaagcccagcggcatcacccggggccagatcgtgggcaccccaggcagcagtggagagaccacccagcccatctgtgtggaggccttcagcggcctgcggctgcggcggccccgggtgagcagcacagagatgaacaagaagatgactggaaggaagctgatccggctgagccagatcaaggagaagatggcccgggagaagctggaggagattgactgggtgaccttcggggtcatcctgaagaaggtgaccccccagagcgtgaacagcggcaagaccttcagcatctggaagctgaatgacctgcgggacctgacccagtgtgtgtccctcttcctgtttggagaggtgcacaaggccctgtggaagacagagcagggcaccgtggtgggcatcctgaatgccaaccccatgaagcccaaggatggcagcgaggaggtgtgcctgagcattgaccacccccagaaggtgctgatcatgggagaggccctggacctgggcacctgcaaggccaagaagaagaatggagagccctgcacccagacagtgaacctgcgggactgtgagtactgccagtaccacgtgcaggcccagtacaagaagctgagcgccaagagagctgacctgcagagcaccttcagcggcggccgcatccccaagaagtttgcccggcggggcaccagcctgaaggagcggctgtgccaggacggcttctactacggcggcgtgtcctctgccagctatgctgccagcattgctgctgctgtggcccccaagaagaagatccagaccaccctgagcaacctggtggtgaagggcaccaacctgatcatccaggagacccggcagaagctgggcatcccccagaagagcctgagctgcagcgaggagttcaaggagctgatggacctgcccacctgtggggccaggaacctgaagcagcacctggccaaggccacagccagcggcatcatgggcagccccaagccagccatcaagagcatcagcgccagcgccctgctgaagcagcagaagcagaggatgctggagatgagaagaaggaagtctgaggagatccagaagcgcttcctgcagagcagcagcgaggtggagagccctgctgtgcccagcagcagccggcagcccccagcccagccccccaggactggaagtgagttcccccggctggagggcgccccagccaccatgacccccaagctgggccggggcgtgctggagggagatgatgtgctcttctatgatgagagccccccaccccggcccaagctgagcgccctggccgaggccaagaagctggccgccatcaccaagctgcgggccaagggccaggtgctgaccaagaccaaccccaacagcatcaagaagaagcagaaggacccccaggacatcctggaggtgaaggagcgggtggagaagaacaccatgttcagcagccaggccgaggatgagctggagcccgccaggaagaagaggcgggagcagctggcctacctggagagcgaggagttccagaagatcctgaaggccaagagcaagcacacaggcatcctgaaggaggccgaggccgagatgcaggagcgctactttgagcccctggtgaagaaggagcagatggaggagaagatgaggaacatccgggaggtgaagtgccgggtggtgacctgcaagacctgtgcctacacccacttcaagctgctggagacctgtgtgtctgagcagcacgagtaccactggcatgatggagtgaagcgcttcttcaagtgcccctgtggcaacagaagcatcagcctggaccggctgcccaacaagcactgcagcaactgtggcctgtacaagtgggagagagatggcatgctgaaggagaagacaggccccaagattggaggagagaccctgctgcccagaggagaggagcacgccaagttcctgaacagcctgaagtag

SEQ ID NO: 159819 - DNA, 2628 bp, Artificial Sequence; identical to SEQ ID NO: 159816
  Description of Artificial Sequence: Synthetic coding sequence

SEQ ID NO: 159820 - DNA, 2466 bp, Artificial Sequence
  Description of Artificial Sequence: Synthetic coding sequence
atggacctggccgctgctgctgagcctggagctggcagccagcacctggaggtgagagatgaggtggccgagaagtgccagaagctgttcctggacttcctggaggagttccagagcagtgatggagagatcaagtacctgcagctggccgaggagctgatccggcctgagaggaacaccctggtggtgtcctttgtggacctggagcagttcaaccagcagctgagcaccaccatccaggaggagttctacagagtgtacccctacctgtgccgggccctgaagacctttgtgaaggacaggaaggagatccccctggccaaggacttctacgtggccttccaggacctgcccaccaggcacaagatccgggagctgaccagcagcagaattggcctgctgacccgcatcagcggccaggtggtgaggacccaccctgtgcaccctgagctggtgtctggcaccttcctgtgcctggactgccagaccgtcatcagagatgtggagcagcagttcaagtacacccagcccaacatctgcagaaatcctgtgtgtgccaacagaagacgcttcctgctggacaccaacaagagcagatttgtggacttccagaaggtgcgcatccaggagacccaggccgagctgccccggggcagcatccccaggagcctggaggtgatcctgcgggcagaggccgtggagagcgcccaggccggggacaagtgtgacttcaccggcaccctgattgtggtgcctgatgtgtccaagctgagcacccctggggcccgggcagagaccaacagccgggtgtctggagtggatggctatgaaacagagggcatccggggcctgcgggccctgggcgtgcgggacctgagctaccgcctggtgttcctggcctgctgcgtggcccccaccaaccccaggtttggaggcaaggagctgagagatgaggagcagacagctgagagcatcaagaaccagatgacagtgaaggagtgggagaaggtgtttgagatgagccaggacaagaacctgtaccacaacctgtgcaccagcctcttccccaccatccatggaaatgatgaggtgaagaggggcgtgctgctgatgctgtttggaggagtgcccaagaccaccggggagggcaccagcctgcggggggacatcaacgtgtgcatcgtgggggaccccagcacagccaagagccagttcctgaagcacgtggaggagttcagccccagggctgtgtacaccagcggcaaggccagcagcgctgctggcctgacagctgctgtggtgagagatgaggagagccatgaatttgtgattgaggccggggccctgatgctggccgacaacggggtgtgctgcattgatgaatttgacaagatggatgtgcgggaccaggtggccatccacgaggccatggagcagcagaccatcagcatcaccaaggccggcgtgaaggccaccctgaatgcccggaccagcatcctggccgccgccaaccccatcagcggccactatgacaggagcaagagcctgaagcagaacatcaacctgagcgcccccatcatgagcagatttgacctcttcttcatcctggtggatgaatgtaatgaggtgacagattatgccatcgcccggcgcatcgtggacctgcacagcagaattgaggagagcattgacagagtgtacagcctggatgacatccgccgctacctgctgtttgcccggcagttcaagcccaagatcagcaaggagagcgaggacttcatcgtggagcagtacaagcacctgcggcagagagatggcagcggcgtgaccaagagctcctggaggatcaccgtgcggcagctggagagcatgatccggctgtctgaggccatggccaggatgcactgctgtgatgaggtgcagcccaagcacgtgaaggaggccttccggctgctgaacaagagcatcatccgggtggagaccccagatgtgaacctggaccaggaggaggagatccagatggaggtggatgaaggagctgggggcatcaatggacatgctgacagccctgcccctgtgaatggcatcaatggctacaatgaagacatcaaccaggagagcgcccccaaggccagcctgcggctgggcttcagcgagtactgccgcatcagcaacctgattgtgctgcacctgaggaaggtggaggaggaggaggatgaaagtgccctgaagaggtctgagctggtgaactggtacctgaaggagattgagagcgagattgacagcgaggaggagctgatcaacaagaagaggatcatcgagaaggtgatccaccggctgacccactatgaccacgtgctgattgagctgacccaggccggcctgaagggcagcacagagggcagcgagagctatgaggaggacccctacctggtggtgaaccccaactacctgctggaggactag

SEQ ID NO: 159821 - DNA, 2160 bp, Artificial Sequence
  Description of Artificial Sequence: Synthetic coding sequence
atggccctgaaggactatgccctggagaaggagaaggtgaagaagttcctgcaggagttctaccaggatgatgagctgggcaagaagcagttcaagtatggcaaccagctggtgcggctggcccaccgggagcaggtggccctgtatgtggacctggatgatgtggctgaagatgatcctgagctggtggacagcatctgtgaaaatgccaggagatatgccaagctgtttgctgatgctgtgcaggagctgctgccccagtacaaggagcgggaggtggtgaacaaggatgtgctggatgtgtacatcgagcaccggctgatgatggagcagaggagccgggaccccggcatggtgcgcagcccccagaaccagtacccagctgagctgatgagaagatttgagctgtacttccagggccccagcagcaacaagcccagggtcatccgggaggtgcgggctgacagcgtgggcaagctggtgacagtgcggggcatcgtgaccagggtgtctgaggtgaagcccaagatggtggtggccacctacacctgtgaccagtgtggggctgagacctaccagcccatccagagccccaccttcatgcccctcatcatgtgccccagccaggagtgccagaccaacagaagtggcggccgcctgtacctgcagacccggggcagccgcttcatcaagttccaggagatgaagatgcaggagcacagcgaccaggtgcctgtgggcaacatccccaggagcatcaccgtgctggtggagggggagaacacccgcatcgcccagcccggggaccacgtgtctgtgacaggcatcttcctgcccatcctgaggacaggcttccggcaggtggtgcagggcctgctgtctgagacctacctggaggcccacagaattgtgaagatgaacaagtcagaagatgatgagagcggggccggggagctgacccgggaggagctgcggcagattgctgaggaggacttctatgagaagctggccgccagcatcgcccctgagatctacggccatgaagatgtgaagaaggccctgctgctgctgctggtgggcggcgtggaccagagcccccggggcatgaagatccggggcaacatcaacatctgcctgatgggagaccccggggtggccaagagccagctgctgagctacatcgaccggctggcccccaggagccagtacaccaccggccggggcagcagcggcgtgggcctgacagctgctgtgctgcgggacagcgtgtctggagagctgaccctggagggcggggccctggtgctggccgaccagggcgtgtgctgcattgatgaatttgacaagatggccgaggccgacagaacagccatccacgaggtgatggagcagcagaccatcagcatcgccaaggccggcatcctgaccaccctgaatgcccgctgcagcatcctggccgccgccaacccagcctacggccgctacaacccccggcgcagcctggagcagaacatccagctgcctgctgccctgctgagcagatttgacctgctgtggctgatccaggacagaccagaccgggacaatgacctgcggctggcccagcacatcacctacgtgcaccagcacagccggcagccccccagccagtttgagcccctggacatgaagctgatgaggcgctacatcgccatgtgccgggagaagcagcccatggtgcctgagagcctggccgactacatcacagctgcctacgtggagatgagaagagaggcctgggccagcaaggatgccacctacaccagcgcccggaccctgctggccatcctgcggctgagcacagccctggcccggctgaggatggtggatgtggtggagaaggaggatgtgaatgaggccatccggctgatggagatgagcaaggacagcctgctgggggacaagggccagacagcccggacccagaggcctgcagatgtgatctttgccaccgtgcgggagctggtgtctgggggccgctctgtgcgcttcagcgaggccgagcagagatgtgtgtcccggggcttcaccccagcccagttccaggccgccctggatgaatatgaggagctgaatgtgtggcaggtgaatgccagcaggacccgcatcacctttgtgtag

SEQ ID NO: 159822 - DNA, 1170 bp, Artificial Sequence
  Description of Artificial Sequence: Synthetic coding sequence
atggccctgaaggactatgccctggagaaggagaaggtgaagaagttcctgcaggagttctaccaggatgatgagctgggcaagaagcagttcaagtatggcaaccagctggtgcggctggcccaccgggagcaggtggccctgtatgtggacctggatgatgtggctgaagatgatcctgagctggtggacagcatctgtgaaaatgccaggagatatgccaagctgtttgctgatgctgtgcaggagctgctgccccagtacaaggagcgggaggtggtgaacaaggatgtgctggatgtgtacatcgagcaccggctgatgatggagcagaggagccgggaccccggcatggtgcgcagcccccagaaccagtacccagctgagctgatgagaagatttgagctgtacttccagggccccagcagcaacaagcccagggtcatccgggaggtgcgggctgacagcgtgggcaagctggtgacagtgcggggcatcgtgaccagggtgtctgaggtgaagcccaagatggtggtggccacctacacctgtgaccagtgtggggctgagacctaccagcccatccagagccccaccttcatgcccctcatcatgtgccccagccaggagtgccagaccaacagaagtggcggccgcctgtacctgcagacccggggcagccgcttcatcaagttccaggagatgaagatgcaggagcacagcgaccaggtgcctgtgggcaacatccccaggagcatcaccgtgctggtggagggggagaacacccgcatcgcccagcccggggaccacgtgtctgtgacaggcatcttcctgcccatcctgaggacaggcttccggcaggtggtgcagggcctgctgtctgagacctacctggaggcccacagaattgtgaagatgaacaagtcagaagatgatgagagcggggccggggagctgacccgggaggagctgcggcagattgctgatgtgatctttgccaccgtgcgggagctggtgtctgggggccgctctgtgcgcttcagcgaggccgagcagagatgtgtgtcccggggcttcaccccagcccagttccaggccgccctggatgaatatgaggagctgaatgtgtggcaggtgaatgccagcaggacccgcatcacctttgtgtag

SEQ ID NO: 159823 - DNA, 1632 bp, Artificial Sequence
  Description of Artificial Sequence: Synthetic coding sequence
atggtggtggccacctacacctgtgaccagtgtggggctgagacctaccagcccatccagagccccaccttcatgcccctcatcatgtgccccagccaggagtgccagaccaacagaagtggcggccgcctgtacctgcagacccggggcagccgcttcatcaagttccaggagatgaagatgcaggagcacagcgaccaggtgcctgtgggcaacatccccaggagcatcaccgtgctggtggagggggagaacacccgcatcgcccagcccggggaccacgtgtctgtgacaggcatcttcctgcccatcctgaggacaggcttccggcaggtggtgcagggcctgctgtctgagacctacctggaggcccacagaattgtgaagatgaacaagtcagaagatgatgagagcggggccggggagctgacccgggaggagctgcggcagattgctgaggaggacttctatgagaagctggccgccagcatcgcccctgagatctacggccatgaagatgtgaagaaggccctgctgctgctgctggtgggcggcgtggaccagagcccccggggcatgaagatccggggcaacatcaacatctgcctgatgggagaccccggggtggccaagagccagctgctgagctacatcgaccggctggcccccaggagccagtacaccaccggccggggcagcagcggcgtgggcctgacagctgctgtgctgcgggacagcgtgtctggagagctgaccctggagggcggggccctggtgctggccgaccagggcgtgtgctgcattgatgaatttgacaagatggccgaggccgacagaacagccatccacgaggtgatggagcagcagaccatcagcatcgccaaggccggcatcctgaccaccctgaatgcccgctgcagcatcctggccgccgccaacccagcctacggccgctacaacccccggcgcagcctggagcagaacatccagctgcctgctgccctgctgagcagatttgacctgctgtggctgatccaggacagaccagaccgggacaatgacctgcggctggcccagcacatcacctacgtgcaccagcacagccggcagccccccagccagtttgagcccctggacatgaagctgatgaggcgctacatcgccatgtgccgggagaagcagcccatggtgcctgagagcctggccgactacatcacagctgcctacgtggagatgagaagagaggcctgggccagcaaggatgccacctacaccagcgcccggaccctgctggccatcctgcggctgagcacagccctggcccggctgaggatggtggatgtggtggagaaggaggatgtgaatgaggccatccggctgatggagatgagcaaggacagcctgctgggggacaagggccagacagcccggacccagaggcctgcagatgtgatctttgccaccgtgcgggagctggtgtctgggggccgctctgtgcgcttcagcgaggccgagcagagatgtgtgtcccggggcttcaccccagcccagttccaggccgccctggatgaatatgaggagctgaatgtgtggcaggtgaatgccagcaggacccgcatcacctttgtgtag

SEQ ID NO: 159824 - DNA, 1839 bp, Artificial Sequence
  Description of Artificial Sequence: Synthetic coding sequence
atgatggagcagaggagccgggaccccggcatggtgcgcagcccccagaaccagtacccagctgagctgatgagaagatttgagctgtacttccagggccccagcagcaacaagcccagggtcatccgggaggtgcgggctgacagcgtgggcaagctggtgacagtgcggggcatcgtgaccagggtgtctgaggtgaagcccaagatggtggtggccacctacacctgtgaccagtgtggggctgagacctaccagcccatccagagccccaccttcatgcccctcatcatgtgccccagccaggagtgccagaccaacagaagtggcggccgcctgtacctgcagacccggggcagccgcttcatcaagttccaggagatgaagatgcaggagcacagcgaccaggtgcctgtgggcaacatccccaggagcatcaccgtgctggtggagggggagaacaccagaattgcccagcccggggaccacgtgtctgtgacaggcatcttcctgcccatcctgaggacaggcttccggcaggtggtgcagggcctgctgtctgagacctacctggaggcccaccgcatcgtgaagatgaacaagtcagaagatgatgaaagtggagctggggagctgacccgggaggagctgcggcagattgctgaggaggacttctatgagaagctggccgccagcatcgcccctgagatctacggccatgaagatgtgaagaaggccctgctgctgctgctggtgggcggcgtggaccagagcccccggggcatgaagatccggggcaacatcaacatctgcctgatgggagaccccggggtggccaagagccagctgctgagctacatcgaccggctggcccccaggagccagtacaccaccggccggggcagcagtggagtgggcctgacagctgctgtgctgcgggacagcgtgtctggagagctgaccctggagggcggggccctggtgctggccgaccagggcgtgtgctgcattgatgaatttgacaagatggccgaggccgacagaacagccatccacgaggtgatggagcagcagaccatcagcatcgccaaggccggcatcctgaccaccctgaatgcccgctgcagcatcctggccgccgccaacccagcctacggccgctacaaccccaggaggagcctggagcagaacatccagctgcctgctgccctgctgagcagatttgacctgctgtggctgatccaggacagaccagaccgggacaatgacctgcggctggcccagcacatcacctacgtgcaccagcacagccggcagccccccagccagtttgagcccctggacatgaagctgatgaggcgctacatcgccatgtgccgggagaagcagcccatggtgcctgagagcctggccgactacatcacagctgcctacgtggagatgaggcgggaggcctgggccagcaaggatgccacctacaccagcgcccggaccctgctggccatcctgcggctgagcacagccctggcccggctgaggatggtggatgtggtggagaaggaggatgtgaatgaggccatccggctgatggagatgagcaaggacagcctgctgggggacaagggccagacagcccggacccagaggcctgcagatgtgatctttgccaccgtgcgggagctggtgtctgggggccgctctgtgcgcttcagcgaggccgagcagagatgtgtgtcccggggcttcaccccagcccagttccaggccgccctggatgaatatgaggagctgaatgtgtggcaggtgaatgccagcaggacccgcatcacctttgtgtag

SEQ ID NO: 159825 - DNA, 1971 bp, Artificial Sequence
  Description of Artificial Sequence: Synthetic coding sequence
atgacccccagctggtggacccagtttgtgaggatgcctggggccaccaggagcagcctgctgatgccctactacaaggagcgggaggtggtgaacaaggatgtgctggatgtgtacatcgagcaccggctgatgatggagcagaggagccgggaccccggcatggtgcgcagcccccagaaccagtacccagctgagctgatgagaagatttgagctgtacttccagggccccagcagcaacaagcccagggtcatccgggaggtgcgggctgacagcgtgggcaagctggtgacagtgcggggcatcgtgaccagggtgtctgaggtgaagcccaagatggtggtggccacctacacctgtgaccagtgtggggctgagacctaccagcccatccagagccccaccttcatgcccctcatcatgtgccccagccaggagtgccagaccaacagaagtggcggccgcctgtacctgcagacccggggcagccgcttcatcaagttccaggagatgaagatgcaggagcacagcgaccaggtgcctgtgggcaacatccccaggagcatcaccgtgctggtggagggggagaacaccagaattgcccagcccggggaccacgtgtctgtgacaggcatcttcctgcccatcctgaggacaggcttccggcaggtggtgcagggcctgctgtctgagacctacctggaggcccaccgcatcgtgaagatgaacaagtcagaagatgatgaaagtggagctggggagctgacccgggaggagctgcggcagattgctgaggaggacttctatgagaagctggccgccagcatcgcccctgagatctacggccatgaagatgtgaagaaggccctgctgctgctgctggtgggcggcgtggaccagagcccccggggcatgaagatccggggcaacatcaacatctgcctgatgggagaccccggggtggccaagagccagctgctgagctacatcgaccggctggcccccaggagccagtacaccaccggccggggcagcagtggagtgggcctgacagctgctgtgctgcgggacagcgtgtctggagagctgaccctggagggcggggccctggtgctggccgaccagggcgtgtgctgcattgatgaatttgacaagatggccgaggccgacagaacagccatccacgaggtgatggagcagcagaccatcagcatcgccaaggccggcatcctgaccaccctgaatgcccgctgcagcatcctggccgccgccaacccagcctacggccgctacaaccccaggaggagcctggagcagaacatccagctgcctgctgccctgctgagcagatttgacctgctgtggctgatccaggacagaccagaccgggacaatgacctgcggctggcccagcacatcacctacgtgcaccagcacagccggcagccccccagccagtttgagcccctggacatgaagctgatgaggcgctacatcgccatgtgccgggagaagcagcccatggtgcctgagagcctggccgactacatcacagctgcctacgtggagatgaggcgggaggcctgggccagcaaggatgccacctacaccagcgcccggaccctgctggccatcctgcggctgagcacagccctggcccggctgaggatggtggatgtggtggagaaggaggatgtgaatgaggccatccggctgatggagatgagcaaggacagcctgctgggggacaagggccagacagcccggacccagaggcctgcagatgtgatctttgccaccgtgcgggagctggtgtctgggggccgctctgtgcgcttcagcgaggccgagcagagatgtgtgtcccggggcttcaccccagcccagttccaggccgccctggatgaatatgaggagctgaatgtgtggcaggtgaatgccagcaggacccgcatcacctttgtgtag

SEQ ID NO: 159826 - DNA, 2475 bp, Artificial Sequence
  Description of Artificial Sequence: Synthetic coding sequence
atgaatggagagtaccggggccggggcttcggccggggccgcttccagagctggaagaggggccggggcggcggcaacttcagcggcaagtggagggagcgggagcacaggccagacctgagcaagaccaccgggaagaggaccagcgagcagaccccccagttcctgctgagcaccaagaccccccagagcatgcagagcaccctggaccgcttcatcccctacaagggctggaagctgtacttcagcgaggtgtacagcgacagcagccccctgattgagaagatccaggcctttgagaagttcttcaccaggcacatcgacctgtatgacaaggatgaaattgaaaggaagggcagcatcctggtggacttcaaggagctgacagaaggaggagaggtgaccaacctgatcccagacatcgccacagagctgagagatgcccctgagaagaccctggcctgcatgggcctggccatccaccaggtgctgaccaaggacctggagagacatgctgctgagctgcaggcccaggagggcctgagcaatgatggagagaccatggtgaatgtgccccacatccacgcccgggtgtacaactatgagcccctgacccagctgaagaatgtgcgggccaactactacggcaagtacatcgccctgcggggcaccgtggtgcgggtgagcaacatcaagcccctgtgcaccaagatggccttcctgtgtgccgcctgtggggagatccagagcttccccctgcctgatggcaagtacagcctgcccaccaagtgccctgtgcctgtgtgccggggccgctccttcaccgccctgcggagcagccccctgactgtgaccatggactggcagagcatcaagatccaggagctgatgtctgatgaccagcgggaggccggccgcatccccaggaccattgaatgtgagctggtgcatgacctggtggacagctgtgtgcctggggacacagtgaccatcaccggcatcgtgaaggtgtccaatgctgaggaggccaacagcatcagcaacagcaagggccagaagaccaagagcagtgaagatggctgcaagcacggcatgctgatggagttcagcctgaaggacctgtatgccatccaggagatccaggccgaggagaacctcttcaagctgattgtgaacagcctgtgccctgtgatctttggacatgagctggtgaaggccggcctggccctggccctgtttggaggcagccagaagtatgcagatgacaagaaccgcatccccatccggggggacccccacatcctggtggtgggggaccccggcctgggcaagagccagatgctgcaggccgcctgcaatgtggccccccggggcgtgtatgtgtgtggcaacaccaccaccaccagcggcctgactgtgaccctgagcaaggacagcagcagcggggactttgccctggaggccggggccctggtgctgggggaccagggcatctgtggcattgatgaatttgacaagatgggcaaccagcaccaggccctgctggaggccatggagcagcagagcatcagcctggccaaggccggcgtggtgtgcagcctgcctgcccggaccagcatcatcgctgctgccaaccctgtgggcggccactacaacaaggccaagacagtgtctgagaacctgaagatgggcagcgccctgctgagcagatttgacctggtgttcatcctgctggacaccccaaatgagcaccacgaccacctgctgtctgagcacgtgattgccatccgggccggcaagcagaggaccatcagcagcgccaccgtggccaggatgaacagccaggacagcaacacctctgtgctggaggtggtgtctgagaagcccctgtctgagcggctgaaggtggtgcctggagagaccatcgaccccatcccccaccagctgctgaggaagtacatcggctacgcccggcagtatgtgtacccccggctgagcacagaagctgcccgggtgctgcaggacttctacctggagctgaggaagcagagccagaggctgaacagcagccccatcaccacccggcagctggagagcctcatccggctgacagaggcccgggcccggctggagctgcgggaggaggccaccaaggaggatgctgaggacatcgtggagatcatgaagtacagcatgctgggcacctacagtgatgaatttggaaacctggactttgagaggagccagcacggcagcggcatgagcaacagaagcacagccaagcgcttcatcagcgccctgaacaacgtggccgagaggacctacaacaacatcttccagttccaccagctgcggcagatcgccaaggagctgaacatccaggtggccgactttgagaacttcatcggcagcctgaatgaccagggctacctgctgaagaagggccccaaggtgtaccagctgcagaccatgtag

SEQ ID NO: 159827 - DNA, 2382 bp, Artificial Sequence
  Description of Artificial Sequence: Synthetic coding sequence
atgaatggagagtaccggggccggggcttcggccggggccgcttccagagctggaagaggggccggggcggcggcaacttcagcggcaagtggagggagcgggagcacaggccagacctgagcaagaccaccgggaagaggaccagcgagcagaccccccagttcctgctgagcaccaagaccccccagagcatgcagagcaccctggaccgcttcatcccctacaagggctggaagctgtacttcagcgaggtgtacagcgacagcagccccctgattgagaagatccaggcctttgagaagttcttcaccaggcacatcgacctgtatgacaaggatgaaattgaaaggaagggcagcatcctggtggacttcaaggagctgacagaaggaggagaggtgaccaacctgatcccagacatcgccacagagctgagagatgcccctgagaagaccctggcctgcatgggcctggccatccaccaggtgctgaccaaggacctggagagacatgctgctgagctgcaggcccaggagggcctgagcaatgatggagagaccatggtgaatgtgccccacatccacgcccgggtgtacaactatgagcccctgacccagctgaagaatgtgcgggccaactactacggcaagtacatcgccctgcggggcaccgtggtgcgggtgagcaacatcaagcccctgtgcaccaagatggccttcctgtgtgccgcctgtggggagatccagagcttccccctgcctgatggcaagtacagcctgcccaccaagtgccctgtgcctgtgtgccggggccgctccttcaccgccctgcggagcagccccctgactgtgaccatggactggcagagcatcaagatccaggagctgatgtctgatgaccagcgggaggccggccgcatccccaggaccattgaatgtgagctggtgcatgacctggtggacagctgtgtgcctggggacacagtgaccatcaccggcatcgtgaaggtgtccaatgctgaggagggcagcaggaacaagaatgacaagtgcatgttcctgctgtacatcgaggccaacagcatcagcaacagcaagggccagaagaccaagagcagtgaagatggctgcaagcacggcatgctgatggagttcagcctgaaggacctgtatgccatccaggagatccaggccgaggagaacctcttcaagctgattgtgaacagcctgtgccctgtgatctttggacatgaagctgcctgcaatgtggccccccggggcgtgtatgtgtgtggcaacaccaccaccaccagcggcctgactgtgaccctgagcaaggacagcagcagcggggactttgccctggaggccggggccctggtgctgggggaccagggcatctgtggcattgatgaatttgacaagatgggcaaccagcaccaggccctgctggaggccatggagcagcagagcatcagcctggccaaggccggcgtggtgtgcagcctgcctgcccggaccagcatcatcgccgccgccaaccctgtgggcggccactacaacaaggccaagacagtgtctgagaacctgaagatgggcagcgccctgctgagcagatttgacctggtgttcatcctgctggacaccccaaatgagcaccacgaccacctgctgtctgaacatgtgattgccatccgggccggcaagcagaggaccatcagcagcgccaccgtggccaggatgaacagccaggacagcaacacctctgtgctggaggtggtgtctgagaagcccctgtctgagcggctgaaggtggtgcctggagagaccatcgaccccatcccccaccagctgctgaggaagtacatcggctacgcccggcagtatgtgtacccccggctgagcacagaggccgcccgggtgctgcaggacttctacctggagctgaggaagcagagccagaggctgaacagcagccccatcaccacccggcagctggagagcctcatccggctgacagaggcccgggcccggctggagctgcgggaggaggccaccaaggaggatgctgaagatattgtggagatcatgaagtacagcatgctgggcacctacagtgatgaatttggaaacctggactttgagaggagccagcacggcagcggcatgagcaacagaagcacagccaagcgcttcatcagcgccctgaacaacgtggccgagaggacctacaacaacatcttccagttccaccagctgcggcagatcgccaaggagctgaacatccaggtggccgactttgagaacttcatcggcagcctgaatgaccagggctacctgctgaagaagggccccaaggtgtaccagctgcagaccatgtag

SEQ ID NO: 159828 - DNA, 2643 bp, Artificial Sequence
  Description of Artificial Sequence: Synthetic coding sequence
atgaatggagagtaccggggccggggcttcggccggggccgcttccagagctggaagaggggccggggcggcggcaacttcagcggcaagtggagggagcgggagcacaggccagacctgagcaagaccaccgggaagaggaccagcgagcagaccccccagttcctgctgagcaccaagaccccccagagcatgcagagcaccctggaccgcttcatcccctacaagggctggaagctgtacttcagcgaggtgtacagcgacagcagccccctgattgagaagatccaggcctttgagaagttcttcaccaggcacatcgacctgtatgacaaggatgaaattgaaaggaagggcagcatcctggtggacttcaaggagctgacagaaggaggagaggtgaccaacctgatcccagacatcgccacagagctgagagatgcccctgagaagaccctggcctgcatgggcctggccatccaccaggtgctgaccaaggacctggagagacatgctgctgagctgcaggcccaggagggcctgagcaatgatggagagaccatggtgaatgtgccccacatccacgcccgggtgtacaactatgagcccctgacccagctgaagaatgtgcgggccaactactacggcaagtacatcgccctgcggggcaccgtggtgcgggtgagcaacatcaagcccctgtgcaccaagatggccttcctgtgtgccgcctgtggggagatccagagcttccccctgcctgatggcaagtacagcctgcccaccaagtgccctgtgcctgtgtgccggggccgctccttcaccgccctgcggagcagccccctgactgtgaccatggactggcagagcatcaagatccaggagctgatgtctgatgaccagcgggaggccggccgcatccccaggaccattgaatgtgagctggtgcatgacctggtggacagctgtgtgcctggggacacagtgaccatcaccggcatcgtgaaggtgtccaatgctgaggagggcagcaggaacaagaatgacaagtgcatgttcctgctgtacatcgaggccaacagcatcagcaacagcaagggccagaagaccaagagcagtgaagatggctgcaagcacggcatgctgatggagttcagcctgaaggacctgtatgccatccaggagatccaggccgaggagaacctcttcaagctgattgtgaagtggagcctggccctgagcccccggctggagtacagcggggccatcagcgcccactgcaacctgcacctgcccagcagcaacagcagccccaccagcgcctgccgggtggccggcaccaccggcatgaggcaccagacccagctgctgctgctggtgaaggccggcctggccctggccctgtttggaggcagccagaagtatgcagatgacaagaaccgcatccccatccggggggacccccacatcctggtggtgggggaccccggcctgggcaagagccagatgctgcaggccgcctgcaatgtggccccccggggcgtgtatgtgtgtggcaacaccaccaccaccagcggcctgactgtgaccctgagcaaggacagcagcagcggggactttgccctggaggccggggccctggtgctgggggaccagggcatctgtggcattgatgaatttgacaagatgggcaaccagcaccaggccctgctggaggccatggagcagcagagcatcagcctggccaaggccggcgtggtgtgcagcctgcctgcccggaccagcatcatcgctgctgccaaccctgtgggcggccactacaacaaggccaagacagtgtctgagaacctgaagatgggcagcgccctgctgagcagatttgacctggtgttcatcctgctggacaccccaaatgagcaccacgaccacctgctgtctgagcacgtgattgccatccgggccggcaagcagaggaccatcagcagcgccaccgtggccaggatgaacagccaggacagcaacacctctgtgctggaggtggtgtctgagaagcccctgtctgagcggctgaaggtggtgcctggagagaccatcgaccccatcccccaccagctgctgaggaagtacatcggctacgcccggcagtatgtgtacccccggctgagcacagaagctgcccgggtgctgcaggacttctacctggagctgaggaagcagagccagaggctgaacagcagccccatcaccacccggcagctggagagcctcatccggctgacagaggcccgggcccggctggagctgcgggaggaggccaccaaggaggatgctgaggacatcgtggagatcatgaagtacagcatgctgggcacctacagtgatgaatttggaaacctggactttgagaggagccagcacggcagcggcatgagcaacagaagcacagccaagcgcttcatcagcgccctgaacaacgtggccgagaggacctacaacaacatcttccagttccaccagctgcggcagatcgccaaggagctgaacatccaggtggccgactttgagaacttcatcggcagcctgaatgaccagggctacctgctgaagaagggccccaaggtgtaccagctgcagaccatgtag

SEQ ID NO: 159829 - DNA, 2523 bp, Artificial Sequence
  Description of Artificial Sequence: Synthetic coding sequence
atgaatggagagtaccggggccggggcttcggccggggccgcttccagagctggaagaggggccggggcggcggcaacttcagcggcaagtggagggagcgggagcacaggccagacctgagcaagaccaccgggaagaggaccagcgagcagaccccccagttcctgctgagcaccaagaccccccagagcatgcagagcaccctggaccgcttcatcccctacaagggctggaagctgtacttcagcgaggtgtacagcgacagcagccccctgattgagaagatccaggcctttgagaagttcttcaccaggcacatcgacctgtatgacaaggatgaaattgaaaggaagggcagcatcctggtggacttcaaggagctgacagaaggaggagaggtgaccaacctgatcccagacatcgccacagagctgagagatgcccctgagaagaccctggcctgcatgggcctggccatccaccaggtgctgaccaaggacctggagagacatgctgctgagctgcaggcccaggagggcctgagcaatgatggagagaccatggtgaatgtgccccacatccacgcccgggtgtacaactatgagcccctgacccagctgaagaatgtgcgggccaactactacggcaagtacatcgccctgcggggcaccgtggtgcgggtgagcaacatcaagcccctgtgcaccaagatggccttcctgtgtgccgcctgtggggagatccagagcttccccctgcctgatggcaagtacagcctgcccaccaagtgccctgtgcctgtgtgccggggccgctccttcaccgccctgcggagcagccccctgactgtgaccatggactggcagagcatcaagatccaggagctgatgtctgatgaccagcgggaggccggccgcatccccaggaccattgaatgtgagctggtgcatgacctggtggacagctgtgtgcctggggacacagtgaccatcaccggcatcgtgaaggtgtccaatgctgaggagggcagcaggaacaagaatgacaagtgcatgttcctgctgtacatcgaggccaacagcatcagcaacagcaagggccagaagaccaagagcagtgaagatggctgcaagcacggcatgctgatggagttcagcctgaaggacctgtatgccatccaggagatccaggccgaggagaacctcttcaagctgattgtgaacagcctgtgccctgtgatctttggacatgagctggtgaaggccggcctggccctggccctgtttggaggcagccagaagtatgcagatgacaagaaccgcatccccatccggggggacccccacatcctggtggtgggggaccccggcctgggcaagagccagatgctgcaggccgcctgcaatgtggccccccggggcgtgtatgtgtgtggcaacaccaccaccaccagcggcctgactgtgaccctgagcaaggacagcagcagcggggactttgccctggaggccggggccctggtgctgggggaccagggcatctgtggcattgatgaatttgacaagatgggcaaccagcaccaggccctgctggaggccatggagcagcagagcatcagcctggccaaggccggcgtggtgtgcagcctgcctgcccggaccagcatcatcgctgctgccaaccctgtgggcggccactacaacaaggccaagacagtgtctgagaacctgaagatgggcagcgccctgctgagcagatttgacctggtgttcatcctgctggacaccccaaatgagcaccacgaccacctgctgtctgagcacgtgattgccatccgggccggcaagcagaggaccatcagcagcgccaccgtggccaggatgaacagccaggacagcaacacctctgtgctggaggtggtgtctgagaagcccctgtctgagcggctgaaggtggtgcctggagagaccatcgaccccatcccccaccagctgctgaggaagtacatcggctacgcccggcagtatgtgtacccccggctgagcacagaagctgcccgggtgctgcaggacttctacctggagctgaggaagcagagccagaggctgaacagcagccccatcaccacccggcagctggagagcctcatccggctgacagaggcccgggcccggctggagctgcgggaggaggccaccaaggaggatgctgaggacatcgtggagatcatgaagtacagcatgctgggcacctacagtgatgaatttggaaacctggactttgagaggagccagcacggcagcggcatgagcaacagaagcacagccaagcgcttcatcagcgccctgaacaacgtggccgagaggacctacaacaacatcttccagttccaccagctgcggcagatcgccaaggagctgaacatccaggtggccgactttgagaacttcatcggcagcctgaatgaccagggctacctgctgaagaagggccccaaggtgtaccagctgcagaccatgtag

SEQ ID NO: 159830 - DNA, 612 bp, Artificial Sequence
  Description of Artificial Sequence: Synthetic coding sequence
atgaatggagagtaccggggccggggcttcggccggggccgcttccagagctggaagaggggccggggcggcggcaacttcagcggcaagtggagggagcgggagcacaggccagacctgagcaagaccaccgggaagaggaccagcgagcagaccccccagttcctgctgagcaccaagaccccccagagcatgcagagcaccctggaccgcttcatcccctacaagggctggaagctgtacttcagcgaggtgtacagcgacagcagccccctgattgagaagatccaggcctttgagaagttcttcaccaggcacatcgacctgtatgacaaggatgaaattgaaaggaagggcagcatcctggtggacttcaaggagctgacagaaggaggagaggtgaccaacctgatcccagacatcgccacagagctgagagatgcccctgagaagaccctggcctgcatgggcctggccatccaccaggtgctgaccaaggacctggagagacatgctgctgagctgcaggcccaggagggcctgagcaatgatggagagaccatggtgaatgtgccccacatccacttcctgaagaagaagaagaagatctag

SEQ ID NO: 159831 - DNA, 1329 bp, Artificial Sequence
  Description of Artificial Sequence: Synthetic coding sequence
atggagaactggagcaaggacatcacccacagctacctggagcaggagaccaccggcatcaacaagagcacccagccagatgagcagctgaccatgaacagcgagaagtccatgcacaggaagagcacagagctggtgaatgagatcacctgtgagaacacagagtggccaggccagaggagcaccaacttccagatcatcagcagctacccagatgatgaatctgtgtactgcaccacagagaagtacaacgtgatggagcaccgccacaatgacatgcactatgagtgcatgaccccctgccaggtgaccagtgacagcgacaaggagaagaccatcgccttcctgctgaaggagctggacatcctgcggaccagcaacaagaagctgcagcagaagctggccaaggaggacaaggagcagaggaagctgaagttcaagctggagctgcaggagaaggagacagaggccaagattgctgagaagacagctgccctggtggaggaggtgtactttgcccagaaggagagagatgaggccgtgatgagccggctgcagctggccatcgaggagagagatgaggccatcgcccgggccaagcacatggagatgagcctgaaggtgctggagaacatcaaccctgaggagaatgacatgaccctgcaggagctgctgaaccgcatcaacaatgctgacacaggaattgccatccagaagaatggagccatcatcgtggaccgcatctacaagaccaaggagtgcaagatgaggatcacagctgaggagatgtctgccctgattgaggagagagatgctgccctgagcaagtgcaagaggctggagcaggagctgcaccacgtgaaggagcagaaccagaccagcgccaacaacatgaggcacctgacagctgagaacaaccaggagcgggccctgaaggccaagctgctgtccatgcagcaggcccgggagacagctgtgcagcagtacaagaagctggaggaggagatccagaccctgcgggtgtactacagcctgcacaagagcctgagccaggaggagaacctgaaggaccagttcaactacaccctgagcacctatgaggaggccctgaagaaccgggagaacatcgtgtccatcacccagcagcagaatgaggagctggccacccagctgcagcaggccctgacagagcgggccaacatggagctgcagctgcagcacgcccgggaggccagccaggtggccaatgagaaggtgcagaagctggagcggctggtggatgtgctgaggaagaaggtgggcaccggcaccatgaggacagtcatctag

SEQ ID NO: 159832 - DNA, 1329 bp, Artificial Sequence; identical to SEQ ID NO: 159831
  Description of Artificial Sequence: Synthetic coding sequence

SEQ ID NO: 159833 - DNA, 786 bp, Artificial Sequence
  Description of Artificial Sequence: Synthetic coding sequence
atgagccggctgcagctggccatcgaggagagagatgaggccatcgcccgggccaagcacatggagatgagcctgaaggtgctggagaacatcaacccagaagaaaatgacatgaccctgcaggagctgctgaaccgcatcaacaatgctgacaccggcatcgccatccagaagaatggagccatcatcgtggaccgcatctacaagaccaaggagtgcaagatgaggatcacagctgaggagatgtctgccctgattgaggagagagatgctgccctgagcaagtgcaagaggctggagcaggagctgcaccacgtgaaggagcagaaccagaccagcgccaacaacatgaggcacctgacagctgagaacaaccaggagcgggccctgaaggccaagctgctgtccatgcagcaggcccgggagacagctgtgcagcagtacaagaagctggaggaggagatccagaccctgcgggtgtactacagcctgcacaagagcctgagccaggaggagaacctgaaggaccagttcaactacaccctgagcacctatgaggaggccctgaagaacagagaaaatattgtgtccatcacccagcagcagaatgaggagctggccacccagctgcagcaggccctgacagagcgggccaacatggagctgcagctgcagcacgcccgggaggccagccaggtggccaatgagaaggtgcagaagctggagcggctggtggatgtgctgaggaagaaggtgggcaccggcaccatgaggacagtcatctag

SEQ ID NO: 159834 - DNA, 1329 bp, Artificial Sequence; identical to SEQ ID NO: 159831
  Description of Artificial Sequence: Synthetic coding sequence

SEQ ID NO: 159835 - DNA, 1275 bp, Artificial Sequence
  Description of Artificial Sequence: Synthetic coding sequence
atgaacagcgagaagtccatgcacaggaagagcacagagctggtgaatgagatcacctgtgaaaatacagagtggccaggccagaggagcaccaacttccagatcatcagcagctacccagatgatgagagcgtgtactgcaccacagagaagtacaacgtgatggagcaccgccacaatgacatgcactatgagtgcatgaccccctgccaggtgaccagtgacagcgacaaggagaagaccatcgccttcctgctgaaggagctggacatcctgcggaccagcaacaagaagctgcagcagaagctggccaaggaggacaaggagcagaggaagctgaagttcaagctggagctgcaggagaaggagacagaggccaagattgctgagaagacagctgccctggtggaggaggtgtactttgcccagaaggagagagatgaagctgtgatgagccggctgcagctggccatcgaggagagagatgaggccatcgcccgggccaagcacatggagatgagcctgaaggtgctggagaacatcaacccagaagaaaatgacatgaccctgcaggagctgctgaaccgcatcaacaatgctgacaccggcatcgccatccagaagaatggagccatcatcgtggaccgcatctacaagaccaaggagtgcaagatgaggatcacagctgaggagatgtctgccctgattgaggagagagatgctgccctgagcaagtgcaagaggctggagcaggagctgcaccacgtgaaggagcagaaccagaccagcgccaacaacatgaggcacctgacagctgagaacaaccaggagcgggccctgaaggccaagctgctgtccatgcagcaggcccgggagacagctgtgcagcagtacaagaagctggaggaggagatccagaccctgcgggtgtactacagcctgcacaagagcctgagccaggaggagaacctgaaggaccagttcaactacaccctgagcacctatgaggaggccctgaagaacagagaaaatattgtgtccatcacccagcagcagaatgaggagctggccacccagctgcagcaggccctgacagagcgggccaacatggagctgcagctgcagcacgcccgggaggccagccaggtggccaatgagaaggtgcagaagagccagatccagatctacttcatccccaacaagaaggatgagcgggagaagttcctgatggacaagaggaggaagatcgtggcccacagcaagcagaacagctag

SEQ ID NO: 159836 - DNA, 315 bp, Artificial Sequence
  Description of Artificial Sequence: Synthetic coding sequence
atggagaactggagcaaggacatcacccacagctacctggagcaggagaccaccggcatcaacaagagcacccagccagatgagcagctgaccatgaacagcgagaagtccatgcacaggaagagcacagagctggtgaatgagatcacctgtgagaacacagagtggccaggccagaggagcaccaacttccagatcatcagcagctacccagatgatgaatctgtgtactgcaccacagagaagtacaacgtgatggagcaccgccacaatgacatgcactatgagtgcatgaccccctgccaggtgacctag

SEQ ID NO: 159837 - DNA, 387 bp, Artificial Sequence
  Description of Artificial Sequence: Synthetic coding sequence
atggagaactggagcaaggacatcacccacagctacctggagcaggagaccaccggcatcaacaagagcacccagccagatgagcagctgaccatgaacagcgagaagtccatgcacaggaagagcacagagctggtgaatgagatcacctgtgagaacacagagtggccaggccagaggagcaccaacttccagatcatcagcagctacccagatgatgaatctgtgtactgcaccacagagaagtacaacgtgatggagcaccgccacaatgacatgcactatgagtgcatgaccccctgccaggtgaccagtgacagcgacaaggagaagaccatcgccttcctgctgaaggagctggacatcctgcggaccagcaacaagtag

SEQ ID NO: 159838 - DNA, 3912 bp, Artificial Sequence
  Description of Artificial Sequence: Synthetic coding sequence
atgggagaccctgccccagcccggagcctggatgacatcgacctgagcgccctgcgggaccctgctggcatctttgagctggtggaggtggtgggcaatggcacctacggccaggtgtacaagggccgccacgtgaagacaggccagctggccgccatcaaggtgatggatgtgacagaagatgaggaggaggagatcaagcaggagatcaacatgctgaagaagtacagccaccacaggaacatcgccacctactacggggccttcatcaagaagagccccccaggaaatgatgaccagctgtggctggtgatggagttctgtggggccggctctgtgacagacctggtgaagaacaccaagggaaatgccctgaaggaggactgcatcgcctacatctgccgggagatcctgcggggcctggcccacctgcacgcccacaaggtgatccaccgggacatcaagggccagaatgtgctgctgacagaaaatgctgaggtgaagctggtggactttggagtgtctgcccagctggacagaacagtgggcagaagaaacaccttcatcggcaccccctactggatggcccctgaggtgattgcctgtgatgagaacccagatgccacctatgactacagaagtgacatctggagcctgggcatcacagccatcgagatggccgagggcgccccacccctgtgtgacatgcaccccatgagggccctcttcctgatccccagaaatcctccaccccggctgaagagcaagaagtggagcaagaagttcatcgacttcatcgacacctgcctgatcaagacctacctgagccggcccccaacagagcagctgctgaagttccccttcatccgggaccagcccacagagcggcaggtgcgcatccagctgaaggaccacatcgacaggagcaggaagaagagaggagagaaggaggagacagaatatgagtacagcggcagcgaggaggaggatgacagccatggagaggagggggagcccagcagcatcatgaatgtgcctggagagagcaccctgcggcgggagttcctgcggctgcagcaggagaacaagagcaacagcgaggccctgaagcagcagcagcagctgcagcagcagcagcagagggaccctgaggcccacatcaagcacctgctgcaccagaggcagaggcgcatcgaggagcagaaggaggagcggcggcgggtggaggagcagcagaggcgggagcgggagcagaggaagctgcaggagaaggagcagcagaggcggctggaggacatgcaggccctgcggcgggaggaggagcggcggcaggccgagcgggagcaggagtacaagaggaagcagctggaggagcagaggcagagcgagcggctgcagaggcagctgcagcaggagcacgcctacctgaagagcctgcagcagcagcagcagcagcagcagctgcagaagcagcagcagcagcagctgctgcccggggacaggaagcccctgtaccactacggccggggcatgaacccagctgacaagccagcctgggcccgggaggtggaggagaggaccaggatgaacaagcagcagaacagccccctggccaagagcaagccaggcagcactggacctgagccccccatcccccaggccagccctggccccccaggccccctgagccagaccccacccatgcagaggcctgtggagccccaggagggcccccacaagagcctggtggcccaccgggtgcccctgaagccctatgctgcccctgtgcccaggagccagagcctgcaggaccagcccaccaggaacctggccgccttccctgccagccatgaccctgaccctgccatcccagcccccacagccaccccatctgcccggggagctgtgatccggcagaacagcgaccccaccagcgagggccctggccccagccccaaccccccagcctgggtgcggccagacaatgaggccccacccaaggtgccccagaggaccagcagcatcgccacagccctgaacaccagcggggccggcggcagcaggcctgcccaggccgtgcgggccagcaacccagacctgcggcggagtgaccccggctgggagaggagtgacagcgtgctgcctgccagccacggccacctgccccaggccggcagcctggagaggaacagagtgggcgtgagcagcaagccagacagcagccctgtgctgagccctggcaacaaggccaagccagatgaccacaggagcaggcctggccggcctgccagctacaagagggccatcggagaagattttgtgctgctgaaggagaggaccctggatgaggcccccaggcctcccaagaaggccatggactacagcagcagcagcgaggaggtggagagcagtgaagatgatgaggaggagggggagggcggccctgctgagggcagccgggacaccccaggcggccgcagtgatggagacacagattctgtgtccaccatggtggtgcatgatgtggaggagatcaccggcacccagcccccctacggcggcggcaccatggtggtgcagaggaccccagaggaggagaggaacctgctgcacgccgacagcaatggctacaccaacctgcctgatgtggtgcagcccagccacagccccacagagaacagcaagggccagagcccccccagcaaggatggcagcggggactaccagagccggggcctggtgaaggcccctgggaagagcagcttcaccatgtttgtggacctgggcatctaccagcccggcggcagcggggacagcatccccatcacagccctggtgggcggggagggcacccggctggaccagctgcagtatgatgtgaggaagggctctgtggtgaatgtgaaccccaccaacacccgggcccacagcgagaccccagagatcaggaagtacaagaagcgcttcaacagcgagatcctgtgtgccgccctgtggggcgtgaacctgctggtgggcacagaaaatggcctgatgctgctggacagaagtggccagggcaaggtgtatggcctcatcggcagaagacgcttccagcagatggatgtgctggagggcctgaacctgctgatcaccatcagcggcaagaggaacaagctgcgggtgtactacctgtcctggctgaggaacaagatcctgcacaatgaccctgaggtggagaagaagcagggctggaccaccgtgggggacatggagggctgcggccactacagagtggtgaagtatgagcgcatcaagttcctggtgattgccctgaagagctctgtggaggtgtatgcctgggcccccaagccctaccacaagttcatggccttcaagagctttgctgacctgccccaccggcccctgctggtggacctgactgtggaggagggccagaggctgaaggtgatctacggcagcagcgctggcttccacgctgtggatgtggacagcggcaacagctatgacatctacatccctgtgcacatccagagccagatcaccccccacgccatcatcttcctgcccaacacagatggcatggagatgctgctgtgctatgaagatgaaggagtgtatgtgaacacctacggccgcatcatcaaggatgtggtgctgcagtggggcgagatgcccacctctgtggcctacatctgcagcaaccagatcatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgtacttcatgaccctgaacagaaactgcatcatgaactggtag

SEQ ID NO: 159839 - DNA, 3999 bp, Artificial Sequence
  Description of Artificial Sequence: Synthetic coding sequence
atgggagaccctgccccagcccggagcctggatgacatcgacctgagcgccctgcgggaccctgctggcatctttgagctggtggaggtggtgggcaatggcacctacggccaggtgtacaagggccgccacgtgaagacaggccagctggccgccatcaaggtgatggatgtgacagaagatgaggaggaggagatcaagcaggagatcaacatgctgaagaagtacagccaccacaggaacatcgccacctactacggggccttcatcaagaagagccccccaggaaatgatgaccagctgtggctggtgatggagttctgtggggccggctctgtgacagacctggtgaagaacaccaagggaaatgccctgaaggaggactgcatcgcctacatctgccgggagatcctgcggggcctggcccacctgcacgcccacaaggtgatccaccgggacatcaagggccagaatgtgctgctgacagaaaatgctgaggtgaagctggtggactttggagtgtctgcccagctggacagaacagtgggcagaagaaacaccttcatcggcaccccctactggatggcccctgaggtgattgcctgtgatgagaacccagatgccacctatgactacagaagtgacatctggagcctgggcatcacagccatcgagatggccgagggcgccccacccctgtgtgacatgcaccccatgagggccctcttcctgatccccagaaatcctccaccccggctgaagagcaagaagtggagcaagaagttcatcgacttcatcgacacctgcctgatcaagacctacctgagccggcccccaacagagcagctgctgaagttccccttcatccgggaccagcccacagagcggcaggtgcgcatccagctgaaggaccacatcgacaggagcaggaagaagagaggagagaaggaggagacagaatatgagtacagcggcagcgaggaggaggatgacagccatggagaggagggggagcccagcagcatcatgaatgtgcctggagagagcaccctgcggcgggagttcctgcggctgcagcaggagaacaagagcaacagcgaggccctgaagcagcagcagcagctgcagcagcagcagcagagggaccctgaggcccacatcaagcacctgctgcaccagaggcagaggcgcatcgaggagcagaaggaggagcggcggcgggtggaggagcagcagaggcgggagcgggagcagaggaagctgcaggagaaggagcagcagaggcggctggaggacatgcaggccctgcggcgggaggaggagcggcggcaggccgagcgggagcaggagtacaagaggaagcagctggaggagcagaggcagagcgagcggctgcagaggcagctgcagcaggagcacgcctacctgaagagcctgcagcagcagcagcagcagcagcagctgcagaagcagcagcagcagcagctgctgcccggggacaggaagcccctgtaccactacggccggggcatgaacccagctgacaagccagcctgggcccgggaggtggaggagaggaccaggatgaacaagcagcagaacagccccctggccaagagcaagccaggcagcactggacctgagccccccatcccccaggccagccctggccccccaggccccctgagccagaccccacccatgcagaggcctgtggagccccaggagggcccccacaagagcctggtggcccaccgggtgcccctgaagccctatgctgcccctgtgcccaggagccagagcctgcaggaccagcccaccaggaacctggccgccttccctgccagccatgaccctgaccctgccatcccagcccccacagccaccccatctgcccggggagctgtgatccggcagaacagcgaccccaccagcgagggccctggccccagccccaaccccccagcctgggtgcggccagacaatgaggccccacccaaggtgccccagaggaccagcagcatcgccacagccctgaacaccagcggggccggcggcagcaggcctgcccaggccgtgcgggcccggcccaggagcaacagcgcctggcagatctacctgcagaggagagctgagcggggcacccccaagcccccaggccccccagcccagcccccaggccccccaaatgccagcagcaacccagacctgcggcggagtgaccccggctgggagaggagtgacagcgtgctgcctgccagccacggccacctgccccaggccggcagcctggagaggaacagagtgggcgtgagcagcaagccagacagcagccctgtgctgagccctggcaacaaggccaagccagatgaccacaggagccggcccggccggcctgctgactttgtgctgctgaaggagaggaccctggatgaggccccccggccccccaagaaggccatggactacagcagcagcagcgaggaggtggagagcagtgaagatgatgaggaggagggggagggcggccctgctgagggcagccgggacacccctgggggccgcagtgatggagacacagacagcgtgtccaccatggtggtgcatgatgtggaggagatcaccggcacccagcccccctatggaggcggcaccatggtggtgcagaggaccccagaggaggagaggaacctgctgcatgctgacagcaatggctacaccaacctgcctgatgtggtgcagcccagccacagccccacagagaacagcaagggccagagcccccccagcaaggatggcagcggggactaccagagccggggcctggtgaaggcccctgggaagagcagcttcaccatgtttgtggacctgggcatctaccagcccggcggcagcggggacagcatccccatcacagccctggtgggcggggagggcacccggctggaccagctgcagtatgatgtgaggaaaggatctgtggtgaatgtgaaccccaccaacacccgggcccacagcgagaccccagagatcaggaagtacaagaagcgcttcaacagcgagatcctgtgtgccgccctgtggggcgtgaacctgctggtgggcacagaaaatggcctgatgctgctggacaggagcggccagggcaaggtgtatggcctgattggaagaagacgcttccagcagatggatgtgctggagggcctgaacctgctgatcaccatcagcggcaagaggaacaagctgcgggtgtactacctgtcctggctgaggaacaagatcctgcacaatgaccctgaggtggagaagaagcagggctggaccaccgtgggggacatggagggctgcggccactacagagtggtgaagtatgaaagaatcaagttcctggtgattgccctgaagagctctgtggaggtgtatgcctgggcccccaagccctaccacaagttcatggccttcaagagctttgctgacctgccccaccggcccctgctggtggacctgactgtggaggagggccagaggctgaaggtgatctacggcagcagcgctggcttccacgctgtggatgtggacagcggcaacagctatgacatctacatccctgtgcacatccagagccagatcacccctcatgccatcatcttcctgcccaacacagatggcatggagatgctgctgtgctatgaagatgagggcgtgtatgtgaacacctacggccgcatcatcaaggatgtggtgctgcagtggggcgagatgcccacctctgtggcctacatctgcagcaaccagatcatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgtacttcatgaccctgaacagaaactgcatcatgaactggtag

SEQ ID NO: 159840 - DNA, 3939 bp, Artificial Sequence
  Description of Artificial Sequence: Synthetic coding sequence
atgggagaccctgccccagcccggagcctggatgacatcgacctgagcgccctgcgggaccctgctggcatctttgagctggtggaggtggtgggcaatggcacctacggccaggtgtacaagggccgccacgtgaagacaggccagctggccgccatcaaggtgatggatgtgacagaagatgaggaggaggagatcaagcaggagatcaacatgctgaagaagtacagccaccacaggaacatcgccacctactacggggccttcatcaagaagagccccccaggaaatgatgaccagctgtggctggtgatggagttctgtggggccggctctgtgacagacctggtgaagaacaccaagggaaatgccctgaaggaggactgcatcgcctacatctgccgggagatcctgcggggcctggcccacctgcacgcccacaaggtgatccaccgggacatcaagggccagaatgtgctgctgacagaaaatgctgaggtgaagctggtggactttggagtgtctgcccagctggacagaacagtgggcagaagaaacaccttcatcggcaccccctactggatggcccctgaggtgattgcctgtgatgagaacccagatgccacctatgactacagaagtgacatctggagcctgggcatcacagccatcgagatggccgagggcgccccacccctgtgtgacatgcaccccatgagggccctcttcctgatccccagaaatcctccaccccggctgaagagcaagaagtggagcaagaagttcatcgacttcatcgacacctgcctgatcaagacctacctgagccggcccccaacagagcagctgctgaagttccccttcatccgggaccagcccacagagcggcaggtgcgcatccagctgaaggaccacatcgacaggagcaggaagaagagaggagagaaggaggagacagaatatgagtacagcggcagcgaggaggaggatgacagccatggagaggagggggagcccagcagcatcatgaatgtgcctggagagagcaccctgcggcgggagttcctgcggctgcagcaggagaacaagagcaacagcgaggccctgaagcagcagcagcagctgcagcagcagcagcagagggaccctgaggcccacatcaagcacctgctgcaccagaggcagaggcgcatcgaggagcagaaggaggagcggcggcgggtggaggagcagcagaggcgggagcgggagcagaggaagctgcaggagaaggagcagcagaggcggctggaggacatgcaggccctgcggcgggaggaggagcggcggcaggccgagcgggagcaggagtacaagaggaagcagctggaggagcagaggcagagcgagcggctgcagaggcagctgcagcaggagcacgcctacctgaagagcctgcagcagcagcagcagcagcagcagctgcagaagcagcagcagcagcagctgctgcccggggacaggaagcccctgtaccactacggccggggcatgaacccagctgacaagccagcctgggcccgggaggtggaggagaggaccaggatgaacaagcagcagaacagccccctggccaagagcaagccaggcagcactggacctgagccccccatcccccaggccagccctggccccccaggccccctgagccagaccccacccatgcagaggcctgtggagccccaggagggcccccacaagagcctgcaggaccagcccaccaggaacctggccgccttccctgccagccatgaccctgaccctgccatcccagcccccacagccaccccatctgcccggggagctgtgatccggcagaacagcgaccccaccagcgagggccctggccccagccccaaccccccagcctgggtgcggccagacaatgaggccccacccaaggtgccccagaggaccagcagcatcgccacagccctgaacaccagcggggccggcggcagcaggcctgcccaggccgtgcgggcccggcccaggagcaacagcgcctggcagatctacctgcagaggagagctgagcggggcacccccaagcccccaggccccccagcccagcccccaggccccccaaatgccagcagcaacccagacctgcggcggagtgaccccggctgggagaggagtgacagcgtgctgcctgccagccacggccacctgccccaggccggcagcctggagaggaacagagtgggcgtgagcagcaagccagacagcagccctgtgctgagccctggcaacaaggccaagccagatgaccacaggagccggcccggccggcctgctgactttgtgctgctgaaggagaggaccctggatgaggccccccggccccccaagaaggccatggactacagcagcagcagcgaggaggtggagagcagtgaagatgatgaggaggagggggagggcggccctgctgagggcagccgggacacccctgggggccgcagtgatggagacacagacagcgtgtccaccatggtggtgcatgatgtggaggagatcaccggcacccagcccccctatggaggcggcaccatggtggtgcagaggaccccagaggaggagaggaacctgctgcatgctgacagcaatggctacaccaacctgcctgatgtggtgcagcccagccacagccccacagagaacagcaagggccagagcccccccagcaaggatggcagcggggactaccagagccggggcctggtgaaggcccctgggaagagcagcttcaccatgtttgtggacctgggcatctaccagcccggcggcagcggggacagcatccccatcacagccctggtgggcggggagggcacccggctggaccagctgcagtatgatgtgaggaaaggatctgtggtgaatgtgaaccccaccaacacccgggcccacagcgagaccccagagatcaggaagtacaagaagcgcttcaacagcgagatcctgtgtgccgccctgtggggcgtgaacctgctggtgggcacagaaaatggcctgatgctgctggacaggagcggccagggcaaggtgtatggcctgattggaagaagacgcttccagcagatggatgtgctggagggcctgaacctgctgatcaccatcagcggcaagaggaacaagctgcgggtgtactacctgtcctggctgaggaacaagatcctgcacaatgaccctgaggtggagaagaagcagggctggaccaccgtgggggacatggagggctgcggccactacagagtggtgaagtatgaaagaatcaagttcctggtgattgccctgaagagctctgtggaggtgtatgcctgggcccccaagccctaccacaagttcatggccttcaagagctttgctgacctgccccaccggcccctgctggtggacctgactgtggaggagggccagaggctgaaggtgatctacggcagcagcgctggcttccacgctgtggatgtggacagcggcaacagctatgacatctacatccctgtgcacatccagagccagatcacccctcatgccatcatcttcctgcccaacacagatggcatggagatgctgctgtgctatgaagatgagggcgtgtatgtgaacacctacggccgcatcatcaaggatgtggtgctgcagtggggcgagatgcccacctctgtggcctacatctgcagcaaccagatcatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgtacttcatgaccctgaacagaaactgcatcatgaactggtag

SEQ ID NO: 159841 - DNA, 879 bp, Artificial Sequence
  Description of Artificial Sequence: Synthetic coding sequence
atgctgctggacaggagcggccagggcaaggtgtatggcctgattggaagaagacgcttccagcagatggatgtgctggagggcctgaacctgctgatcaccatcagcggcaagaggaacaagctgcgggtgtactacctgtcctggctgaggaacaagatcctgcacaatgaccctgaggtggagaagaagcagggctggaccaccgtgggggacatggagggctgcggccactacagagtggtgaagtatgaaagaatcaagttcctggtgattgccctgaagagctctgtggaggtgtatgcctgggcccccaagccctaccacaagttcatggccttcaagagctttgctgacctgccccaccggcccctgctggtggacctgactgtggaggagggccagaggctgaaggtgatctacggcagcagcgctggcttccacgctgtggatgtggacagcggcaacagctatgacatctacatccctgtgcacatccagagccagatcacccctcatgccatcatcttcctgcccaacacagatggcatggagatgctgctgtgctatgaagatgagggcgtgtatgtgaacacctacggccgcatcatcaaggatgtggtgctgcagtggggcgagatgcccacctctgtggcctacatctgcagcaaccagatcatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgtacttcatgaccctgaacagaaactgcatcatgaactggtag

SEQ ID NO: 159842 - DNA, 336 bp, Artificial Sequence
  Description of Artificial Sequence: Synthetic coding sequence
atgggagaccctgccccagcccggagcctggatgacatcgacctgagcgccctgcgggccctgtggttccagttcttctaccacagcggcagcagcctggagagccctggcatgctgaatggccccttccagcacaggaacagccgcatcatgacccacaggtctgctgagaagaccctgctgggcagcctgagcctgtggcgctggagcgccatggagcccacagaccgctgcaccagggtgggcatgagcagaagaggctcctggctgcccagccgctcctggatgagcaggaggaccaggaggaagaggagcaacagaagaagcacctgctag

SEQ ID NO: 159843 - DNA, 1014 bp, Artificial Sequence
  Description of Artificial Sequence: Synthetic coding sequence
atgggcgccgccggcagcagcgccctggccaggtttgtgctgctggcccagagccggcccggctggctgggcgtggccgccctgggcctgacagctgtggccctgggcgctgtggcctggaggcgggcctggcccaccaggagaagaaggctgctgcagcaggtgggcaccgtggcccagctgtggatctaccctgtgaagagctgcaagggcgtgcctgtgtctgaggccgagtgcacagccatgggcctgcggagcggcaacctgcgggaccgcttctggctggtgatcaaccaggagggcaacatggtgacagcccggcaggagccccggctggtgctgatcagcctgacctgtgatggagacaccctgaccctgtctgctgcctacaccaaggacctgctgctgcccatcaagacccccaccaccaatgctgtgcacaagtgccgggtgcacggcctggagattgagggccgggactgtggggaggccacagcccagtggatcaccagcttcctgaagagccagccctaccgcctggtgcactttgagccccacatgaggccccggcggccccaccagattgctgacctcttccggcccaaggaccagatcgcctacagcgacaccagccccttcctgatcctgtctgaggccagcctggccgacctgaacagccggctggagaagaaggtgaaggccaccaacttccggcccaacatcgtcatcagcggctgtgatgtgtatgcagaagattcctgggatgagctgctgattggagatgtggagctgaagagggtgatggcctgcagccgctgcatcctgaccaccgtggaccctgacaccggggtgatgagcaggaaggagcccctggagaccctgaagagctaccggcagtgtgaccccagcgagaggaagctgtatggcaagagccccctgtttggccagtactttgtgctggagaaccctggcaccatcaaggtgggggaccctgtgtacctgctgggccagtag

SEQ ID NO: 159844 - DNA, 774 bp, Artificial Sequence
  Description of Artificial Sequence: Synthetic coding sequence
atgggcgccagcagcagcagcgccctggcccggctgggcctgcctgcccggccctggccccgctggctgggcgtggccgccctgggcctggccgctgtggccctgggcaccgtggcctggaggcgggcctggcccaggagaagaagaaggctgcagcaggtgggcaccgtggccaagctgtggatctaccctgtgaagagctgcaagggcgtgcctgtgtctgaggctgaatgtacagccatgggcctgcggagcggcaacctgcgggaccgcttctggctggtgatcaaggaggatggccacatggtgacagcccggcaggagccccggctggtgctgatcagcatcatctatgagaacaactgcctgatcttccgggccccagacatggaccagctggtgctgcccagcaagcagcccagcagcaacaagctgcacaactgccgcatcttcggcctggacatcaagggccgggactgtggaaatgaggccgccaagtggttcaccaacttcctgaagacagaggcctaccgcctggtgcagtttgagaccaacatgaagggccgcaccagcaggaagctgctgcccaccctggaccagaacttccaggtggcctacccagactactgccccctgctgatcatgacagatgccagcctggtggacctgaacaccaggatggagaagaagatgaagatggagaacttccggcccaacatcgtggtgacaggctgtgatgcctttgaggaggccagcgccacccggcgggactag

SEQ ID NO: 159845 - DNA, 1008 bp, Artificial Sequence
  Description of Artificial Sequence: Synthetic coding sequence
atgggcgccagcagcagcagcgccctggcccggctgggcctgcctgcccggccctggccccgctggctgggcgtggccgccctgggcctggccgctgtggccctgggcaccgtggcctggaggcgggcctggcccaggagaagaagaaggctgcagcaggtgggcaccgtggccaagctgtggatctaccctgtgaagagctgcaagggcgtgcctgtgtctgaggctgaatgtacagccatgggcctgcggagcggcaacctgcgggaccgcttctggctggtgatcaaggaggatggccacatggtgacagcccggcaggagccccggctggtgctgatcagcatcatctatgagaacaactgcctgatcttccgggccccagacatggaccagctggtgctgcccagcaagcagcccagcagcaacaagctgcacaactgccgcatcttcggcctggacatcaagggccgggactgtggaaatgaggccgccaagtggttcaccaacttcctgaagacagaggcctaccgcctggtgcagtttgagaccaacatgaagggccgcaccagcaggaagctgctgcccaccctggaccagaacttccaggtggcctacccagactactgccccctgctgatcatgacagatgccagcctggtggacctgaacaccaggatggagaagaagatgaagatggagaacttccggcccaacatcgtggtgacaggctgtgatgcctttgaggaggacacctgggatgagctgctgattggctctgtggaggtgaagaaggtgatggcctgcccccgctgcatcctgaccaccgtggaccctgacacaggagtcatcgacaggaagcagcccctggacaccctgaagagctaccgcctgtgtgaccccagcgagcgggagctgtacaagctgagccccctgtttggcatctactacagcgtggagaagattggcagcctgcgggtgggggaccctgtgtacaggatggtgtag

SEQ ID NO: 159846 - DNA, 519 bp, Artificial Sequence
  Description of Artificial Sequence: Synthetic coding sequence
ggccacatggtgacagcccggcaggagccccggctggtgctgatcagcatcatctatgagaacaactgcctgatcttccgggccccagacatggaccagctggtgctgcccagcaagcagcccagcagcaacaagctgcacaactgccgcatcttcggcctggacatcaagggccgggactgtggaaatgaagctgccaagtggttcaccaacttcctgaagacagaggcctaccgcctggtgcagtttgagaccaacatgaagggccgcaccagcaggaagctgctgcccaccctggaccagaacttccaggtggcctacccagactactgccccctgctgatcatgacagatgccagcctggtggacctgaacaccaggatggagaagaagatgaagatggagaacttccggcccaacatcgtggtgacaggctgtgatgcctttgaggaggacacctgggatgagctgctgattggctctgtggaggtgaagaaggtgatggcctgccccaggtag

SEQ ID NO: 159847 - DNA, 447 bp, Artificial Sequence
  Description of Artificial Sequence: Synthetic coding sequence
atgccctttgctgaggacaagacctacaagtacatctgcaggaacttcagcaacttctgcaatgtggatgtggtggagatcctgccctacctgccctgcctgacagcccgggaccaggaccggctgcgggccacctgcaccctgagcggcaacagagacaccctgtggcacctgttcaacaccctgcagctgcccacctgggccggggaggagaccccaggcggccagagcagcggccggggcctggacttcagcagcctgaccagcggggctgtgtggctgtggcagatgtctgacttctggagctgcttcagcacctggacagtgtccatctggctgatcctgcactgggtgctgctgcggctgaacctgcaggtgtttgccaagtgcctggcccagagcaagtggcccctgctgctgcccagcctgagctgccccacctggtag

SEQ ID NO: 159848 - DNA, 375 bp, Artificial Sequence
  Description of Artificial Sequence: Synthetic coding sequence
atgccctttgctgaggacaagacctacaagtacatctgcaggaacttcagcaacttctgcaatgtggatgtggtggagatcctgccctacctgccctgcctgacagcccgggaccaggaccggctgcgggccacctgcaccctgagcggcaacagagacaccctgtggcacctgttcaacaccctgcagaggcggcccggctgggtggagtacttcatcgccgccctgcggggctgtgagctggtggacctggctgatgaggtggcctctgtgtaccagagctaccagccccagttccgggccagccctgcagatgcccagccccagagccaccccaaggagagccgctggtggcccccaggagtgctgctgtag

SEQ ID NO: 159849 - DNA, 1200 bp, Artificial Sequence
  Description of Artificial Sequence: Synthetic coding sequence
atgcctgtgcaggagacccaggcccctgagagccctggagagaacagcgagcaggccctgcagaccctgagcccccgggccatccccaggaacccagatggcggccccctggagagcagcagtgacctggccgccctgagccccctgaccagcagcggccaccaggagcaggacacagagctgggcagcacccacacagctggggccaccagcagcctgacccccagccggggccctgtgagccccagcgtgtccttccagcccctggcccggagcaccccccgggccagccggctgcccggccccactggatctgtggtgtccacaggcaccagcttcagcagcagcagccctggcctggccagcgctggagctgctgagggcaagcagggcgctgagagtgaccaggccgagcccatcatctgcagcagcggggctgaggccccagccaacagcctgcccagcaaggtgcccaccaccctgatgcctgtgaacacagtggccctgaaggtgcctgccaacccagcctctgtgtccacagtgcccagcaagctgcccaccagcagcaagcccccaggagctgtgcccagcaatgccctgaccaacccagcccccagcaagctgcccatcaacagcaccagggctggcatggtgcccagcaaggtgcccacctccatggtgctgaccaaggtgtctgccagcacagtgcccacagatggcagcagcagaaatgaggagaccccagctgcccccaccccagctggggccactggaggcagcagcgcctggctggacagcagcagtgaaaatagaggcctgggcagcgagctgagcaagccaggagtgctggccagccaggtggacagccccttcagcggctgctttgaggacctggccatcagcgccagcaccagcctgggcatgggcccctgccacggccctgaggagaatgagtacaagtctgagggcaccttcggcatccacgtggccgagaaccccagcatccagctgctggagggcaaccctggccccccagctgaccctgatggcggcccccggccccaggccgacaggaagttccaggagcgggaggtgccctgccaccggcccagccctggggccctgtggctgcaggtggccgtgactggagtgctggtggtgaccctgctggtggtgctgtacagaagaaggctgcactag

SEQ ID NO: 159850 - DNA, 1623 bp, Artificial Sequence
  Description of Artificial Sequence: Synthetic coding sequence
atgccctttgctgaggacaagacctacaagtacatctgcaggaacttcagcaacttctgcaatgtggatgtggtggagatcctgccctacctgccctgcctgacagcccgggaccaggaccggctgcgggccacctgcaccctgagcggcaacagagacaccctgtggcacctgttcaacaccctgcagaggcggcccggctgggtggagtacttcatcgccgccctgcggggctgtgagctggtggacctggctgatgaggtggcctctgtgtaccagagctaccagcccaggaccagtgaccggcccccagaccccctggagccccccagcctgcctgctgagaggcctggcccccccaccccagctgctgcccacagcatcccctacaacagctgccgggagaaggagcccagctaccccatgcctgtgcaggagacccaggcccctgagagccctggagaaaattctgagcaggccctgcagaccctgagcccccgggccatccccagaaatccagatggcggccccctggagagcagcagtgacctggccgccctgagccccctgaccagcagcggccaccaggagcaggacacagagctgggcagcacccacacagctggggccaccagcagcctgacccccagccggggccctgtgagccccagcgtgtccttccagcccctggcccggagcaccccccgggccagccggctgcccggccccaccggctctgtggtgtccacaggcaccagcttcagcagcagcagccctggcctggccagcgctggagctgctgagggcaagcagggcgctgagagtgaccaggccgagcccatcatctgcagcagtggagctgaggccccagccaacagcctgcccagcaaggtgcccaccaccctgatgcctgtgaacacagtggccctgaaggtgcctgccaacccagcctctgtgtccacagtgcccagcaagctgcccaccagcagcaagcccccaggagctgtgcccagcaatgccctgaccaacccagcccccagcaagctgcccatcaacagcacccgggccggcatggtgcccagcaaggtgcccacctccatggtgctgaccaaggtgtctgccagcacagtgcccacagatggcagcagcagaaatgaggagaccccagctgcccccaccccagctggggccaccggcggcagcagcgcctggctggacagcagcagcgagaacagaggcctgggcagcgagctgagcaagccaggagtgctggccagccaggtggacagccccttcagcggctgctttgaggacctggccatcagcgccagcaccagcctgggcatgggcccctgccacggcccagaagaaaatgagtacaagtctgagggcaccttcggcatccacgtggccgagaaccccagcatccagctgctggagggcaaccctggccccccagctgaccctgatggcggcccccggccccaggccgacaggaagttccaggagcgggaggtgccctgccaccggcccagccctggggccctgtggctgcaggtggccgtgactggagtgctggtggtgaccctgctggtggtgctgtacagaagaaggctgcactag

SEQ ID NO: 159851 - DNA, 993 bp, Artificial Sequence
  Description of Artificial Sequence: Synthetic coding sequence
atggctgctgctgctggccgcagcctgctgctgctgctgagcagcagaggaggcggcggcggcggggccggcggctgtggggccctgacagctggctgcttccctggcctgggcgtgagccgccaccggcagcagcagcaccacaggacagtgcaccagagaattgcctcctggcagaacctgggcgctgtgtactgcagcacagtggtgcccagtgatgatgtgacagtggtgtaccagaatggcctgcccgtcatctctgtgcggctgcccagcagaagagagcgctgccagttcaccctgaagcccatcagtgacagcgtgggcgtcttcctgcggcagctgcaggaggaggaccggggcatcgacagagtggccatctacagcccagatggagtgcgggtggccgccagcactggaattgacctgctgctgctggatgacttcaagctggtgatcaatgacctgacctaccacgtgcggccccccaagagggtggagatgggcttctgccacgtgggccagaatggatttgagctgctgaccagcagctacctgcctgccagcgccagccagagcgctgagatcatcgctgtgagaattgagatcagcaggaaggccgagaagaggaccaccctggtgctgtggggcggcctggcctacatggccacccagtttggcatcctggcccggctgacctggtgggagtacagctgggacatcatggagcctgtgacctacttcatcacctacggcagcgccatggccatgtatgcctactttgtgatgacccggcaggagtatgtgtacccagaggcccgggaccggcagtacctgctcttcttccacaagggggccaagaagagcagatttgacctggagaagtacaaccagctgaaggatgccatcgcccaggccgagatggacctgaagaggctgcgggaccccctgcaggtgcacctgcccctgcggcagatcggggagaaggactag

SEQ ID NO: 159852 - DNA, 1056 bp, Artificial Sequence
  Description of Artificial Sequence: Synthetic coding sequence
atggctgctgctgctggccgcagcctgctgctgctgctgagcagcagaggaggcggcggcggcggggccggcggctgtggggccctgacagctggctgcttccctggcctgggcgtgagccgccaccggcagcagcagcaccacaggacagtgcaccagagaattgcctcctggcagaacctgggcgctgtgtactgcagcacagtggtgcccagtgatgatgtgacagtggtgtaccagaatggcctgcccgtcatctctgtgcggctgcccagcagaagagagcgctgccagttcaccctgaagcccatcagtgacagcgtgggcgtcttcctgcggcagctgcaggaggaggaccggggcatcgacagagtggccatctacagcccagatggagtgcgggtggccgccagcactggaattgacctgctgctgctggatgacttcaagctggtgatcaatgacctgacctaccacgtgcggccccccaagagggacctgctgagccatgaaaatgctgccaccctgaatgatgtgaagaccctggtgcagcagctgtacaccaccctgtgcatcgagcagcaccagctgaacaaggagcgggagctgattgaaaggctggaggacctgaaggagcagctggcccccctggagaaggtgcgcatcgagatcagcaggaaggccgagaagaggaccaccctggtgctgtggggcggcctggcctacatggccacccagtttggcatcctggcccggctgacctggtgggagtacagctgggacatcatggagcctgtgacctacttcatcacctacggcagcgccatggccatgtatgcctactttgtgatgacccggcaggagtatgtgtacccagaggcccgggaccggcagtacctgctcttcttccacaagggggccaagaagagcagatttgacctggagaagtacaaccagctgaaggatgccatcgcccaggccgagatggacctgaagaggctgcgggaccccctgcaggtgcacctgcccctgcggcagattggagagaaggactag

SEQ ID NO: 159853 - DNA, 909 bp, Artificial Sequence
  Description of Artificial Sequence: Synthetic coding sequence
atggtgcaccagagaattgcctcctggcagaacctgggcgctgtgtactgcagcacagtggtgcccagtgatgatgtgacagtggtgtaccagaatggcctgcctgtgatctctgtgcggctgcccagccggcgggagcgctgccagttcaccctgaagcccatcagtgacagcgtgggcgtcttcctgcggcagctgcaggaggaggaccggggcatcgacagagtggccatctacagcccagatggagtgcgggtggccgccagcacaggcatcgacctgctgctgctggatgacttcaagctggtgatcaatgacctgacctaccacgtgcggccccccaagagggacctgctgagccatgaaaatgctgccaccctgaatgatgtgaagaccctggtgcagcagctgtacaccaccctgtgcatcgagcagcaccagctgaacaaggagcgggagctgattgagcggctggaggacctgaaggagcagctggcccccctggagaaggtgagaattgagatcagcaggaaggccgagaagaggaccaccctggtgctgtggggcggcctggcctacatggccacccagtttggcatcctggcccggctgacctggtgggagtacagctgggacatcatggagcctgtgacctacttcatcacctacggcagcgccatggccatgtatgcctactttgtgatgacccggcaggagtatgtgtacccagaggcccgggaccggcagtacctgctcttcttccacaagggggccaagaagagcagatttgacctggagaagtacaaccagctgaaggatgccatcgcccaggccgagatggacctgaagaggctgcgggaccccctgcaggtgcacctgcccctgcggcagatcggggagaaggactag

SEQ ID NO: 159854 - DNA, 912 bp, Artificial Sequence
  Description of Artificial Sequence: Synthetic coding sequence
atggctgatgctgccagccaggtgctgctgggcagcggcctgaccatcctgagccagcccctgatgtatgtgaaggtgctgatccaggtgggctatgagcccctgccccccaccatcggcaggaacatcttcggccggcaggtgtgccagctgcccggcctcttctcctatgcccagcacatcgccagcattgatggaagaagaggcctcttcaccggcctgaccccccggctgtgcagcggcgtgctgggcaccgtggtgcacggcaaggtgctgcagcactaccaggagagtgacaagggggaggagctgggccctggaaatgtgcagaaggaggtgagcagcagctttgaccacgtgatcaaggagaccacccgggagatgattgcccggtctgctgccaccctcatcacccaccccttccacgtgatcaccctgcgctccatggtgcagttcatcggccgggagagcaagtactgcggcctgtgtgacagcatcatcaccatctaccgggaggagggcatcctgggcttctttgctggcctggtgccccggctgctgggggacatcctgagcctgtggctgtgcaacagcctggcctacctggtgaacacctacgccctggacagcggcgtgtccaccatgaatgagatgaagagctacagccaggccgtgacaggcttctttgcctccatgctgacctacccctttgtgctggtgagcaacctgatggctgtgaacaactgtggcctggccggcggctgccccccctacagccccatctacacctcctggattgactgctggtgcatgctgcagaaggagggcaacatgagccggggcaacagcctcttcttcaggaaggtgccctttgggaagacctactgctgtgacctgaagatgctgatctag

SEQ ID NO: 159855 - DNA, 468 bp, Artificial Sequence
  Description of Artificial Sequence: Synthetic coding sequence
atggtgcagttcatcggccgggagagcaagtactgcggcctgtgtgacagcatcatcaccatctaccgggaggagggcatcctgggcttctttgctggcctggtgccccggctgctgggggacatcctgagcctgtggctgtgcaacagcctggcctacctggtgaacacctacgccctggacagcggcgtgtccaccatgaatgagatgaagagctacagccaggccgtgacaggcttctttgcctccatgctgacctacccctttgtgctggtgagcaacctgatggctgtgaacaactgtggcctggccggcggctgccccccctacagccccatctacacctcctggattgactgctggtgcatgctgcagaaggagggcaacatgagccggggcaacagcctcttcttcaggaaggtgccctttgggaagacctactgctgtgacctgaagatgctgatctag

SEQ ID NO: 159856 - DNA, 360 bp, Artificial Sequence
  Description of Artificial Sequence: Synthetic coding sequence
atggtgctgcccctgccctggctgagccgctaccacttcctgcggctgctgctgcccagctggagcctggccccccagggcagccacggctgctgcagccagaaccccaaggcctccatggaggagcagaccagcagcagaggaaatggcaagatgaccagccccccccggggccctggcacccacaggacagctgagctggcccgggcagaggagctgctggagcagcagctggagctgtaccaggccctgctggagggccaggagggcgcctgggaggcccaggccctggtgctgaagatccagaagctgaaggagcagatgagaagacaccaggagagcctgggcggcggggcctag

SEQ ID NO: 159857 - DNA, 360 bp, Artificial Sequence
  Description of Artificial Sequence: Synthetic coding sequence
atggtgctgcccctgccctggctgagccgctaccacttcctgcggctgctgctgcccagctggagcctggccccccagggcagccacggctgctgcagccagaaccccaaggcctccatggaggagcagaccaacagcagaggaaatggcaagatgaccagccccccccggggccctggcacccacaggacagctgagctggcccgggcagaggagctgctggagcagcagctggagctgtaccaggccctgctggagggccaggagggcgcctgggaggcccaggccctggtgctgaagatccagaagctgaaggagcagatgagaagacaccaggagagcctgggcggcggggcctag

SEQ ID NO: 159858 - DNA, 360 bp, Artificial Sequence; identical to SEQ ID NO: 159857
  Description of Artificial Sequence: Synthetic coding sequence

SEQ ID NO: 159859 - DNA, 360 bp, Artificial Sequence; identical to SEQ ID NO: 159856
  Description of Artificial Sequence: Synthetic coding sequence

SEQ ID NO: 159860 - DNA, 360 bp, Artificial Sequence; identical to SEQ ID NO: 159856
  Description of Artificial Sequence: Synthetic coding sequence

SEQ ID NO: 159861 - DNA, 360 bp, Artificial Sequence
  Description of Artificial Sequence: Synthetic coding sequence
atggtgctgcccctgccctggctgagccgctaccacttcctgcggctgctgctgcccagctggagcctggccccccagggcagccacggctgctgcagccagaaccccaaggcctccatggagaagcagaccaacagcagaggaaatggcaagatgaccagccccccccggggccctggcacccacaggacagctgagctggcccgggcagaggagctgctggagcagcagctggagctgtaccaggccctgctggagggccaggagggcgcctgggaggcccaggccctggtgctgaagatccagaagctgaaggagcagatgagaagacaccaggagagcctgggcggcggggcctag

SEQ ID NO: 159862 - DNA, 360 bp, Artificial Sequence; identical to SEQ ID NO: 159857
  Description of Artificial Sequence: Synthetic coding sequence

SEQ ID NO: 159863 - DNA, 360 bp, Artificial Sequence; identical to SEQ ID NO: 159857
  Description of Artificial Sequence: Synthetic coding sequence

SEQ ID NO: 159864 - DNA, 1059 bp, Artificial Sequence
  Description of Artificial Sequence: Synthetic coding sequence
atggagagcggcggccggcccagcctgtgccagttcatcctgctgggcaccacctctgtggtgacagctgccctgtacagcgtgtaccggcagaaggcccgggtgtcccaggagctgaagggggccaagaaggtgcacctgggggaggacctgaagagcatcctgtctgaggcccctggaaaatgtgtgccctatgctgtgattgagggcgctgtgcgctctgtgaaggagaccctgaacagccagtttgtggagaactgcaagggcgtcatccagaggctgaccctgcaggagcacaagatggtgtggaacagaaccacccacctgtggaatgactgcagcaagatcatccaccagaggaccaacacagtgccctttgacctggtgccccatgaagatggagtggatgtggccgtgcgggtgctgaagcccctggacagcgtggacctgggcctggagaccgtgtatgagaagttccaccccagcatccagagcttcacagatgtgattggccactacatctctggagagcggcccaagggcatccaggagacagaggagatgctgaaggtgggcgccaccctgactggagtgggggagctggtgctggacaacaacagcgtgcggctgcagccccccaagcagggcatgcagtactacctgagcagccaggactttgacagcctgctgcagaggcaggagagctctgtgcggctgtggaaggtgctggccctggtgtttggatttgccacctgtgccaccctcttcttcatcctgaggaagcagtacctgcagaggcaggagcggctgcggctgaagcagatgcaggaggagttccaggagcacgaggcccagctgctgagccgggccaagccagaagatcgggagagcctgaagagcgcctgtgtggtgtgcctgagcagcttcaagagctgtgtgttcctggagtgtggccacgtgtgcagctgcacagagtgctaccgggccctgcctgagcccaagaagtgccccatctgccggcaggccatcaccagggtcatccccctgtacaacagctag

SEQ ID NO: 159865 - DNA, 2142 bp, Artificial Sequence
  Description of Artificial Sequence: Synthetic coding sequence
atgctgtgtgtgggccgcctgggcggcctgggcgcccgggctgctgccctgcccccccggcgggccggccggggcagcctggaggccggcatccgggcccggcgggtgtccacctcctggagccctgtgggcgccgccttcaacgtgaagccccagggcagccggctggacctgtttggagagcggcggggcctgtttggagtgcctgagctgagcgcccctgagggcttccacatcgcccaggagaaggccctgaggaagacagagctgctggtggaccgggcctgcagcaccccacctggcccccagacagtgctgatctttgatgagctgagtgacagcctgtgccgggtggccgacctggccgactttgtgaagatcgcccaccctgagcccgccttccgggaggccgctgaggaggcctgccgcagcatcggcaccatggtggagaagctgaacaccaacgtggacctgtaccagagcctgcagaagctgctggccgacaagaagctggtggacagcctggaccctgagacccggcgggtggccgagctgttcatgtttgattttgagatcagcggcatccacctggacaaggagaagaggaagagagctgtggacctgaatgtgaagatcctggacctgagcagcaccttcctgatgggcaccaacttccccaacaagattgagaagcacctgctgcctgagcacatcagaagaaacttcaccagcgctggggaccacatcatcattgatggcctgcacgccgagagcccagatgacctggtgcgggaggccgcctacaagatcttcctgtacccaaatgccggccagctgaagtgcctggaggagctgctgagcagccgggacctgctggccaagctggtgggctacagcaccttcagccaccgggccctgcagggcaccatcgccaagaaccctgagaccgtgatgcagttcctggagaagctgagtgacaagctgtctgagaggaccctgaaggactttgagatgatccggggcatgaagatgaagctgaacccccagaacagcgaggtgatgccctgggaccccccctactacagcggggtcatccgggcagagcgctacaacatcgagcccagcctgtactgccccttcttcagcctgggcgcctgcatggagggcctgaacatcctgctgaaccggctgctgggcatcagcctgtatgcagagcagcctgccaagggggaggtgtggagcgaagatgtgaggaagctggccgtggtgcatgagagcgagggcctgctgggctacatctactgtgacttcttccagagagctgacaagccccaccaggactgccacttcaccatccggggcggccgcctgaaggaggatggagactaccagctgcctgtggtggtgctgatgctgaacctgcccaggagcagccgcagcagccccaccctgctgacccccagcatgatggagaacctcttccacgagatgggccacgccatgcacagcatgctgggccgcacccgctaccagcacgtgacaggcacccgctgccccacagactttgctgaggtgcccagcatcctgatggagtactttgccaatgactacagagtggtgaaccagtttgcccggcactaccagacaggccagcccctgcccaagaacatggtgtcccggctgtgtgagagcaagaaggtgtgtgccgctgctgacatgcagctgcaggtgttctacgccaccctggaccagatctaccacggcaagcaccccctgaggaacagcaccacagacatcctgaaggagacccaggagaagttctacggcctgccctacgtgcccaacacagcctggcagctgcgcttcagccacctggtgggctacggggcccgctactacagctacctgatgagcagagctgtggcctccatggtgtggaaggagtgcttcctgcaggaccccttcaacagagctgctggggagcgctaccgccgggagatgctggcccacggcggcggccgggagcccatgctgatggtggagggcatgctgcagaagtgccccagcgtggatgactttgtgtctgccctggtgtctgacctggacctggactttgagaccttcctgatggacagcgagtag

SEQ ID NO: 159866 - DNA, 1353 bp, Artificial Sequence; identical to SEQ ID NO: 148628
  Description of Artificial Sequence: Synthetic coding sequence

SEQ ID NO: 159867 - DNA, 1170 bp, Artificial Sequence
  Description of Artificial Sequence: Synthetic coding sequence
atgagggtgctggtgcggcgctgctggggcccccccctggcccatggagcccggcggggccggcccagcccccagtggagggccctggcccggctgggctgggaggactgccgggacagccgggtgcgggagaagccaccctggagggtgctcttctttggaacagaccagtttgcccgggaggccctgcgggccctgcacgccgcccgggagaacaaggaggaggagctgattgacaagctggaggtggtgaccatgcccagccccagccccaagggcctgcctgtgaagcagtatgctgtgcagagccagctgcctgtgtatgagtggccagatgtgggcagcggggagtatgatgtgggcgtggtggccagctttggccgcctgctgaatgaggccctgatcctgaagttcccctacggcatcctgaatgtgcaccccagctgcctgccccgctggaggggccctgcccctgtgatccacacagtgctgcatggagacacagtgactggagtgaccatcatgcagatccggcccaagagatttgatgtgggccccatcctgaagcaggagaccgtgcctgtgccccccaagagcacagccaaggagctggaggccgtgctgagccggctgggcgccaacatgctgatctctgtgctgaagaacctgcctgagagcctgagcaatggccggcagcagcccatggagggcgccacctacgcccccaagatctctgctggcaccagctgcatcaagtgggaggagcagaccagcgagcagatcttccggctgtaccgggccatcggcaacatcatccccctgcagaccctgtggatggccaacaccatcaagctgctggacctggtggaggtgaacagctctgtgctggccgaccccaagctgaccggccaggccctgatccctggcagcgtcatctaccacaagcagagccagatcctgctggtgtactgcaaggatggctggattggagtgcgctctgtgatgctgaagaagagcctgacagccacagacttctacaacggctacctgcacccctggtaccagaagaacagccaggcccagcccagccagtgccgcttccagaccctgcggctgcccaccaagaagaagcagaagaagacagtggccatgcagcagtgcatcgagtag

SEQ ID NO: 159868 - DNA, 1749 bp, Artificial Sequence
  Description of Artificial Sequence: Synthetic coding sequence
atggctgtgcctggggtgggcctgctgacccggctgaacctgtgtgcccggcggaggaccagggtgcagaggcccatcgtgcggctgctgagctgccccggcaccgtggccaaggacctgcggagagatgagcagcccagcggctctgtggagaccggctttgaggacaagatccccaagaggcgcttcagcgagatgcagaatgaaagaagagagcaggcccagaggacagtgctgatccactgcccagagaagatcagcgagaacaagttcctgaagtacctgagccagtttggccccatcaacaaccacttcttctatgagagctttggcctgtatgctgtggtggagttctgccagaaggagagcatcggcagcctgcagaatggcacccacacccccagcacagccatggagacagccatccccttccgcagccgcttcttcaacctgaagctgaagaaccagaccagcgagaggagccgggtgcgcagcagcaaccagctgcccaggagcaacaagcagctgtttgagctgctgtgctacgccgagagcattgatgaccagctgaacaccctgctgaaggagttccagctgacagaggagaacaccaagctgcgctacctgacctgcagcctgattgaggacatggctgctgcctacttcccagactgcatcgtgcggcccttcggcagctctgtgaacaccttcggcaagctgggctgtgacctggacatgttcctggacctggatgagaccaggaacctgagcgcccacaagatcagcggcaacttcctgatggagttccaggtgaagaatgtgcccagcgagagaattgccacccagaagatcctgtctgtgctgggggagtgcctggaccactttggacctggctgtgtgggcgtgcagaagatcctgaatgcccgctgccccctggtgcgcttcagccaccaggccagcggcttccagtgtgacctgaccaccaacaaccgcatcgccctgaccagcagcgagctgctgtacatctatggagccctggacagccgggtgcgggccctggtgttttctgtgcgctgctgggcccgggcccacagcctgaccagcagcatccctggggcctggatcaccaacttcagcctgaccatgatggtgatcttcttcctgcagaggaggagcccccccatcctgcccaccctggacagcctgaagaccctggctgatgctgaagataaatgtgtgattgagggcaacaactgcacctttgtgcgggacctgagccgcatcaagcccagccagaacacagagaccctggagctgctgctgaaggagttctttgagtacttcggcaactttgcctttgacaagaacagcatcaacatccggcagggccgggagcagaacaagccagacagcagccccctgtacatccagaacccctttgagaccagcctgaacatcagcaagaatgtgtcccagagccagctgcagaagtttgtggacctggcccgggagagcgcctggatcctgcagcaggaggacacagaccggcccagcatcagcagcaaccggccctggggcctggtgtccctgctgctgcccagcgcccccaacaggaagagcttcaccaagaagaagagcaacaagtttgccattgaaacagtgaagaacctgctggagagcctgaagggcaacagaacagagaacttcaccaagaccagcggcaagaggaccatcagcacccagacctag

SEQ ID NO: 159869 - DNA, 2139 bp, Artificial Sequence
  Description of Artificial Sequence: Synthetic coding sequence
atggcctgggccaagaaggtgggcggccgggccggccagggccgcagcctgagccgctgtgaccccatcatcctggaccctgagtggctgtatggccccccagagggggagggcggccctgagggcgtgggcggggagacccgggccagcatccacccccccctgaggacaggccgccaccaccagaaggtgaaccacaacatccggggccctgagggcagcgccaaggatgctgcccctgggggcggcggccaccaccaggccggccctggccagagaggagatgaagatggagccctgcagcacctgtgtggcggcggcggcggcgtgggcgtgtctgtgggccggggcaccggcacctctgtggccgctgagcaccccagcctgcaggtgaagctgctggagctgcaggagctggtgctgcggctggccggggaccacaatgaaggacatggcaagttcctggccgccgcccagaacccagcagatgatcctgcccctggggccccagccccccaggagctgggcgctgctgacaagcagggcggctttgaggacaagatccccaagaggcgcttcagcgagatgcagaatgaaagaagagagcaggcccagaggacagtgctgatccactgcccagagaagatcagcgagaacaagttcctgaagtacctgagccagtttggccccatcaacaaccacttcttctatgagagctttggcctgtatgctgtggtggagttctgccagaaggagagcatcggcagcctgcagaatggcacccacacccccagcacagccatggagacagccatccccttccgcagccgcttcttcaacctgaagctgaagaaccagaccagcgagaggagccgggtgcgcagcagcaaccagctgcccaggagcaacaagcagctgtttgagctgctgtgctacgccgagagcattgatgaccagctgaacaccctgctgaaggagttccagctgacagaggagaacaccaagctgcgctacctgacctgcagcctgattgaggacatggctgctgcctacttcccagactgcatcgtgcggcccttcggcagctctgtgaacaccttcggcaagctgggctgtgacctggacatgttcctggacctggatgagaccaggaacctgagcgcccacaagatcagcggcaacttcctgatggagttccaggtgaagaatgtgcccagcgagagaattgccacccagaagatcctgtctgtgctgggggagtgcctggaccactttggacctggctgtgtgggcgtgcagaagatcctgaatgcccgctgccccctggtgcgcttcagccaccaggccagcggcttccagtgtgacctgaccaccaacaaccgcatcgccctgaccagcagcgagctgctgtacatctatggagccctggacagccgggtgcgggccctggtgttttctgtgcgctgctgggcccgggcccacagcctgaccagcagcatccctggggcctggatcaccaacttcagcctgaccatgatggtgatcttcttcctgcagaggaggagcccccccatcctgcccaccctggacagcctgaagaccctggctgatgctgaagataaatgtgtgattgagggcaacaactgcacctttgtgcgggacctgagccgcatcaagcccagccagaacacagagaccctggagctgctgctgaaggagttctttgagtacttcggcaactttgcctttgacaagaacagcatcaacatccggcagggccgggagcagaacaagccagacagcagccccctgtacatccagaacccctttgagaccagcctgaacatcagcaagaatgtgtcccagagccagctgcagaagtttgtggacctggcccgggagagcgcctggatcctgcagcaggaggacacagaccggcccagcatcagcagcaaccggccctggggcctggtgtccctgctgctgcccagcgcccccaacaggaagagcttcaccaagaagaagagcaacaagtttgccattgaaacagtgaagaacctgctggagagcctgaagggcaacagaacagagaacttcaccaagaccagcggcaagaggaccatcagcacccagacctag

SEQ ID NO: 159870 - DNA, 660 bp, Artificial Sequence
  Description of Artificial Sequence: Synthetic coding sequence
atgcagaatgaaagaagagagcaggcccagaggacagtgctgatccactgcccagagaagatcagcgagaacaagttcctgaagtacctgagccagtttggccccatcaacaaccacttcttctatgagagctttggcctgtatgctgtggtggagttctgccagaaggagagcatcggcagcctgcagaatggcacccacacccccagcacagccatggagacagccatccccttccgcagccgcttcttcaacctgaagctgaagaaccagaccagcgagaggagccgggtgcgcagcagcaaccagctgcccaggagcaacaagcagctgtttgagctgctgtgctacgccgagagcattgatgaccagctgaacaccctgctgaaggagttccagctgacagaggagaacaccaagctgcgctacctgacctgcagcctgattgaggacatggccgccgcctacttcccagactgcatcgtgcggcccttcggcagctctgtgaacaccttcggcaagctgggctgtgacctggacatgttcctggacctggatgagaccaggaacctgagcgcccacaagatcagcggcaacttcctgatggagttccaggtgaagaatgtgcccagcgagcgcatcgccacccagaagatctag

SEQ ID NO: 159871 - DNA, 453 bp, Artificial Sequence
  Description of Artificial Sequence: Synthetic coding sequence
gacctgcggagagatgagcagcccagcggctctgtggagaccggctttgaggacaagatccccaagaggcgcttcagcgagatgcagaatgaaagaagagagcaggcccagaggacagtgctgatccactgcccagagaagatcagcgagaacaagttcctgaagtacctgagccagtttggccccatcaacaaccacttcttctatgagagctttggcctgtatgctgtggtggagttctgccagaaggagagcatcggcagcctgcagaatggcacccacacccccagcacagccatggagacagccatccccttccgcagccgcttcttcaacctgaagctgaagaaccagaccagcgagaggagccgggtgcgcagcagcaaccagctgcccaggagcaacaagcagctgtttgagctgctgtgctacgccgagagcgtgtccttctag

SEQ ID NO: 159872 - DNA, 309 bp, Artificial Sequence
  Description of Artificial Sequence: Synthetic coding sequence
atgttcctgacagccctgctgtggaggggccgcatccctggccggcagtggattggcaagcaccggcggcccaggtttgtgtccctgcgggccaagcagaacatgatccggcggctggagattgaagctgagaaccactactggctgtccatgccctacatgacccgggagcaggagcggggccatgctgctgtgagaagaagagaggcctttgaggccatcaaggctgctgccaccagcaagtttcctccccaccgcttcatcgctgaccagctggaccacctgaatgtgaccaagaagtggagctag

SEQ ID NO: 159873 - DNA, 978 bp, Artificial Sequence
  Description of Artificial Sequence: Synthetic coding sequence
atggctgctgctgtgcgctgcatgggccgggccctgatccaccaccagaggcacagcctgagcaagatggtgtaccagaccagcctgtgcagctgcagcgtgaacatccgggtgcccaacagacactttgctgctgccaccaagagcgccaagaagaccaagaagggggccaaggagaagaccccagatgagaagaaggatgaaattgagaagatcaaggcctacccctacatggagggggagccagaagatgatgtgtacctgaagaggctgtacccccggcagatctatgaggtggagaaggctgtgcacctgctgaagaagttccagatcctggacttcaccagccccaagcagagcgtgtacctggacctgaccctggacatggccctgggcaagaagaagaatgtggagcccttcacctctgtgctgagcctgccctacccctttgccagcgagatcaacaaggtggccgtgttcacagaaaatgccagcgaggtgaagattgctgaggagaatggagctgcctttgctgggggcaccagcctcatccagaagatctgggatgatgagatcgtggccgacttctacgtggccgtgcctgagatcatgcctgagctgaaccggctgaggaagaagctgaacaagaagtaccccaagctgagcagaaattccatcggccgggacatccccaagatgctggagctgttcaagaatggacatgagatcaaggtggatgaggagcgggagaacttcctgcagaccaagatcgccaccctggacatgagcagtgaccagattgctgccaacctgcaggccgtcatcaatgaggtgtgccgccaccggcccctgaacctgggcccctttgtggtgcgggccttcctgcggagcagcaccagcgagggcctgctgctgaagattgaccccctgctgcccaaggaggtgaagaatgaggagagcgagaaggaggatgcctag

SEQ ID NO: 159874 - DNA, 909 bp, Artificial Sequence
  Description of Artificial Sequence: Synthetic coding sequence
atggtgtaccagaccagcctgtgcagctgcagcgtgaacatccgggtgcccaacagacactttgctgctgccaccaagagcgccaagaagaccaagaagggggccaaggagaagaccccagatgagaagaaggatgaaattgagaagatcaaggcctacccctacatggagggggagccagaagatgatgtgtacctgaagaggctgtacccccggcagatctatgaggtggagaaggctgtgcacctgctgaagaagttccagatcctggacttcaccagccccaagcagagcgtgtacctggacctgaccctggacatggccctgggcaagaagaagaatgtggagcccttcacctctgtgctgagcctgccctacccctttgccagcgagatcaacaaggtggccgtgttcacagaaaatgccagcgaggtgaagattgctgaggagaatggagctgcctttgctgggggcaccagcctcatccagaagatctgggatgatgagatcgtggccgacttctacgtggccgtgcctgagatcatgcctgagctgaaccggctgaggaagaagctgaacaagaagtaccccaagctgagcagaaattccatcggccgggacatccccaagatgctggagctgttcaagaatggacatgagatcaaggtggatgaggagcgggagaacttcctgcagaccaagatcgccaccctggacatgagcagtgaccagattgctgccaacctgcaggccgtcatcaatgaggtgtgccgccaccggcccctgaacctgggcccctttgtggtgcgggccttcctgcggagcagcaccagcgagggcctgctgctgaagattgaccccctgctgcccaaggagatcaagagccagcccaagaagaagaagaactag

SEQ ID NO: 159875 - DNA, 816 bp, Artificial Sequence
  Description of Artificial Sequence: Synthetic coding sequence
atgatcagcgcccactgcaacctgcacctgcccggcagcagtgacagccctgccagcgccagccaggtggccggcatcaccggccgcctgcccaccctgcagacagtgcgctatggcagcaaggctgtgaccaggcacagaagagtgatgcacttccagaggcagaagctgatggctgtgacagagtacatcccccccaagccagccatccaccccagctgcctgcccagcccccccagccccccccaggaggagatcggcctcatccggctgctgcggcgggagattgctgctgtgttccaggacaacaggatgattgctgtgtgccagaatgtggccctgtctgctgaggacaagctgctgatgaggcaccagctgaggaagcacaagatcctgatgaaggtgttccccaaccaggtgctgaagcccttcctggaggacagcaagtaccagaacctgctgcccctgtttgtgggccacaacatgctgctggtgtctgaggagcccaaggtgaaggagatggtgcgcatcctgaggacagtgcccttcctgcccctgctgggcggctgcattgatgacaccatcctgagccggcagggcttcatcaactacagcaagctgcccagcctgcccctggtgcagggcgagctggtgggcggcctgacctgcctgacagcccagacccacagcctgctgcagcaccagcccctgcagctgaccaccctgctggaccagtacatccgggagcagcgggagaaggacagcgtgatgtctgccaacgggaagccagaccctgacacagtgcctgacagctag

SEQ ID NO: 159876 - DNA, 786 bp, Artificial Sequence
  Description of Artificial Sequence: Synthetic coding sequence
atggctgctgctgtggccggcatgctgcggggcggcctgctgccccaggccggccgcctgcccaccctgcagacagtgcgctatggcagcaaggctgtgaccaggcacagaagagtgatgcacttccagaggcagaagctgatggctgtgacagagtacatcccccccaagccagccatccaccccagctgcctgcccagcccccccagccccccccaggaggagatcggcctcatccggctgctgcggcgggagattgctgctgtgttccaggacaacaggatgattgctgtgtgccagaatgtggccctgtctgctgaggacaagctgctgatgaggcaccagctgaggaagcacaagatcctgatgaaggtgttccccaaccaggtgctgaagcccttcctggaggacagcaagtaccagaacctgctgcccctgtttgtgggccacaacatgctgctggtgtctgaggagcccaaggtgaaggagatggtgcgcatcctgaggacagtgcccttcctgcccctgctgggcggctgcattgatgacaccatcctgagccggcagggcttcatcaactacagcaagctgcccagcctgcccctggtgcagggcgagctggtgggcggcctgacctgcctgacagcccagacccacagcctgctgcagcaccagcccctgcagctgaccaccctgctggaccagtacatccgggagcagcgggagaaggacagcgtgatgtctgccaacgggaagccagaccctgacacagtgcctgacagctag

SEQ ID NO: 159877 - DNA, 816 bp, Artificial Sequence; identical to SEQ ID NO: 159875
  Description of Artificial Sequence: Synthetic coding sequence

SEQ ID NO: 159878 - DNA, 579 bp, Artificial Sequence
  Description of Artificial Sequence: Synthetic coding sequence
atgagcaagctgggccgggccgcccggggcctgaggaagccagaggtgggcggcgtcatccgggccatcgtgcgggccggcctggccatgcctggcccccccctgggccctgtgctgggccagaggggcgtgtccatcaaccagttctgcaaggagttcaatgaaagaaccaaggacatcaaggagggcatccccctgcccaccaagatcctggtgaagccagacaggacctttgagatcaagattggccagcccaccgtgtcctacttcctgaaggctgctgctggcattgaaaaaggagcccggcagacaggcaaggaggtggccggcctggtgaccctgaagcacgtgtatgagatcgcccgcatcaaggcccaggatgaggcctttgccctgcaggatgtgcccctgagctctgtggtgcgcagcatcatcggcagcgcccggagcctgggcatccgggtggtgaaggacctgagcagcgaggagctggccgccttccagaaggagcgggccatcttcctggccgcccagaaggaggccgacctggccgcccaggaggaggccgccaagaagtag

SEQ ID NO: 159879 - DNA, 546 bp, Artificial Sequence
  Description of Artificial Sequence: Synthetic coding sequence
atgagcaagctgggccgggccgcccggggcctgaggaagccagaggtgggcggcgtcatccgggccatcgtgcgggccggcctggccatgcctggcccccccctgggccctgtgctgggccagaggggcgtgtccatcaaccagttctgcaaggagttcaatgaaagaaccaaggacatcaaggagggcatccccctgcccaccaagatcctggtgaagccagacaggacctttgagatcaagattggccagcccaccgtgtcctacttcctgaaggctgctgctggcattgaaaaaggagcccggcagacaggcaaggaggtggccggcctggtgaccctgaagcacgtgtatgagatcgcccgcatcaaggcccaggatgaggcctttgccctgcaggatgtgcccctgagctctgtggtgcgcagcatcatcggcagcgcccggagcctgggcatccgggtggtgaaggagcgctgcagcgccaacgtgctgagaaatggcaagatctccatgaaggaccccagcggccgcagctctgtgtag

SEQ ID NO: 159880 - DNA, 501 bp, Artificial Sequence
  Description of Artificial Sequence: Synthetic coding sequence
atgagcaagctgggccgggccgcccggggcctgaggaagccagagcggggcgtgtccatcaaccagttctgcaaggagttcaatgaaagaaccaaggacatcaaggagggcatccccctgcccaccaagatcctggtgaagccagacaggacctttgagatcaagattggccagcccaccgtgtcctacttcctgaaggctgctgctggcattgaaaaaggagcccggcagacaggcaaggaggtggccggcctggtgaccctgaagcacgtgtatgagatcgcccgcatcaaggcccaggatgaggcctttgccctgcaggatgtgcccctgagctctgtggtgcgcagcatcatcggcagcgcccggagcctgggcatccgggtggtgaaggacctgagcagcgaggagctggccgccttccagaaggagcgggccatcttcctggccgcccagaaggaggccgacctggccgcccaggaggaggccgccaagaagtag

SEQ ID NO: 159881 - DNA, 891 bp, Artificial Sequence
  Description of Artificial Sequence: Synthetic coding sequence
atggctgctgaggcccgggtgagccgctggtactttggaggcctggccagctgtggggccgcctgctgcacccaccccctggacctgctgaaggtgcacctgcagacccagcaggaggtgaagctgaggatgacaggcatggccctgcgggtggtgaggacagatggcatcctggccctgtacagcggcctgagcgccagcctgtgccggcagatgacctacagcctgaccaggtttgccatctatgagaccgtgcgggacagagtggccaagggcagccagggccccctgcccttccacgagaaggtgctgctgggctctgtgtctggcctggccggcggctttgtgggcaccccagctgacctggtgaatgtgaggatgcagaatgatgtgaagctgccccagggccagaggagaaattatgcccacgccctggatggcctgtacagagtggcccgggaggagggcctgcggcggctcttcagcggggccaccatggccagcagcagaggagccctggtgacagtgggccagctgagctgctatgaccaggccaagcagctggtgctgagcacaggctacctgagtgacaacatcttcacccactttgtggccagcttcatcgctgctgctggagatgagcccccaccccagggcggctgtgccaccttcctgtgccagcccctggatgtgctgaagacccggctgatgaacagcaagggggagtaccagggcgtcttccactgtgctgtggagacagccaagctgggccccctggccttctacaagggcctggtgcctgctggcatccgcctcatcccccacacagtgctgacctttgtgttcctggagcagctgaggaagaactttggcatcaaggtgcccagctag

SEQ ID NO: 159882 - DNA, 537 bp, Artificial Sequence
  Description of Artificial Sequence: Synthetic coding sequence
atgctgcctgctgctgcccggcccctgtggggcccctgcctgggcctgcgggctgctgccttccggctggcccggcggcaggtgccctgtgtgtgtgctgtgcgccacatgaggagcagcggccaccagagatgtgaggccctggccggggcccccctggacaatgcccccaaggagtacccacccaagatccagcagctggtgcaggacatcgccagcctgaccctgctggagatcagtgacctgaatgagctgctgaagaagaccctgaagatccaggatgtgggcctggtgcccatgggcggcgtgatgtctggagctgtgcctgctgctgctgcccaggaggccgtggaggaggacatccccatcgccaaggagaggacccacttcaccgtgcggctgacagaggccaagcctgtggacaaggtgaagctgatcaaggagatcaagaactacatcaaggccagcaccagcagccggcagaggtcctggtggagcccctgccccggcaaccagagccagtgccggcagagctag

SEQ ID NO: 159883 - DNA, 597 bp, Artificial Sequence
  Description of Artificial Sequence: Synthetic coding sequence
atgctgcctgctgctgcccggcccctgtggggcccctgcctgggcctgcgggctgctgccttccggctggcccggcggcaggtgccctgtgtgtgtgctgtgcgccacatgaggagcagcggccaccagagatgtgaggccctggccggggcccccctggacaatgcccccaaggagtacccacccaagatccagcagctggtgcaggacatcgccagcctgaccctgctggagatcagtgacctgaatgagctgctgaagaagaccctgaagatccaggatgtgggcctggtgcccatgggcggcgtgatgtctggagctgtgcctgctgctgctgcccaggaggccgtggaggaggacatccccatcgccaaggagaggacccacttcaccgtgcggctgacagaggccaagcctgtggacaaggtgaagctgatcaaggagatcaagaactacatccagggcatcaacctggtgcaggccaagaagctggtggagagcctgccccaggagatcaaggccaacgtggccaaggccgaggccgagaagatcaaggccgccctggaggccgtgggcggcaccgtggtgctggagtag

SEQ ID NO: 159884 - DNA, 864 bp, Artificial Sequence
  Description of Artificial Sequence: Synthetic coding sequence
atggctgctgaggcccgggtgagccgctggtactttggaggcctggccagctgtggggccgcctgctgcacccaccccctggacctgctgaaggtgcacctgcagacccagcaggaggtgaagctgaggatgacaggcatggccctgcgggtggtgaggacagatggcatcctggccctgtacagcggcctgagcgccagcctgtgccggcagatgacctacagcctgaccaggtttgccatctatgagaccgtgcgggacagagtggccaagggcagccagggccccctgcccttccacgagaaggtgctgctgggctctgtgtctggcctggccggcggctttgtgggcaccccagctgacctggtgaatgtgaggatgcagaatgatgtgaagctgccccagggccagaggagaaattatgcccacgccctggatggcctgtacagagtggcccgggaggagggcctgcggcggctcttcagcggggccaccatggccagcagcagaggagccctggtgacagtgggccagctgagctgctatgaccaggccaagcagctggtgctgagcacaggctacctgagtgacaacatcttcacccactttgtggccagcttcatcgccggcggctgtgccaccttcctgtgccagcccctggatgtgctgaagacccggctgatgaacagcaaaggagagtaccagggcgtcttccactgtgctgtggagacagccaagctgggccccctggccttctacaagggcctggtgcctgctggcatccgcctcatcccccacacagtgctgacctttgtgttcctggagcagctgaggaagaactttggcatcaaggtgcccagctag

SEQ ID NO: 159885 - DNA, 1329 bp, Artificial Sequence
  Description of Artificial Sequence: Synthetic coding sequence
atgctgcctgctgctgcccggcccctgtggggcccctgcctgggcctgcgggctgctgccttccggctggcccggcggcaggtgccctgtgtgtgtgctgtgcgccacatgaggagcagcggccaccagagatgtgaggccctggccggggcccccctggacaatgcccccaaggagtacccacccaagatccagcagctggtgcaggacatcgccagcctgaccctgctggagatcagtgacctgaatgagctgctgaagaagaccctgaagatccaggatgtgggcctggtgcccatgggcggcgtgatgtctggagctgtgcctgctgctgctgcccaggaggccgtggaggaggacatccccatcgccaaggagaggacccacttcaccgtgcggctgacagaggccaagcctgtggacaaggtgaagctgatcaaggagatcaagaactacatccagggcatcaacctggtgcaggccaagaagctggtggagagcctgccccaggagatcaaggccaacgtggccaaggccgaggccgagaagatcaaggccgccctggaggccacccagcaggaggtgaagctgaggatgacaggcatggccctgcgggtggtgaggacagatggcatcctggccctgtacagcggcctgagcgccagcctgtgccggcagatgacctacagcctgaccaggtttgccatctatgaaacagtgcgggacagagtggccaagggcagccagggccccctgcccttccacgagaaggtgctgctgggctctgtgtctggcctggccggcggctttgtgggcaccccagctgacctggtgaatgtgaggatgcagaatgatgtgaagctgccccagggccagaggaggaactatgcccacgccctggatggcctgtacagagtggcccgggaggagggcctgcggcggctcttcagcggggccaccatggccagcagcagaggagccctggtgacagtgggccagctgagctgctatgaccaggccaagcagctggtgctgagcacaggctacctgagtgacaacatcttcacccactttgtggccagcttcatcgccggcggctgtgccaccttcctgtgccagcccctggatgtgctgaagacccggctgatgaacagcaagggggagtaccagggcgtcttccactgtgctgtggagacagccaagctgggccccctggccttctacaagggcctggtgcctgctggcatccgcctcatcccccacacagtgctgacctttgtgttcctggagcagctgaggaagaactttggcatcaaggtgcccagctag

SEQ ID NO: 159886 - DNA, 735 bp, Artificial Sequence
  Description of Artificial Sequence: Synthetic coding sequence
atgacaggcatggccctgcgggtggtgaggacagatggcatcctggccctgtacagcggcctgagcgccagcctgtgccggcagatgacctacagcctgaccaggtttgccatctatgaaacagtgcgggacagagtggccaagggcagccagggccccctgcccttccacgagaaggtgctgctgggctctgtgtctggcctggccggcggctttgtgggcaccccagctgacctggtgaatgtgaggatgcagaatgatgtgaagctgccccagggccagaggaggaactatgcccacgccctggatggcctgtacagagtggcccgggaggagggcctgcggcggctcttcagcggggccaccatggccagcagcagaggagccctggtgacagtgggccagctgagctgctatgaccaggccaagcagctggtgctgagcacaggctacctgagtgacaacatcttcacccactttgtggccagcttcatcgccggcggctgtgccaccttcctgtgccagcccctggatgtgctgaagacccggctgatgaacagcaagggggagtaccagggcgtcttccactgtgctgtggagacagccaagctgggccccctggccttctacaagggcctggtgcctgctggcatccgcctcatcccccacacagtgctgacctttgtgttcctggagcagctgaggaagaactttggcatcaaggtgcccagctag

SEQ ID NO: 159887 - DNA, 438 bp, Artificial Sequence
  Description of Artificial Sequence: Synthetic coding sequence
atggccttcttcaccggcctgtggggccccttcacctgtgtgtcccgggtgctgagccaccactgcttcagcaccaccggcagcctgagcgccatccagaagatgaccagggtgcgggtggtggacaacagcgccctgggcaacagcccctaccaccgggccccccgctgcatccacgtgtacaagaagaatggagtgggcaaggtgggggaccagatcctgctggccatcaagggccagaagaagaaggccctgattgtgggccactgcatgcctggccccaggatgacccccaggtttgacagcaacaacgtggtgctgattgaagataatggaaatcctgtgggcacccgcatcaagacccccatccccaccagcctgaggaagcgggagggggagtacagcaaggtgctggccatcgcccagaactttgtgtag

SEQ ID NO: 159888 - DNA, 891 bp, Artificial Sequence
  Description of Artificial Sequence: Synthetic coding sequence
atggccggccccctgcagggcggcggggcccgggccctggacctgctgcggggcctgccccgggtgtccctggccaacctgaagcccaaccctggcagcaagaagccagagcggcggccccggggcagaagaagaggaagaaaatgtggccggggccacaagggggagcggcagaggggcacccggccccggctgggctttgaaggaggccagacccccttctacatccgcatccccaagtatggcttcaatgaaggccacagcttccggcggcagtacaagcccctgagcctgaaccggctgcagtacctgattgacctgggccgggtggaccccagccagcccatcgacctgacccagctggtgaatggccggggcgtgaccatccagcccctgaagagggactatggagtgcagctggtggaggagggcgctgacaccttcaccgccaaggtgaacatcgaggtgcagctggccagcgagctggccatcgccgccatcgagaagaatggaggagtggtgaccacagccttctatgaccccaggagcctggacatcgtgtgcaagcctgtgcccttcttcctgcggggccagcccatccccaagaggatgctgcccccagaggagctggtgccctactacacagatgccaagaacagaggctacctggccgaccctgccaagtttcctgaggcccggctggagctggccaggaaatatggctacatcctgcctgacatcaccaaggatgagctgttcaagatgctgtgcaccaggaaggacccccggcagatcttcttcggcctggcccctggctgggtggtgaacatggctgacaagaagatcctgaagcccacagatgagaacctgctgaagtactacaccagctag

SEQ ID NO: 159889 - DNA, 756 bp, Artificial Sequence
  Description of Artificial Sequence: Synthetic coding sequence
atgtggaggctgctggcccgggccagcgcccccctgctgcgggtgcccctgagtgacagctgggccctgctgcctgccagcgctggggtgaagaccctgctgcctgtgcccagctttgaagatgtgtccatccctgagaagcccaagctgcgcttcatcgagcgggcccccctggtgcccaaggtgagaagagagcccaagaacctgagtgacatccggggccccagcacagaggccacagagttcacagagggcaactttgccatcctggccctgggcggcggctacctgcactggggccactttgagatgatgaggctgaccatcaacagatccatggaccccaagaacatgtttgccatctggagggtgcctgcccccttcaagcccatcaccaggaagtctgtgggccacaggatgggcggcggcaagggggccatcgaccactacgtgacccctgtgaaggccggccgcctggtggtggagatgggcggccgctgtgaatttgaggaggtgcagggcttcctggaccaggtggcccacaagctgccctttgctgccaaggctgtgtcccggggcaccctggagaagatgaggaaggaccaggaggagcgggagaggaacaaccagaacccctggacctttgagcgcatcgccacagccaacatgctgggcatcaggaaggtgctgagcccctatgacctgacccacaagggcaagtactggggcaagttctacatgcccaagagggtgtag

SEQ ID NO: 159890 - DNA, 528 bp, Artificial Sequence
  Description of Artificial Sequence: Synthetic coding sequence
atgaggctgtctgtggccgccgccatcagccacggccgggtcttccggaggatgggcctgggccctgagagccgcatccacctgctgaggaacctgctgaccggcctggtgagacatgagcgcatcgaggccccctgggcccgggtggatgagatgaggggctacgccgagaagctgattgattatggcaagctgggggacaccaatgaaagagccatgaggatggctgacttctggctgacagagaaggacctgatccccaagctgttccaggtgctggccccccgctacaaggaccagacaggaggctacaccaggatgctgcagatccccaacagaagcctggaccgggccaagatggctgtgattgagtacaagggcaactgcctgccccccctgcccctgccccggcgggacagccacctgaccctgctgaaccagctgctgcagggcctgcggcaggacctgcggcagagccaggaggccagcaaccacagcagccacacagcccagaccccaggcatctag

SEQ ID NO: 159891 - DNA, 543 bp, Artificial Sequence
  Description of Artificial Sequence: Synthetic coding sequence
atggccctgcggagccgcttctggggcctcttctctgtgtgcagaaatcctggctgccgctttgctgccctgagcaccagcagcgagcctgctgccaagccagaggtggaccctgtggagaatgaagctgtggcccctgagttcaccaacagaaaccccaggaacctggagctgctgtctgtggccaggaaggagcggggctggaggacagtgttccccagccgggagttctggcaccggctgcgggtcatccgcacccagcaccacgtggaggccctggtggagcaccagaatggcaaggtggtggtgtctgccagcacccgggagtgggccatcaagaagcacctgtacagcaccagaaatgtggtggcctgtgagagcatcggccgggtgctggcccagcgctgcctggaggccggcatcaacttcatggtgtaccagcccaccccctgggaggccgccagtgacagcatgaagaggctgcagagcgccatgacagagggcggcgtggtgctgcgggagccccagaggatctatgaatag

SEQ ID NO: 159892 - DNA, 879 bp, Artificial Sequence
  Description of Artificial Sequence: Synthetic coding sequence
atggccgcctgcatcgctgctggccactgggccgccatgggcctgggccgctccttccaggccgcccggaccctgctgcccccaccagccagcatcgcctgccgggtgcacgccggccctgtgcggcagcagagcacaggccccagcgagcccggggccttccagcccccacccaagcctgtgattgtggacaagcacaggcctgtggagcctgagcggcgcttcctgagccctgagttcatcccccggcggggccgcacagaccccctgaagttccagatcgagaggaaggacatgctggagaggaggaaggtgctgcacatccctgagttctacgtgggcagcatcctgcgggtgaccacagctgacccctatgccagcggcaagatcagccagttcctgggcatctgcatccagaggagcggccggggcctgggcgccaccttcatcctgagaaatgtgattgagggccagggcgtggagatctgctttgagctgtacaacccccgggtgcaggagatccaggtggtgaagctggagaagaggctggatgacagcctgctgtacctgagagatgccctgcctgagtacagcacctttgatgtgaacatgaagcctgtggtgcaggagcccaaccagaaggtgcctgtgaatgagctgaaggtgaagatgaagcccaagccctggagcaagcgctgggagcggcccaacttcaacatcaagggcatccgctttgacctgtgcctgacagagcagcagatgaaggaggcccagaagtggaaccagccctggctggagtttgacatgatgagagaatatgacaccagcaagattgaggccgccatctggaaggagattgaggccagcaagaggagctag

SEQ ID NO: 159893 - DNA, 879 bp, Artificial Sequence; identical to SEQ ID NO: 159892
  Description of Artificial Sequence: Synthetic coding sequence

SEQ ID NO: 159894 - DNA, 240 bp, Artificial Sequence
  Description of Artificial Sequence: Synthetic coding sequence
aaggtgcctgtgaatgagctgaaggtgaagatgaagcccaagccctggagcaagcgctgggagcggcccaacttcaacatcaagggcatccgctttgacctgtgcctgacagagcagcagatgaaggaggcccagaagtggaaccagccctggctggagtttgacatgatgagagaatatgacaccagcaagattgaagctgccatctggaaggagattgaggccagcaagaggagctag

SEQ ID NO: 159895 - DNA, 918 bp, Artificial Sequence
  Description of Artificial Sequence: Synthetic coding sequence
atggccctgtgtgccctgacccgggccctgcggagcctgaacctggcccccccaacagtggccgccccagcccccagcctcttccctgctgcccagatgatgaacaacggcctgctgcagcagcccagcgccctgatgctgctgccctgcaggcctgtgctgacctctgtggccctgaatgccaactttgtgtcctggaagagcaggaccaagtacaccatcacccctgtgaagatgaggaagagcggcggccgggaccacacaggccgcatccgggtgcacggcatcggcggcggccacaagcagcgctacaggatgattgacttcctgcgcttccggcctgaggagaccaagagcggcccctttgaggagaaggtgatccaggtgcgctatgacccctgccgctctgctgacatcgccctggtggccggcggcagcaggaagcgctggatcatcgccacagagaacatgcaggccggggacaccatcctgaacagcaaccacatcggccgcatggctgtggccgcccgggagggagatgcccaccccctgggcgccctgcctgtgggcaccctcatcaacaacgtggagagcgagcccggccgcggggcccagtacatccgggccgccggcacctgtggggtgctgctgaggaaggtgaatggaacagccatcatccagctgcccagcaagaggcagatgcaggtgctggagacctgtgtggccaccgtgggccgggtgtccaatgtggaccacaacaagagggtgattggcaaggccggcaggaaccgctggctgggcaagaggcccaacagcggccgctggcacaggaagggcggctgggccggcaggaagatccggcccctgccccccatgaagagctatgtgaagctgcccagcgccagcgcccagagctag

SEQ ID NO: 159896 - DNA, 450 bp, Artificial Sequence
  Description of Artificial Sequence: Synthetic coding sequence
atggtgttcctgacagcccagctgtggctgaggaacagagtgacagaccgctacttccgcatccaggaggtgctgaagcacgcccggcacttccggggcaggaagaaccgctgctaccgcctggccgtgaggacagtcatccgggcctttgtgaagtgcaccaaggcccgctacctgaagaagaagaacatgaggaccctgtggatcaaccgcatcacagctgccagccaggagcacggcctgaagtacccagccctgattggcaacctggtgaagtgccaggtggagctgaacaggaaggtgctggccgacctggccatctatgagcccaagaccttcaagagcctggccgccctggccagcagaagaagacatgagggctttgctgctgccctgggagatggcaaggagcctgagggcatcttcagccgggtggtgcagtaccactag

SEQ ID NO: 159897 - DNA, 618 bp, Artificial Sequence
  Description of Artificial Sequence: Synthetic coding sequence
atggccgccagcagcctgactgtgaccctgggccgcctggccagcgcctgcagccacagcatcctgcggcccagcggccctggagctgccagcctgtggagcgccagccgccgcttcaacagccagagcaccagctacctgcccggctacgtgcccaagaccagcctgagcagccccccctggccagaggtggtgctgcctgaccctgtggaggagaccaggcaccacgccgaggtggtgaagaaggtgaatgagatgattgtgacaggccagtatggccgcctgtttgctgtggtgcactttgccagccggcagtggaaggtgaccagtgaagatctcatcctgattggaaatgagctggacctggcctgtggggagcgcatccggctggagaaggtgctgctggtgggcgctgacaacttcaccctgctgggcaagcccctgctgggcaaggacctggtgcgggtggaggccaccgtgattgagaagacagagagctggccccgcatcatcatgaggttcaggaagaggaagaacttcaagaagaagagaattgtgaccaccccccagacagtgctgcgcatcaacagcattgagatcgccccctgcctgctgtag

SEQ ID NO: 159898 - DNA, 843 bp, Artificial Sequence
  Description of Artificial Sequence: Synthetic coding sequence
atggccgccagcagcctgactgtgaccctgggccgcctggccagcgcctgcagccacagcatcctgcggcccagcggccctggagctgccagcctgtggagcgccagccgccgcttcaacagccagagcaccagctacctgcccggctacgtgcccaagaccagcctgagcagccccccctggccagaggtggtgctgcctgaccctgtggaggagaccaggcaccacgccgaggtggtgaagaaggtgaatgagatgattgtgacaggccagtatggccgcctgtttgctgtggtgcactttgccagccggcagtggaaggtgaccagtgaagatctcatcctgattggaaatgagctggacctggcctgtggggagcgcatccggctggagaaggtgctgctggtgggcgctgacaacttcaccctgctgggcaagcccctgctgggcaaggacctggtgcgggtggaggccaccgtgattgagaagacagagagctggccccgcatcatcatgaggttcaggaagaggaagaacttcaagaagaagaggagcaagctggagaaggtgcccctgggccctgtggcccgctgctggctgcccaggaggatgaggacagagggcgtgggccacgtgggcctgggcaccggcagccctggccgcagccagcccggctgccactgccccctggccaccctcatcctggagggcgccccccggggcagcagcctggcccccctgctgctgcacgccccccgggtgaccccacccaggagccccagcccccccaggtctgcccgggaccccaccagcctgcccttcagcagcaccctgcgggcctag

SEQ ID NO: 159899 - DNA, 363 bp, Artificial Sequence
  Description of Artificial Sequence: Synthetic coding sequence
atgattgtgacaggccagtatggccgcctgtttgctgtggtgcactttgccagccggcagtggaaggtgaccagcgaggacctgatcctgattggaaatgagctggacctggcctgtggggagcgcatccggctggagaaggtgctgctggtgggcgctgacaacttcaccctgctgggcaagcccctgctgggcaaggacctggtgcgggtggaggccaccgtcatcgagaagacagagagctggccccgcatcatcatgaggttcaggaagaggaagaacttcaagaagaagagaattgtgaccaccccccagacagtgctgcgcatcaacagcattgaaattgccccctgcctgctgtag

SEQ ID NO: 159900 - DNA, 381 bp, Artificial Sequence
  Description of Artificial Sequence: Synthetic coding sequence
atgtggtacctggccaagctgatccggggcatgagcattgaccaggccctggcccagctggagttcaatgacaagaagggggccaagatcatcaaggaggtgctgctggaggcccaggacatggctgtgcgggaccacaacgtggagttccgcagcaacctgtacatcgccgagagcaccagcggccggggccagtgcctgaagaggatccgctaccacggccggggccgcttcggcatcatggagaaggtgtactgccactactttgtgaagctggtggagggccccccacctcctcctgagccccccaagacagctgtggcccacgccaaggagtacatccagcagctgcggagcaggaccatcgtgcacaccctgtag

SEQ ID NO: 159901 - DNA, 699 bp, Artificial Sequence
  Description of Artificial Sequence: Synthetic coding sequence
atggctgctgctgtgctgggccagctgggcaaggacttcctggtggtgaagaggcagaagggcgtggagatggagagcgagctgacagcctgtgtggatgtggccggggccctgtggatccacaacctgcggagccggggcaagctggccctgggcgtgctgccccagagctacatccacaccagcgccagcctggacatcagcaggaagtgggagaagaagaacaagatcgtgtacccaccccagctgcccggggagccccggcggcctgctgagatctaccactgccggcggcagatcaagtacagcaaggacaagatgtggtacctggccaagctgatccggggcatgagcattgaccaggccctggcccagctggagttcaatgacaagaagggggccaagatcatcaaggaggtgctgctggaggcccaggacatggctgtgcgggaccacaacgtggagttccgcagcaacctgtacatcgccgagagcaccagcggccggggccagtgcctgaagaggatccgctaccacggccggggccgcttcggcatcatggagaaggtgtactgccactactttgtgaagctggtggagggccccccacctcctcctgagccccccaagacagctgtggcccacgccaaggagtacatccagcagctgcggagcaggaccatcgtgcacaccctgtag

SEQ ID NO: 159902 - DNA, 639 bp, Artificial Sequence
  Description of Artificial Sequence: Synthetic coding sequence
atggctgctgctgtgctgggccagctgggcgccctgtggatccacaacctgcggagccggggcaagctggccctgggcctgctgtccttccacagcgtgctgccccagagctacatccacaccagcgccagcctggacatcagcaggaagtgggagaagaagaacaagatcgtgtacccaccccagctgcccggggagccccggcggcctgctgagatctaccactgccggcggcagatcaagtacagcaaggacaagatgtggtacctggccaagctgatccggggcatgagcattgaccaggccctggcccagctggagttcaatgacaagaagggggccaagatcatcaaggaggtgctgctggaggcccaggacatggctgtgcgggaccacaacgtggagttccgcagcaacctgtacatcgccgagagcaccagcggccggggccagtgcctgaagaggatccgctaccacggccggggccgcttcggcatcatggagaaggtgtactgccactactttgtgaagctggtggagggccccccacctcctcctgagccccccaagacagctgtggcccacgccaaggagtacatccagcagctgcggagcaggaccatcgtgcacaccctgtag

SEQ ID NO: 159903 - DNA, 621 bp, Artificial Sequence
  Description of Artificial Sequence: Synthetic coding sequence
atggctgctgctgtgctgggccagctgggcgccctgtggatccacaacctgcggagccggggcaagctggccctgggcgtgctgccccagagctacatccacaccagcgccagcctggacatcagcaggaagtgggagaagaagaacaagatcgtgtacccaccccagctgcccggggagccccggcggcctgctgagatctaccactgccggcggcagatcaagtacagcaaggacaagatgtggtacctggccaagctgatccggggcatgagcattgaccaggccctggcccagctggagttcaatgacaagaagggggccaagatcatcaaggaggtgctgctggaggcccaggacatggctgtgcgggaccacaacgtggagttccgcagcaacctgtacatcgccgagagcaccagcggccggggccagtgcctgaagaggatccgctaccacggccggggccgcttcggcatcatggagaaggtgtactgccactactttgtgaagctggtggagggccccccacctcctcctgagccccccaagacagctgtggcccacgccaaggagtacatccagcagctgcggagcaggaccatcgtgcacaccctgtag

SEQ ID NO: 159904 - DNA, 462 bp, Artificial Sequence
  Description of Artificial Sequence: Synthetic coding sequence
atggccagaaatgtggtgtaccccctgtaccgcctgggcggcccccagctgcgggtcttccgcaccaacttcttcatccagctggtgcggcctggggtggcccagccagaagatactgtgcagttccgcatccccatggagatgaccagggtggacctgaggaactacctggagggcatctacaacgtgcctgtggccgctgtgaggaccagggtgcagcacggcagcaacaagagaagagaccacagaaatgtgcgcatcaagaagccagactacaaggtggcctacgtgcagctggcccacggccagaccttcaccttcccagacctcttccctgagaaggatgagagccctgagggcagcgctgctgatgacctgtacagcatgctggaggaggagcggcagcagaggcagagcagtgaccccaggagaggaggagtgcccagctggtttggcctgtag

SEQ ID NO: 159905 - DNA, 462 bp, Artificial Sequence; identical to SEQ ID NO: 159904
  Description of Artificial Sequence: Synthetic coding sequence

SEQ ID NO: 159906 - DNA, 651 bp, Artificial Sequence
  Description of Artificial Sequence: Synthetic coding sequence
atgaggctgagcgccctgctggccctggccagcaaggtgaccctgcccccccactaccgctatggcatgagccccccaggctctgtggccgacaagaggaagaaccccccctggatcagaagaagacctgtggtggtggagcccatcagtgatgaggactggtacctgttctgtggggacacagtggagatcctggagggcaaggatgctgggaagcagggcaaggtggtgcaggtgatccggcagaggaactgggtggtggtgggcggcctgaacacccactaccgctacatcggcaagaccatggactaccggggcaccatgatccccagcgaggcccccctgctgcaccggcaggtgaagctggtggaccccatggacaggaagcccacagaaattgagtggaggttcacagaggccggggagcgggtgcgggtgtccaccaggagcggccgcatcatccccaagccagagttccccagggcagatggcatcgtgcctgagacctggattgatggccccaaggacacctctgtggaggatgccctggagaggacctacgtgccctgcctgaagaccctgcaggaggaggtgatggaggccatgggcatcaaggagaccaggaagtacaagaaggtgtactggtactag

SEQ ID NO: 159907 - DNA, 651 bp, Artificial Sequence; identical to SEQ ID NO: 159906
  Description of Artificial Sequence: Synthetic coding sequence

SEQ ID NO: 159908 - DNA, 300 bp, Artificial Sequence
  Description of Artificial Sequence: Synthetic coding sequence
atgaggctgagcgccctgctggccctggccagcaaggtgaccctgcccccccactaccgctatggcatgagccccccaggctctgtggccgacaagaggaagaaccccccctggatcagaagaagacctgtggtggtggagcccatcagtgatgaggactggtacctgttctgtggggacacagtggagatcctggagggcaaggatgctgggaagcagggcaaggtggtgcaggtgatccggcagaggaactgggtggtggtgggcggcctgaacacccactaccgctacatcggctag

SEQ ID NO: 159909 - DNA, 207 bp, Artificial Sequence
  Description of Artificial Sequence: Synthetic coding sequence
atgaggctgagcgccctgctggccctggccagcaaggtgaccctgcccccccactaccgctatggcatgagccccccaggctctgtggccgacaagaggaagaaccccccctggatcagaagaagacctgtggtggtggagcccatcagtgatgaggactggtacctgttctgtggggacacagtggagatcctggagggcaagtag

SEQ ID NO: 159910 - DNA, 522 bp, Artificial Sequence
  Description of Artificial Sequence: Synthetic coding sequence
atgaggctgagcgccctgctggccctggccagcaaggtgaccctgcccccccactaccgctatggcatgagccccccaggctctgtggccgacaagaggaagaaccccccctggatcagaagaagacctgtggtggtggagcccatcagtgatgaggactggtacctgttctgtggggacacagtggagatcctggagggcaaggatgctgggaagcagggcaaggtggtgcaggtgatccggcagaggaactgggtggtggtgggcggcctgaacacccactaccgctacatcggcaagaccatggactaccggggcaccatgatccccagcgaggcccccctgctgcaccggcaggtgaagctggtggaccccatggacaggaagcccacagaaattgagtggaggttcacagaggccggggagcgggtgcgggtgtccaccaggagcggccgcatcatccccaagccagagttccccagggcagatggcatcgtgcctgagacctggattgatggatag

SEQ ID NO: 159911 - DNA, 4395 bp, Artificial Sequence
  Description of Artificial Sequence: Synthetic coding sequence
atgttctcctttgtggacctgcggctgctgctgctgctggccgccacagccctgctgacccacggccaggaggagggccaggtggagggccaggatgaggacatcccccccatcacctgtgtgcagaatggcctgcgctaccatgacagagatgtgtggaagccagagccctgccgcatctgtgtgtgtgacaatggcaaggtgctgtgtgatgatgtgatctgtgatgagaccaagaactgccctggagctgaggtgcctgagggggagtgctgccctgtgtgcccagatggcagcgagagccccacagaccaggagaccaccggggtggagggccccaagggggacaccggcccccggggcccccggggccctgctggccccccaggaagagatggcatccctggccagcccggcctgcccggccccccaggccccccaggccccccaggccccccaggcctgggcggcaactttgccccccagctgtcctatggctatgatgagaagagcactggaggcatctctgtgcccggccccatgggccccagcggcccccggggcctgcccggccccccaggggcccctggcccccagggcttccagggccccccaggagagcccggggagcccggggccagcggccccatgggcccccggggccccccaggccccccaggcaagaatggagatgatggagaggccggcaagccaggccggcctggagagcggggccccccaggcccccagggcgcccggggcctgcccggcacagctggcctgcccggcatgaagggccaccggggcttcagcggcctggatggagccaagggagatgctggccctgctggccccaagggggagcccggcagccctggagaaaatggagcccctggccagatgggcccccggggcctgcctggagagcggggccggcctggggcccctggccctgctggggcccggggaaatgatggagccaccggggctgctggccccccaggccccactggacctgctggccccccaggcttccctggagctgtgggcgccaagggggaggccggcccccagggcccccggggcagcgagggcccccagggcgtgcggggggagcccggccccccaggccctgctggagctgctggccctgctggcaaccctggagcagatggccagcccggggccaagggggccaacggggcccctggcattgctggggcccctggcttccctggggcccggggccccagcggcccccagggccctgggggccccccaggccccaagggcaacagcggggagcccggggcccctggcagcaagggggacacaggagccaagggggagcccggccctgtgggcgtgcagggccccccaggccctgctggggaggagggcaagagaggagcccggggggagcccggccccaccggcctgcccggccccccaggagagcggggcggccctggcagccggggcttccctggagcagatggagtggccggccccaagggccctgctggggagcggggcagccctggccctgctggccccaagggcagccctggagaggccggccggcctggagaggccggcctgcccggggccaagggcctgaccggcagccctggcagccctggcccagatggcaagacaggccccccaggccctgctggccaggacggccggcccggccccccaggccccccaggggcccggggccaggccggcgtgatgggcttccctggccccaagggagctgctggggagcccgggaaggccggggagcggggcgtgcccggccccccaggagctgtgggccctgctgggaaggatggagaggccggggcccagggccccccaggccctgctggccctgctggggagcggggggagcagggccctgctggcagccctggcttccagggcctgcccggccctgctggccccccaggagaggccggcaagccaggagagcagggcgtgcctggggacctgggcgcccctggccccagcggggcccggggggagcggggcttccctggagagcggggcgtgcagggccccccaggccctgctggccccaggggggccaacggggcccctggaaatgatggagccaagggagatgctggggcccctggggcccctggcagccagggcgcccctggcctgcagggcatgcctggagagagaggagctgctggcctgcccggccccaagggggacagaggagatgctggccccaagggagcagatggcagccctgggaaggatggagtgcggggcctgaccggccccatcggccccccaggccctgctggggcccctggggacaagggggagagcggccccagcggccctgctggccccactggagcccggggggcccctggggacagaggagagcccggccccccaggccctgctggctttgctggccccccaggagcagatggccagcccggggccaagggggagcctggagatgctggggccaagggagatgctggccccccaggccctgctggccctgctggccccccaggccccatcggaaatgtgggcgcccctggggccaagggggcccggggcagcgctggccccccaggggccaccggcttccctggagctgctggccgggtgggccccccaggccccagcggaaatgccggccccccaggccccccaggccctgctgggaaggagggcggcaagggccccagaggagaaacaggccctgctggccggcctggagaggtgggccccccaggccccccaggccctgctggggagaagggcagccctggagcagatggccctgctggggcccctggcaccccaggcccccagggcattgctggccagaggggcgtggtgggcctgcccggccagagaggagagcggggcttccctggcctgcccggccccagcggggagcccgggaagcagggccccagcggggccagcggggagcggggccccccaggccccatgggccccccaggcctggccggccccccaggagagagcggccgggagggcgcccctggagctgagggcagccctggaagagatggcagccctggggccaagggggacagaggagaaacaggccctgctggccccccaggggcccctggggcccctggggcccctggccctgtgggccctgctgggaagagcggggacagaggagaaacaggccctgctggccccactggacctgtgggccctgtgggcgcccggggccctgctggcccccagggccccaggggggacaagggggagactggagagcagggcgaccggggcatcaagggccaccggggcttcagcggcctgcagggccccccaggccccccaggcagccctggagagcagggccccagcggggccagcggccctgctggcccccggggccccccaggcagcgctggggcccctgggaaggatggcctgaatggcctgcccggccccatcggccccccaggcccccggggccgcactggagatgctggccctgtgggccccccaggccccccaggccccccaggccccccaggccccccatctgctggctttgacttctccttcctgccccagcccccccaggagaaggcccatgatggcggccgctactacagagcagatgatgccaacgtggtgcgggaccgggacctggaggtggacaccaccctgaagagcctgagccagcagatcgagaacatccgcagccctgagggcagcaggaagaacccagcccggacctgccgggacctgaagatgtgccacagcgactggaagtctggagagtactggattgaccccaaccagggctgcaacctggatgccatcaaggtgttctgcaacatggagactggagagacctgtgtgtaccccacccagcccagcgtggcccagaagaactggtacatcagcaagaaccccaaggacaagagacatgtgtggtttggagagagcatgacagatggcttccagtttgaatatggaggccagggcagtgaccctgcagatgtggccatccagctgaccttcctgcggctgatgagcacagaggccagccagaacatcacctaccactgcaagaacagcgtggcctacatggaccagcagacaggcaacctgaagaaggccctgctgctgcagggcagcaatgaaattgagatccgggcagagggcaacagccgcttcacctacagcgtgacagtggatggctgcaccagccacactggagcctggggcaagacagtgattgagtacaagaccaccaagaccagccggctgcccatcattgatgtggcccccctggatgtgggcgccccagaccaggagtttggatttgatgtgggccctgtgtgcttcctgtag

SEQ ID NO: 159912 - DNA, 285 bp, Artificial Sequence
  Description of Artificial Sequence: Synthetic coding sequence
atggcctctgtggtgctggccctgcggaccaggacagctgtgaccagcctgctgagccccaccccagccacagccctggccgtgcgctatgccagcaagaagagcggcggcagcagcaagaacctgggcggcaagagcagtggaagacggcagggcatcaagaagatggagggccactacgtgcatgctggcaacatcatcgccacccagaggcacttccgctggcaccctggggcccacgtgtcctgcagcgtggccgcccccctcttccccttcctgggctag

SEQ ID NO: 159913 - DNA, 282 bp, Artificial Sequence
  Description of Artificial Sequence: Synthetic coding sequence
atggagggccactacgtgcacgccggcaacatcatcgccacccagaggcacttccgctggcaccctggggcccacgtgggcgtgggcaagaacaagtgcctgtatgccctggaggagggcatcgtgcgctacaccaaggaggtgtatgtgccccaccccaggaacacagaggccgtggacctgatcacccggctgcccaagggagctgtgctgtacaagacctttgtgcacgtggtgcctgccaagccagagggcaccttcaagctggtggccatgctgtag

SEQ ID NO: 159914 - DNA, 282 bp, Artificial Sequence; identical to SEQ ID NO: 159913
  Description of Artificial Sequence: Synthetic coding sequence

SEQ ID NO: 159915 - DNA, 771 bp, Artificial Sequence
  Description of Artificial Sequence: Synthetic coding sequence
atgcccctgcacaagtaccctgtgtggctgtggaagaggctgcagctgcgggagggcatctgcagccggctgcccggccactacctgcggagcctggaggaggagaggacccccacccctgtgcactaccggccccacggggccaagttcaagatcaaccccaagaatggccagcgggagcgggtggaggatgtgcccatccccatctacttccccccagagagccagaggggcctgtggggcggggagggctggatcctgggccagatctatgccaacaatgacaagctgagcaagaggctgaagaaggtgtggaagccccagctgtttgagcgggagttctacagcgagatcctggacaagaagttcaccgtgacagtgaccatgaggaccctggacctgattgatgaggcctacggcctggacttctacatcctgaagacccccaaggaggacctgtgcagcaagtttggcatggacctgaagaggggcatgctgctgcggctggcccggcaggacccccagctgcacccagaagatcctgagaggagagctgccatctatgacaagtacaaggagtttgccatccctgaggaggaggccgagtgggtgggcctgaccctggaggaggccatcgagaagcagaggctgctggaggagaaggaccctgtgcccctcttcaagatctacgtggccgagctgatccagcagctgcagcagcaggccctgtctgagcctgctgtggtgcagaagagggccagcggccagtag

SEQ ID NO: 159916 - DNA, 771 bp, Artificial Sequence; identical to SEQ ID NO: 159915
  Description of Artificial Sequence: Synthetic coding sequence

SEQ ID NO: 159917 - DNA, 771 bp, Artificial Sequence
  Description of Artificial Sequence: Synthetic coding sequence
atgcccctgcacaagtaccctgtgtggctgtggaagaggctgcagctgcgggagggcatctgcagccggctgcccggccactacctgcggagcctggaggaggagaggacccccacccctgtgcactaccggccccacggggccaagttcaagatcaaccccaagaatggccagcgggagcgggtggaggatgtgcccatccccatctacttccccccagagagccagaggggcctgtggggcggggagggctggatcctgggccagatctatgccaacaatgacaagctgagcaagaggctgaagaaggtgtggaagccccagctgtttgagcgggagttctacagcgagatcctggacaagaagttcaccgtgacagtgaccatgaggaccctggacctgattgatgaggcctacggcctggacttctacatcctgaaggccagcggggaggacctgtgcagcaagtttggcatggacctgaagaggggcatgctgctgcggctggcccggcaggacccccagctgcacccagaagatcctgagaggagagctgccatctatgacaagtacaaggagtttgccatccctgaggaggaggccgagtgggtgggcctgaccctggaggaggccatcgagaagcagaggctgctggaggagaaggaccctgtgcccctcttcaagatctacgtggccgagctgatccagcagctgcagcagcaggccctgtctgagcctgctgtggtgcagaagagggccagcggccagtag

SEQ ID NO: 159918 - DNA, 771 bp, Artificial Sequence; identical to SEQ ID NO: 159917
  Description of Artificial Sequence: Synthetic coding sequence

SEQ ID NO: 159919 - DNA, 147 bp, Artificial Sequence
  Description of Artificial Sequence: Synthetic coding sequence
atgagccgggccggcggccgcggggagcagagccgctggggcagaagagctgagctgcggggcctgggccggcctgaggcccccctgcggctgggcccagatgtgtgtggctctgtgccctgtgcccggggagctggcagcgagtag

SEQ ID NO: 159920 - DNA, 723 bp, Artificial Sequence
  Description of Artificial Sequence: Synthetic coding sequence
atgcccctgcacaagtaccctgtgtggctgtggaagaggctgcagctgcgggagggcatctgcagccggctgcccggccactacctgcggagcctggaggaggagaggacccccacccctgtgcactaccggccccacggggccaagttcaagatcaaccccaagaatggccagcgggagcgggtggaggatgtgcccatccccatctacttccccccagagagccagaggggcctgtggggcggggagggctggatcctgggccagatctatgccaacaatgacaagctgagcaagaggctgaagaaggtgtggaagccccagctgtttgagcgggagttctacagcgagatcctggacaagaagttcaccgtgacagtgaccatgaggaccctggacctgattgatgaggcctacggcctggacttctacatcctgaagacccccaaggaggacctgtgcagcaagtttggcatggacctgaagaggggcatgctgctgcggctggcccggcaggacccccagctgcacccagaagatcctgagaggagagctgccatctatgacaagtacaaggagtttgccatccctgaggaggaggccgagtgggtgggcctgaccctggaggaggccatcgagaagcagaggctgctggaggagaaggaccctgtgcccctcttcaagatctacgtggccgagctgatccagcagctgcagcagtag

SEQ ID NO: 159921 - DNA, 657 bp, Artificial Sequence
  Description of Artificial Sequence: Synthetic coding sequence
atgcccctgcacaagtaccctgtgtggctgtggaagaggctgcagctgcgggagggcatctgcagccggctgcccggccactacctgcggagcctggaggaggagaggacccccacccctgtgcactaccggccccacggggccaagttcaagatcaaccccaagaatggccagcgggagcgggtggaggatgtgcccatccccatctacttccccccagagagccagaggggcctgtggggcggggagggctggatcctgggccagatctatgccaacaatgacaagctgagcaagaggctgaagaaggtgtggaagccccagctgtttgagcgggagttctacagcgagatcctggacaagaagttcaccgtgacagtgaccatgaggaccctggacctgattgatgaggcctacggcctggacttctacatcctgaagacccccaaggaggacctgtgcagcaagtttggcatggacctgaagaggggcatgctgctgcggctggcccggcaggacccccagctgcacccagaagatcctgagaggagagctgccatctatgacaagtacaaggagtttgccatccctgaggaggaggccgagtgggtgggcctgaccctggaggaggccatcgagaagcagaggctgctgtag

SEQ ID NO: 159922 - DNA, 585 bp, Artificial Sequence
  Description of Artificial Sequence: Synthetic coding sequence
atgcccctgcacaagtaccctgtgtggctgtggaagaggctgcagctgcgggagggcatctgcagccggctgcccggccactacctgcggagcctggaggaggagaggacccccacccctgtgcactaccggccccacggggccaagttcaagatcaaccccaagaatggccagcgggagcgggtggaggatgtgcccatccccatctacttccccccagagagccagaggggcctgtggggcggggagggctggatcctgggccagatctatgccaacaatgacaagctgagcaagaggctgaagaaggtgtggaagccccagctgtttgagcgggagttctacagcgagatcctggacaagaagttcaccgtgacagtgaccatgaggaccctggacctgattgatgaggcctacggcctggacttctacatcctgaagacccccaaggaggacctgtgcagcaagtttggcatggacctgaagaggggcatgctgctgcggctggcccggcaggacccccagctgcacccagaagatcctgagaggagagctgccatctatgacaagtacaaggagttctag

SEQ ID NO: 159923 - DNA, 1047 bp, Artificial Sequence
  Description of Artificial Sequence: Synthetic coding sequence
atgcctggctggaggctgctgacccaggtgggcgcccaggtgctgggccgcctgggagatggcctgggcgccgccctgggccctggcaacagaacccacatctggctgtttgtgcggggcctgcacggcaagagcggcacctggtgggatgagcacctgtctgaggagaatgtgcccttcatcaagcagctggtgtctgatgaggacaaggcccagctggccagcaagctgtgccccctgaaggatgagccctggcccatccacccctgggagcccggcagcttccgggtgggcctcatcgccctgaagctgggcatgatgcccctgtggaccaaggatggccagaagcacgtggtgaccctgctgcaggtgcaggactgccacgtgctgaagtacaccagcaaggagaactgcaatggcaagatggccaccctgtctgtgggcggcaagacagtgagccgcttcaggaaggccaccagcatcctggagttctaccgggagctgggcctgccccccaagcagacagtgaagatcttcaacatcacagacaatgctgccatcaagccaggcacccccctgtatgctgcccacttccggcccggccagtatgtggatgtgacagccaagaccatcggcaagggcttccagggcgtgatgaagcgctggggcttcaagggccagcctgccacccacggccagaccaagacccaccggcggcctggagctgtggccactggagacatcggccgggtgtggccaggcaccaagatgcctgggaagatgggcaacatctacagaacagaatatggcctgaaggtgtggaggatcaacaccaagcacaacatcatctacgtgaatggatctgtgcccggccacaagaactgcctggtgaaggtgaaggacagcaagctgcctgcctacaaggacctgggcaagaacctgcccttccccacctacttcccagatggagatgaggaggagctgcctgaggacctgtatgatgaaaatgtgtgccagcccggggcccccagcatcacctttgcctag

SEQ ID NO: 159924 - DNA, 1128 bp, Artificial Sequence
  Description of Artificial Sequence: Synthetic coding sequence
atgcctggctggaggctgctgacccaggtgggcgcccaggtgctgggccgcctgggagatggcctgggcgccgccctgggccctggcaacagagtgaccaccaacagcctgaatgtgtccctcatcagaagaaatgtgggcagcgaggagaaggtgggggacctgaagaagaggacccacatctggctgtttgtgcggggcctgcacggcaagagcggcacctggtgggatgagcacctgtctgaagaaaatgtgcccttcatcaagcagctggtgtctgatgaggacaaggcccagctggccagcaagctgtgccccctgaaggatgagccctggcccatccacccctgggagcccggcagcttccgggtgggcctgattgccctgaagctgggcatgatgcccctgtggaccaaggatggccagaagcacgtggtgaccctgctgcaggtgcaggactgccacgtgctgaagtacaccagcaaagaaaactgcaatggcaagatggccaccctgtctgtgggcggcaagacagtgagccgcttcaggaaggccaccagcatcctggagttctaccgggagctgggcctgccccccaagcagacagtgaagatcttcaacatcacagacaatgctgccatcaagccaggcacccccctgtatgctgcccacttccggcccggccagtatgtggatgtgacagccaagaccatcggcaagggcttccagggcgtgatgaagcgctggggcttcaagggccagcctgccacccacggccagaccaagacccacagaagacctggagctgtggccaccggggacatcggccgggtgtggccaggcaccaagatgcctgggaagatgggcaacatctacagaacagaatatggcctgaaggtgtggaggatcaacaccaagcacaacatcatctacgtgaatggatctgtgcccggccacaagaactgcctggtgaaggtgaaggacagcaagctgcctgcctacaaggacctgggcaagaacctgcccttccccacctacttcccagatggagatgaggaggagctgcctgaggacctgtatgatgaaaatgtgtgccagcccggggcccccagcatcacctttgcctag

SEQ ID NO: 159925 - DNA, 1092 bp, Artificial Sequence
  Description of Artificial Sequence: Synthetic coding sequence
tgattcttccccagccagagggccagcgctggggacagaagtggcggccactgtgagaacttccccacagccacagccagcacctggcgctggaggggggacagcctgaaggccgagcggcagggcgccaggaagagcacccacatctggctgtttgtgcggggcctgcacggcaagagcggcacctggtgggatgagcacctgtctgaagaaaatgtgcccttcatcaagcagctggtgtctgatgaggacaaggcccagctggccagcaagctgtgccccctgaaggatgagccctggcccatccacccctgggagcccggcagcttccgggtgggcctgattgccctgaagctgggcatgatgcccctgtggaccaaggatggccagaagcacgtggtgaccctgctgcaggtgcaggactgccacgtgctgaagtacaccagcaaagaaaactgcaatggcaagatggccaccctgtctgtgggcggcaagacagtgagccgcttcaggaaggccaccagcatcctggagttctaccgggagctgggcctgccccccaagcagacagtgaagatcttcaacatcacagacaatgctgccatcaagccaggcacccccctgtatgctgcccacttccggcccggccagtatgtggatgtgacagccaagaccatcggcaagggcttccagggcgtgatgaagcgctggggcttcaagggccagcctgccacccacggccagaccaagacccacagaagacctggagctgtggccaccggggacatcggccgggtgtggccaggcaccaagatgcctgggaagatgggcaacatctacagaacagaatatggcctgaaggtgtggaggatcaacaccaagcacaacatcatctacgtgaatggatctgtgcccggccacaagaactgcctggtgaaggtgaaggacagcaagctgcctgcctacaaggacctgggcaagaacctgcccttccccacctacttcccagatggagatgaggaggagctgcctgaggacctgtatgatgaaaatgtgtgccagcccggggcccccagcatcacctttgcctag

SEQ ID NO: 159926 - DNA, 486 bp, Artificial Sequence
  Description of Artificial Sequence: Synthetic coding sequence
atggccggcatcctgcggctggtggtgcagtggcccccaggccgcctgcagacagtgaccaagggcgtggagagcctcatctgcacagactggatccgccacaagttcaccaggagccgcatccctgagaaggtgttccaggccagcccagaagatcatgagaagtatggaggagacccccagaacccccacaagctgcacatcgtgacccgcatcaagagcaccaggagaagaccctactgggagaaggacatcatcaagatgctgggcctggagaaggcccacaccccccaggtgcacaagaacatccccagcgtgaatgccaagctgaaggtggtgaagcacctgatccgcatcaagcccctgaagctgccccagggcctgcctgctgaggagaacatgagcaacacctgcctgaagagcactggagagctggtggtgcagtggcacctgaagcctgtggagcagaaggcccacgagagctag

SEQ ID NO: 159927 - DNA, 486 bp, Artificial Sequence; identical to SEQ ID NO: 159926
  Description of Artificial Sequence: Synthetic coding sequence

SEQ ID NO: 159928 - DNA, 705 bp, Artificial Sequence
  Description of Artificial Sequence: Synthetic coding sequence
atggccgagcggggctacagcttcagcctgaccaccttcagccccagcggcaagctggtgcagatcgagtatgccctggccgctgtggccggcggggcccccagcgtgggcatcaaggccgccaacggggtggtgctggccacagagaagaagcagaagagcatcctgtatgatgagaggtctgtgcacaaggtggagcccatcaccaagcacatcggcctggtgtacagcggcatgggccctgactacagagtgctggtgcaccgggccaggaagctggcccagcagtactacctggtgtaccaggagcccatccccacagcccagctggtgcagagggtggcctctgtgatgcaggagtacacccagagcggcggcgtgcggcccttcggcgtgtccctgctgatctgtggctggaatgaaggccggccctacctgttccagagcgaccccagcggggcctactttgcctggaaggccacagccatgggcaagaactacgtgaatggcaagaccttcctggagaagcgctacaatgaagacctggagctggaggatgccatccacacagccatcctgaccctgaaggagagctttgagggccagatgacagaggacaacatcgaggtgggcatctgcaatgaggccggcttccggcggctgacccccacagaggtgaaggactacctggccgccatcgcctag

SEQ ID NO: 159929 - DNA, 324 bp, Artificial Sequence
  Description of Artificial Sequence: Synthetic coding sequence
atggccctggccatgctggtgctggtggtgagcccctggagcgctgcccggggcgtgctgaggaactactgggagcggctgctgaggaagctgccccagagccggcccggcttccccagccccccctggggccctgccctggccgtgcagggccctgccatgttcacagagcccgccaatgacaccagcggcagcaaagaaaacagcagcctgctggacagcatcttctggatggccgcccccaagaacagaaggaccatcgaggtgaaccgctgcagaagaagaaacccccagaagctgatcaaggtgaaggtgatgcactag

SEQ ID NO: 159930 - DNA, 279 bp, Artificial Sequence
  Description of Artificial Sequence: Synthetic coding sequence
atggctgtgctggccggcagcctgctgggccccaccagccgctctgctgccctgctgggcggccgctggctgcagccccgggcctggctgggcttcccagatgcctggggcctgcccaccccccagcaggcccggggcaaggcccggggaaatgagtaccagcccagcaacatcaagaggaagaacaagcacggctgggtgcggcggctgagcaccccagctggggtgcaggtgatcctgcggaggatgctgaagggcaggaagagcctgagccactag

SEQ ID NO: 159931 - DNA, 513 bp, Artificial Sequence
  Description of Artificial Sequence: Synthetic coding sequence
atggccgccagcgcctttgctggagctgtgcgggccgccagcggcatcctgcggcccctgaacatcctggccagcagcacctacagaaactgtgtgaagaatgccagcctcatcagcgccctgagcacaggccgcttcagccacatccagacccctgtggtgagcagcaccccccggctgaccaccagcgagaggaacctgacctgtggccacaccagcgtcatcctgaacaggatggcccctgtgctgcccagcgtgctgaagctgcctgtgcgcagcctgacctacttcagcgccaggaagggcaagaggaagacagtgaaggctgtgattgaccgcttcctgcggctgcactgcggcctgtgggtgcggaggaaggccggctacaagaagaagctgtggaagaagaccccagccaggaagaagaggctgcgggagtttgtgttctgcaacaagacccagagcaagctgctggacaagatgaccaccagcttctggaagagaagaaattag

SEQ ID NO: 159932 - DNA, 567 bp, Artificial Sequence
  Description of Artificial Sequence: Synthetic coding sequence
atggccgccagcgcctttgctggagctgtgcgggccgccagcggcatcctgcggcccctgaacatcctggccagcagcacctacagaaactgtgtgaagaatgccagcctcatcagcgccctgagcacaggccgcttcagccacatccagacccctgtggtgagcagcaccccccggctgaccaccagcgagaggaacctgacctgtggccacaccagcgtcatcctgaacaggatggcccctgtgctgcccagcgtgctgaagctgcctgtgcgcagcctgacctacttcagcgccaggaagggcaagaggaagacagtgaaggctgtgattgaccgcttcctgcggctgcactgcggcctgtgggtgcggaggaaggccggctacaagaagaagctgtggaagaagaccccagccaggaagaagaggctgcgggagtttgtgttctgcaacaagacccagagcaagctgctggacaagatgaccaccagcttctggaagagaagaaactggtacgtggatgacccctaccagaagtaccatgacaggaccaacctgaaggtgtag

SEQ ID NO: 159933 - DNA, 312 bp, Artificial Sequence
  Description of Artificial Sequence: Synthetic coding sequence
atggccaacctcttcatcaggaagatggtgaaccccctgctgtacctgagccgccacacagtgaagccccgggccctgagcaccttcctgtttggcagcatcagaggagctgcccctgtggccgtggagcccggggctgctgtgcgcagcctgctgagccctggcctgctgccccacctgctgcctgccctgggcttcaagaacaagacagtgctgaagaagcgctgcaaggactgctacctggtgaagaggcggggccgctggtacgtgtactgcaagacccaccccaggcacaagcagaggcagatgtag

SEQ ID NO: 159934 - DNA, 312 bp, Artificial Sequence; identical to SEQ ID NO: 159933
  Description of Artificial Sequence: Synthetic coding sequence

SEQ ID NO: 159935 - DNA, 312 bp, Artificial Sequence; identical to SEQ ID NO: 159933
  Description of Artificial Sequence: Synthetic coding sequence

SEQ ID NO: 159936 - DNA, 312 bp, Artificial Sequence; identical to SEQ ID NO: 159933
  Description of Artificial Sequence: Synthetic coding sequence

SEQ ID NO: 159937 - DNA, 1251 bp, Artificial Sequence
  Description of Artificial Sequence: Synthetic coding sequence
atgcactttgtgccctggctggcccggcccatcttccccccctgggaccggggctacaaggacccccgcttctaccgcagcccccccctgcacgagcaccccctgtacaaggaccaggcctgctacatcttccaccaccgctgccgcctgctggagggcgtgaagcaggccctgtggctgaccaagaccaagctgattgagggcctgcctgagaaggtgctgagcctggtggatgaccccaggaaccacatcgagaaccaggatgaatgtgtgctgaatgtcatcagccacgcccggctgtggcagaccacagaggagatccccaagcgggagacctactgccctgtgattgtggacaacctgatccagctgtgcaagagccagatcctgaagcaccccagcctggcccggcgcatctgtgtgcagaacagcaccttcagcgccacctggaaccgggagagcctgctgctgcaggtgcggggcagcggcggggcccggctgagcaccaaggaccccctgcccaccatcgccagccgggaggagattgaggccaccaagaaccacgtgctggagaccttctaccccatcagccccatcatcgacctgcacgagtgcaacatctatgatgtgaagaatgacaccggcttccaggagggctacccctacccctacccccacaccctgtacctgctggacaaggccaacctgcggccccaccggctgcagcctgaccagctgcgggccaagatgatcctgtttgcctttggaagtgccctggcccaggcccggctgctgtatggaaatgatgccaaggtgctggagcagcctgtggtggtgcagagcgtgggcacagatggccgggtcttccacttcctggtgttccagctgaacaccacagacctggactgcaatgaaggagtgaagaacctggcctgggtggacagcgaccagctgctgtaccagcacttctggtgcctgcctgtgatcaagaagagggtggtggtgacaggcccctgcttcagcaagagccagatgagcaccagctttgtgctgacccccagcttcaatgctggggaggaggtgatgcagaggaacctgcgggccagcgccagcctgccccccagcacaggcagccctgccagcgagctggtgaaggagcaggagcacgccgccggccgggtgctgcggcgggtgatgctggacagcgagaccccccgggaggagctgcctgctgctgacttctggaagtag

SEQ ID NO: 159938 - DNA, 879 bp, Artificial Sequence
  Description of Artificial Sequence: Synthetic coding sequence
atgtctggggcctgtgccccccggggcagccgcagcctgctgccctggattggctgcaccaggagcctggactggagccccagccccctgcggggccgctgcaccagctgccccggctggaggggccgctccttccggcctggaacagctgccaccaggacccagggcagcacagcccggcccctcttcaccagcatccgctgcaccaagaccaggcctgccatctccttcaccaccgtggccgccttcagccgcagcctgctgctgcaggtgcggggcagcggcggggcccggctgagcaccaaggaccccctgcccaccatcgccagccgggaggagattgaggccaccaagaaccacgtgctggagaccttctaccccatcagccccatcatcgacctgcacgagtgcaacatctatgatgtgaagaatgacaccggcttccaggagggctacccctacccctacccccacaccctgtacctgctggacaaggccaacctgcggccccaccggctgcagcctgaccagctgcgggccaagatgatcctgtttgcctttggaagtgccctggcccaggcccggctgctgtatggaaatgatgccaaggtgctggagcagcctgtggtggtgcagagcgtgggcacagatggccgggtcttccacttcctggtgttccagctgaacaccacagacctggactgcaatgaaggagtgaagaacctggcctgggtggacagcgaccagctgctgtaccagcacttctggtgcctgcctgtgatcaagaagagggtggtggtggagcctgtgggccctgtgggcttcaagccagagaccttcaggaagttcctggccctgtacctgcatggagctgcctag

SEQ ID NO: 159939 - DNA, 1272 bp, Artificial Sequence
  Description of Artificial Sequence: Synthetic coding sequence
atggccctggccagcggccctgcccggcgggccctggccggcagcggccagctgggcctgggcggctttggagcccccaggagaggagcctatgagtggggcgtgcgcagcaccaggaagtctgagcccccacccctggacagagtgtatgagatccctggcctggagcccatcacctttgctgggaagatgcactttgtgccctggctggcccggcccatcttccccccctgggaccggggctacaaggacccccgcttctaccgcagcccccccctgcacgagcaccccctgtacaaggaccaggcctgctacatcttccaccaccgctgccgcctgctggagggcgtgaagcaggccctgtggctgaccaagaccaagctgattgagggcctgcctgagaaggtgctgagcctggtggatgaccccaggaaccacatcgagaaccaggatgaatgtgtgctgaatgtcatcagccacgcccggctgtggcagaccacagaggagatccccaagcgggagacctactgccctgtgattgtggacaacctgatccagctgtgcaagagccagatcctgaagcaccccagcctggcccggcgcatctgtgtgcagaacagcaccttcagcgccacctggaaccgggagagcctgctgctgcaggtgcggggcagcggcggggcccggctgagcaccaaggaccccctgcccaccatcgccagccgggaggagattgaggccaccaagaaccacgtgctggagaccttctaccccatcagccccatcatcgacctgcacgagtgcaacatctatgatgtgaagaatgacaccggcttccaggagggctacccctacccctacccccacaccctgtacctgctggacaaggccaacctgcggccccaccggctgcagcctgaccagctgcgggccaagatgatcctgtttgccttcggcagcgccctggcccaggcccggctgctgtatggaaatgatgccaaggtgctggagcagcctgtggtggtgcagagcgtgggcacagatggccgggtcttccacttcctggtgttccagctgaacaccacagacctggactgcaatgaaggagtgaagaacctggcctgggtggacagcgaccagctgctgtaccagcacttctggtgcctgcccgtcatcaagaagagggtggtggtggagcctgtgggccctgtgggcttcaagccagagaccttcaggaagttcctggccctgtacctgcacggggccgcctag

SEQ ID NO: 159940 - DNA, 795 bp, Artificial Sequence
  Description of Artificial Sequence: Synthetic coding sequence
tgaagcctgctgctgcaggtgcggggcagcggcggggcccggctgagcaccaaggaccccctgcccaccatcgccagccgggaggagattgaggccaccaagaaccacgtgctggagaccttctaccccatcagccccatcatcgacctgcacgagtgcaacatctatgatgtgaagaatgacaccggcttccaggagggctacccctacccctacccccacaccctgtacctgctggacaaggccaacctgcggccccaccggctgcagcctgaccagctgcgggccaagatgatcctgtttgcctttggaagtgccctggcccaggcccggctgctgtatggaaatgatgccaaggtgctggagcagcctgtggtggtgcagagcgtgggcacagatggccgggtcttccacttcctggtgttccagctgaacaccacagacctggactgcaatgaaggagtgaagaacctggcctgggtggacagcgaccagctgctgtaccagcacttctggtgcctgcctgtgatcaagaagagggtggtggtgacaggcccctgcttcagcaagagccagatgagcaccagctttgtgctgacccccagcttcaatgctggggaggaggtgatgcagaggaacctgcgggccagcgccagcctgccccccagcacaggcagccctgccagcgagctggtgaaggagcaggagcacgccgccggccgggtgctgcggcgggtgatgctggacagcgagaccccccgggaggagctgcctgctgctgacttctggaagtag

SEQ ID NO: 159941 - DNA, 1143 bp, Artificial Sequence
  Description of Artificial Sequence: Synthetic coding sequence
atggccgccccctggtggagggctgccctgtgtgagtgccgccgctggaggggcttcagcaccagcgctgtgctgggccgccgcaccccacccctgggccccatgcccaacagcgacatcgacctgagcaacctggagcggctggagaagtaccgcagctttgaccgctacagaagaagagctgagcaggaggcccaggccccccactggtggaggacctaccgggagtactttggagagaagacagaccccaaggagaagattgacatcggcctgcccccacccaaggtgtccaggacccagcagctgctggagaggaagcaggccatccaggagctgcgggccaacgtggaggaggagcgggccgcccggctgaggacagcctctgtgcccctggatgctgtgcgggcagagtgggagaggacctgtggcccctaccacaagcagaggctggccgagtactacggcctgtacagagacctcttccatggagccacctttgtgccccgggtgcccctgcacgtggcctatgctgtgggagaagatgacctgatgcctgtgtactgtggaaatgaggtgacccccacagaggccgcccaggcccctgaggtgacctatgaggccgaggagggcagcctgtggaccctgctgctgaccagcctggatggccacctgctggagccagatgctgagtacctgcactggctgctgaccaacatccctggcaacagagtggccgagggccaggtgacctgcccctacctgccccccttccctgcccggggcagcggcatccaccggctggccttcctgctcttcaagcaggaccagcccatcgacttctctgaagatgcccggcccagcccctgctaccagctggcccagaggaccttccgcacctttgacttctacaagaagcaccaggagaccatgaccccagctggcctgtccttcttccagtgccgctgggatgacagcgtgacctacatcttccaccagctgctggacatgagggagcctgtgtttgaatttgtgcggcccccaccctaccaccccaagcagaagcgcttcccccaccggcagcccctgcgctacctggaccgctacagagacagccatgagcccacctacggcatctactag

SEQ ID NO: 159942 - DNA, 591 bp, Artificial Sequence
  Description of Artificial Sequence: Synthetic coding sequence
atgcctgtgtactgtggaaatgaggtgacccccacagaggccgcccaggcccctgaggtgacctatgaggccgaggagggcagcctgtggaccctgctgctgaccagcctggatggccacctgctggagccagatgctgagtacctgcactggctgctgaccaacatccctggcaacagagtggccgagggccaggtgacctgcccctacctgccccccttccctgcccggggcagcggcatccaccggctggccttcctgctcttcaagcaggaccagcccatcgacttctctgaagatgcccggcccagcccctgctaccagctggcccagaggaccttccgcacctttgacttctacaagaagcaccaggagaccatgaccccagctggcctgtccttcttccagtgccgctgggatgacagcgtgacctacatcttccaccagctgctggacatgagggagcctgtgtttgaatttgtgcggcccccaccctaccaccccaagcagaagcgcttcccccaccggcagcccctgcgctacctggaccgctacagagacagccatgagcccacctacggcatctactag

SEQ ID NO: 159943 - DNA, 1062 bp, Artificial Sequence
  Description of Artificial Sequence: Synthetic coding sequence
atggaggccctggccatgggcagccgggccctgcggctgtggctggtggcccctgggggcggcatcaagtggaggttcatcgccaccagcagcgccagccagctgagccccacagagctgacagagatgagaaatgacctcttcaacaaggagaaggcccggcagctgagcctgacccccaggacagagaagattgaggtgaagcacgtgggcaagacagatcctggcaccgtgtttgtgatgaacaagaacatcagcaccccctacagctgtgccatgcacctgtctgagtggtactgcaggaagagcatcctggccctggtggatggccagccctgggacatgtacaagcccctgaccaagagctgtgagatcaagttcctgaccttcaaggactgtgaccctggagaggtgaacaaggcctactggaggagctgtgccatgatgatgggctgcgtcatcgagcgggccttcaaggatgagtacatggtgaacctggtgcgggcccctgaggtgcctgtgatcagcggggccttctgctatgatgtggtgctggacagcaagctggatgagtggatgcccaccaaggagaacctgcgctccttcaccaaggatgcccacgccctgatctacaaggacctgccctttgagaccctggaggtggaggccaaggtggccctggagatcttccagcacagcaagtacaaggtggacttcatcgaggagaaggccagccagaaccctgagagaattgtgaagctgcacagaattggagacttcattgatgtgtctgagggccccctcatccccaggaccagcatctgcttccagtatgaggtgtctgctgtgcacaacctgcagcccacccagcccagcctcatccgccgcttccagggcgtgtccctgcctgtgcacctgcgggcccacttcaccatctgggacaagctgctggagaggagcaggaagatgacccccttccccatcctgctgctcttcaccacccagagcttcttcaccaccagccctgagagctacctgctgcacggcaccgtgtctgagtag

SEQ ID NO: 159944 - DNA, 1017 bp, Artificial Sequence
  Description of Artificial Sequence: Synthetic coding sequence
atggaggccctggccatgggcagccgggccctgcggctgtggctggtggcccctgggggcggcatcaagtggaggttcatcgccaccagcagcgccagccagctgagccccacagagctgacagagatgagaaatgacctcttcaacaaggagaaggcccggcagctgagcctgacccccaggacagagaagattgaggtgaagcacgtgggcaagacagatcctggcaccgtgtttgtgatgaacaagaacatcagcaccccctacagctgtgccatgcacctgtctgagtggtactgcaggaagagcatcctggccctggtggatggccagccctgggacatgtacaagcccctgaccaagagctgtgagatcaagttcctgaccttcaaggactgtgaccctggagaggtgaacaaggcctactggaggagctgtgccatgatgatgggctgcgtcatcgagcgggccttcaaggatgagtacatggtgaacctggtgcgggcccctgaggtgcctgtgatcagcggggccttctgctatgatgtggtgctggacagcaagctggatgagtggatgcccaccaaggagaacctgcgctccttcaccaaggatgcccacgccctgatctacaaggacctgccctttgagaccctggaggtggaggccaaggtggccctggagatcttccagcacagcaagtacaaggtggacttcatcgaggagaaggccagccagaaccctgagagaattgtgaagctgcacagaattggagacttcattgatgtgtctgagggccccctcatccccaggaccagcatctgcttccagtatgaggtgtctgctgtgcacaacctgcagcccacccagcccagcctcatccgccgcttccagggcgtgtccctgcctgtgcacctgcgggcccacttcaccatctgggacaagctgctggagaggagcaggaagatggtgacagaggaccagagcaaggccacagaggagtgcaccagcacctag

SEQ ID NO: 159945 - DNA, 936 bp, Artificial Sequence
  Description of Artificial Sequence: Synthetic coding sequence
atgctgcagtttgtgcgggccggggcccgggcctggctgcggcccaccggcagccagggcctgagcagcctggccgaggaggccgcccgggccacagaaaatcctgagcaggtggccagcgagggcctgcctgagcctgtgctgaggaaggtggagctgcctgtgcccacccacagaagacctgtgcaggcctgggtggagagcctgcggggctttgagcaggagcgggtgggcctggccgacctgcacccagatgtgtttgccacagccccccggctggacatcctgcaccaggtggccatgtggcagaagaacttcaagaggatctcctatgccaagaccaagaccagggctgaggtgcggggcggcggcaggaagccctggccccagaagggcaccggccgggcccggcacggcagcatccgcagccccctgtggaggggcggcggcgtggcccacggcccccggggccccaccagctactactacatgctgcccatgaaggtgcgggccctgggcctgaaggtggccctgactgtgaagctggcccaggatgacctgcacatcatggacagcctggagctgcccactggagacccccagtacctgacagagctggcccactaccgccgctggggagacagcgtgctgctggtggacctgacccatgaggagatgccccagagcatcgtggaggccaccagccggctgaagaccttcaacctgatcccagctgtgggcctgaatgtgcacagcatgctgaagcaccagaccctggtgctgaccctgcccaccgtggccttcctggaggacaagctgctgtggcaggacagccgctaccggcccctgtaccccttcagcctgccctacagcgacttcccccggcccctgccccacgccacccagggccctgctgccaccccctaccactgctag

SEQ ID NO: 159946 - DNA, 936 bp, Artificial Sequence; identical to SEQ ID NO: 159945
  Description of Artificial Sequence: Synthetic coding sequence

SEQ ID NO: 159947 - DNA, 792 bp, Artificial Sequence
  Description of Artificial Sequence: Synthetic coding sequence
atgctgcagtttgtgcgggccggggcccgggcctggctgcggcccaccggcagccagggcctgagcagcctggccgaggaggccgcccgggccacagaaaatcctgagcaggtggccagcgagggcctgcctgagcctgtgctgaggaaggtggagctgcctgtgcccacccacagaagacctgtgcaggcctgggtggagagcctgcggggctttgagcaggagcgggtgggcctggccgacctgcacccagatgtgtttgccacagccccccggctggacatcctgcaccaggtggccatgtggcagaagaacttcaagaggatctcctatgccaagaccaagaccagggctgaggtgcggggcggcggcaggaagccctggccccagaagggcaccggccgggcccggcacggcagcatccgcagccccctgtggaggggcggcggcgtggcccacggcccccggggccccaccagctactactacatgctgcccatgaaggtgcgggccctgggcctgaaggtggccctgactgtgaagctggcccaggatgacctgcacatcatggacagcctggagctgcccactggagacccccagtacctgacagagctggcccactaccgccgctggggagacagcgtgctgctggtggacctgacccatgaggagatgccccagagcatcgtggaggccaccagccggctgaagaccttcaacctgatcccagctgtgggggagcagagggcccaggccccccgggtgaggatgtgccgcctgcgctgctag

SEQ ID NO: 159948 - DNA, 792 bp, Artificial Sequence; identical to SEQ ID NO: 159947
  Description of Artificial Sequence: Synthetic coding sequence

SEQ ID NO: 159949 - DNA, 414 bp, Artificial Sequence
  Description of Artificial Sequence: Synthetic coding sequence
atgggcgtgctggccgctgctgcccgctgcctggtgagaggagctgacaggatgagcaagtggaccagcaagaggggccccaggagcttccggggcaggaagggccgcggggccaagggcatcggcttcctgaccagcggctggaggtttgtgcagatcaaggagatggtgcctgagtttgtggtgcctgacctgaccggcttcaagctgaagccctacgtgtcctacctggcccctgagagcgaggagacccccctgacagctgcccagctgttcagcgaggccgtggccccagccatcgagaaggacttcaaggatggcacctttgatcctgacaacctggagaagtatggctttgagcccacccaggagggcaagctgttccagctgtaccccaggaacttcctgaggtag

SEQ ID NO: 159950 - DNA, 429 bp, Artificial Sequence
  Description of Artificial Sequence: Synthetic coding sequence
atgggagatgtgaaggagaactacctggagaccttcatcagcagccccaagtttggccgcacctgtgctgatggagccctgtactgtgtgtgccacaagagcacctacagccccctgcctgatgactacaactgcaatgtggagctggccctgaccagtgatggccgcaccatcgtgtgctaccaccccagcgtggacatcccctatgagcacaccaagcccatccccaggccagaccctgtgcacaacaatgaggagacccatgaccaggtgctgaagacccggctggaggagaaggtggagcacctggaggagggccccatgattgagcagctgagcaagatgttcttcaccaccaagcaccgctggtacccccacggccgctaccaccgctgcaggaagaacctgaacccccccaaggacagatag

SEQ ID NO: 159951 - DNA, 429 bp, Artificial Sequence
  Description of Artificial Sequence: Synthetic coding sequence
atggctgtggccgctgtgaagtgggtgatgagcaagaggaccatcctgaagcacctgtttcctgtgcagaatggagccctgtactgtgtgtgccacaagagcacctacagccccctgcctgatgactacaactgcaatgtggagctggccctgaccagtgatggccgcaccatcgtgtgctaccaccccagcgtggacatcccctatgagcacaccaagcccatccccaggccagaccctgtgcacaacaatgaggagacccatgaccaggtgctgaagacccggctggaggagaaggtggagcacctggaggagggccccatgattgagcagctgagcaagatgttcttcaccaccaagcaccgctggtacccccacggccgctaccaccgctgcaggaagaacctgaacccccccaaggacagatag

SEQ ID NO: 159952 - DNA, 429 bp, Artificial Sequence; identical to SEQ ID NO: 159951
  Description of Artificial Sequence: Synthetic coding sequence

SEQ ID NO: 159953 - DNA, 429 bp, Artificial Sequence; identical to SEQ ID NO: 159951
  Description of Artificial Sequence: Synthetic coding sequence

SEQ ID NO: 159954 - DNA, 609 bp, Artificial Sequence
  Description of Artificial Sequence: Synthetic coding sequence
atgacagcccggggcacccccagccgcttcctggcctctgtgctgcacaacggcctgggccgctacgtgcagcagctgcagaggctgtccttctctgtgtccagagatggagccagcagcagaggagcccgggagtttgtggagcgggaggtgattgactttgccaggagaaatcctggggtggtgatctacgtgaacagccggccctgctgcgtgccccgggtggtggccgagtacctgaatggagctgtgcgggaggagagcatccactgcaagtctgtggaggagatcagcaccctggtgcagaagctggccgaccagagcggcctggatgtgatccgcatcaggaagcccttccacacagacaaccccagcatccagggccagtggcaccccttcaccaacaagcccaccaccttccggggcctgcggccccgggaggtgcaggaccctgccccagcccaggacaccggcctgcggctgtctgctgtggccccccagatcctgctgcccggctggccagaccccatctctgtgcagagcagtgacctgccctggggcaacacccactacagacctgagcccctgagcagcaccacctggctgtag

SEQ ID NO: 159955 - DNA, 648 bp, Artificial Sequence
  Description of Artificial Sequence: Synthetic coding sequence
atgacagcccggggcacccccagccgcttcctggcctctgtgctgcacaacggcctgggccgctacgtgcagcagctgcagaggctgtccttctctgtgtccagagatggagccagcagcagaggagcccgggagtttgtggagcgggaggtgattgactttgccaggagaaatcctggggtggtgatctacgtgaacagccggccctgctgcgtgccccgggtggtggccgagtacctgaatggagctgtgcgggaggagagcatccactgcaagtctgtggaggagatcagcaccctggtgcagaagctggccgaccagagcggcctggatgtgatccgcatcaggaagcccttccacacagacaaccccagcatccagggccagtggcaccccttcaccaacaagcccaccaccttccggggcctgcggccccgggaggtgcaggaccctgccccagcccaggacaccggcctgcggctgtctgctgtggccccccagatcctgctgcccggctggccagaccccccagacctgcccaccgtggaccccatcagcagcagcctgaccagcgccccagcccccatgctgtctgctgtgtcctgcctgcccatcgtgcctgccctgaccaccgtgtgcagcgcctag

SEQ ID NO: 159956 - DNA, 480 bp, Artificial Sequence
  Description of Artificial Sequence: Synthetic coding sequence
atgacagcccggggcacccccagccgcttcctggcctctgtgctgcacaacggcctgggccgctacgtgcagcagctgcagaggctgtccttctctgtgtccagagatggagccagcagcagaggagcccgggagtttgtggagcgggaggtgattgactttgccaggagaaatcctggggtggtgatctacgtgaacagccggccctgctgcgtgccccgggtggtggccgagtacctgaatggagctgtgcgggaggagagcatccactgcaagtctgtggaggagatcagcaccctggtgcagaagctggccgaccagagcggcctggatgtgatccgcatcaggaagcccttccacacagacaaccccagcatccagggccagtggcaccccttcaccaacaagcccaccaccttccggggcctgcggccccgggaggtgcaggaccctgccccagcccaggtgcaggcccagtag

SEQ ID NO: 159957 - DNA, 708 bp, Artificial Sequence
  Description of Artificial Sequence: Synthetic coding sequence
atgacagcccggggcacccccagccgcttcctggcctctgtgctgcacaacggcctgggccgctacgtgcagcagctgcagaggctgtccttctctgtgtccagagatggagccagcagcagaggagcccgggagtttgtggagcgggaggtgattgactttgccaggagaaatcctggggtggtgatctacgtgaacagccggccctgctgcgtgccccgggtggtggccgagtacctgaatggagctgtgcgggaggagagcatccactgcaagtctgtggaggagatcagcaccctggtgcagaagctggccgaccagagcggcctggatgtgatccgcatcaggaagcccttccacacagacaaccccagcatccagggccagtggcaccccttcaccaacaagcccaccaccttccggggcctgcggccccgggaggtgcaggaccctgccccagcccaggatgctgctgagttcctgggggagggcgccggcccctgctggtacagcatcgtggccctgccccagaagcacatcgccatcgccatccaccccccccagcctgctggccagtgccaccaggccatcggccactggccagagaccgtgtgcagctgcacagctgaccccccagcccggctggcccggcccaacatcagcagcgtcatccgcagcagcctgggcaagtaccccctgcccagctag

SEQ ID NO: 159958 - DNA, 495 bp, Artificial Sequence
  Description of Artificial Sequence: Synthetic coding sequence
atgacagcccggggcacccccagccgcttcctggcctctgtgctgcacaacggcctgggccgctacgtgcagcagctgcagaggctgtccttctctgtgtccagagatggagccagcagcagaggagcccgggagtttgtggagcgggaggtgattgactttgccaggagaaatcctggggtggtgatctacgtgaacagccggccctgctgcgtgccccgggtggtggccgagtacctgaatggagctgtgcgggaggagagcatccactgcaagtctgtggaggagatcagcaccctggtgcagaagctggccgaccagagcggcctggatgtgatccgcatcaggaagcccttccacacagacaaccccagcatccagggccagtggcaccccttcaccaacaagcccaccaccttccggggcctgcggccccgggaggtgcaggaccctgccccagcccagtgcctgctgctgggcgctgtgaccctgtag

SEQ ID NO: 159959 - DNA, 480 bp, Artificial Sequence; identical to SEQ ID NO: 159956
  Description of Artificial Sequence: Synthetic coding sequence

SEQ ID NO: 159960 - DNA, 555 bp, Artificial Sequence
  Description of Artificial Sequence: Synthetic coding sequence
atgacagcccggggcacccccagccgcttcctggcctctgtgctgcacaacggcctgggccgctacgtgcagcagctgcagaggctgtccttctctgtgtccagagatggagccagcagcagaggagcccgggagtttgtggagcgggaggtgattgactttgccaggagaaatcctggggtggtgatctacgtgaacagccggccctgctgcgtgccccgggtggtggccgagtacctgaatggagctgtgcgggaggagagcatccactgcaagtctgtggaggagatcagcaccctggtgcagaagctggccgaccagagcggcctggatgtgatccgcatcaggaagcccttccacacagacaaccccagcatccagggccagtggcaccccttcaccaacaagcccaccaccttccggggcctgcggccccgggaggtgcaggaccctgccccagcccaggacaccggcctgcggctgtctgctgtggccccccagatcctgctgcccggctggccagaccccacccgggccacccgggccaccaggtag

SEQ ID NO: 159961 - DNA, 786 bp, Artificial Sequence
  Description of Artificial Sequence: Synthetic coding sequence
atgacagcccggggcacccccagccgcttcctggcctctgtgctgcacaacggcctgggccgctacgtgcagcagctgcagaggctgtccttctctgtgtccagagatggagccagcagcagaggagcccgggagtttgtggagcgggaggtgattgactttgccaggagaaatcctggggtggtgatctacgtgaacagccggccctgctgcgtgccccgggtggtggccgagtacctgaatggagctgtgcgggaggagagcatccactgcaagtctgtggaggagatcagcaccctggtgcagaagctggccgaccagagcggcctggatgtgatccgcatcaggaagcccttccacacagacaaccccagcatccagggccagtggcaccccttcaccaacaagcccaccaccttccggggcctgcggccccgggaggtgcaggaccctgccccagcccaggatgctgctgagttcctgggggagggcgccggcccctgctggtacagcatcgtggccctgccccagaagcacatcgccatcgccatccaccccccccagcctgctggccagtgccaccaggccatcggccactggccagagaccgtgtgcagctgcacagctgaccccccagcccggctggcccggcccaccaggcctccccacagcggcagctacctgatcctgattgacctgtgcagcagcccctatgctgtgcgctccttcctgcccccagactgcccctgcacagaccactgtgtgctgtctgtgaaggccgcctag

SEQ ID NO: 159962 - DNA, 510 bp, Artificial Sequence
  Description of Artificial Sequence: Synthetic coding sequence
tgaggaacacccagccgcttcctggcctctgtgctgcacaacggcctgggccgctacgtgcagcagctgcagaggctgtccttctctgtgtccagagatggagccagcagcagaggagcccgggagtttgtggagcgggaggtgattgactttgcccggaggaaccctggggtggtgatctacgtgaacagccggccctgctgcgtgccccgggtggtggccgagtacctgaatggagctgtgcgggaggagagcatccactgcaagtctgtggaggagatcagcaccctggtgcagaagctggccgaccagagcggcctggatgtgatccgcatcaggaagcccttccacacagacaaccccagcatccagggccagtggcaccccttcaccaacaagcccaccaccttccggggcctgcggccccgggaggtgcaggaccctgccccagcccaggatgctgctgagttcctgggggagggcgccggcccctgctggaccctggcctag

SEQ ID NO: 159963 - DNA, 999 bp, Artificial Sequence
  Description of Artificial Sequence: Synthetic coding sequence
atggccagcggcctggtgcggctgctgcagcagggccaccgctgcctgctggcccctgtggcccccaagctggtgccccctgtgcggggcgtgaagaagggcttccgggccgccttccgcttccagaaggagctggagcggcagaggctgctgcgctgccccccacctcctgtgagaagaagtgagaagcccaactgggactaccacgccgagatccaggccttcggccaccggctgcaggagaacttcagcctggacctgctgaagacagcctttgtgaacagctgctacatcaagtctgaggaggccaagaggcagcagctgggcatcgagaaggaggccgtgctgctgaacctgaagagcaaccaggagctgtctgagcagggcaccagcttcagccagacctgcctgacccagttcctggaggatgagtacccagacatgcccacagagggcatcaagaacctggtggacttcctgactggagaggaggtggtgtgccacgtggccaggaacctggccgtggagcagctgaccctgtctgaggagttccctgtgcccccagctgtgctgcagcagaccttctttgctgtgattggagccctgctgcagagcagcggccctgagaggacagccctcttcatccgggacttcctgatcacccagatgaccgggaaggagctgtttgagatgtggaagatcatcaaccccatgggcctgctggtggaggagctgaagaagagaaatgtgtctgcccctgagagccggctgacccggcagagcggcggcaccacagccctgcccctgtactttgtgggcctgtactgtgacaagaagctgattgctgagggccctggagagaccgtgctggtggccgaggaggaggccgcccgggtggccctgaggaagctgtatggcttcacagaaaatagaagaccctggaactacagcaagcccaaggagaccctgcgggcagagaagagcatcacagccagctag

SEQ ID NO: 159964 - DNA, 921 bp, Artificial Sequence
  Description of Artificial Sequence: Synthetic coding sequence
atggccgcccccatcccccagggcttcagctgcctgagccgcttcctgggctggtggttccggcagcctgtgctggtgacccagagcgctgccatcgtgcctgtgaggaccaagaagcgcttcaccccacccatctaccagcccaagttcaagacagagaaggagttcatgcagcacgccaggaaggccggcctggtgatccccccagagaagagtgacaggagcatccacctggcctgcacagctggcatctttgatgcctacgtgcccccagaaggagatgcccgcatcagcagcctgagcaaggagggcctcatcgagaggacagagaggatgaagaagaccatggccagccaggtgtccatccgccgcatcaaggactatgatgccaacttcaagatcaaggacttccctgagaaggccaaggacatcttcatcgaggcccacctgtgcctgaacaacagcgaccatgaccggctgcacaccctggtgacagagcactgcttcccagacatgacctgggacatcaagtacaagacagtgcgctggagctttgtggagagcctggagcccagccacgtggtgcaggtgcgctgcagctccatgatgaaccagggcaatgtgtatggccagatcaccgtgaggatgcacacccggcagaccctggccatctatgaccgcttcggccgcctgatgtatggccaggaggatgtgcccaaggatgtgctggagtatgtggtgtttgagaagcagctgaccaacccctacggctcctggaggatgcacaccaagatcgtgcccccctgggccccacccaagcagcccatcctgaagacagtgatgatccctggcccccagctgaagccagaggaggagtatgaggaggcccagggcgaggcccagaagccccagctggcctag

SEQ ID NO: 159965 - DNA, 693 bp, Artificial Sequence
  Description of Artificial Sequence: Synthetic coding sequence
atggctgctgctggcctggccctgctgtgcagaagagtgtcctctgccctgaagagcagccgcagcctcatcaccccccaggtgcctgcctgcaccggcctgctgcacaccaccctgagcaggaagggcctggaggagttctttgatgaccccaagaactggggccaggagaaggtgaagtctggagctgcctggacctgccagcagctgaggaacaagagcaatgaagacctgcacaagctgtggtacgtgctgctgaaggagaggaacatgctgctgaccctggagcaggaggccaagaggcagaggctgcccatgcccagccctgagcggctggacaaggtggtggacagcatggatgccctggacaaggtggtgcaggagcgggaggatgccctgcggctgctgcagacaggccaggagcgggcccggcctggggcctggaggcgggacatcttcggccgcatcatctggcacaagttcaagcagtgggtgatcccctggcacctgaacaagcgctacaacaggaagcgcttctttgccctgccctacgtggaccacttcctgcggctggagcgggagaagagggcccgcatcaaggccaggaaggagaacctggagaggaagaaggccaagatcctgctgaagaagttcccccacctggccgaggcccagaagagcagcctggtgtag

SEQ ID NO: 159966 - DNA, 423 bp, Artificial Sequence
  Description of Artificial Sequence: Synthetic coding sequence
atgctgctgaccctggagcaggaggccaagaggcagaggctgcccatgcccagccctgagcggctggacaaggtggtggacagcatggatgccctggacaaggtggtgcaggagcgggaggatgccctgcggctgctgcagacaggccaggagcgggcccggcctggggcctggaggcgggacatcttcggccgcatcatctggcacaagttcaagcagtgggtgatcccctggcacctgaacaagcgctacaacaggaagcgcttctttgccctgccctacgtggaccacttcctgcggctggagcgggagaagagggcccgcatcaaggccaggaaggagaacctggagaggaagaaggccaagatcctgctgaagaagttcccccacctggccgaggcccagaagagcagcctggtgtag

SEQ ID NO: 159967 - DNA, 753 bp, Artificial Sequence
  Description of Artificial Sequence: Synthetic coding sequence
atggctgctgctggcctggccctgctgtgcagaagagtgtcctctgccctgaagagcagccgcagcctcatcaccccccaggtgcctgcctgcaccggcttcttcctgagcctgctgcccaagagcaccccaaatgtgaccagcttccaccagtaccgcctgctgcacaccaccctgagcaggaagggcctggaggagttctttgatgaccccaagaactggggccaggagaaggtgaagtctggagctgcctggacctgccagcagctgaggaacaagagcaatgaagacctgcacaagctgtggtacgtgctgctgaaggagaggaacatgctgctgaccctggagcaggaggccaagaggcagaggctgcccatgcccagccctgagcggctggacaaggtggtggacagcatggatgccctggacaaggtggtgcaggagcgggaggatgccctgcggctgctgcagacaggccaggagcgggcccggcctggggcctggaggcgggacatcttcggccgcatcatctggcacaagttcaagcagtgggtgatcccctggcacctgaacaagcgctacaacaggaagcgcttctttgccctgccctacgtggaccacttcctgcggctggagcgggagaagagggcccgcatcaaggccaggaaggagaacctggagaggaagaaggccaagatcctgctgaagaagttcccccacctggccgaggcccagaagagcagcctggtgtag

SEQ ID NO: 159968 - DNA, 639 bp, Artificial Sequence
  Description of Artificial Sequence: Synthetic coding sequence
atgagcggcaccctggagaaggtgctgtgcctgaggaacaacaccatcttcaagcaggccttcagcctgctgcgcttccgcaccagcggggagaagcccatctacagcgtgggcggcatcctgctgagcatcagccggccctacaagaccaagcccacccacggcatcggcaagtacaagcacctgatcaaggccgaggagcccaagaagaagaagggcaaggtggaggtgcgggccatcaacctgggcacagattatgaatatggagtgctgaacatccacctgacagcctatgacatgaccctggccgagagctatgcccagtatgtgcacaacctgtgcaacagcctgagcatcaaggtggaggagagctatgccatgcccaccaagaccatcgaggtgctgcagctgcaggaccagggcagcaagatgctgctggacagcgtgctgaccacccatgagcgggtggtgcagatcagcggcctgagcgccacctttgctgagatcttcctggagatcatccagagcagcctgcctgagggcgtgcggctgtctgtgaaggagcacacagaggaggacttcaagggccgcttcaaggcccggcctgagctggaggagctgctggccaagctgaagtag

SEQ ID NO: 159969 - DNA, 585 bp, Artificial Sequence
  Description of Artificial Sequence: Synthetic coding sequence
atgggcctgagcagctgcaggaagaccagcagcggcctgcccctcatcctgcactatggaggcatcctgctgagcatcagccggccctacaagaccaagcccacccacggcatcggcaagtacaagcacctgatcaaggccgaggagcccaagaagaagaagggcaaggtggaggtgcgggccatcaacctgggcacagattatgaatatggagtgctgaacatccacctgacagcctatgacatgaccctggccgagagctatgcccagtatgtgcacaacctgtgcaacagcctgagcatcaaggtggaggagagctatgccatgcccaccaagaccatcgaggtgctgcagctgcaggaccagggcagcaagatgctgctggacagcgtgctgaccacccatgagcgggtggtgcagatcagcggcctgagcgccacctttgctgagatcttcctggagatcatccagagcagcctgcctgagggcgtgcggctgtctgtgaaggagcacacagaggaggacttcaagggccgcttcaaggcccggcctgagctggaggagctgctggccaagctgaagtag

SEQ ID NO: 159970 - DNA, 501 bp, Artificial Sequence
  Description of Artificial Sequence: Synthetic coding sequence
atggccgccaccatgttccgggccaccctgcggggctggaggactggagtgcagaggggctgcggcctgcggctgctgagccagacccagggccccccagactaccccaggtttgtggagagcgtggatgagtaccagtttgtggagcggctgctgcctgccacccgcatcccagacccccccaagcatgagcactaccccacccccagcggctggcagcccccccgggaccccccacccaacctgccctactttgtgagaagaagcaggatgcacaacatccctgtgtacaaggacatcacccacggcaaccggcagatgaccgtcatcaggaaggtggagggggacatctgggccctgcagaaggatgtggaggacttcctgagccccctgctgggcaagacccctgtgacccaggtgaatgaggtgacaggcaccctgcgcatcaagggctactttgaccaggagctgaaggcctggctgctggagaagggcttctag

SEQ ID NO: 159971 - DNA, 501 bp, Artificial Sequence; identical to SEQ ID NO: 159970
  Description of Artificial Sequence: Synthetic coding sequence

SEQ ID NO: 159972 - DNA, 477 bp, Artificial Sequence
  Description of Artificial Sequence: Synthetic coding sequence
atggccgcccggtctgtgtctggcatcaccaggagggtcttcatgtggacagtgtctggcaccccctgccgggagttctggagccgcttcaggaaggagaaggagcctgtggtggtggagaccgtggaggagaagaaggagcccatcctggtgtgcccccccctgcggagccgggcctacaccccacctgaggacctgcagagccggctggagagctatgtgaaggaggtgtttggcagcagcctgcccagcaactggcaggacatcagcctggaggacagccggctgaagttcaacctgctggcccacctggctgatgacctgggccacgtggtgcccaacagccggctgcaccagatgtgccgggtgagagatgtgctggacttctacaacgtgcccatccaggacaggagcaagtttgatgagctgagcgccagcaacctgccccccaacctgaagatcacctggagctactag

SEQ ID NO: 159973 - DNA, 408 bp, Artificial Sequence
  Description of Artificial Sequence: Synthetic coding sequence
atggccgcccggtctgtgtctggcatcaccaggagggtcttcatgtggacagtgtctggcaccccctgccgggagttctggagccgcttcaggaaggagaaggagcctgtggtggtggagaccgtggaggagaagaaggagcccatcctggtgtgcccccccctgcggagccgggcctacaccccacctgaggacctgcagagccggctggagagctatgtgaaggaggtgtttggcagcagcctgcccagcaactggcaggacatcagcctggaggacagccggctgaagttcaacctgctggcccacctggctgatgacctgggccacgtggtgcccaacagccggctgcaccagatgtgccggggctacagctttgaggagggcaagatccagctgggcatctag

SEQ ID NO: 159974 - DNA, 1146 bp, Artificial Sequence
  Description of Artificial Sequence: Synthetic coding sequence
atggccagccccagcctggagaggcctgagaagggagctgggaagtctgagttcaggaaccagaagcccaagccagagaaccaggatgaaagtgagctgctgactgtgcctgatggctggaaggagcccgccttcagcaaggaggacaacccccggggcctgctggaggagagcagctttgccaccctcttccccaagtaccgggaggcctacctgaaggagtgctggcccctggtgcagaaggccctgaatgagcaccacgtgaatgccaccctggacctgattgagggctccatgacagtgtgcaccaccaagaagacctttgacccctacatcatcatccgggcccgggacctgatcaagctgctggcccggtctgtgtcctttgagcaggccgtgcgcatcctgcaggatgatgtggcctgtgacatcatcaagattggcagcctggtgaggaacaaggagagatttgtgaagaggcggcagaggctgattggccccaagggcagcaccctgaaggccctggagctgctgaccaactgctacatcatggtgcagggcaacacagtgtctgccatcggccccttcagcggcctgaaggaggtgaggaaggtggtgctggacaccatgaagaacatccaccccatctacaacatcaagagcctgatgatcaagcgggagctggccaaggacagcgagctgcggagccagagctgggagcgcttcctgccccagttcaagcacaagaatgtgaacaagaggaaggagcccaagaagaagacagtgaagaaggagtacacccccttccccccaccccagcctgagagccagattgacaaggagctggccagcggggagtacttcctgaaggccaaccagaagaagaggcagaagatggaggccatcaaggccaagcaggccgaggccatcagcaagaggcaggaggagaggaacaaggccttcatcccccccaaggagaagcccatcgtgaagcccaaggaggccagcacagagaccaagattgatgtggccagcatcaaggagaaggtgaagaaggccaagaacaagaagctgggcgccctgacagctgaggagatcgccctgaagatggaggctgatgagaagaagaagaagaagaagaagtag

SEQ ID NO: 159975 - DNA, 372 bp, Artificial Sequence
  Description of Artificial Sequence: Synthetic coding sequence
atggccgccctgggcaccgtgctcttcaccggggtgcggcggctgcactgcagcgtggccgcctgggccggcggccagtggaggctgcagcagggcctggccgccaaccccagcggctacggccccctgacagagctgcctgactggagctatgcagatggccggcctgccccacccatgaagggccagctgcggaggaaggccgagcgggagacctttgccaggagagtggtgctgctgagccaggagatggatgctggcctgcaggcctggcagctgcggcagcagaagctgcaggaggagcagaggaagcaggagaatgccctgaagcccaagggggccagcctgaagagccccctgcccagccagtag

SEQ ID NO: 159976 - DNA, 369 bp, Artificial Sequence
  Description of Artificial Sequence: Synthetic coding sequence
atggccgccctgggcaccgtgctcttctctgtgcggcggctgcactgcagcgtggccgcctgggccggcggccagtggaggctgcagcagggcctggccgccaaccccagcggctacggccccctgacagagctgcctgactggagctatgcagatggccgcccagccccacccatgaagggccagctgcggaggaaggccgagcgggagacctttgcccggcgggtggtgctgctgagccaggagatggatgctggcctgcaggcctggcagctgcggcagcagaagctgcaggaggagcagaggaagcaggagaatgccctgaagcccaagggggccagcctgaagagccccctgcccagccagtag

SEQ ID NO: 159977 - DNA, 264 bp, Artificial Sequence
  Description of Artificial Sequence: Synthetic coding sequence
atggccgccctgggcaccgtgctcttcaccggggtgcggcggctgcactgcagcgtggccgcctgggccggcggccagtggaggctgcagcagggcctggccgccaaccccagcggctacggccccctgacagagctgcctgactggagctatgcagagaccagctgcacagctgtgactggaaatggccgctggatcacctccatggccgcccaggccgctgaggtggccggccgcaccaaggaggccggcaagtgcagctag

SEQ ID NO: 159978 - DNA, 195 bp, Artificial Sequence
  Description of Artificial Sequence: Synthetic coding sequence
atgaagggccagctgcggaggaaggccgagcgggagacctttgcccggcgggtggtgctgctgagccaggagatggatgctggcctgcaggcctggcagctgcggcagcagaagctgcaggaggagcagaggaagcaggagaatgccctgaagcccaagggggccagcctgaagagccccctgcccagccagtag

SEQ ID NO: 159979 - DNA, 195 bp, Artificial Sequence; identical to SEQ ID NO: 159978
  Description of Artificial Sequence: Synthetic coding sequence

SEQ ID NO: 159980 - DNA, 195 bp, Artificial Sequence; identical to SEQ ID NO: 159978
  Description of Artificial Sequence: Synthetic coding sequence

SEQ ID NO: 159981 - DNA, 339 bp, Artificial Sequence
  Description of Artificial Sequence: Synthetic coding sequence
atggctgctgccctggcccggctgggcctgcggcctgtgaagcaggtgcgggtgcagttctgcccctttgagaagaatgtggagagcaccaggaccttcctgcagacagtgtcctctgagaaggtgcgcagcaccaacctgaactgcagcgtgattgctgatgtgagacatgatggcagcgagccctgtgtggatgtgctgtttggagatggccacaggctcatcatgagaggagcccacctgacagccctggagatgctgacagcctttgccagccacatccgggccagagatgctgctggcagcggggacaagccaggagctgacaccggccgctag

SEQ ID NO: 159982 - DNA, 417 bp, Artificial Sequence
  Description of Artificial Sequence: Synthetic coding sequence
atggccaccaagaggctgtttggagccaccaggacctgggccggctggggcgcctgggagctgctgaacccagccaccagcggccgcctgctggcccgggactatgccaagaagcctgtgatgaagggggccaagagcgggaaaggagctgtgaccagcgaggccctgaaggaccctgatgtgtgcacagatcctgtgcagctgaccacctacgccatgggcgtgaacatctacaaggagggccaggatgtgcccctgaagccagatgctgagtacccagagtggctgtttgagatgaacctgggcccccccaagaccctggaggagctggaccctgagagccgggagtactggaggcggctgaggaagcagaacatctggaggcacaaccggctgagcaagaacaagaggctgtag

SEQ ID NO: 159983 - DNA, 387 bp, Artificial Sequence
  Description of Artificial Sequence: Synthetic coding sequence
atggctgctgtgggcagcctgctgggccgcctgcggcagagcacagtgaaggccactggacctgccctgcggcggctgcacaccagctcctggagggctgacagcagccgggccagcctgaccagggtgcaccggcaggcctatgcccggctgtaccctgtgctgctggtgaagcaggacggcagcaccatccacatccgctaccgggagcccaggaggatgctggccatgcccatcgacctggacaccctgagccctgaggagcggcgggcccggctgaggaagcgggaggcccagctgcagagcaggaaggagtatgagcaggagctgagtgatgacctgcacgtggagcgctaccggcagttctggaccaggaccaagaagtag

SEQ ID NO: 159984 - DNA, 387 bp, Artificial Sequence; identical to SEQ ID NO: 159983
  Description of Artificial Sequence: Synthetic coding sequence

SEQ ID NO: 159985 - DNA, 387 bp, Artificial Sequence; identical to SEQ ID NO: 159983
  Description of Artificial Sequence: Synthetic coding sequence

SEQ ID NO: 159986 - DNA, 387 bp, Artificial Sequence; identical to SEQ ID NO: 159983
  Description of Artificial Sequence: Synthetic coding sequence

SEQ ID NO: 159987 - DNA, 495 bp, Artificial Sequence
  Description of Artificial Sequence: Synthetic coding sequence
atggctgctgtgggcagcctgctgggcctggccgccagctcctggctgggcggccagaatgccagtgaccacagcctgtggctgctgaggaagccccggggcagcagctgccccggcaccggccaccagctgtgccgcctgcggcagagcacagtgaaggccactggacctgccctgcggcggctgcacaccagctcctggagggctgacagcagccgggccagcctgaccagggtgcaccggcaggcctatgcccggctgtaccctgtgctgctggtgaagcaggacggcagcaccatccacatccgctaccgggagcccaggaggatgctggccatgcccatcgacctggacaccctgagccctgaggagcggcgggcccggctgaggaagcgggaggcccagctgcagagcaggaaggagtatgagcaggagctgagtgatgacctgcacgtggagcgctaccggcagttctggaccaggaccaagaagtag

SEQ ID NO: 159988 - DNA, 378 bp, Artificial Sequence
  Description of Artificial Sequence: Synthetic coding sequence
atggctgctgtgggcagcctgctgggccagagcacagtgaaggccaccggccctgccctgcggcggctgcacaccagctcctggagggctgacagcagccgggccagcctgaccagggtgcaccggcaggcctatgcccggctgtaccctgtgctgctggtgaagcaggacggcagcaccatccacatccgctaccgggagcccaggaggatgctggccatgcccatcgacctggacaccctgagccctgaggagcggcgggcccggctgaggaagcgggaggcccagctgcagagcaggaaggagtatgagcaggagctgagtgatgacctgcacgtggagcgctaccggcagttctggaccaggaccaagaagtag

SEQ ID NO: 159989 - DNA, 387 bp, Artificial Sequence; identical to SEQ ID NO: 159983
  Description of Artificial Sequence: Synthetic coding sequence

SEQ ID NO: 159990 - DNA, 387 bp, Artificial Sequence; identical to SEQ ID NO: 159983
  Description of Artificial Sequence: Synthetic coding sequence

SEQ ID NO: 159991 - DNA, 387 bp, Artificial Sequence; identical to SEQ ID NO: 159983
  Description of Artificial Sequence: Synthetic coding sequence

SEQ ID NO: 159992 - DNA, 387 bp, Artificial Sequence; identical to SEQ ID NO: 159983
  Description of Artificial Sequence: Synthetic coding sequence

SEQ ID NO: 159993 - DNA, 495 bp, Artificial Sequence; identical to SEQ ID NO: 159987
  Description of Artificial Sequence: Synthetic coding sequence

SEQ ID NO: 159994 - DNA, 387 bp, Artificial Sequence; identical to SEQ ID NO: 159983
  Description of Artificial Sequence: Synthetic coding sequence

SEQ ID NO: 159995 - DNA, 387 bp, Artificial Sequence; identical to SEQ ID NO: 159983
  Description of Artificial Sequence: Synthetic coding sequence

SEQ ID NO: 159996 - DNA, 387 bp, Artificial Sequence; identical to SEQ ID NO: 159983
  Description of Artificial Sequence: Synthetic coding sequence

SEQ ID NO: 159997 - DNA, 387 bp, Artificial Sequence; identical to SEQ ID NO: 159983
  Description of Artificial Sequence: Synthetic coding sequence

SEQ ID NO: 159998 - DNA, 387 bp, Artificial Sequence; identical to SEQ ID NO: 159983
  Description of Artificial Sequence: Synthetic coding sequence

SEQ ID NO: 159999 - DNA, 387 bp, Artificial Sequence; identical to SEQ ID NO: 159983
  Description of Artificial Sequence: Synthetic coding sequence

SEQ ID NO: 160000 - DNA, 387 bp, Artificial Sequence; identical to SEQ ID NO: 159983
  Description of Artificial Sequence: Synthetic coding sequence

SEQ ID NO: 160001 - DNA, 387 bp, Artificial Sequence; identical to SEQ ID NO: 159983
  Description of Artificial Sequence: Synthetic coding sequence

SEQ ID NO: 160002 - DNA, 387 bp, Artificial Sequence; identical to SEQ ID NO: 159983
  Description of Artificial Sequence: Synthetic coding sequence

SEQ ID NO: 160003 - DNA, 495 bp, Artificial Sequence; identical to SEQ ID NO: 159987
  Description of Artificial Sequence: Synthetic coding sequence

SEQ ID NO: 160004 - DNA, 231 bp, Artificial Sequence
  Description of Artificial Sequence: Synthetic coding sequence
atggctgctgtgggcagcctgctgggccgcctgcggcagagcacagtgaaggccactggacctgccctgcggcggctgcacaccagctcctggagggctgacagcagccgggccagcctgaccagggtgcaccggcaggcctatgcccggctgtaccctgtgctgctggtgaagcaggacggcagcaccatccacatccgctaccgggagcccaggaggatgctggcctag

SEQ ID NO: 160005 - DNA, 702 bp, Artificial Sequence
  Description of Artificial Sequence: Synthetic coding sequence
atggccgcccctgtggtgacagcccctggccgggccctgctgcgggccggggccggccgcctgctgcggggcggcgtgcaggagctgctgcggcccaggcatgagggcaatgccccagacctggcctgcaacttcagcctgagccagaacagaggaacagtgattgtggagcgctggtggaaggtgcccctggccggggagggcaggaagccccggctgcacagaagacaccgggtgtacaagctggtggaggacaccaagcaccggcccaaggagaacctggagctgatcctgacccagagcgtggagaatgtgggcgtgcggggggacctggtgtctgtgaagaagagcctgggcaggaaccggctgctgccccagggcctggccgtgtatgccagccctgagaacaagaagctgtttgaggaggagaagctgctgcggcaggagggcaagctggagaagatccagaccaaggccggggaggccctgggcgtggtggtggccccccacaccctgaagctgcctgaggagcccatcacccgctggggcgagtactggtgtgaggtgacagtgaatggcctggacacagtgcgggtgcccatgtctgtggtgaactttgagaagcccaagaccaagcgctacaagtactggctggcccagcaggccgccaaggccatggcccccaccagcccccagatctag

SEQ ID NO: 160006 - DNA, 804 bp, Artificial Sequence
  Description of Artificial Sequence: Synthetic coding sequence
atggccgcccctgtggtgacagcccctggccgggccctgctgcgggccggggccggccgcctgctgcggggcggcgtgcaggagctgctgcggcccaggcatgagggcaatgccccagacctggcctgcaacttcagcctgagccagaacagaggaacagtgattgtggagcgctggtggaaggtgcccctggccggggagggcaggaagccccggctgcacagaagacaccgggtgtacaagctggtggaggacaccaagcaccggcccaaggagaacctggagctgatcctgacccagagcgtggagaatgtgggcgtgcggggggacctggtgtctgtgaagaagagcctgggcaggaaccggctgctgccccagggcctggccgtgtatgccagccctgagaacaagaagctgtttgaggaggagaagctgctgcggcaggagggcaagctggagaagatccagaccaaggccggggaggccaccgtgaagttcctgaagagctgccgcctggaggtgggcatgaagaacaacgtgaagtgggagctgaaccctgagatcgtggcccggcacttcttcaagaacctgggcgtggtggtggccccccacaccctgaagctgcctgaggagcccatcacccgctggggcgagtactggtgtgaggtgacagtgaatggcctggacacagtgcgggtgcccatgtctgtggtgaactttgagaagcccaagaccaagcgctacaagtactggctggcccagcaggccgccaaggccatggcccccaccagcccccagatctag

SEQ ID NO: 160007 - DNA, 606 bp, Artificial Sequence
  Description of Artificial Sequence: Synthetic coding sequence
atggccgccaggacagcctttggagctgtgtgccggcggctgtggcagggcctgggcaacttctctgtgaacaccagcaaaggaaacacagccaagaatggaggcctgctgctgagcaccaacatgaagtgggtgcagttcagcaacctgcacgtggatgtgcccaaggacctgaccaagcctgtggtgaccatcagtgatgagccagacatcctgtacaagaggctgtctgtgctggtgaagggccatgacaaggctgtgctggacagctatgagtactttgctgtgctggccgccaaggagctgggcatcagcatcaaggtgcatgagccccccaggaagattgagcgcttcaccctgctgcagagcgtgcacatctacaagaagcaccgggtgcagtatgagatgaggaccctgtaccgctgcctggagctggagcacctgaccggcagcacagcagatgtgtacctggagtacatccagaggaacctgcctgagggcgtggccatggaggtgaccaagacccagctggagcagctgcctgagcacatcaaggagcccatctgggagaccctgtctgaggagaaggaggagagcaagagctag

SEQ ID NO: 160008 - DNA, 585 bp, Artificial Sequence
  Description of Artificial Sequence: Synthetic coding sequence
atgcaggccgtgagaaatgccggcagccgcttcctgcgctcctggacctggccccagacagctggccgggtggtggcccggaccccagctggcaccatctgcacaggagcccggcagctgcaggatgctgctgccaagcagaaggtggagcagaatgctgcccccagccacaccaagttcagcatctacccacccatccctggagaggagagcagcctgcgctgggccggcaagaagtttgaggagatccccatcgcccacatcaaggccagccacaacaacacccagatccaggtggtgtctgccagcaatgagcccctggcctttgccagctgtggcacagagggcttcagaaatgccaagaagggcaccggcattgctgcccagacagctggcattgctgctgctgcccgggccaagcagaagggcgtcatccacatccgggtggtggtgaagggcctgggccctggccgcctgagcgccatgcacggcctcatcatgggcggcctggaggtgatcagcatcacagacaacacccccatcccccacaacggctgccggcccaggaaggccaggaagctgtag

SEQ ID NO: 160009 - DNA, 486 bp, Artificial Sequence
  Description of Artificial Sequence: Synthetic coding sequence
atgcaggccgtgagaaatgccggcagccgcttcctgcgctcctggacctggccccagacagctggccgggtggtggcccggaccccagctggcaccatctgcacaggagcccggcagctgcaggatgctgctgccaagcagaaggtggagcagaatgctgcccccagccacaccaagttcagcacccagatccaggtggtgtctgccagcaatgagcccctggcctttgccagctgtggcacagagggcttcagaaatgccaagaagggcactggaattgctgcccagacagctggcattgctgctgctgcccgggccaagcagaagggcgtcatccacatccgggtggtggtgaagggcctgggccctggccgcctgagcgccatgcacggcctcatcatgggcggcctggaggtgatcagcatcacagacaacacccccatcccccacaacggctgccggcccaggaaggccaggaagctgtag

SEQ ID NO: 160010 - DNA, 417 bp, Artificial Sequence
  Description of Artificial Sequence: Synthetic coding sequence
atgtcctggagcggcctgctgcacggcctgaacaccagcctgacctgtggccctgccctggtgccccggctgtgggccacctgcagcatggccaccctgaaccagatgcaccggctgggcccccccaagaggcctcccaggaagctgggccccacagagggccggccccagctgaagggcgtggtgctgtgcaccttcaccaggaagcccaagaagcccaacagcgccaacaggaagtgctgccgggtgcggctgagcacaggccgggaggccgtgtgcttcatccctggagagggccacaccctgcaggagcaccagatcgtgctggtggagggcggccgcacccaggacctgcccggggtgaagctgactgtggtgcggggcaagtatgactgtggccacgtgcagaagaagtag

SEQ ID NO: 160011 - DNA, 417 bp, Artificial Sequence; identical to SEQ ID NO: 160010
  Description of Artificial Sequence: Synthetic coding sequence

SEQ ID NO: 160012 - DNA, 417 bp, Artificial Sequence; identical to SEQ ID NO: 160010
  Description of Artificial Sequence: Synthetic coding sequence

SEQ ID NO: 160013 - DNA, 387 bp, Artificial Sequence
  Description of Artificial Sequence: Synthetic coding sequence
atggccgccttcatgctgggcagcctgctgcggaccttcaagcagatggtgcccagcagcgccagcggccaggtgcgcagccactacgtggactggaggatgtggagagatgtgaagaggaggaagatggcctatgaatatgcagatgagcggctgcgcatcaacagcctgaggaagaacaccatcctgcccaagatcctgcaggatgtggctgatgaggagattgctgccctgccccgggacagctgccctgtgcgcatccggaacagatgtgtgatgaccagccggccccggggcgtgaagaggcgctggaggctgagcagaattgtgttccgccacctggccgaccacggccagctgagcggcatccagagggccacctggtag

SEQ ID NO: 160014 - DNA, 774 bp, Artificial Sequence
  Description of Artificial Sequence: Synthetic coding sequence
atgctgcgggtggcctggaggaccctgagcctcatccgcaccagggctgtgacccaggtgctggtgcccggcctgcccggcggcggcagcgccaagttccccttcaaccagtggggcctgcagcccaggagcctgctgctgcaggccgcccggggctacgtggtgaggaagccagcccagagccggctggatgatgatcctccacccagcaccctgctgaaggactaccagaatgtgcccggcatcgagaaggtggatgatgtggtgaagaggctgctgagcctggagatggccaacaagaaggagatgctgaagatcaagcaggagcagttcatgaagaagatcgtggccaaccctgaggacaccaggagcctggaggcccgcatcatcgccctgtctgtgaagatccgctcctatgaggagcacctggagaagcacaggaaggacaaggcccacaagcgctacctgctgatgagcattgaccagaggaagaagatgctgaagaacctgaggaacaccaactatgatgtgtttgagaagatctgctggggcctgggcatcgagtacaccttcccccccctgtactacagaagagcccacagaagatttgtgaccaagaaggccctgtgcatccgggtcttccaggagacccagaagctgaagaagagaagaagagccctgaaggctgctgctgctgcccagaagcaggccaagagaagaaatccagacagccctgccaaggccatccccaagaccctgaaggacagccagtag

SEQ ID NO: 160015 - DNA, 300 bp, Artificial Sequence
  Description of Artificial Sequence: Synthetic coding sequence
atggtgcacctgaccaccctgctgtgcaaggcctaccggggcggccacctgaccatccggctggccctgggcggctgcaccaaccggcccttctaccgcatcgtggccgcccacaacaagtgccccagagatggccgctttgtggagcagctgggcagctatgaccccctgcccaacagccatggagagaagctggtggccctgaacctggaccgcatccgccactggattggctgtggggcccacctgagcaagcccatggagaagctgctgggcctgaagtacagccacgtgttctag

SEQ ID NO: 160016 - DNA, 414 bp, Artificial Sequence
  Description of Artificial Sequence: Synthetic coding sequence
atggtgcacctgaccaccctgctgtgcaaggcctaccggggcggccacctgaccatccggctggccctgggcggctgcaccaaccggcccttctaccgcatcgtggccgcccacaacaagtgccccagagatggccgctttgtggagcagctgggcagctatgaccccctgcccaacagccatggagagaagctggtggccctgaacctggaccgcatccgccactggattggctgtggggcccacctgagcaagcccatggagaagctgctgggcctggccggcttcttccccctgcaccccatgatgatcaccaatgctgagcggctgcggaggaagagggcccgggaggtgctgctggccagccagaagacagatgctgaggccacagacacagaggccacagagacctag

SEQ ID NO: 160017 - DNA, 372 bp, Artificial Sequence
  Description of Artificial Sequence: Synthetic coding sequence
atggtgcacctgaccaccctgctgtgcaaggcctaccggggcggccacctgaccatccggctggccctgggcggctgcaccaaccggcccttctaccgcatcgtggccgcccacaacaagtgccccagagatggccgctttgtggagcagctgggcagctatgaccccctgcccaacagccatggagagaagctggtggccctgaacctggaccgcatccgccactggattggctgtggggcccacctgagcaagcccatggagaagctgctgggcaagacagatgcccgcttccctgagcagggcgaggagaggcctgagcagcaccacttccctgaggacctggccccagcccggggccggggcctgtag

SEQ ID NO: 160018 - DNA, 393 bp, Artificial Sequence
  Description of Artificial Sequence: Synthetic coding sequence
atgtctgtggtgcgcagctctgtgcacgcccgctggatcgtgggcaaggtgattggcaccaagatgcagaagacagccaaggtgcgggtgacccggctggtgctggacccctacctgctgaagtacttcaacaagaggaagacctactttgcccatgatgccctgcagcagtgcaccgtgggggacatcgtgctgctgcgggccctgcctgtgccccgggccaagcacgtgaagcatgagctggccgagatcgtgttcaaggtgggcaaggtgattgatcctgtgacaggcaagccctgtgccggcaccacctacctggagagccccctgagcagcgagaccacccagctgagcaagaacctggaggagctgaacatcagcagcgcccagtag

SEQ ID NO: 160019 - DNA, 390 bp, Artificial Sequence
  Description of Artificial Sequence: Synthetic coding sequence
atgtctgtggtgcgcagctctgtgcacgcccgctggatcgtgggcaaggtgattggcaccaagatgcagaagacagccaaggtgcgggtgacccggctggtgctggacccctacctgctgaagtacttcaacaagaggaagacctactttgcccatgatgccctgcagcagtgcaccgtgggggacatcgtgctgctgcgggccctgcctgtgccccgggccaagcacgtgaagcatgagctggccgagatcgtgttcaaggtgggcaaggtgattgatcctgtgacaggcaagccctgtgccggcaccacctacctggagagccccctgagcagcgagaccacccagctgagcaagaacctggaggagctgaacatcagcagcgcctag

SEQ ID NO: 160020 - DNA, 384 bp, Artificial Sequence
  Description of Artificial Sequence: Synthetic coding sequence
atggccgccctgaaggccctggtgtctggctgcggccgcctgctgcggggcctgctggccggccctgctgccacctcctggagccggctgcctgcccggggcttccgggaggtggtggagacccaggagggcaagaccaccatcatcgagggccgcatcacagccacccccaaggagagccccaacccccccaaccccagcggccagtgccccatctgccgctggaacctgaagcacaagtacaactatgatgatgtgctgctgctgagccagttcatccggccccacggcggcatgctgcccaggaagatcaccggcctgtgccaggaggagcacaggaagattgaagaatgtgtgaagatggcccacagagctggcacctag

SEQ ID NO: 160021 - DNA, 813 bp, Artificial Sequence
  Description of Artificial Sequence: Synthetic coding sequence
atggccgccctgaaggccctggtgtctggctgcggccgcctgctgcggggcctgctggccggccctgctgccacctcctggagccggctgcctgcccggggcttccgggaggtggtggagacccaggagggcaagaccaccatcatcgagggccgcatcacagccacccccaaggagagccccaacccccccaaccccagcggccagtgccccatctgccgctggaacctgaagcacaagtacaactatgatgatgtgctgctgctgagccagttcatccggccccacggcggcatgctgcccaggaagatcaccggcctgtgccaggaggagcacaggaagattgaagaatgtgtgaagatggcccacagagctggaagaagaccctggggccccagaggagctgagggctgccgccacagcctgcccacccagctgccccacgtgtctgcccctcctggcaggaaggtggacatccgctctgtgaactacacccaccaccccatgcccaccttccccctgccctgggccttccccctggcccccagcgagctgcagcgggagctgcagaggctgagccccctgcccaggcacagcggcctgctgcccaaccaccggccccggctgcctgagggcgtggtgcccaagagcaagccccagctgaaccgctacctgacccgctgggcccctggctctgtgaagcccatctacaagaagggcccccgctggaacagagtgaggatgcctgtgggcagccccctgctgcgggacaacgtgtgctacagcaggaccccctggaagctgtaccactag

SEQ ID NO: 160022 - DNA, 591 bp, Artificial Sequence
  Description of Artificial Sequence: Synthetic coding sequence
atggccgccctgaaggccctggtgtctggctgcggccgcctgctgcggggcctgctggccggccctgctgccacctcctggagccggctgcctgcccggggcttccgggaggtggtggagacccaggagggcaagaccaccatcatcgagggccgcatcacagccacccccaaggagagccccaacccccccaaccccagcggccagtgccccatctgccgctggaacctgaagcacaagtacaactatgatgatgtgctgctgctgagccagttcatccggccccacggcggcatgctgcccaggaagatcaccggcctgtgccaggaggagcacaggaagattgaagaatgtgtgaagatggcccacagagctggcctgctgcccaaccaccggccccggctgcctgagggcgtggtgcccaagagcaagccccagctgaaccgctacctgacccgctgggcccctggctctgtgaagcccatctacaagaagggcccccgctggaacagagtgaggatgcctgtgggcagccccctgctgcgggacaacgtgtgctacagcaggaccccctggaagctgtaccactag

SEQ ID NO: 160023 - DNA, 795 bp, Artificial Sequence
  Description of Artificial Sequence: Synthetic coding sequence
atggccgccctgaaggccctggtgtctggctgcggccgcctgctgcggggcctgctggccggccctgctgccacctcctggagccggctgcctgcccggggcttccgggaggtggtggagacccaggagggcaagaccaccatcatcgagggccgcatcacagccacccccaaggagagccccaacccccccaaccccagcggccagtgccccatctgccgctggaacctgaagcacaagtacaactatgatgatgtgctgctgctgagccagttcatccggccccacggcggcatgctgcccaggaagatcaccggcctgtgccaggaggagcacaggaagattgaagaatgtgtgaagatggcccacagagctggaagaagaccctggggccccagaggagctgagggctgccgccacagcctgcccacccagctgccccacgtgtctgcccctcctggcaggaaggtggacatccgctctgtgaactacacccaccaccccatgcccaccttccccctgccctgggccttccccctggcccccagcgagctgcagcgggagctgcagaggctgagccccctgcccaggcacagcggcctgctgcccaaccaccggccccggctgcctgagggcgtggtgcccaagagcaagccccagctgaaccgctacctgacccgctgggcccctggctctgtgaagcccatctacaagaagggcccccgctggaacagagtgaggatgcctgtgggcagccccctgctgcgggacaacgtgtgctacagcaggacatag

SEQ ID NO: 160024 - DNA, 777 bp, Artificial Sequence
  Description of Artificial Sequence: Synthetic coding sequence
atggccgcctctgtgctgaacacagtgctgcggcggctgcccatgctgagcctcttccggggcagccaccgggtgcaggtgcccctgcagaccctgtgcaccaaggcccccagcgaggaggacagcctgagctctgtgcccatcagcccctacaaggatgagccctggaagtacctggagagcgaggagtaccaggagagatatggcagcaggcctgtgtgggccgactacagaagaaaccacaagggcggcgtgcccccccagaggaccaggaagacctgcatcagaagaaacaaggtggtgggcaacccctgccccatctgccgggaccacaagctgcacgtggacttcagaaatgtgaagctgctggagcagtttgtgtgtgcccacacaggcatcatcttctacgccccctacacaggagtgtgtgtgaagcagcacaagaggctgacccaggccatccagaaggcccgggaccacggcctgctgatctaccacatcccccaggtggagccccgggacctggacttcagcaccagccatggagctgtgtctgccaccccaccagcccccaccctggtgtctggggacccctggtacccctggtacaactggaagcagcccccagagcgggagctgagccggctgcggcggctgtaccagggccacctgcaggaggagagcggccccccacctgagagcatgcccaagatgccacccaggaccccagctgaggccagcagcacaggccagacaggcccccagagcgccctgtag

SEQ ID NO: 160025 - DNA, 777 bp, Artificial Sequence; identical to SEQ ID NO: 160024
  Description of Artificial Sequence: Synthetic coding sequence

SEQ ID NO: 160026 - DNA, 648 bp, Artificial Sequence
  Description of Artificial Sequence: Synthetic coding sequence
atggccgcctctgtgctgaacacagtgctgcggcggctgcccatgctgagcctcttccggggcagccaccgggtgcaggtgcccctgcagaccctgtgcaccaaggcccccagcgaggaggacagcctgagctctgtgcccatcagcccctacaaggatgagccctggaagtacctggagagcgaggagtaccaggagagatatggcagcaggcctgtgtgggccgactacagaagaaaccacaagggcggcgtgcccccccagaggaccaggaagacctgcatcaacgtgaagctgctggagcagtttgtgtgtgcccacacaggcatcatcttctacgccccctacacaggcctgctgatctaccacatcccccaggtggagccccgggacctggacttcagcaccagccacggggctgtgtctgccaccccaccagcccccaccctggtgtctggggacccctggtacccctggtacaactggaagcagcccccagagcgggagctgagccggctgcggcggctgtaccagggccacctgcaggaggagagcggccccccacctgagagcatgcccaagatgccacccaggaccccagctgaggccagcagcacaggccagacaggcccccagagcgccctgtag

SEQ ID NO: 160027 - DNA, 648 bp, Artificial Sequence; identical to SEQ ID NO: 160026
  Description of Artificial Sequence: Synthetic coding sequence

SEQ ID NO: 160028 - DNA, 777 bp, Artificial Sequence; identical to SEQ ID NO: 160024
  Description of Artificial Sequence: Synthetic coding sequence

SEQ ID NO: 160029 - DNA, 648 bp, Artificial Sequence; identical to SEQ ID NO: 160026
  Description of Artificial Sequence: Synthetic coding sequence

SEQ ID NO: 160030 - DNA, 648 bp, Artificial Sequence; identical to SEQ ID NO: 160026
  Description of Artificial Sequence: Synthetic coding sequence

SEQ ID NO: 160031 - DNA, 777 bp, Artificial Sequence; identical to SEQ ID NO: 160024
  Description of Artificial Sequence: Synthetic coding sequence

SEQ ID NO: 160032 - DNA, 648 bp, Artificial Sequence; identical to SEQ ID NO: 160026
  Description of Artificial Sequence: Synthetic coding sequence

SEQ ID NO: 160033 - DNA, 777 bp, Artificial Sequence; identical to SEQ ID NO: 160024
  Description of Artificial Sequence: Synthetic coding sequence

SEQ ID NO: 160034 - DNA, 648 bp, Artificial Sequence; identical to SEQ ID NO: 160026
  Description of Artificial Sequence: Synthetic coding sequence

SEQ ID NO: 160035 - DNA, 648 bp, Artificial Sequence; identical to SEQ ID NO: 160026
  Description of Artificial Sequence: Synthetic coding sequence

SEQ ID NO: 160036 - DNA, 777 bp, Artificial Sequence; identical to SEQ ID NO: 160024
  Description of Artificial Sequence: Synthetic coding sequence

SEQ ID NO: 160037 - DNA, 777 bp, Artificial Sequence; identical to SEQ ID NO: 160024
  Description of Artificial Sequence: Synthetic coding sequence

SEQ ID NO: 160038 - DNA, 366 bp, Artificial Sequence
  Description of Artificial Sequence: Synthetic coding sequence
atggccgcctctgtgctgaacacagtgctgcggcggctgcccatgctgagcctcttccggggcagccaccgggtgcaggtgcccctgcagaccctgtgcaccaaggcccccagcgaggaggacagcctgagctctgtgcccatcagcccctacaaggatgagccctggaagtacctggagagcgaggagtaccaggagagatatggcagcaggcctgtgtgggccgactacagaagaaaccacaagggcggcgtgcccccccagaggaccaggaagacctgcatcagaagaaacaaggtggtgggcaacccctgccccatctgccgggaccacaagctgcacgtggacttccgggagagcgtgtag

SEQ ID NO: 160039 - DNA, 366 bp, Artificial Sequence; identical to SEQ ID NO: 160038
  Description of Artificial Sequence: Synthetic coding sequence

SEQ ID NO: 160040 - DNA, 366 bp, Artificial Sequence; identical to SEQ ID NO: 160038
  Description of Artificial Sequence: Synthetic coding sequence

SEQ ID NO: 160041 - DNA, 366 bp, Artificial Sequence; identical to SEQ ID NO: 160038
  Description of Artificial Sequence: Synthetic coding sequence

SEQ ID NO: 160042 - DNA, 366 bp, Artificial Sequence; identical to SEQ ID NO: 160038
  Description of Artificial Sequence: Synthetic coding sequence

SEQ ID NO: 160043 - DNA, 366 bp, Artificial Sequence; identical to SEQ ID NO: 160038
  Description of Artificial Sequence: Synthetic coding sequence

SEQ ID NO: 160044 - DNA, 366 bp, Artificial Sequence; identical to SEQ ID NO: 160038
  Description of Artificial Sequence: Synthetic coding sequence

SEQ ID NO: 160045 - DNA, 429 bp, Artificial Sequence
  Description of Artificial Sequence: Synthetic coding sequence
atggctgctgtggtggccgtgtgtggcggcctgggcaggaagaagctgacccacctggtgacagctgctgtgtccctgacccaccctggcacccacacagtgctgtggaggcggggctgcagccagcaggtgagcagcaatgaagacctgcccatctccatggagaacccctacaaggagcccctgaagaagtgcatcctgtgtgggaagcacgtggactacaagaatgtgcagctgctgagccagtttgtgagccccttcaccggctgcatctacggccgccacatcaccggcctgtgtgggaagaagcagaaggagatcaccaaggccatcaagagggcccagatcatgggcttcatgcctgtgacctacaaggaccctgcctacctgaaggaccccaaggtgtgcaacatccgctaccgggagtag

SEQ ID NO: 160046 - DNA, 345 bp, Artificial Sequence
  Description of Artificial Sequence: Synthetic coding sequence
atggctgctgtggtggccgtgtgtggcggcctgggcaggaagaagctgacccacctggtgacagctgctgtgtccctgacccaccctggcacccacacagtgctgtggaggcggggctgcagccagcaggtgagcagcaatgaagacctgctgctgagccagtttgtgagccccttcaccggctgcatctacggccgccacatcaccggcctgtgtgggaagaagcagaaggagatcaccaaggccatcaagagggcccagatcatgggcttcatgcctgtgacctacaaggaccctgcctacctgaaggaccccaaggtgtgcaacatccgctaccgggagtag

SEQ ID NO: 160047 - DNA, 891 bp, Artificial Sequence
  Description of Artificial Sequence: Synthetic coding sequence
atggccaccagcagcgctgccctgccccgcatcctgggcgctggggcccgggcccccagccgctggctgggcttcctgggcaaggccacccccaggcctgcccggcccagcaggaggaccctgggcagcgccacagccctgatgatccgggagagcgaggacagcacagacttcaatgacaagatcctgaatgagcccctgaagcacagcgacttcttcaacgtgaaggagctgttctctgtgcgcagcctgtttgatgcccgggtgcacctgggccacaaggccggctgccgccaccgcttcatggagccctacatcttcggcagccggctggaccatgacatcatcgacctggagcagacagccacccacctgcagctggccctgaacttcaccgcccacatggcctacaggaagggcatcatcctcttcatcagcaggaaccggcagttctcctacctgattgagaacatggcccgggactgtggggagtatgcccacacccgctacttccggggcggcatgctgaccaatgcccggctgctgtttggccccaccgtgcggctgcctgacctgatcatcttcctgcacaccctgaacaacatctttgagccccacgtggccgtgagagatgctgccaagatgaacatccccaccgtgggcatcgtggacaccaactgcaacccctgcctgatcacctaccctgtgcctggaaatgatgacagccccctggccgtgcacctgtactgccgcctcttccagacagccatcacccgggccaaggagaagaggcagcaggtggaggccctgtaccgcctgcagggccagaaggagcccggggaccagggccctgcccaccccccaggagctgacatgagccacagcctgtag

SEQ ID NO: 160048 - DNA, 891 bp, Artificial Sequence; identical to SEQ ID NO: 160047
  Description of Artificial Sequence: Synthetic coding sequence

SEQ ID NO: 160049 - DNA, 813 bp, Artificial Sequence
  Description of Artificial Sequence: Synthetic coding sequence
agaagaggccccctgggcatgcgctggggcgccggcgtggtgcacagcggcctgggcgcccggaccagcatctacttccccccaggggcccgggcccccagccgctggctgggcttcctgggcaaggccacccccaggcctgcccggcccagcaggaggaccctgggcagcgccacagccctgatgatccgggagagcgaggacagcacagacttcaatgacaagatcctgaatgagcccctgaagcacagcgacttcttcaacgtgaaggagctgttctctgtgcgcagcctgtttgatgcccgggtgcacctgggccacaaggccggctgccgccaccgcttcatggagccctacatcttcggcagccggctggaccatgacatcatcgacctggagcagacagccacccacctgcagctggccctgaacttcaccgcccacatggcctacaggaagggcatcatcctcttcatcagcaggaaccggcagttctcctacctgattgagaacatggcccgggactgtggggagtatgcccacacccgctacttccggggcggcatgctgaccaatgcccggctgctgtttggccccaccgtgcggctgcctgacctgatcatcttcctgcacaccctgaacaacatctttgagccccacgtggccgtgagagatgctgccaagatgaacatccccaccgtgggcatcgtggacaccaactgcaacccctgcctgatcacctaccctgtgcctggaaatgatgacagccccctggccgtgcacctgtactgccgcctcttccagacagcctag

SEQ ID NO: 160050 - DNA, 264 bp, Artificial Sequence
  Description of Artificial Sequence: Synthetic coding sequence
atggccaagcacctgaagttcatcgccaggacagtgatggtgcaggagggcaatgtggagagcgcctaccgcaccctgaaccgcatcctgaccatggatggcctgattgaggacatcaagcaccggcgctactatgagaagccctgcagaagacggcagcgggagagctatgagcgctgccgccgcatctacaacatggagatggccaggaagatcaacttcctgatgaggaagaacagagctgacccctggcagggctgctag

SEQ ID NO: 160051 - DNA, 264 bp, Artificial Sequence; identical to SEQ ID NO: 160050
  Description of Artificial Sequence: Synthetic coding sequence

SEQ ID NO: 160052 - DNA, 1083 bp, Artificial Sequence
  Description of Artificial Sequence: Synthetic coding sequence
atggcccccctgggcaccaccgtgctgctgtggagcctgctgcggagcagccctggggtggagcgggtgtgcttccgggcccgcatccagccctggcatggaggcctgctgcagcccctgccctgcagctttgagatgggcctgccccggcggcgcttcagcagcgaggccgctgagagcggcagccctgagaccaagaagcccaccttcatggatgaggaggtgcagagcatcctgaccaagatgacaggcctgaacctgcagaagaccttcaagccagccatccaggagctgaagccacccacctacaagctgatgacccaggcccagctggaggaggccacccggcaggccgtggaggccgccaaggtgcggctgaagatgcctcctgtgctggaggagcgggtgcccatcaatgatgtgctggccgaggacaagatcctggagggcacagagaccaccaagtatgtgttcacagacatctcctacagcatcccccaccgggagcgcttcatcgtggtgcgggagcccagcggcaccctgaggaaggcctcctgggaggagcgggacaggatgatccaggtgtacttccccaaggagggcaggaagatcctgacccccatcatcttcaaggaggagaacctgcggaccatgtacagccaggacagacatgtggatgtgctgaacctgtgctttgcccagtttgagccagacagcacagagtacatcaaggtgcaccacaagacctatgaagatattgacaagaggggcaagtatgacctgctgcggagcacccgctactttggaggcatggtgtggtactttgtgaacaacaagaagattgatggcctgctgattgaccagatccagagggacctgattgatgatgccaccaacctggtgcagctgtaccacgtgctgcacccagatggccagagcgcccagggcgccaaggaccaggccgctgagggcatcaacctgatcaaggtgtttgccaagacagaggcccagaagggggcctacatcgagctgaccctgcagacctaccaggaggccctgagccgccacagcgctgccagctag

SEQ ID NO: 160053 - DNA, 1080 bp, Artificial Sequence
  Description of Artificial Sequence: Synthetic coding sequence
atggcccccctgggcaccaccgtgctgctgtggagcctgctgcggagcagccctggggtggagcgggtgtgcttccgggcccgcatccagccctggcatggaggcctgctgcagcccctgccctgcagctttgagatgggcctgccccggcggcgcttcagcagcgaggccgagagcggcagccctgagaccaagaagcccaccttcatggatgaggaggtgcagagcatcctgaccaagatgacaggcctgaacctgcagaagaccttcaagccagccatccaggagctgaagccacccacctacaagctgatgacccaggcccagctggaggaggccacccggcaggccgtggaggccgccaaggtgcggctgaagatgcctcctgtgctggaggagcgggtgcccatcaatgatgtgctggccgaggacaagatcctggagggcacagagaccaccaagtatgtgttcacagacatctcctacagcatcccccaccgggagcgcttcatcgtggtgcgggagcccagcggcaccctgaggaaggcctcctgggaggagcgggacaggatgatccaggtgtacttccccaaggagggcaggaagatcctgacccccatcatcttcaaggaggagaacctgcggaccatgtacagccaggacagacatgtggatgtgctgaacctgtgctttgcccagtttgagccagacagcacagagtacatcaaggtgcaccacaagacctatgaggacatcgacaagaggggcaagtatgacctgctgcggagcacccgctactttggaggcatggtgtggtactttgtgaacaacaagaagattgatggcctgctgattgaccagatccagagggacctgattgatgatgccaccaacctggtgcagctgtaccacgtgctgcacccagatggccagagcgcccagggcgccaaggaccaggccgctgagggcatcaacctgatcaaggtgtttgccaagacagaggcccagaagggggcctacatcgagctgaccctgcagacctaccaggaggccctgagccgccacagcgctgccagctag

SEQ ID NO: 160054 - DNA, 960 bp, Artificial Sequence
  Description of Artificial Sequence: Synthetic coding sequence
atgagcagaaatgaaacagagcaccgctacctgggcacccactttggagctgagagcggcagccctgagaccaagaagcccaccttcatggatgaggaggtgcagagcatcctgaccaagatgacaggcctgaacctgcagaagaccttcaagccagccatccaggagctgaagccacccacctacaagctgatgacccaggcccagctggaggaggccacccggcaggccgtggaggccgccaaggtgcggctgaagatgcctcctgtgctggaggagcgggtgcccatcaatgatgtgctggccgaggacaagatcctggagggcacagagaccaccaagtatgtgttcacagacatctcctacagcatcccccaccgggagcgcttcatcgtggtgcgggagcccagcggcaccctgaggaaggcctcctgggaggagcgggacaggatgatccaggtgtacttccccaaggagggcaggaagatcctgacccccatcatcttcaaggaggagaacctgcggaccatgtacagccaggacagacatgtggatgtgctgaacctgtgctttgcccagtttgagccagacagcacagagtacatcaaggtgcaccacaagacctatgaggacatcgacaagaggggcaagtatgacctgctgcggagcacccgctactttggaggcatggtgtggtactttgtgaacaacaagaagattgatggcctgctgattgaccagatccagagggacctgattgatgatgccaccaacctggtgcagctgtaccacgtgctgcacccagatggccagagcgcccagggcgccaaggaccaggccgctgagggcatcaacctgatcaaggtgtttgccaagacagaggcccagaagggggcctacatcgagctgaccctgcagacctaccaggaggccctgagccgccacagcgctgccagctag

SEQ ID NO: 160055 - DNA, 1083 bp, Artificial Sequence; identical to SEQ ID NO: 160052
  Description of Artificial Sequence: Synthetic coding sequence

SEQ ID NO: 160056 - DNA, 507 bp, Artificial Sequence
  Description of Artificial Sequence: Synthetic coding sequence
atggcccccctgggcaccaccgtgctgctgtggagcctgctgcggagcagccctggggtggagcgggtgtgcttccgggcccgcatccagccctggcatggaggcctgctgcagcccctgccctgcagctttgagatgggcctgccccggcggcgcttcagcagcgaggccgagagcggcagccctgagaccaagaagcccaccttcatggatgaggaggtgcagagcatcctgaccaagatgacaggcctgaacctgcagaagaccttcaagccagccatccaggagctgaagccacccacctacaagctgatgacccaggcccagctggaggaggccacccggcaggccgtggaggccgccaaggtgcggctgaagatgcctcctgtgctggaggagcgggtgcccatcaatgatgtgctggccgaggacaagatcctggagggcacagagaccaccaagtatgtgttcacagacatctcctacagcatcccccaccgctgctag

SEQ ID NO: 160057 - DNA, 573 bp, Artificial Sequence
  Description of Artificial Sequence: Synthetic coding sequence
atggccggcagccggctggagaccgtgggcagcatcttcagcaggacccgggacctggtgcgggccggcgtgctgaaggagaagcccctgtggtttgatgtgtatgatgccttcccccccctgcgggagcccgtcttccagaggccccgggtgcgctatggcaaggccaaggcccccatccaggacatctggtaccatgaagatcgcatccgggccaagttctacagcgtgtatggcagcggccagagggcctttgacctcttcaaccccaacttcaagagcacctgccagagatttgtggagaagtacacagagctgcagaagctgggggagacagatgaggagaagctgtttgtggagaccgggaaggccctgctggccgagggcgtcatcctgcggcgggtgggggaggcccggacccagcacggcggcagccacgtgtccaggaagtctgagcacctgtctgtgcggccccagacagccctggaggagaatgagacccagaaggaggtgccccaggaccagcacctggaggccccagctgaccagagcaagggcctgctgcccccatag

SEQ ID NO: 160058 - DNA, 504 bp, Artificial Sequence
  Description of Artificial Sequence: Synthetic coding sequence
atggccgcctctgtgtgcagcggcctgctgggcccccgggtgctgtcctggagccgggagctgccctgtgcctggagggccctgcacaccagccctgtgtgtgccaagaacagagctgcccgggtgcgggtgtccaagggggacaagcctgtgacctatgaggaggcccacgccccccactacatcgcccacaggaagggctggctgagcctgcacactggaaacctggatggagaagatcatgctgctgagaggacagtggaggatgtgttcctgaggaagttcatgtggggcaccttccctggctgcctggccgaccagctggtgctgaagaggcggggcaaccagctggagatctgtgctgtggtgctgcggcagctgagcccccacaagtactacttcctggtgggctacagcgagaccctgctgagctacttctacaagtgccctgtgcggctgcacctgcagacagtgcccagcaaggtggtgtacaagtacctgtag

SEQ ID NO: 160059 - DNA, 522 bp, Artificial Sequence
  Description of Artificial Sequence: Synthetic coding sequence
atgcccatgaagggccgcttccccatccggaggaccctgcagtacctgagccagggcaatgtggtgttcaaggacagcgtgaaggtgatgacagtgaactacaacacccatggagagctgggggagggcgccaggaagtttgtgttcttcaacatcccccagatccagtacaagaacccctgggtgcagatcatgatgttcaagaacatgacccccagccccttcctgcgcttctacctggacagcggggagcaggtgctggtggatgtggagaccaagagcaacaaggagatcatggagcacatcaggaagatcctgggcaagaatgaggagaccctgcgggaggaggaggaggagaagaagcagctgagccacccagccaactttggccccaggaagtactgcctgcgggagtgcatctgtgaggtggagggccaggtgccctgccccagcctggtgcccctgcccaaggagatgaggggcaagtacaaggccgccctgaaggcagatgcccaggactag

SEQ ID NO: 160060 - DNA, 333 bp, Artificial Sequence
  Description of Artificial Sequence: Synthetic coding sequence
atgcccatgaagggccgcttccccatccggaggaccctgcagtacctgagccagggcaatgtggtgttcaaggacagcgtgaaggtgatgacagtgaactacaacacccatggagagctgggggagggcgccaggaagtttgtgttcttcaacatcccccagatccagtacaagaacccctgggtgcagatcatgatgttcaagaacatgacccccagccccttcctgcgcttctacctggacagcggggagcaggtgctggtggatgtggagaccaagagcaacaaggagatcatggagcacatcaggaagatcctgggcaagaatgaatag

SEQ ID NO: 160061 - DNA, 390 bp, Artificial Sequence
  Description of Artificial Sequence: Synthetic coding sequence
atgcccatgaagggccgcttccccatccggaggaccctgcagtacctgagccagggcaatgtggtgttcaaggacagcgtgaaggtgatgacagtgaactacaacacccatggagagctgggggagggcgccaggaagtttgtgttcttcaacatcccccagatccagtacaagaacccctgggtgcagatcatgatgttcaagaacatgacccccagccccttcctgcgcttctacctgggcaagcccagcggcaagagaagaagaaggaagagcagcttcctgacccagcccaccagcgccctggagagcacagcctgtggcagcgcctctgtgaagtggaagggccgctgcccagccccagcctggtgccactaccccaggaggtag

SEQ ID NO: 160062 - DNA, 333 bp, Artificial Sequence; identical to SEQ ID NO: 160060
  Description of Artificial Sequence: Synthetic coding sequence

SEQ ID NO: 160063 - DNA, 438 bp, Artificial Sequence
  Description of Artificial Sequence: Synthetic coding sequence
atgcccatgaagggccgcttccccatccggaggaccctgcagtacctgagccagggcaatgtggtgttcaaggacagcgtgaaggtgatgacagtgaactacaacacccatggagagctgggggagggcgccaggaagtttgtgttcttcaacatcccccagatccagtacaagaacccctgggtgcagatcatgatgttcaagaacatgacccccagccccttcctgcgcttctacctggacagcggggagcaggtgctggtggatgtggagaccaagagcaacaaggagatcatggagcacatcaggaagatcctgggcaagaatgagcactacctggccgcccccagcaagcctgtgagcagcgctgtggtgcctgtgacccaggaggccgaggccggcggcagcctggagccccggcggctgcggctggagtag

SEQ ID NO: 160064 - DNA, 618 bp, Artificial Sequence
  Description of Artificial Sequence: Synthetic coding sequence
atgctgcgggccctgagccggctgggcgccggcaccccctgccggccccgggcccccctggtgctgcctgcccggggcaggaagaccaggcatgaccccctggccaagagcaagattgagcgggtgaacatgcctcctgctgtggaccctgctgagttctttgtgctgatggagcgctaccagcactaccggcagacagtgcgggccctgaggatggagtttgtgtctgaggtgcagaggaaggtgcatgaggcccgggccggcgtgctggccgagaggaaggccctgaaggatgctgctgagcaccgggagctgatggcctggaaccaggccgagaacagaaggctgcacgagctgagaattgcccggctgcggcaggaggagcgggagcaggagcagaggcaggccctggagcaggccaggaaggccgaggaggtgcaggcctgggcccagaggaaggagcgggaggtgctgcagctgcaggaggaggtgaagaacttcatcacccgggagaacctggaggcccgggtggaggccgccctggacagcaggaagaactacaactgggccatcacccgggagggcctggtggtgcggccccagaggcgggacagctag

SEQ ID NO: 160065 - DNA, 1245 bp, Artificial Sequence
  Description of Artificial Sequence: Synthetic coding sequence
atggccgccagcatcgtgagaagaggcatgctgctggcccggcaggtggtgctgccccagctgagccctgctgggaagcgctacctgctgagcagcgcctacgtggacagccacaagtgggaggcccgggagaaggagcactactgcctggccgacctggccagcctgatggacaagacctttgagaggaagctgcctgtgagcagcctgaccatcagccggctgattgacaacatcagcagccgggaggagattgaccacgccgagtactacctgtacaagttccgccacagccccaactgctggtacctgaggaactggaccatccacacctggatccggcagtgcctgaagtatgatgcccaggacaaggccctgtacaccctggtgaacaaggtgcagtatggcatcttcccagacaacttcaccttcaacctgctgatggacagcttcatcaagaaggagaactacaaggatgccctgtctgtggtgtttgaggtgatgatgcaggaggcctttgaggtgcccagcacccagctgctgagcctgtatgtgctcttccactgcctggccaagaagacagacttctcctgggaggaggagaggaactttggagccagcctgctgctgcccggcctgaagcagaagaacagcgtgggcttcagcagccagctgtatggctacgccctgctgggcaaggtggagctgcagcagggcctgcgggctgtgtaccacaacatgcccctcatctggaagccaggctacctggaccgggccctgcaggtgatggagaaggtggccgccagccctgaggacatcaagctgtgccgggaggccctggatgtgctgggcgctgtgctgaaggccctgaccagcgcagatggagccagcgaggagcagagccagaatgatgaggacaaccagggcagcgagaagctggtggagcagctggacatcgaggagacagagcagagcaagctgccccagtacctggagcgcttcaaggccctgcacagcaagctgcaggccctgggcaagattgaaagtgagggcctgctgagcctgaccacccagctggtgaaggagaagctgagcacctgtgaggccgaggacatcgccacctatgagcagaacctgcagcagtggcacctggacctggtgcagctgatccagcgggagcagcagcagcgggagcaggccaagcaggagtaccaggcccagaaggccgccaaggccagcgcctag

SEQ ID NO: 160066 - DNA, 1077 bp, Artificial Sequence
  Description of Artificial Sequence: Synthetic coding sequence
atggacaagacctttgagaggaagctgcctgtgagcagcctgaccatcagccggctgattgacaacatcagcagccgggaggagattgaccacgccgagtactacctgtacaagttccgccacagccccaactgctggtacctgaggaactggaccatccacacctggatccggcagtgcctgaagtatgatgcccaggacaaggccctgtacaccctggtgaacaaggtgcagtatggcatcttcccagacaacttcaccttcaacctgctgatggacagcttcatcaagaaggagaactacaaggatgccctgtctgtggtgtttgaggtgatgatgcaggaggcctttgaggtgcccagcacccagctgctgagcctgtatgtgctcttccactgcctggccaagaagacagacttctcctgggaggaggagaggaactttggagccagcctgctgctgcccggcctgaagcagaagaacagcgtgggcttcagcagccagctgtatggctacgccctgctgggcaaggtggagctgcagcagggcctgcgggctgtgtaccacaacatgcccctcatctggaagccaggctacctggaccgggccctgcaggtgatggagaaggtggccgccagccctgaggacatcaagctgtgccgggaggccctggatgtgctgggcgctgtgctgaaggccctgaccagcgcagatggagccagcgaggagcagagccagaatgatgaggacaaccagggcagcgagaagctggtggagcagctggacatcgaggagacagagcagagcaagctgccccagtacctggagcgcttcaaggccctgcacagcaagctgcaggccctgggcaagattgaaagtgagggcctgctgagcctgaccacccagctggtgaaggagaagctgagcacctgtgaggccgaggacatcgccacctatgagcagaacctgcagcagtggcacctggacctggtgcagctgatccagcgggagcagcagcagcgggagcaggccaagcaggagtaccaggcccagaaggccgccaaggccagcgcctag

SEQ ID NO: 160067 - DNA, 1287 bp, Artificial Sequence
  Description of Artificial Sequence: Synthetic coding sequence
atggccgccagcatcgtgagaagaggcatgctgctggcccggcaggtggtgctgccccagctgagccctgctgggaagcgctacctgctgagcagcgcctacgtggacagccacaagtgggaggcccgggagaaggagcactactgcctggccgacctggccagcctgatggacaagacctttgagaggaagctgcctgtgagcagcctgaccatcagccggctgattgacaacatcagcagccgggaggagattgaccacgccgagtactacctgtacaagaagggagaatgtagcagcagcaacccccagaactacagccgcttccgccacagccccaactgctggtacctgaggaactggaccatccacacctggatccggcagtgcctgaagtatgatgcccaggacaaggccctgtacaccctggtgaacaaggtgcagtatggcatcttcccagacaacttcaccttcaacctgctgatggacagcttcatcaagaaggagaactacaaggatgccctgtctgtggtgtttgaggtgatgatgcaggaggcctttgaggtgcccagcacccagctgctgagcctgtatgtgctcttccactgcctggccaagaagacagacttctcctgggaggaggagaggaactttggagccagcctgctgctgcccggcctgaagcagaagaacagcgtgggcttcagcagccagctgtatggctacgccctgctgggcaaggtggagctgcagcagggcctgcgggctgtgtaccacaacatgcccctcatctggaagccaggctacctggaccgggccctgcaggtgatggagaaggtggccgccagccctgaggacatcaagctgtgccgggaggccctggatgtgctgggcgctgtgctgaaggccctgaccagcgcagatggagccagcgaggagcagagccagaatgatgaggacaaccagggcagcgagaagctggtggagcagctggacatcgaggagacagagcagagcaagctgccccagtacctggagcgcttcaaggccctgcacagcaagctgcaggccctgggcaagattgaaagtgagggcctgctgagcctgaccacccagctggtgaaggagaagctgagcacctgtgaggccgaggacatcgccacctatgagcagaacctgcagcagtggcacctggacctggtgcagctgatccagcgggagcagcagcagcgggagcaggccaagcaggagtaccaggcccagaaggccgccaaggccagcgcctag

SEQ ID NO: 160068 - DNA, 564 bp, Artificial Sequence
  Description of Artificial Sequence: Synthetic coding sequence
atggccgccctgtgcaggaccagggctgtggccgctgagagccacttcctgcgggtcttcctgttcttccggcccttccggggcgtgggcacagaaagtggcagcgagagcggcagcagcaatgccaaggagcccaagaccagggctgggggctttgccagcgccctggagcggcacagcgagctgctgcagaaggtggagcccctgcagaagggcagccccaagaatgtggagagctttgcctccatgctgcggcacagccccctgacccagatgggccctgccaaggacaagctggtgattggccgcatcttccacatcgtggagaatgacctgtacatcgactttggaggcaagttccactgtgtgtgcagaagacctgaggtggatggagagaagtaccagaagggcaccagggtgcggctgcggctgctggacctggagctgaccagccgcttcctgggcgccaccacagacaccaccgtgctggaggccaatgctgtgctgctgggcatccaggagagcaaggacagccgcagcaaggaggagcaccacgagaagtag

SEQ ID NO: 160069 - DNA, 1320 bp, Artificial Sequence
  Description of Artificial Sequence: Synthetic coding sequence
atggctgctgcccgctgctggaggcccctgctgcggggcccccggctgagcctgcacacagctgccaatgctgctgccacagccacagagaccacctgccaggatgtggccgccacccctgtggcccgctacccacccatcgtggcctccatgacagctgacagcaaggccgcccggctgcggagaattgagcgctggcaggccaccgtgcacgccgctgagagcgtggatgagaagctgcgcatcctgaccaagatgcagttcatgaagtacatggtgtacccccagacctttgccctgaatgctgaccgctggtaccagtacttcaccaagacagtgttcctgagcggcctgcccccacctcctgctgagcctgagcctgagcctgagcctgagcctgagcccgccctggacctggccgccctgcgggctgtggcctgtgactgcctgctgcaggagcacttctacctgcggaggagaagaagagtgcacagatatgaggagagcgaggtgatcagcctgcccttcctggaccagctggtgtccaccctggtgggcctgctgagcccccacaacccagccctggccgccgccgccctggactaccgctgccctgtgcacttctactgggtgcggggggaggagatcatcccccggggccaccggcggggcagaattgatgacctgcgctaccagattgatgacaagcccaacaaccagatccgcatcagcaagcagctggccgagtttgtgcccctggactacagcgtgcccatcgagatccccaccatcaagtgcaagccagacaagctgcccctcttcaagaggcagtatgagaaccacatctttgtgggcagcaagacagctgacccctgctgctacggccacacccagttccacctgctgcctgacaagctgcggcgggagcggctgctgcggcagaactgtgccgaccagatcgaggtggtgttccgggccaatgccatcgccagcctgtttgcctggacaggagcccaggccatgtaccagggcttctggagcgaggctgatgtgacccggccctttgtgtcccaggccgtcatcacagatggcaagtacttctccttcttctgctaccagctgaacaccctggccctgaccacccaggccgaccagaacaaccccaggaagaacatctgctggggcacccagagcaagcccctgtatgagaccatcgaggacaatgatgtgaagggcttcaatgatgatgtgctgctgcagatcgtgcacttcctgctgaaccggcccaaggaggagaagagccagctgctggagaactag

SEQ ID NO: 160070 - DNA, 1188 bp, Artificial Sequence
  Description of Artificial Sequence: Synthetic coding sequence
atgttcccccgggtgtccaccttcctgcccctgcggcccctgagccgccaccccctgagcagcggcagccctgagaccagcgctgctgccatcatgctgctgactgtgcgccacggcaccgtgcgctaccgcagcagcgccctgctggcccggaccaagaacaacatccagcgctacttcggcaccaacagcgtcatctgcagcaagaaggacaagcagagcgtgaggacagaggagaccagcaaggagaccagcgagagccaggacagcgagaaggagaacaccaagaaggacctgctgggcatcatcaagggcatgaaggtggagctgagcacagtgaatgtgaggaccaccaagccacccaagagaagacccctgaagagcctggaggccaccctgggccgcctgcggcgggccacagaatatgcccccaagaagagaattgagcccctgagccctgagctggtggccgccgccagcgctgtggccgacagcctgccctttgacaagcagaccaccaagtctgagctgctgagccagctgcagcagcacgaggaggagagccgggcccagagagatgccaagaggcccaagatctccttcagcaacatcatcagtgacatgaaggtggcccggagcgccacagcccgggtgcgcagcaggcctgagctgcgcatccagtttgatgagggctatgacaactacccaggccaggagaagacagatgacctgaagaagaggaagaacatcttcaccgggaagaggctgaacatctttgacatgatggctgtgaccaaggaggcccctgagacagacaccagccccagcctgtgggatgtggagtttgccaagcagctggccaccgtgaatgagcagcccctgcagaatggatttgaggagctgatccagtggaccaaggagggcaagctgtgggagttccccatcaacaatgaagctggctttgatgatgatggcagcgagttccacgagcacatcttcctggagaagcacctggagagcttccccaagcagggccccatccgccacttcatggagctggtgacctgtggcctgagcaagaacccctacctgtctgtgaagcagaaggtggagcacatcgagtggttcaggaactacttcaatgagaagaaggacatcctgaaggagagcaacatccagttcaactag

SEQ ID NO: 160071 - DNA, 321 bp, Artificial Sequence
  Description of Artificial Sequence: Synthetic coding sequence
atgagcagcctgtctgaatatgccttcaggatgagccggctgagcgcccggctgtttggagaggtgacccggcccaccaacagcaagtccatgaaggtggtgaagctgttcagcgagctgcccctggccaagaagaaggagacctatgactggtaccccaaccaccacacctatgcagagctgatgcagaccctgcgcttcctgggcctgtacagagatgagcaccaggacttcatggatgagcagaagaggctgaagaagctgcggggcaaggagaagcccaagaagggggagggcaagagagctgccaagaggaagtag

SEQ ID NO: 160072 - DNA, 321 bp, Artificial Sequence; identical to SEQ ID NO: 160071
  Description of Artificial Sequence: Synthetic coding sequence

SEQ ID NO: 160073 - DNA, 321 bp, Artificial Sequence; identical to SEQ ID NO: 160071
  Description of Artificial Sequence: Synthetic coding sequence

SEQ ID NO: 160074 - DNA, 321 bp, Artificial Sequence; identical to SEQ ID NO: 160071
  Description of Artificial Sequence: Synthetic coding sequence

SEQ ID NO: 160075 - DNA, 339 bp, Artificial Sequence
  Description of Artificial Sequence: Synthetic coding sequence
atgagcagcctgtctgaatatgccttcaggatgagccggctgagcgcccggctgtttggagaggtgacccggcccaccaacagcaagtccatgaaggtggtgaagctgttcagcgagctgcccctggccaagaagaaggagacctatgactggtaccccaaccaccacacctatgcagagctgatgcagaccctgcgcttcctgggcctgtacagagatgagcaccaggacttcatggatgagcagaagaggctgaagaagctgcggggcaaggagaagcccaagaagggggagggcaagagagctgccaagaggaagaagaagaagaagaagaggtag

SEQ ID NO: 160076 - DNA, 678 bp, Artificial Sequence
  Description of Artificial Sequence: Synthetic coding sequence
atggccaggaagaaggtgcggccccggctgattgctgagctggcccggcgggtgcgggccctgcgggagcagctgaaccggccccgggacagccagctgtatgctgtggactatgagaccctgacccggcccttcagcggccggcggctgcctgtgcgggcctgggcagatgtgagaagagagagccggctgctgcagctgctgggccgcctgcccctgtttggcctgggccgcctggtgaccaggaagtcctggctgtggcagcatgatgagccctgctactggaggctgaccagggtgcggccagactacacagcccagaacctggaccacggcaaggcctggggcatcctgaccttcaaggatgccagcttcagcagcagcggcaagacagaaagtgaggcccgggagattgagcacgtgatgtaccatgactggaggctggtgcccaagcatgaggaggaggccttcaccgccttcaccccagcccctgaggacagcctggcctctgtgccctacccacccctgctgcgggccatgatcatcgccgagcggcagaagaatggagacaccagcacagaggagcccatgctgaatgtgcagaggatccgcatggagccctgggactacccagccaagcaggaggacaagggccgggccaagggcacccctgtgtag

SEQ ID NO: 160077 - DNA, 657 bp, Artificial Sequence
  Description of Artificial Sequence: Synthetic coding sequence
atggccaggaagaaggtgcggccccggctgattgctgagctggcccggcgggtgcgggccctgcgggagcagctgaaccggccccgggacagccagctgtatgctgtggactatgagaccctgacccggcccttcagcggccggcggctgcctgtgcgggcctgggcagatgtgagaagagagagccggctgctgcagctgctgggccgcctgcccctgtttggcctgggccgcctggtgaccaggaagtcctggctgtggcagcatgatgagccctgctactggaggctgaccagggtgcggccagactacacagcccagaacctggaccacggcaaggcctggggcatcctgaccttcaagggcaagacagagagcgaggcccgggagattgaacatgtgatgtaccatgactggaggctggtgcccaagcatgaggaggaggccttcaccgccttcaccccagcccctgaggacagcctggcctctgtgccctacccacccctgctgcgggccatgatcatcgccgagcggcagaagaatggagacaccagcacagaggagcccatgctgaatgtgcagaggatccgcatggagccctgggactacccagccaagcaggaggacaagggccgggccaagggcacccctgtgtag

SEQ ID NO: 160078 - DNA, 972 bp, Artificial Sequence
  Description of Artificial Sequence: Synthetic coding sequence
atggctgctgctgccctgcctgcctggctgagcctgcagagccgggcccggaccctgcgggccttcagcacagctgtgtacagcgccacccctgtgcccacccccagcctgcctgagaggaccccaggaaatgaaagaccacccaggaggaaggccctgccccccaggacagagaagatggctgtggaccaggactggcccagcgtgtaccctgtggccgcccccttcaagcccagcgctgtgcccctgcctgtgaggatgggctaccctgtgaagaagggcgtgcccatggccaaggagggcaacctggagctgctgaagatccccaacttcctgcacctgacccctgtggccatcaagaagcactgtgaggccctgaaggacttctgcacagagtggccagctgccctggacagtgatgagaagtgtgagaagcacttccccattgaaattgacagcacagattatgtgagcagcggccccagcgtgaggaacccccgggcccgggtggtggtgctgcgggtgaagctgagcagcctgaacctggatgaccacgccaagaagaagctgatcaagctggtgggggagcgctactgcaagaccacagatgtgctgaccatcaagacagaccgctgccccctgcggcggcagaactatgactatgctgtgtacctgctgactgtgctgtaccacgagagctggaacacagaggagtgggagaagagcaagacagaggccgacatggaggagtacatctgggagaacagcagcagcgagaggaacatcctggagaccctgctgcagatgaaggctgctgagaagaacatggagatcaacaaggaggagctgctgggcaccaaggagattgaggagtacaagaagtctgtggtgtccctgaagaatgaggaggagaatgaaaacagcatcagccagtacaaggagagcgtgaagaggctgctgaatgtgacctag

SEQ ID NO: 160079 - DNA, 864 bp, Artificial Sequence
  Description of Artificial Sequence: Synthetic coding sequence
atggctgctgctgccctgcctgcctggctgagcctgcagagccgggcccggaccctgcgggccttcagcacagctgtgtacagcgccacccctgtgcccacccccagcctgcctgagaggaccccaggaaatgaaagaccacccaggaggaaggccctgccccccaggacagagaagatggctgtggaccaggactggcccagcgtgtaccctgtggccgcccccttcaagcccagcgctgtgcccctgcctgtgaggatgggctaccctgtgaagaagggcgtgcccatggccaaggagggcaacctggagctgctgaagatccccaacttcctgcacctgacccctgtggccatcaagaagcactgtgaggccctgaaggacttctgcacagagtggccagctgccctggacagtgatgagaagtgtgagaagcacttccccattgaaattgacagcacagattatgtgagcagcggccccagcgtgaggaacccccgggcccgggtggtggtgctgcggcgctgccccctgcggcggcagaactatgactatgctgtgtacctgctgactgtgctgtaccacgagagctggaacacagaggagtgggagaagagcaagacagaggccgacatggaggagtacatctgggagaacagcagcagcgagaggaacatcctggagaccctgctgcagatgaaggctgctgagaagaacatggagatcaacaaggaggagctgctgggcaccaaggagattgaggagtacaagaagtctgtggtgtccctgaagaatgaggaggagaatgaaaacagcatcagccagtacaaggagagcgtgaagaggctgctgaatgtgacctag

SEQ ID NO: 160080 - DNA, 585 bp, Artificial Sequence
  Description of Artificial Sequence: Synthetic coding sequence
atggctgctgctgccctgcctgcctggctgagcctgcagagccgggcccggaccctgcgggccttcagcacagctgtgtacagcgccacccctgtgcccacccccagcctgcctgagaggaccccaggaaatgaaagaccacccaggaggaaggccctgccccccaggacagagaagatggctgtggaccaggactggcccagcgtgtaccctgtggccgcccccttcaagcccagcgctgtgcccctgcctgtgaggatgggctaccctgtgaagaagggcgtgcccatggccaaggagggcaacctggagctgctgaagatccccaacttcctgcacctgacccctgtggccatcaagaagcactgtgaggccctgaaggacttctgcacagagtggccagctgccctggacagtgatgagaagtgtgagaagcacttccccattgaaattgacagcacagattatgtgagcagcggccccagcgtgaggaacccccgggcccgggtggtggtgctgcgggtgcccttcaaggaggccgagctgcggctgtgcagcgtgtccaccaacagcgtcatcccctag

SEQ ID NO: 160081 - DNA, 312 bp, Artificial Sequence
  Description of Artificial Sequence: Synthetic coding sequence
atgatgggcagcaagatggccagcgccagccgggtggtgcaggtggtgaagccccacacccccctcatccgcttcccagaccggcgggacaaccccaagcccaacgtgtctgaggccctgcggtctgctggcctgcccagccacagcagcgtcatcagccagcacagcaagggcagcaagagcccagacctgctgatgtaccagggccccccagacacagctgagatcatcaagaccctgccccagaagtacagaaggaagctggtgtcccaggaggagatggagttcatccagaggggcggccctgagtag

SEQ ID NO: 160082 - DNA, 1293 bp, Artificial Sequence
  Description of Artificial Sequence: Synthetic coding sequence
atggccacagctgtgcgggctgtgggctgcctgcctgtgctgtgcagcggcacagctggccacctgctgggccggcagtgcagcctgaacaccctgcctgctgccagcatcctggcctggaagtctgtgctgggcaatggccacctgagcagcctgggcacccgggacacccacccctatgccagcctgagccgggccctgcagacccagtgctgcatcagcagccccagccacctgatgagccagcagtaccggccctacagcttcttcaccaagctgacagcagatgagctgtggaagggggccctggccgagaccggggccggggccaagaagggccggggcaagaggaccaagaagaagaagaggaaggacctgaacagaggccagatcatcggggagggccgctatggcttcctgtggccaggcctgaatgtgcccctgatgaagaatggagctgtgcagaccatcgcccagaggagcaaggaggagcaggagaaggtggaggccgacatgatccagcagcgggaggagtgggacaggaagaagaagatgaaggtgaagcgggagcggggctggagcggcaacagctggggcggcatcagcctgggccccccagaccccggcccctgtggggagacctatgaggactttgacacccgcatcctggaggtgagaaatgtgttcaccatgacagccaaggagggcaggaagaagagcatccgggtgctggtggccgtgggcaatggaaaaggagctgctggcttcagcatcggcaaggccacagacaggatggatgccttcaggaaggccaagaacagagctgtgcaccacctgcactacatcgagagatatgaggaccacaccatcttccatgacatcagcctgcgcttcaagaggacccacatcaagatgaagaagcagcccaagggctacggcctgcgctgccaccgggccatcatcaccatctgccgcctgattggcatcaaggacatgtatgccaaggtgtctggcagcatcaacatgctgagcctgacccagggcctcttccggggcctgagccggcaggagacccaccagcagctggccgacaagaagggcctgcacgtggtggagatccgggaggagtgtggccccctgcccatcgtggtggccagcccccggggccccctgaggaaggaccctgagccagaagatgaggtgcctgatgtgaagctggactgggaggatgtgaagacagcccagggcatgaagaggtctgtgtggagcaacctgaagagagctgccacctag

SEQ ID NO: 160083 - DNA, 378 bp, Artificial Sequence
  Description of Artificial Sequence: Synthetic coding sequence
atgcccaggtatgagctggccctgatcctgaaggccatgcagaggcctgagacagctgccaccctgaagaggaccatcgaggccctgatggacagaggagccatcgtgcgggacctggagaacctgggggagcgggccctgccctaccgcatcagcgcccacagccagcagcacaacagaggaggctacttcctggtggacttctacgcccccacagctgctgtggagagcatggtggagcacctgagccgggacattgatgtgatccggggcaacatcgtgaagcaccccctgacccaggagctgaaggaatgtgagggcatcgtgcctgtgcccctggccgagaagctgtacagcaccaagaagaggaagaagtag

SEQ ID NO: 160084 - DNA, 729 bp, Artificial Sequence
  Description of Artificial Sequence: Synthetic coding sequence
atggccgccccagctgtgaaggtggcccggggctggagcggcctggccctgggcgtgcggcgggctgtgctgcagctgcccggcctgacccaggtgcgctggagccgctacagccctgagttcaaggaccccctgattgacaaggagtactacaggaagcctgtggaggagctgacagaggaggagaagtatgtgcgggagctgaagaagacccagctgatcaaggccgccccagctgggaagaccagctctgtgtttgaagatcctgtgatcagcaagttcaccaacatgatgatgattggaggcaacaaggtgctggcccggagcctgatgatccagaccctggaggccgtgaagaggaagcagtttgagaagtaccacgccgccagcgctgaggagcaggccaccattgaaagaaacccctacaccatcttccaccaggccctgaagaactgtgagcccatgattggcctggtgcccatcctgaagggcggccgcttctaccaggtgcctgtgcccctgcctgacagaagaagacgcttcctggccatgaagtggatgatcacagagtgccgggacaagaagcaccagaggaccctgatgcctgagaagctgagccacaagctgctggaggccttccacaaccagggccctgtgatcaagaggaagcatgacctgcacaagatggccgaggccaacagagccctggcccactaccgctggtggtag

SEQ ID NO: 160085 - DNA, 1191 bp, Artificial Sequence
  Description of Artificial Sequence: Synthetic coding sequence
atggccgccccctgtgtgtcctatggaggagctgtgtcctaccgcctgctgctgtggggccggggcagcctggccaggaagcagggcctgtggaagacagctgcccctgagctgcagaccaacgtgcgcagccagatcctgcggctgcggcacacagccttcgtcatccccaagaagaatgtgcccaccagcaagcgggagacctacacagaggacttcatcaagaagcagatcgaggagttcaacatcggcaagaggcacctggccaacatgatgggagaggaccctgagaccttcacccaggaggacatcgaccgggccatcgcctacctgttccccagcggcctgtttgagaagagggcccggcctgtgatgaagcaccctgagcagatcttcccccggcagagggccatccagtggggagaagatggccggcccttccactacctgttctacacaggcaagcagagctactacagcctgatgcatgatgtgtatggcatgctgctgaacctggagaagcaccagagccacctgcaggccaagagcctgctgcctgagaagacagtgaccagagatgtgattggcagccgctggctgatcaaggaggagctggaggagatgctggtggagaagctgagtgacctggactacatgcagttcatccggctgctggagaagctgctgaccagccagtgtggggctgctgaggaggagtttgtgcagcgcttcagaagatctgtgaccctggagagcaagaagcagctgattgagcctgtgcagtatgatgagcagggcatggccttcagcaagtctgagggcaagaggaagacagccaaggccgaggccatcgtgtacaagcacggcagcggccgcatcaaggtgaatggcatcgactaccagctgtacttccccatcacccaggaccgggagcagctgatgttccccttccactttgtggaccggctgggcaagcatgatgtgacctgcaccgtgtctgggggcggccgcagcgcccaggccggggccatccggctggccatggccaaggccctgtgcagctttgtgacagaagatgaggtggagtggatgaggcaggccggcctgctgaccacagacccccgggtgcgggagaggaagaagccaggccaggagggcgcccggaggaagttcacctggaagaagaggtag

SEQ ID NO: 160086 - DNA, 1122 bp, Artificial Sequence
  Description of Artificial Sequence: Synthetic coding sequence
atgtgggtgtgcagcaccctgtggagggtgaggaccccagcccggcagtggaggggcctgctgcctgccagcggctgccacggccctgctgccagcagctacagcgccagcgctgagcccgcccgggtgcgggccctggtgtatggccaccacggggaccctgccaaggtggtggagctgaagaacctggagctggccgctgtgcggggcagtgatgtgcgggtgaagatgctggccgcccccatcaaccccagcgacatcaacatgatccagggcaactacggcttcctgcctgagctgcctgctgtgggcggcaatgaaggagtggcccaggtggtggccgtgggcagcaatgtgacaggcctgaagccaggggactgggtgatcccagccaatgccggcctgggcacctggaggacagaggccgtgttttctgaggaggccctgatccaggtgcccagcgacatccccctgcagagcgctgccaccctgggcgtgaacccctgcacagcctacaggatgctgatggactttgagcagctgcagcccggggacagcgtcatccagaatgccagcaacagcggcgtgggccaggccgtcatccagattgctgctgccctgggcctgcggaccatcaacgtggtgcgggacagaccagacatccagaagctgagtgaccggctgaagagcctgggcgctgagcacgtgatcacagaggaggagctgcggcggcctgagatgaagaacttcttcaaggacatgccccagccccggctggccctgaactgtgtgggcggcaagagcagcacagagctgctgcggcagctggcccggggcggcaccatggtgacctatggaggcatggccaagcagcctgtggtggcctctgtgtccctgctgatcttcaaggacctgaagctgcggggcttctggctgagccagtggaagaaggaccacagcccagaccagttcaaggagctgatcctgaccctgtgtgacctgatccggcggggccagctgacagccccagcctgcagccaggtgcccctgcaggactaccagagcgccctggaggcctccatgaagcccttcatcagcagcaagcagatcctgaccatgtag

SEQ ID NO: 160087 - DNA, 894 bp, Artificial Sequence
  Description of Artificial Sequence: Synthetic coding sequence
atgctggccgcccccatcaaccccagcgacatcaacatgatccagggcaactacggcttcctgcctgagctgcctgctgtgggcggcaatgaaggagtggcccaggtggtggccgtgggcagcaatgtgacaggcctgaagccaggggactgggtgatcccagccaatgccggcctgggcacctggaggacagaggccgtgttttctgaggaggccctgatccaggtgcccagcgacatccccctgcagagcgctgccaccctgggcgtgaacccctgcacagcctacaggatgctgatggactttgagcagctgcagcccggggacagcgtcatccagaatgccagcaacagcggcgtgggccaggccgtcatccagattgctgctgccctgggcctgcggaccatcaacgtggtgcgggacagaccagacatccagaagctgagtgaccggctgaagagcctgggcgctgagcacgtgatcacagaggaggagctgcggcggcctgagatgaagaacttcttcaaggacatgccccagccccggctggccctgaactgtgtgggcggcaagagcagcacagagctgctgcggcagctggcccggggcggcaccatggtgacctatggaggcatggccaagcagcctgtggtggcctctgtgtccctgctgatcttcaaggacctgaagctgcggggcttctggctgagccagtggaagaaggaccacagcccagaccagttcaaggagctgatcctgaccctgtgtgacctgatccggcggggccagctgacagccccagcctgcagccaggtgcccctgcaggactaccagagcgccctggaggcctccatgaagcccttcatcagcagcaagcagatcctgaccatgtag

SEQ ID NO: 160088 - DNA, 789 bp, Artificial Sequence
  Description of Artificial Sequence: Synthetic coding sequence
atgatccagggcaactacggcttcctgcctgagctgcctgctgtgggcggcaatgaaggagtggcccaggtggtggccgtgggcagcaatgtgacaggcctgaagccaggggactgggtgatcccagccaatgccggcctgggcacctggaggacagaggccgtgttttctgaggaggccctgatccaggtgcccagcgacatccccctgcagagcgctgccaccctgggcgtgaacccctgcacagcctacaggatgctgatggactttgagcagctgcagcccggggacagcgtcatccagaatgccagcaacagcggcgtgggccaggccgtcatccagattgctgctgccctgggcctgcggaccatcaacgtggtgcgggacagaccagacatccagaagctgagtgaccggctgaagagcctgggcgctgagcacgtgatcacagaggaggagctgcggcggcctgagatgaagaacttcttcaagatcaggaagctgcggctgaggaaggaggagatgctgaaccagaaccacatcgtgtacaagggcagccgggagagcgagctggcctctgtgagccccaacagcaagcccctgaacctgcctgagcccccaccccacaacatgcccaggcatgccccagccacagcctgcagccagctgtgctggtgggagaagctgcacagagctgctgctgctgtgtctgcctggaggaaccacggcaacctgtggggagatggccaggccgcccggcgcagcctgtgtgagcccgcccacttctag

SEQ ID NO: 160089 - DNA, 570 bp, Artificial Sequence
  Description of Artificial Sequence: Synthetic coding sequence
gccaccctgggcgtgaacccctgcacagcctacaggatgctgatggactttgagcagctgcagcccggggacagcgtcatccagaatgccagcaacagcggcgtgggccaggccgtcatccagattgctgctgccctgggcctgcggaccatcaacgtggtgcgggacagaccagacatccagaagctgagtgaccggctgaagagcctgggcgctgagcacgtgatcacagaggaggagctgcggcggcctgagatgaagaacttcttcaagatcaggaagctgcggctgaggaaggaggagatgctgaaccagaaccacatcgtgtacaagggcagccgggagagcgagctggcctctgtgagccccaacagcaagcccctgaacctgcctgagcccccaccccacaacatgcccaggcatgccccagccacagcctgcagccagctgtgctggtgggagaagctgcacagagctgctgctgctgtgtctgcctggagaaatcatggcaacctgtggggagatggccaggccgcccggcgcagcctgtgtgagcccgcccacttctag

SEQ ID NO: 160090 - DNA, 1200 bp, Artificial Sequence
  Description of Artificial Sequence: Synthetic coding sequence
atgcagagcctgagcctgggccagaccagcatcagcaagggcctgaactacctgaccatcatggcccctggcaacctgtggcacatgaggaacaacttcctgtttggcagccgctgctggatgacccgcttctctgctgagaacatcttcaagtctgtgtccttccggctgtttggagtgaagtgccacaacacagattctgagcccctgaagaatgaagacctgctgaagaacctgctgaccatgggcgtggacatcgacatggccaggaagaggcagcccggggtcttccacaggatgatcaccaatgagcaggacctgaagatgttcctgctgagcaagggggccagcaaggaggtgattgccagcatcatcagccgctacccccgggccatcaccaggaccccagagaacctgagcaagcgctgggacctgtggaggaagatcgtgaccagtgacctggagatcgtgaacatcctggagaggagccctgagagcttcttccgcagcaacaacaacctgaacctggagaacaacatcaagttcctgtacagcgtgggcctgaccaggaagtgcctgtgccgcctgctgaccaatgcccccaggaccttcagcaacagcctggacctgaacaagcagatggtggagttcctgcaggccgccggcctgagcctgggccacaatgaccctgctgactttgtgaggaagatcatcttcaagaaccccttcatcctgatccagagcaccaagagggtgaaggccaacatcgagttcctgcggagcaccttcaacctgaacagcgaggagctgctggtgctgatctgtggccctggagctgagatcctggacctgagcaatgactatgcccggcgctcctatgccaacatcaaggagaagctgttcagcctgggctgcacagaggaggaggtgcagaagtttgtgctgagctacccagatgtgatcttcctggccgagaagaagttcaatgacaagattgactgcctgatggaggagaacatcagcatcagccagatcatcgagaacccccgggtgctggacagcagcatcagcaccctgaagagccgcatcaaggagctggtgaatgccggctgcaacctgagcaccctgaacatcaccctgctgtcctggagcaagaagagatatgaggccaagctgaagaagctgagcagatttgcctag

SEQ ID NO: 160091 - DNA, 477 bp, Artificial Sequence
  Description of Artificial Sequence: Synthetic coding sequence
atgcagagcctgagcctgggccagaccagcatcagcaagggcctgaactacctgaccatcatggcccctggcaacctgtggcacatgaggaacaacttcctgtttggcagccgctgctggatgacccgcttctctgctgagaacatcttcaagtctgtgtccttccggctgtttggagtgaagtgccacaacacagattctgagcccctgaagaatgaagacctgctgaagaacctgctgaccatgggcgtggacatcgacatggccaggaagaggcagcccggggtcttccacaggatgatcaccaatgagcaggacctgaagatgttcctgctgagcaagggggccagcaaggaggtgattgccagcatcatcagccgctacccccgggccatcaccaggaccccagagaacctgagcaagcgctgggacctgtggaggaagatcgtgaccagtgacctggagatcgtgaactag

SEQ ID NO: 160092 - DNA, 2184 bp, Artificial Sequence
  Description of Artificial Sequence: Synthetic coding sequence
atgaaccagaagctgctgaagctggagaacctgctgcgcttccacaccatctaccggcagctgcacagcctgtgccagaggcgggccctgcggcagtggaggcatggcttcagcagcgcctaccctgtgtggacagcccagctgtgtgcctggccctggcccacagatgtgctgactggagctgccctgagccagtaccgcctgctggtgaccaagaaggaggagggcccctggaagagccagctgagcagcaccaagagcaagaaggtggtggaggtgtggattggcatgaccatcgaggagctggcccgggccatggagaagaacacagattatgtgtatgaggccctgctgaacacagacatcgacatcgacagcctggaggccgacagccacctggatgaggtgtggatcaaggaggtgatcaccaaggccggcatgaagctgaagtggagcaagctgaagcaggacaaggtgaggaagaacaaggatgctgtgagaagaccccaggccgaccctgccctgctgacccccaggagccctgtggtgaccatcatgggccacgtggaccacggcaagaccaccctgctggacaagttcaggaagacccaggtggccgctgtggagaccggcggcatcacccagcacatcggggccttcctggtgtccctgcccagcggggagaagatcaccttcctggacaccccaggccatgctgccttcagcgccatgagggcccggggggcccaggtgacagacatcgtggtgctggtggtggccgcagatgatggagtgatgaagcagacagtggagagcatccagcacgccaaggatgcccaggtgcccatcatcctggccgtgaacaagtgtgacaaggccgaggccgaccctgagaaggtgaagaaggagctgctggcctatgatgtggtgtgtgaggactatggaggagatgtgcaggccgtgcctgtgtctgccctgactggagacaacctgatggccctggccgaggccaccgtggccctggccgagatgctggagctgaaggctgaccccaacggccctgtggagggcaccgtcatcgagagcttcacagacaagggccggggcctggtgaccacagccatcatccagaggggcaccctgaggaaaggatctgtgctggtggccggcaagtgctgggccaaggtgcggctgatgtttgatgaaaatggcaagaccattgatgaggcctaccccagcatgcctgtgggcatcaccggctggagggacctgcccagcgctggggaggagatcctggaggtggagagcgagccccgggcccgggaggtggtggactggaggaaatatgagcaggagcaggagaagggccaggaggacctgaagatcatcgaggagaagaggaaggagcacaaggaggcccaccagaaggcccgggagaagtatggccacctgctgtggaagaagaggagcatcctgcgcttcctggagaggaaggagcagatccccctgaagcccaaggagaagcgggagcgggacagcaatgtgctgagcgtcatcatcaagggagatgtggatggctctgtggaggccatcctgaacatcatcgacacctatgatgccagccatgaatgtgagctggagctggtgcactttggagtgggagatgtgtctgccaatgatgtgaacctggccgagacctttgatggagtcatctacggcttcaacgtgaatgctggaaatgtcatccagcagagcgctgccaagaagggcgtgaagatcaagctgcacaagatcatctaccgcctggtggaggacctgcaggaggagctgagcagccggctgccctgtgctgtggaggagcaccctgtgggggaggccagcatcctggccaccttctctgtgacagagggcaagaagaaggtgcctgtggccggctgccgggtgcagaagggccagctggagaagcagaagaagttcaagctgaccagaaatggccacgtgatctggaagggcagcctgaccagcctgaagcaccacaaggatgacatcagcatcgtgaagacaggcatggactgtggcctgagcctggatgaggacaacatggagttccaggtgggggacagaattgtgtgctatgaggagaagcagatccaggccaagacctcctgggaccccggcttctag

SEQ ID NO: 160093 - DNA, 219 bp, Artificial Sequence
  Description of Artificial Sequence: Synthetic coding sequence
atgaaccagaagctgctgaagctggagaacctgctgcgcttccacaccatctaccggcagctgcacagcctgtgccagaggcgggccctgcggcagtggaggcatggcttcagcagcgcctaccctgtgtggacagcccagctgtgtgcctggccctggcccacagatgtgctgactggagctgccctgagccagtaccgcctgctggtgaccaagtag

SEQ ID NO: 160094 - DNA, 2184 bp, Artificial Sequence; identical to SEQ ID NO: 160092
  Description of Artificial Sequence: Synthetic coding sequence

SEQ ID NO: 160095 - DNA, 2184 bp, Artificial Sequence; identical to SEQ ID NO: 160092
  Description of Artificial Sequence: Synthetic coding sequence

SEQ ID NO: 160096 - DNA, 213 bp, Artificial Sequence
  Description of Artificial Sequence: Synthetic coding sequence
atgaaccagaagctgctgaagctggagaacctgctgcgcttccacaccatctaccggcagctgcacagcctgtgccagaggcgggccctgcggcagtggaggcatggcttcagcagcgcctaccctgtgtggacagcccagctgtgtgcctggccctggcccacagatgtgctgactggagctgccctgagccagtaccgcctgctggtgtag

SEQ ID NO: 160097 - DNA, 24 bp, Artificial Sequence
  Description of Artificial Sequence: Synthetic coding sequence
atgaaccagaagctgctgaagtag

SEQ ID NO: 160098 - DNA, 33 bp, Artificial Sequence; identical to SEQ ID NO: 89302
  Description of Artificial Sequence: Synthetic coding sequence

SEQ ID NO: 160099 - DNA, 81 bp, Artificial Sequence
  Description of Artificial Sequence: Synthetic coding sequence
atgaaccagaagctgctgaagctggagaacctgctgcgcttccacaccatctaccggcagctgcacagcctgtgccagtag

SEQ ID NO: 160100 - DNA, 216 bp, Artificial Sequence
  Description of Artificial Sequence: Synthetic coding sequence
atgaaccagaagctgctgaagctggagaacctgctgcgcttccacaccatctaccggcagctgcacagcctgtgccagaggcgggccctgcggcagtggaggcatggcttcagcagcgcctaccctgtgtggacagcccagctgtgtgcctggccctggcccacagatgtgctgactggagctgccctgagccagtaccgcctgctggtgacctag

SEQ ID NO: 160101 - DNA, 1398 bp, Artificial Sequence
  Description of Artificial Sequence: Synthetic coding sequence
atgaaccagaagctgctgaagctggagaacctgctgcgcttccacaccatctaccggcagctgcacagcctgtgccagaggcgggccctgcggcagtggaggcatggcttcagcagcgcctaccctgtgtggacagcccagctgtgtgcctggccctggcccacagatgtgctgactggagctgccctgagccagtaccgcctgctggtgaccaagaaggaggagggcccctggaagagccagctgagcagcaccaagagcaagaaggtggtggaggtgtggattggcatgaccatcgaggagctggcccgggccatggagaagaacacagattatgtgtatgaggccctgctgaacacagacatcgacatcgacagcctggaggccgacagccacctggatgaggtgtggatcaaggaggtgatcaccaaggccggcatgaagctgaagtggagcaagctgaagcaggacaaggtgaggaagaacaaggatgctgtgagaagaccccaggccgaccctgccctgctgacccccaggagccctgtggtgaccatcatgggccacgtggaccacggcaagaccaccctgctggacaagttcaggaagacccaggtggccgctgtggagaccggcggcatcacccagcacatcggggccttcctggtgtccctgcccagcggggagaagatcaccttcctggacaccccaggccatgctgccttcagcgccatgagggcccggggggcccaggtgacagacatcgtggtgctggtggtggccgcagatgatggagtgatgaagcagacagtggagagcatccagcacgccaaggatgcccaggtgcccatcatcctggccgtgaacaagtgtgacaaggccgaggccgaccctgagaaggtgaagaaggagctgctggcctatgatgtggtgtgtgaggactatggaggagatgtgcaggccgtgcctgtgtctgccctgactggagacaacctgatggccctggccgaggccaccgtggccctggccgagatgctggagctgaaggctgaccccaacggccctgtggagggcaccgtcatcgagagcttcacagacaagggccggggcctggtgaccacagccatcatccagaggggcaccctgaggaaaggatctgtgctggtggccggcaagtgctgggccaaggtgcggctgatgtttgatgaaaatggcaagaccattgatgaggcctaccccagcatgcctgtgggcatcaccggctggagggacctgcccagcgctggggaggagatcctggaggtggagagcgagccccgggcccgggaggtggtggactggaggaaatatgagcaggagcaggagaagggccaggaggacctgaagaaggagaagaactag

SEQ ID NO: 160102 - DNA, 456 bp, Artificial Sequence
  Description of Artificial Sequence: Synthetic coding sequence
atgaacagacacctgtgtgtgtggctgttccgccaccccagcctgaatggctacctgcagtgccacatccagctgcacagccaccagttccggcagatccacctggacacccggctgcaggtgttccggcagaacagaaactgcatcctgcacctgctgagcaagaactggagccgccgctactgccaccaggacaccaagatgctgtggaagcacaaggccctgcagaagtacatggagaacctgagcaaggagtaccagaccctggagcagtgcctgcagcacatccctgtgaatgaagaaaatagaagaagcctgaacagaagacatgctgagctggcccccctggccgccatctaccaggagatccaggagacagagcaggccatcgaggagctggagagcatgtgcaagaagacagagagctgcagcgtggcccaggccggcatgcagtag

SEQ ID NO: 160103 - DNA, 1338 bp, Artificial Sequence
  Description of Artificial Sequence: Synthetic coding sequence
atgaacagacacctgtgtgtgtggctgttccgccaccccagcctgaatggctacctgcagtgccacatccagctgcacagccaccagttccggcagatccacctggacacccggctgcaggtgttccggcagaacagaaactgcatcctgcacctgctgagcaagaactggagccgccgctactgccaccaggacaccaagatgctgtggaagcacaaggccctgcagaagtacatggagaacctgagcaaggagtaccagaccctggagcagtgcctgcagcacatccctgtgaatgaagaaaatagaagaagcctgaacagaagacatgctgagctggcccccctggccgccatctaccaggagatccaggagacagagcaggccatcgaggagctggagagcatgtgcaagagcctgaacaagcaggatgagaagcagctgcaggagctggccctggaggagcggcagaccatcgaccagaagatcaacatgctgtacaatgagctgttccagagcctggtgcccaaggagaagtatgacaagaatgatgtgatcctggaggtgacagctggccgcaccactggaggagacatctgccagcagttcacccgggagatctttgacatgtaccagaactacagctgctacaagcactggcagtttgagctgctgaactacaccccagctgactatggaggcctgcaccacgccgccgcccgcatctctggagatggagtgtacaagcacctgaagtatgaaggaggcatccaccgggtgcagagaattcctgaggtgggcctgagcagcaggatgcagaggatccacacaggcaccatgtctgtgattgtgctgccccagccagatgaggtggatgtgaagctggaccccaaggacctgagaattgacaccttccgggccaagggggccggcggccagcacgtgaacaagacagacagcgctgtgcggctggtgcacatccccaccggcctggtggtggagtgccagcaggagaggagccagatcaagaacaaggagatcgccttccgggtgctgcgggcccggctgtaccagcagatcatcgagaaggacaagaggcagcagcagagcgccaggaagctgcaggtgggcacccgggcccagagcgagcgcatccgcacctacaacttcacccaggacagagtgtctgaccaccgcatcgcctatgaggtgcgggacatcaaggagttcctgtgtggcggcaagggcctggaccagctgatccagaggctgctgcagagcgcagatgaggaggccatcgccgagctgctggatgagcacctgaagagcgccaagtag

SEQ ID NO: 160104 - DNA, 1338 bp, Artificial Sequence; identical to SEQ ID NO: 160103
  Description of Artificial Sequence: Synthetic coding sequence

SEQ ID NO: 160105 - DNA, 1407 bp, Artificial Sequence
  Description of Artificial Sequence: Synthetic coding sequence
atgggaaatggagaggtggtgctcttcagtgatgctgagatgaacagacacctgtgtgtgtggctgttccgccaccccagcctgaatggctacctgcagtgccacatccagctgcacagccaccagttccggcagatccacctggacacccggctgcaggtgttccggcagaacagaaactgcatcctgcacctgctgagcaagaactggagccgccgctactgccaccaggacaccaagatgctgtggaagcacaaggccctgcagaagtacatggagaacctgagcaaggagtaccagaccctggagcagtgcctgcagcacatccctgtgaatgaggagaacagaagaagcctgaacagaagacatgctgagctggcccccctggccgccatctaccaggagatccaggagacagagcaggccatcgaggagctggagagcatgtgcaagagcctgaacaagcaggatgagaagcagctgcaggagctggccctggaggagcggcagaccatcgaccagaagatcaacatgctgtacaatgaactcttccagagcctggtgcccaaggagaagtatgacaagaatgatgtgatcctggaggtgacagctggccgcaccaccggcggggacatctgccagcagttcacccgggagatctttgacatgtaccagaactacagctgctacaagcactggcagtttgagctgctgaactacaccccagctgactatggaggcctgcaccacgccgccgcccgcatctctggagatggagtgtacaagcacctgaagtatgagggcggcatccaccgggtgcagagaattcctgaggtgggcctgagcagcaggatgcagaggatccacacaggcaccatgtctgtcatcgtgctgccccagccagatgaggtggatgtgaagctggaccccaaggacctgagaattgacaccttccgggccaagggagctgggggccagcacgtgaacaagacagattctgctgtgcggctggtgcacatccccaccggcctggtggtggagtgccagcaggagaggagccagatcaagaacaaggagatcgccttccgggtgctgcgggcccggctgtaccagcagatcatcgagaaggacaagaggcagcagcagagcgccaggaagctgcaggtgggcacccgggcccagagcgagcgcatccgcacctacaacttcacccaggacagagtgtctgaccacagaattgcctatgaggtgcgggacatcaaggcccagagccacagcactggaggcagccgggaccctgcccacagcaccttcctgagcctggacagcgtgcgcagccctggcatcctgatcatgaccagctctgtgaggaacttctacgtggtgggccgggcctggatctcctag

SEQ ID NO: 160106 - DNA, 2274 bp, Artificial Sequence
  Description of Artificial Sequence: Synthetic coding sequence
atgagcctgctcttcagccgctgcaacagcatcgtgacagtgaagaagaacaagaggcacatggccgaggtgaatgccagccccctgaagcactttgtgacagccaagaagaagatcaatggcatctttgagcagctgggcgcctacatccaggagagcgccaccttcctggaggacacctacagaaatgctgagctggaccctgtgaccacagaggagcaggtgctggatgtgaagggctacctgagcaaggtgcggggcatcagcgaggtgctggcccggcggcacatgaaggtggccttcttcggccgcaccagcaatggcaagagcaccgtcatcaatgccatgctgtgggacaaggtgctgcccagcggcatcggccacaccaccaactgcttcctgcgggtggagggcacagatggccacgaggccttcctgctgacagagggcagcgaggagaagaggtctgccaagacagtgaaccagctggcccacgccctgcaccaggacaagcagctgcatgctggcagcctggtgtctgtgatgtggcccaacagcaaatgtcccctgctgaaggatgacctggtgctgatggacagccctggcattgatgtgaccacagagctggacagctggattgacaagttctgcctggatgctgatgtgtttgtgctggtggccaacagcgagagcaccctgatgcagacagagaagcacttcttccacaaggtgtctgagcggctgagccggcccaacatcttcatcctgaacaaccgctgggatgccagcgccagcgagcctgagtacatggaggaggtgcggcggcagcacatggagcgctgcaccagcttcctggtggatgagctgggcgtggtggacaggagccaggccggggaccgcatcttctttgtgtctgccaaggaggtgctgaatgcccgcatccagaaggcccagggcatgcctgagggcggcggggccctggccgagggcttccaggtgaggatgtttgagttccagaactttgaaagaagatttgaggagtgcatcagccagagcgctgtgaagaccaagtttgagcagcacacagtgcgggccaagcagattgctgaggccgtgcggctcatcatggacagcctgcacatggccgcccgggagcagcaggtgtactgtgaggagatgagggaggagcggcaggaccggctgaagttcatcgacaagcagctggagctgctggcccaggactacaagctgcgcatcaagcagatcacagaggaggtggagcggcaggtgtccacagccatggccgaggagatccggcggctgtctgtgctggtggatgactaccagatggacttccaccccagccctgtggtgctgaaggtgtacaagaatgagctgcaccgccacatcgaggagggcctgggcaggaacatgtctgaccgctgcagcacagccatcaccaacagcctgcagaccatgcagcaggacatgattgatggcctgaagcccctgctgcctgtgtctgtgcgcagccagattgacatgctggtgccccggcagtgcttcagcctgaactatgacctgaactgtgacaagctgtgtgccgacttccaggaggacatcgagttccacttcagcctgggctggaccatgctggtgaaccgcttcctgggccccaagaacagcagaagagccctgatgggctacaatgaccaggtgcagaggcccatccccctgaccccagccaaccccagcatgccacccctgccccagggcagcctgacccaggaggagttcatggtgtccatggtgacaggcctggccagcctgaccagcaggacctccatgggcatcctggtggtgggcggcgtggtgtggaaggctgtgggctggaggctcatcgccctgagctttggcctgtatggcctgctgtatgtgtatgagcggctgacctggaccaccaaggccaaggagcgggccttcaagaggcagtttgtggagcacgccagcgagaagctgcagctggtgatctcctacacaggcagcaactgcagccaccaggtgcagcaggagctgagcggcacctttgcccacctgtgccagcaggtggatgtgacccgggagaacctggagcaggagattgctgccatgaacaagaagattgaggtgctggacagcctgcagagcaaggccaagctgctgaggaacaaggccggctggctggacagcgagctgaacatgttcacccaccagtacctgcagcccagcaggtag

SEQ ID NO: 160107 - DNA, 1311 bp, Artificial Sequence
  Description of Artificial Sequence: Synthetic coding sequence
atgcacccccacctgagcaccctgagcctgcccaggagaagatccatggccttcctgagctcctggggcgccctggccgagggcttccaggtgaggatgtttgagttccagaactttgaaagaagatttgaggagtgcatcagccagagcgctgtgaagaccaagtttgagcagcacacagtgcgggccaagcagattgctgaggccgtgcggctcatcatggacagcctgcacatggccgcccgggagcagcaggtgtactgtgaggagatgagggaggagcggcaggaccggctgaagttcatcgacaagcagctggagctgctggcccaggactacaagctgcgcatcaagcagatcacagaggaggtggagcggcaggtgtccacagccatggccgaggagatccggcggctgtctgtgctggtggatgactaccagatggacttccaccccagccctgtggtgctgaaggtgtacaagaatgagctgcaccgccacatcgaggagggcctgggcaggaacatgtctgaccgctgcagcacagccatcaccaacagcctgcagaccatgcagcaggacatgattgatggcctgaagcccctgctgcctgtgtctgtgcgcagccagattgacatgctggtgccccggcagtgcttcagcctgaactatgacctgaactgtgacaagctgtgtgccgacttccaggaggacatcgagttccacttcagcctgggctggaccatgctggtgaaccgcttcctgggccccaagaacagcagaagagccctgatgggctacaatgaccaggtgcagaggcccatccccctgaccccagccaaccccagcatgccacccctgccccagggcagcctgacccaggaggagttcatggtgtccatggtgacaggcctggccagcctgaccagcaggacctccatgggcatcctggtggtgggcggcgtggtgtggaaggctgtgggctggaggctcatcgccctgagctttggcctgtatggcctgctgtatgtgtatgagcggctgacctggaccaccaaggccaaggagcgggccttcaagaggcagtttgtggagcacgccagcgagaagctgcagctggtgatctcctacacaggcagcaactgcagccaccaggtgcagcaggagctgagcggcacctttgcccacctgtgccagcaggtggatggagagaccctgtctgagaggtccatggccaagagcaccctgatgctgctgaccctgctcttcctgtgcagctttgctggggcccaggatgtgctgacccagtag

SEQ ID NO: 160108 - DNA, 297 bp, Artificial Sequence
  Description of Artificial Sequence: Synthetic coding sequence
atgagcctgctcttcagccgctgcaacagcatcgtgacagtgaagaagaacaagaggcacatggccgaggtgaatgccagccccctgaagcactttgtgacagccaagaagaagatcaatggcatctttgagcagctgggcgcctacatccaggagagcgccaccttcctggaggacacctacagaaatgctgagctggaccctgtgaccacagaggagcaggtgctggatgtgaagggctacctgagcaaggtgcggggcatcagcgaggtgctggcccggcggcacatgaagtag

SEQ ID NO: 160109 - DNA, 2274 bp, Artificial Sequence; identical to SEQ ID NO: 160106
  Description of Artificial Sequence: Synthetic coding sequence

SEQ ID NO: 160110 - DNA, 1395 bp, Artificial Sequence
  Description of Artificial Sequence: Synthetic coding sequence
atgagcctgcacttcctgtactactgcagcgagcccaccctggatgtgaagatcgccttctgccagggctttgacaagcaggtggatgtgtcctacatcgccaagcactacaacatgagcaagagcaaggtggacaaccagttctacagcgtggaggtgggggacagcaccttcaccgtgctgaagcgctaccagaacctgaagcccatcggcagcggggcccagggcatcgtgtgtgccgcctatgatgctgtgctggacagaaatgtggccatcaagaagctgagccggcccttccagaaccagacccacgccaagagggcctaccgggagctggtgctgatgaagtgtgtgaaccacaagaacatcatcagcctgctgaatgtgttcaccccccagaagaccctggaggagttccaggatgtgtacctggtgatggagctgatggatgccaacctgtgccaggtgatccagatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagctggcaccagcttcatgatgaccccctacgtggtgacccgctactaccgggcccctgaggtgatcctgggcatgggctacaaggaaaatgtggacatctggagcgtgggctgcatcatgggagagatggtgcgccacaagatcctcttccctggccgggactacatcgaccagtggaacaaggtgattgagcagctgggcaccccctgcccagagttcatgaagaagctgcagcccaccgtgagaaattatgtggagaaccggcccaagtatgccggcctgaccttccccaagctgttcccagacagcctcttccctgctgacagcgagcacaacaagctgaaggccagccaggcccgggacctgctgagcaagatgctggtgattgatcctgccaagaggatctctgtggatgatgccctgcagcacccctacatcaacgtgtggtatgaccctgctgaggtggaggcccccccaccccagatctatgacaagcagctggatgagcgggagcacaccatcgaggagtggaaggagctgatctacaaggaggtgatgaacagcgaggagaagaccaagaatggagtggtgaagggccagcccagccccagcggggctgctgtgaacagcagcgagagcctgccccccagcagctctgtgaatgacatcagctccatgagcacagaccagaccctggccagtgacacagacagcagcctggaggccagcgctggccccctgggctgctgcaggtag

SEQ ID NO: 160111 - DNA, 1269 bp, Artificial Sequence
  Description of Artificial Sequence: Synthetic coding sequence
atgagcctgcacttcctgtactactgcagcgagcccaccctggatgtgaagatcgccttctgccagggctttgacaagcaggtggatgtgtcctacatcgccaagcactacaacatgagcaagagcaaggtggacaaccagttctacagcgtggaggtgggggacagcaccttcaccgtgctgaagcgctaccagaacctgaagcccatcggcagcggggcccagggcatcgtgtgtgccgcctatgatgctgtgctggacagaaatgtggccatcaagaagctgagccggcccttccagaaccagacccacgccaagagggcctaccgggagctggtgctgatgaagtgtgtgaaccacaagaacatcatcagcctgctgaatgtgttcaccccccagaagaccctggaggagttccaggatgtgtacctggtgatggagctgatggatgccaacctgtgccaggtgatccagatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagctggcaccagcttcatgatgaccccctacgtggtgacccgctactaccgggcccctgaggtgatcctgggcatgggctacaaggaaaatgtggacatctggagcgtgggctgcatcatgggagagatggtgcgccacaagatcctcttccctggccgggactacatcgaccagtggaacaaggtgattgagcagctgggcaccccctgcccagagttcatgaagaagctgcagcccaccgtgagaaattatgtggagaaccggcccaagtatgccggcctgaccttccccaagctgttcccagacagcctcttccctgctgacagcgagcacaacaagctgaaggccagccaggcccgggacctgctgagcaagatgctggtgattgatcctgccaagaggatctctgtggatgatgccctgcagcacccctacatcaacgtgtggtatgaccctgctgaggtggaggcccccccaccccagatctatgacaagcagctggatgagcgggagcacaccatcgaggagtggaaggagctgatctacaaggaggtgatgaacagcgaggagaagaccaagaatggagtggtgaagggccagcccagccccagcgcccaggtgcagcagtag

SEQ ID NO: 160112 - DNA, 960 bp, Artificial Sequence
  Description of Artificial Sequence: Synthetic coding sequence
atggagctgatggatgccaacctgtgccaggtgatccagatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagctggcaccagcttcatgatgaccccctacgtggtgacccgctactaccgggcccctgaggtgatcctgggcatgggctacaaggaaaatgtggacatctggagcgtgggctgcatcatgggagagatggtgcgccacaagatcctcttccctggccgggactacatcgaccagtggaacaaggtgattgagcagctgggcaccccctgcccagagttcatgaagaagctgcagcccaccgtgaggaactacgtggagaaccggcccaagtatgccggcctgaccttccccaagctgttcccagacagcctcttccctgctgacagcgagcacaacaagctgaaggccagccaggcccgggacctgctgagcaagatgctggtgattgatcctgccaagaggatctctgtggatgatgccctgcagcacccctacatcaacgtgtggtatgaccctgctgaggtggaggcccccccaccccagatctatgacaagcagctggatgagcgggagcacaccatcgaggagtggaaggagctgatctacaaggaggtgatgaacagcgaggagaagaccaagaatggagtggtgaagggccagcccagccccagcggggctgctgtgaacagcagcgagagcctgccccccagcagctctgtgaatgacatcagctccatgagcacagaccagaccctggccagtgacacagacagcagcctggaggccagcgctggccccctgggctgctgcaggtag

SEQ ID NO: 160113 - DNA, 834 bp, Artificial Sequence
  Description of Artificial Sequence: Synthetic coding sequence
atggagctgatggatgccaacctgtgccaggtgatccagatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagctggcaccagcttcatgatgaccccctacgtggtgacccgctactaccgggcccctgaggtgatcctgggcatgggctacaaggaaaatgtggacatctggagcgtgggctgcatcatgggagagatggtgcgccacaagatcctcttccctggccgggactacatcgaccagtggaacaaggtgattgagcagctgggcaccccctgcccagagttcatgaagaagctgcagcccaccgtgaggaactacgtggagaaccggcccaagtatgccggcctgaccttccccaagctgttcccagacagcctcttccctgctgacagcgagcacaacaagctgaaggccagccaggcccgggacctgctgagcaagatgctggtgattgatcctgccaagaggatctctgtggatgatgccctgcagcacccctacatcaacgtgtggtatgaccctgctgaggtggaggcccccccaccccagatctatgacaagcagctggatgagcgggagcacaccatcgaggagtggaaggagctgatctacaaggaggtgatgaacagcgaggagaagaccaagaatggagtggtgaagggccagcccagccccagcgcccaggtgcagcagtag

SEQ ID NO: 160114 - DNA, 1269 bp, Artificial Sequence; identical to SEQ ID NO: 160111
  Description of Artificial Sequence: Synthetic coding sequence

SEQ ID NO: 160115 - DNA, 1281 bp, Artificial Sequence
  Description of Artificial Sequence: Synthetic coding sequence
atgagcaagagcaaggtggacaaccagttctacagcgtggaggtgggggacagcaccttcaccgtgctgaagcgctaccagaacctgaagcccatcggcagcggggcccagggcatcgtgtgtgccgcctatgatgctgtgctggacagaaatgtggccatcaagaagctgagccggcccttccagaaccagacccacgccaagagggcctaccgggagctggtgctgatgaagtgtgtgaaccacaagaacatcatcagcctgctgaatgtgttcaccccccagaagaccctggaggagttccaggatgtgtacctggtgatggagctgatggatgccaacctgtgccaggtgatccagatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagctggcaccagcttcatgatgaccccctacgtggtgacccgctactaccgggcccctgaggtgatcctgggcatgggctacaaggaaaatgtggacatctggagcgtgggctgcatcatgggagagatggtgcgccacaagatcctcttccctggccgggactacatcgaccagtggaacaaggtgattgagcagctgggcaccccctgcccagagttcatgaagaagctgcagcccaccgtgagaaattatgtggagaaccggcccaagtatgccggcctgaccttccccaagctgttcccagacagcctcttccctgctgacagcgagcacaacaagctgaaggccagccaggcccgggacctgctgagcaagatgctggtgattgatcctgccaagaggatctctgtggatgatgccctgcagcacccctacatcaacgtgtggtatgaccctgctgaggtggaggcccccccaccccagatctatgacaagcagctggatgagcgggagcacaccatcgaggagtggaaggagctgatctacaaggaggtgatgaacagcgaggagaagaccaagaatggagtggtgaagggccagcccagccccagcggggctgctgtgaacagcagcgagagcctgccccccagcagctctgtgaatgacatcagctccatgagcacagaccagaccctggccagtgacacagacagcagcctggaggccagcgctggccccctgggctgctgcaggtag

SEQ ID NO: 160116 - DNA, 1281 bp, Artificial Sequence; identical to SEQ ID NO: 160115
  Description of Artificial Sequence: Synthetic coding sequence

SEQ ID NO: 160117 - DNA, 960 bp, Artificial Sequence
  Description of Artificial Sequence: Synthetic coding sequence
atggagctgatggatgccaacctgtgccaggtgatccagatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagctggcaccagcttcatgatgaccccctacgtggtgacccgctactaccgggcccctgaggtgatcctgggcatgggctacaaggaaaatgtggacatgtggagcgtgggctgcatcatgggagagatgatcaagggagctgtgctcttccctggaacagaccacatcgaccagtggaacaaggtgattgagcagctgggcaccccctgcccagagttcatgaagaagctgcagcccaccgtgaggaactacgtggagaaccggcccaagtatgccggcctgaccttccccaagctgttcccagacagcctcttccctgctgacagcgagcacaacaagctgaaggccagccaggcccgggacctgctgagcaagatgctggtgattgatcctgccaagaggatctctgtggatgatgccctgcagcacccctacatcaacgtgtggtatgaccctgctgaggtggaggcccccccaccccagatctatgacaagcagctggatgagcgggagcacaccatcgaggagtggaaggagctgatctacaaggaggtgatgaacagcgaggagaagaccaagaatggagtggtgaagggccagcccagccccagcggggctgctgtgaacagcagcgagagcctgccccccagcagctctgtgaatgacatcagctccatgagcacagaccagaccctggccagtgacacagacagcagcctggaggccagcgctggccccctgggctgctgcaggtag

SEQ ID NO: 160118 - DNA, 102 bp, Artificial Sequence
  Description of Artificial Sequence: Synthetic coding sequence
atgagcaagagcaaggtggacaaccagttctacagcgtggaggtgggggacagcaccttcaccgtgctgaagcgctaccagaacctgaagcccatcggctag

SEQ ID NO: 160119 - DNA, 156 bp, Artificial Sequence
  Description of Artificial Sequence: Synthetic coding sequence
atgagcctgcacttcctgtactactgcagcgagcccaccctggatgtgaagatcgccttctgccagggctttgacaagcaggtggatgtgtcctacatcgccaagcactacaacatgagcaagagcaaggtggacaaccagttctacagcgtgtag

SEQ ID NO: 160120 - DNA, 276 bp, Artificial Sequence
  Description of Artificial Sequence: Synthetic coding sequence
atgagcctgcacttcctgtactactgcagcgagcccaccctggatgtgaagatcgccttctgccagggctttgacaagcaggtggatgtgtcctacatcgccaagcactacaacatgagcaagagcaaggtggacaaccagttctacagcgtggaggtgggggacagcaccttcaccgtgctgaagcgctaccagaacctgaagcccatcggcagcggggcccagggcatcgtgtgtgccgcctatgatgctgtgctggacagaaatgtggcctag

SEQ ID NO: 160121 - DNA, 225 bp, Artificial Sequence
  Description of Artificial Sequence: Synthetic coding sequence
atgagcaagagcaaggtggacaaccagttctacagcgtggaggtgggggacagcaccttcaccgtgctgaagcgctaccagaacctgaagcccatcggcagcggggcccagggcatcgtgtgtgccgcctatgatgctgtgctggacagaaatgtggccatcaagaagctgagccggcccttccagaaccagacccacgccaagagggcctaccgggagctgtag

SEQ ID NO: 160122 - DNA, 366 bp, Artificial Sequence
  Description of Artificial Sequence: Synthetic coding sequence
atgagcctgcacttcctgtactactgcagcgagcccaccctggatgtgaagatcgccttctgccagggctttgacaagcaggtggatgtgtcctacatcgccaagcactacaacatgagcaagagcaaggtggacaaccagttctacagcgtggaggtgggggacagcaccttcaccgtgctgaagcgctaccagaacctgaagcccatcggcagcggggcccagggcatcgtgtgtgccgcctatgatgctgtgctggacagaaatgtggccatcaagaagctgagccggcccttccagaaccagacccacgccaagagggcctaccgggagctggtgctgatgaagtgtgtgaaccacaagtag

SEQ ID NO: 160123 - DNA, 354 bp, Artificial Sequence
  Description of Artificial Sequence: Synthetic coding sequence
atgagcctgcacttcctgtactactgcagcgagcccaccctggatgtgaagatcgccttctgccagggctttgacaagcaggtggatgtgtcctacatcgccaagcactacaacatgagcaagagcaaggtggacaaccagttctacagcgtggaggtgggggacagcaccttcaccgtgctgaagcgctaccagaacctgaagcccatcggcagcggggcccagggcatcgtgtgtgccgcctatgatgctgtgctggacagaaatgtggccatcaagaagctgagccggcccttccagaaccagacccacgccaagagggcctaccgggagctggtgctgatgaagtgctag

SEQ ID NO: 160124 - DNA, 426 bp, Artificial Sequence
  Description of Artificial Sequence: Synthetic coding sequence
atgagcctgcacttcctgtactactgcagcgagcccaccctggatgtgaagatcgccttctgccagggctttgacaagcaggtggatgtgtcctacatcgccaagcactacaacatgagcaagagcaaggtggacaaccagttctacagcgtggaggtgggggacagcaccttcaccgtgctgaagcgctaccagaacctgaagcccatcggcagcggggcccagggcatcgtgtgtgccgcctatgatgctgtgctggacagaaatgtggccatcaagaagctgagccggcccttccagaaccagacccacgccaagagggcctaccgggagctggtgctgatgaagtgtgtgaaccacaagaacatcatcagcctgctgaatgtgttcaccccccagaagaccctggaggagttccaggactag

SEQ ID NO: 160125 - DNA, 255 bp, Artificial Sequence
  Description of Artificial Sequence: Synthetic coding sequence
atgagcaagagcaaggtggacaaccagttctacagcgtggaggtgggggacagcaccttcaccgtgctgaagcgctaccagaacctgaagcccatcggcagcggggcccagggcatcgtgtgtgccgcctatgatgctgtgctggacagaaatgtggccatcaagaagctgagccggcccttccagaaccagacccacgccaagagggcctaccgggagctggtgctgatgaagtgtgtgaaccacaagaactag

SEQ ID NO: 160126 - DNA, 159 bp, Artificial Sequence
  Description of Artificial Sequence: Synthetic coding sequence
atgagcaagagcaaggtggacaaccagttctacagcgtggaggtgggggacagcaccttcaccgtgctgaagcgctaccagaacctgaagcccatcggcagcggggcccagggcatcgtgtgtgccgcctatgatgctgtgctggacagaaatgtgtag

SEQ ID NO: 160127 - DNA, 147 bp, Artificial Sequence
  Description of Artificial Sequence: Synthetic coding sequence
atgagcctgcacttcctgtactactgcagcgagcccaccctggatgtgaagatcgccttctgccagggctttgacaagcaggtggatgtgtcctacatcgccaagcactacaacatgagcaagagcaaggtggacaaccagttctag

SEQ ID NO: 160128 - DNA, 1008 bp, Artificial Sequence
  Description of Artificial Sequence: Synthetic coding sequence
tgaaatgtggccatcaagaagctgagccggcccttccagaaccagacccacgccaagagggcctaccgggagctggtgctgatgaagtgtgtgaaccacaagaacatcatcagcctgctgaatgtgttcaccccccagaagaccctggaggagttccaggatgtgtacctggtgatggagctgatggatgccaacctgtgccaggtgatccagatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagctggcaccagcttcatgatgaccccctacgtggtgacccgctactaccgggcccctgaggtgatcctgggcatgggctacaaggaaaatgtggacatgtggagcgtgggctgcatcatgggagagatgatcaagggagctgtgctcttccctggaacagaccacatcgaccagtggaacaaggtgattgagcagctgggcaccccctgcccagagttcatgaagaagctgcagcccaccgtgaggaactacgtggagaaccggcccaagtatgccggcctgaccttccccaagctgttcccagacagcctcttccctgctgacagcgagcacaacaagctgaaggccagccaggcccgggacctgctgagcaagatgctggtgattgatcctgccaagaggatctctgtggatgatgccctgcagcacccctacatcaacgtgtggtatgaccctgctgaggtggaggcccccccaccccagatctatgacaagcagctggatgagcgggagcacaccatcgaggagtggaaggagctgatctacaaggaggtgatgaacagcgaggagaagaccaagaatggagtggtgaagggccagcccagccccagcgcccaggtgcagcagtag

SEQ ID NO: 160129 - DNA, 1764 bp, Artificial Sequence
  Description of Artificial Sequence: Synthetic coding sequence
atggccgagaagggggactgcatcgcctctgtgtatggctatgacctgggcggccgctttgtggacttccagcccctgggcttcggcgtgaatggcctggtgctgtctgctgtggacagccgggcctgcaggaaggtggccgtgaagaagatcgccctgagtgatgcccgctccatgaagcacgccctgcgggagatcaagatcatccggcggctggaccatgacaacatcgtgaaggtgtatgaggtgctgggccccaagggcacagacctgcagggcgagctgttcaagttctctgtggcctacatcgtgcaggagtacatggagacagacctggcccggctgctggagcagggcaccctggccgaggagcacgccaagctgttcatgtaccagctgctgcggggcctgaagtacatccacagcgccaacgtgctgcaccgggacctgaagccagccaacatcttcatcagcacagaggacctggtgctgaagatcggggactttggcctggcccgcatcgtggaccagcactacagccacaagggctacctgtctgagggcctggtgaccaagtggtaccgcagcccccggctgctgctgagccccaacaactacaccaaggccatcgacatgtgggccgccggctgcatcctggccgagatgctgaccggccgcatgctgtttgctggggcccacgagctggagcagatgcagctgatcctggagaccatccctgtgatccgggaggaggacaaggatgagctgctgcgggtgatgcccagctttgtgagcagcacctgggaggtgaagaggcccctgaggaagctgctgcctgaggtgaacagcgaggccatcgacttcctggagaagatcctgaccttcaaccccatggaccggctgacagctgagatgggcctgcagcacccctacatgagcccctacagctgcccagaagatgagcccaccagccagcaccccttcagaattgaagatgaaattgatgacatcgtgctgatggccgccaaccagagccagctgagcaactgggacacctgcagcagccgctaccctgtgtccctgagcagtgacctggagtggaggccagaccgctgccaggatgccagcgaggtgcagagggacccccgggccggcagcgcccccctggctgaagatgtgcaggtggaccccaggaaggacagccacagcagcagcgagcgcttcctggagcagagccacagctccatggagcgggcctttgaggccgactatggccgcagctgtgactacaaggtgggcagccccagctacctggacaagctgctgtggagggacaacaagccccaccactacagcgagcccaagctgatcctggacctgagccactggaagcaggccgccggggccccacccacagccaccggcctggccgacacaggagccagagaagatgagcccgccagcctcttcctggagatcgcccagtgggtgaagagcacccagggcggccctgagcacgccagccccccagcagatgatcctgagcggcggctgagcgccagccccccaggccggcctgcccctgtggatggaggagccagcccccagtttgacctggatgtgttcatcagccgggccctgaagctgtgcaccaagccagaggacctgcctgacaacaagctgggggacctgaatggagcctgcatccctgagcaccctggggacctggtgcagacagaggccttcagcaaggagcgctggtag

SEQ ID NO: 160130 - DNA, 1131 bp, Artificial Sequence
  Description of Artificial Sequence: Synthetic coding sequence
atgtgggccgccggctgcatcctggccgagatgctgactggaaggatgctgtttgctggggcccacgagctggagcagatgcagctgatcctggagaccatccctgtgatccgggaggaggacaaggatgagctgctgcgggtgatgcccagctttgtgagcagcacctgggaggtgaagaggcccctgaggaagctgctgcctgaggtgaacagcgaggccatcgacttcctggagaagatcctgaccttcaaccccatggaccggctgacagctgagatgggcctgcagcacccctacatgagcccctacagctgcccagaagatgagcccaccagccagcaccccttcagaattgaagatgaaattgatgacatcgtgctgatggccgccaaccagagccagctgagcaactgggacacctgcagcagccgctaccctgtgtccctgagcagtgacctggagtggaggccagaccgctgccaggatgccagcgaggtgcagagggaccccagggctggcagcgcccccctggccgaggatgtgcaggtggaccccaggaaggacagccacagcagcagcgagcgcttcctggagcagagccacagctccatggagcgggcctttgaagctgactatggccgcagctgtgactacaaggtgggcagccccagctacctggacaagctgctgtggagggacaacaagccccaccactacagcgagcccaagctgatcctggacctgagccactggaagcaggccgccggggccccacccacagccaccggcctggccgacaccggggcccgggaggatgagcccgccagcctcttcctggagatcgcccagtgggtgaagagcacccagggcggccctgagcacgccagccccccagcagatgatcctgagcggcggctgagcgccagccccccaggccgcccagcccctgtggatggaggagccagcccccagtttgacctggatgtgttcatcagccgggccctgaagctgtgcaccaagccagaggacctgcctgacaacaagctgggggacctgaatggagcctgcatccctgagcaccctggggacctggtgcagacagaggccttcagcaaggagcgctggtag

SEQ ID NO: 160131 - DNA, 2034 bp, Artificial Sequence
  Description of Artificial Sequence: Synthetic coding sequence
atggagagtgacctgcaccagatcatccacagcagccagcccctgaccctggagcacgtgcgctacttcctgtaccagctgctgcggggcctgaagtacatgcacagcgcccaggtgatccaccgggacctgaagcccagcaacctgctggtgaatgaaaactgtgagctgaagattggagactttggcatggcccggggcctgtgcaccagccctgctgagcaccagtacttcatgacagaatatgtggccacccgctggtaccgggcccctgagctgatgctgagcctgcacgagtacacccaggccatcgacctgtggagcgtgggctgcatctttggagagatgctggcccggcggcagctgtttcctgggaagaactacgtgcaccagctgcagctgatcatgatggtgctgggcacccccagccctgctgtgatccaggccgtgggcgctgagcgggtgcgggcctacatccagagcctgcccccccggcagcctgtgccctgggagaccgtgtacccaggagctgaccggcaggccctgagcctgctgggccgcatgctgcgctttgagcccagcgcccgcatctctgctgctgctgccctgcggcaccccttcctggccaagtaccatgaccctgatgatgagccagactgtgcccccccatttgattttgcctttgaccgggaggccctgacccgggagcgcatcaaggaggccatcgtggccgagattgaggacttccacgcccggcgggagggcatccggcagcagatccgcttccagcccagcctgcagcctgtggccagcgagcccggctgcccagatgtggagatgcccagcccctgggcccccagcggggactgtgccatggagagccccccaccagcccccccaccctgccccggccctgccccagacaccatcgacctgaccctgcagcccccacctcctgtgtctgagcccgccccacccaagaaggatggagccatcagtgacaacaccaaggccgccctgaaggccgccctgctgaagagcctgcggagccggctgagagatggccccagcgcccccctggaggcccctgagcccaggaagcctgtgacagcccaggagcggcagcgggagcgggaggagaagagaagaagacggcaggagcgggccaaggagcgggagaagaggcggcaggagcgggagaggaaggagcggggggccggggccagcggcggccccagcacagaccccctggccggcctggtgctgagtgacaatgacaggagcctgctggagcgctggaccaggatggcccggcctgctgccccagccctgacctctgtgcctgccccagccccagcccccacccccacccccacccctgtgcagcccaccagccccccacctggccctgtggcccagcccaccggcccccagccccagagcgctggcagcaccagcggccctgtgccccagcctgcctgccccccacctggccctgccccccaccccaccggccccccaggccccatccctgtgcctgccccaccccagatcgccaccagcaccagcctgctggccgcccagagcctggtgcccccacctggcctgcccggcagcagcaccccaggagtgctgccctacttccccccaggcctgcccccaccagatgctggaggagccccccagagctccatgtctgagagcccagatgtgaacctggtgacccagcagctgagcaagagccaggtggaggaccccctgccccctgtgttcagcggcacccccaagggcagcggggccggctacggcgtgggctttgacctggaggagttcctgaaccagagctttgacatgggcgtggctgatggcccccaggacggccaggccgacagcgccagcctgagcgccagcctgctggccgactggctggagggccacggcatgaacccagctgacatcgagagcctgcagcgggagatccagatggacagccccatgctgctggccgacctgcctgacctgcaggacccctag

SEQ ID NO: 160132 - DNA, 2451 bp, Artificial Sequence
  Description of Artificial Sequence: Synthetic coding sequence
atggccgagcccctgaaggaggaggatggagaagatggcagcgctgagcccccaggccctgtgaaggccgagcccgcccacacagctgcctctgtggccgccaagaacctggccctgctgaaggcccggagctttgatgtgacctttgatgtgggagatgaatatgagatcatcgagaccatcggaaatggagcctacggcgtggtgtcctctgcccggcggcggctgaccggccagcaggtggccatcaagaagatccccaatgcctttgatgtggtgaccaatgccaagaggaccctgcgggagctgaagatcctgaagcacttcaagcatgacaacatcatcgccatcaaggacatcctgcggcccaccgtgccctatggagagttcaagtctgtgtatgtggtgctggacctgatggagagtgacctgcaccagatcatccacagcagccagcccctgaccctggagcacgtgcgctacttcctgtaccagctgctgcggggcctgaagtacatgcacagcgcccaggtgatccaccgggacctgaagcccagcaacctgctggtgaatgaaaactgtgagctgaagatcggggactttggcatggcccggggcctgtgcaccagccctgctgagcaccagtacttcatgacagaatatgtggccacccgctggtaccgggcccctgagctgatgctgagcctgcacgagtacacccaggccatcgacctgtggagcgtgggctgcatctttggagagatgctggcccggcggcagctgtttcctgggaagaactacgtgcaccagctgcagctgatcatgatggtgctgggcacccccagccctgctgtgatccaggccgtgggcgctgagcgggtgcgggcctacatccagagcctgcccccccggcagcctgtgccctgggagaccgtgtacccaggagctgaccggcaggccctgagcctgctgggccgcatgctgcgctttgagcccagcgcccgcatctctgctgctgctgccctgcggcaccccttcctggccaagtaccatgaccctgatgatgagccagactgtgcccccccatttgattttgcctttgaccgggaggccctgacccgggagcgcatcaaggaggccatcgtggccgagattgaggacttccacgcccggcgggagggcatccggcagcagatccgcttccagcccagcctgcagcctgtggccagcgagcccggctgcccagatgtggagatgcccagcccctgggcccccagcggggactgtgccatggagagccccccaccagcccccccaccctgccccggccctgccccagacaccatcgacctgaccctgcagcccccacctcctgtgtctgagcccgccccacccaagaaggatggagccatcagtgacaacaccaaggccgccctgaaggccgccctgctgaagagcctgcggagccggctgagagatggccccagcgcccccctggaggcccctgagcccaggaagcctgtgacagcccaggagcggcagcgggagcgggaggagaagagaagaagacggcaggagcgggccaaggagcgggagaagaggcggcaggagcgggagaggaaggagagaggagctggggccagcggcggccccagcacagaccccctggccggcctggtgctgagtgacaatgacaggagcctgctggagcgctggaccaggatggcccggcctgctgccccagccctgacctctgtgcctgccccagccccagcccccacccccacccccacccctgtgcagcccaccagccccccacctggccctgtggcccagcccaccggcccccagccccagagcgctggcagcaccagcggccctgtgccccagcctgcctgccccccacctggccctgccccccaccccactggacctcctggccccatccctgtgcctgccccaccccagatcgccaccagcaccagcctgctggccgcccagagcctggtgcccccacctggcctgcccggcagcagcaccccaggagtgctgccctacttccccccaggcctgcccccaccagatgctgggggcgccccccagagctccatgtctgagagcccagatgtgaacctggtgacccagcagctgagcaagagccaggtggaggaccccctgccccctgtgttttctggcacccccaagggcagcggggccggctatggagtgggctttgacctggaggagttcctgaaccagagctttgacatgggcgtggctgatggcccccaggacggccaggccgacagcgccagcctgagcgccagcctgctggccgactggctggagggccacggcatgaacccagctgacatcgagagcctgcagcgggagatccagatggacagccccatgctgctggccgacctgcctgacctgcaggacccctag

SEQ ID NO: 160133 - DNA, 2451 bp, Artificial Sequence; identical to SEQ ID NO: 160132
  Description of Artificial Sequence: Synthetic coding sequence

SEQ ID NO: 160134 - DNA, 2451 bp, Artificial Sequence; identical to SEQ ID NO: 160132
  Description of Artificial Sequence: Synthetic coding sequence

SEQ ID NO: 160135 - DNA, 726 bp, Artificial Sequence
  Description of Artificial Sequence: Synthetic coding sequence
atggccgagcccctgaaggaggaggatggagaagatggcagcgctgagcccccaggccctgtgaaggccgagcccgcccacacagctgcctctgtggccgccaagaacctggccctgctgaaggcccggagctttgatgtgacctttgatgtgggagatgaatatgagatcatcgagaccatcggaaatggagcctacggcgtggtgtcctctgcccggcggcggctgaccggccagcaggtggccatcaagaagatccccaatgcctttgatgtggtgaccaatgccaagaggaccctgcgggagctgaagatcctgaagcacttcaagcatgacaacatcatcgccatcaaggacatcctgcggcccaccgtgccctatggagagttcaagtctgtgtatgtggtgctggacctgatggagagtgacctgcaccagatcatccacagcagccagcccctgaccctggagcacgtgcgctacttcctgtaccagctgctgcggggcctgaagtacatgcacagcgcccaggtgatccaccgggacctgaagcccagcaacctgctggtgaatgaaaactgtgagctgaagatcggggactttggcatggcccggggcctgtgcaccagccctgctgagcaccagtacttcatgacagaatatgtggccacccgctggtaccgggcccctgagctgatgctgagcctgcacgagtacacccagtag

SEQ ID NO: 160136 - DNA, 2136 bp, Artificial Sequence
  Description of Artificial Sequence: Synthetic coding sequence
atggccgagcgggagagcggcggcctgggcggcggggccgccagccccccagctgccagccccttcctgggcctgcacatcgccagcccccccaacttccggctgacccatgacatcagcctggaggagtttgaagatgaggacctgtctgagatcacagatgaatgtggcatcagcctgcagtgcaaggacaccctgagcctgcggccccccagggctggcctgctgtctgctgggggcggcggggccggcagccggctgcaggccgagatgctgcagatggacctgattgatgccaccggggacaccccaggagcagaagatgatgaagaagatgatgatgaggagcgggccgcccggcggcctggggccggcccccccaaggccgagagcggccaggagcccgccagccggggccagggccagagccagggccagagccagggccctggcagcggggacacctaccggcccaagaggcccaccaccctgaacctcttcccccaggtgcccaggagccaggacaccctgaacaacaacagcctgggcaagaagcacagctggcaggacagagtgagccgcagcagcagccccctgaagacaggagagcagaccccacctcatgagcacatctgcctgagtgatgagctgcccccccagagcggccctgcccccaccacagaccggggcaccagcacagacagcccctgccgccgcagcacagccacccagatggcccctcctgggggccccccagctgcccctcctgggggccggggccacagccaccgggaccgcatccactaccaggctgatgtgcggctggaggccacagaggagatctacctgacccctgtgcagaggcccccagatgctgctgagcccaccagcgccttcctgcccccaacagagagcaggatgtctgtgtccagtgaccctgaccctgctgcctaccccagcacagctggccggccccaccccagcatcagcgaggaggaggagggctttgactgcctgagcagccctgagagagctgagcccccaggcggcggctggaggggcagcctgggggagcccccacctccaccccgggccagcctgagcagtgacaccagcgccctgtcctatgacagcgtgaagtacaccctggtggtggatgagcacgcccagctggagctggtgtccctgcggccctgcttcggggactacagtgatgaaagtgacagcgccaccgtgtatgacaactgtgcctctgtgagcagcccctatgaaagtgccatcggggaggagtatgaggaggccccccggccccagcccccagcctgcctgtctgaggacagcaccccagatgagccagatgtgcacttcagcaagaagttcctgaatgtgttcatgagcggccgcagccgcagcagcagcgctgagagctttggcctcttcagctgcatcatcaatggagaggagcaggagcagacccaccgggccatcttccgctttgtgcccaggcatgaagatgagctggagctggaggtggatgaccccctgctggtggagctgcaggccgaggactactggtatgaggcctacaacatgaggactggagcccggggcgtcttccctgcctactatgccatcgaggtgaccaaggagcctgagcacatggccgccctggccaagaacagcgactgggtggaccagttccgggtgaagttcctgggctctgtgcaggtgccctaccacaagggaaatgatgtgctgtgtgccgccatgcagaagatcgccaccacccggcggctgactgtgcacttcaacccccccagcagctgtgtgctggagatctctgtgcggggcgtgaagattggagtgaaggcagatgacagccaggaggccaagggcaacaagtgcagccacttcttccagctgaagaacatctccttctgtggctaccaccccaagaacaacaagtacttcggcttcatcaccaagcaccctgctgaccacagatttgcctgccacgtgtttgtgtctgaggacagcaccaaggccctggccgagagcgtgggccgggccttccagcagttctacaagcagtttgtggagtacacctgccccacagaggacatctacctggagtag

SEQ ID NO: 160137 - DNA, 1797 bp, Artificial Sequence
  Description of Artificial Sequence: Synthetic coding sequence
atgctgcctgacttccccagccccagcacctgggcccctggcctgctgctgcccagcggccctgccctgctgagccccagcgtgctgcaggacagcctgagcctgggccgctctgagcagccccaccccatctgcagcttccaggatgacttccaggagtttgagatgattgatgacaatgaggaggaggatgatgaagatgaggaggaggaggaggaggaggaggagggagatggagagggccaggagggcggggaccccggcagcgaggccccagcccctggccccctcatccccagccccagcgtggaggagccccacaagcaccggcccaccaccctgcggctgaccaccctgggcgcccaggacagccaggaccctgaggccgctgctggccctggaggagtggagctggtggacatggagaccctgaaccccacccgggacaccatcacccccctgtgggccgcccctggccgggccgcccggcccggccgggcctgcagcgctgcctgcagcgaggaggaggatgaagaagatgatgaggaggaggaggatgctgaggacagcgctggcagccctgggggccggggcaccggccccagcgcccccagagatgccagcctggtgtatgatgctgtgaagtacaccctggtggtggatgagcacacccagctggagctggtgtccctgcggcgctgtgccggcctgggccatgattctgaagaagattctggaggagaggccagcgaggaggaggccggggccgccctgctgggcggcggccaggtgtctggggacaccagcccagacagcccagacctgaccttcagcaagaagttcctgaatgtgtttgtgaacagcaccagccgcagcagcagcacagagagctttggcctcttcagctgcctggtgaatggagaggagcgggagcagacccacagagctgtgttccgcttcatccccaggcacccagatgagctggagctggatgtggatgatcctgtgctggtggaggccgaggaggatgacttctggttccggggcttcaacatgaggactggagagcggggcgtcttccctgccttctacgcccatgctgtgcccggccctgccaaggacctgctgggcagcaagaggagcccctgctgggtggagagatttgatgtgcagttcctgggctctgtggaggtgccctgccaccagggcaatggcatcctgtgtgccgccatgcagaagatcgccacagccaggaagctgactgtgcacctgcggcccccagccagctgtgacctggagatcagcctgcggggcgtgaagctgagcctgagcggcggcggccctgagttccagcgctgcagccacttcttccagatgaagaacatctccttctgtggctgccaccccaggaacagctgtgaggccccccagggcgccgccttccagtgggagcggggcgtggacaggaagagggtgctgcagaccagaggaaatgtgcagccccacctgggcgccggccagggcgccgccctgaacagagccacagagggcagcagcacaggcagcgagaagggggagtggacccccctggtgatcatggagctgacccagagcgtgaacagctgctacttcggcttcatcaccaagcaccccctgctgagcagatttgcctgccacgtgtttgtgtcccaggagagcatgaggcctgtggcccagagcgtgggccgggccttcctggagtactaccaggagcacctggcctatgcctgccccacagaggacatctacctggagtag

SEQ ID NO: 160138 - DNA, 2472 bp, Artificial Sequence
  Description of Artificial Sequence: Synthetic coding sequence
atggctgacagagctgagatgttcagcctgagcaccttccacagcctgagccccccaggctgcaggcctccccaggacatcagcctggaggagtttgatgatgaggacctgtctgagatcacagatgactgtggcctgggcctgtcctatgacagcgaccactgtgagaaggacagcctgagcctgggccgctctgagcagccccaccccatctgcagcttccaggatgacttccaggagtttgagatgattgatgacaatgaggaggaggatgatgaagatgaggaggaggaggaggaggaggaggagggagatggagagggccaggagggcggggaccccggcagcgaggccccagcccctggccccctcatccccagccccagcgtggaggagccccacaagcaccggcccaccaccctgcggctgaccaccctgggcgcccaggacagcctgaacaacaatggaggctttgacctggtgcggcctgcctcctggcaggagacagccctgtgcagccctgcccctgaggccctgcgggagctgcccggccccctgcctgccacagacaccggccctggaggagcccagagccctgtgcggcccggctgtgactgtgagggcaacagacctgctgagcccccagcccctgggggcaccagccccagcagtgaccccggcatcgaggccgacctgcggagccgcagcagcggcggccggggcggcagaagaagcagccaggagctgagcagccctggcagtgacagtgaagatgctgggggccgcctgggccgcatgatcagcagcatcagcgagacagagctggagctgagcagtgatggcggcagcagcagcagcggccgcagcagccacctgaccaacagcattgaggaggccagcagccctgccagcgagcctgagcccccccgggagcccccccggcggcctgccttcctgcctgtgggcccagatgacaccaacagtgaatatgagagcggcagcgagagcgagccagacctgtctgaagatgctgacagcccctggctgctgagcaacctggtgtccaggatgatcagcgagggcagcagccccatccgctgccccggccagtgcctgagccctgccccccggcccccaggagagcctgtgtccccagctgggggcgccgcccaggacagccaggaccctgaggccgccgccggccctgggggcgtggagctggtggacatggagaccctgtgtgcccctcctcctccagccccagctgccccccggcccggccctgcccagcccggcccctgcctcttcctgagcaaccccacccgggacaccatcacccccctgtgggccgcccctggccgggccgcccggcccggccgggcctgcagcgctgcctgcagcgaggaggaggatgaagaagatgatgaggaggaggaggatgctgaggacagcgctggcagccctgggggccggggcaccggccccagcgcccccagagatgccagcctggtgtatgatgctgtgaagtacaccctggtggtggatgagcacacccagctggagctggtgtccctgcggcgctgtgccggcctgggccatgattctgaagaagattctggaggagaggccagcgaggaggaggccggggccgccctgctgggcggcggccaggtgtctggggacaccagcccagacagcccagacctgaccttcagcaagaagttcctgaatgtgtttgtgaacagcaccagccgcagcagcagcacagagagctttggcctcttcagctgcctggtgaatggagaggagcgggagcagacccacagagctgtgttccgcttcatccccaggcacccagatgagctggagctggatgtggatgatcctgtgctggtggaggccgaggaggatgacttctggttccggggcttcaacatgaggactggagagcggggcgtcttccctgccttctacgcccatgctgtgcccggccctgccaaggacctgctgggcagcaagaggagcccctgctgggtggagagatttgatgtgcagttcctgggctctgtggaggtgccctgccaccagggcaatggcatcctgtgtgccgccatgcagaagatcgccacagccaggaagctgactgtgcacctgcggcccccagccagctgtgacctggagatcagcctgcggggcgtgaagctgagcctgagcggcggcggccctgagttccagcgctgcagccacttcttccagatgaagaacatctccttctgtggctgccaccccaggaacagctgctacttcggcttcatcaccaagcaccccctgctgagcagatttgcctgccacgtgtttgtgtcccaggagagcatgaggcctgtggcccagagcgtgggccgggccttcctggagtactaccaggagcacctggcctatgcctgccccacagaggacatctacctggagtag

SEQ ID NO: 160139 - DNA, 1335 bp, Artificial Sequence
  Description of Artificial Sequence: Synthetic coding sequence
atggctgacagagctgagatgttcagcctgagcaccttccacagcctgagccccccaggctgcaggcctccccaggacatcagcctggaggagtttgatgatgaggacctgtctgagatcacagatgactgtggcctgggcctgtcctatgacagcgaccactgtgagaaggacagcctgagcctgggccgctctgagcagccccaccccatctgcagcttccaggatgacttccaggagtttgagatgattgatgacaatgaggaggaggaggatgaggaggatgatgaggaggaggaggatgctgaagattctgctggcagccctgggggccggggcaccggccccagcgcccccagagatgccagcctggtgtatgatgctgtgaagtacaccctggtggtggatgagcacacccagctggagctggtgtccctgcggcgctgtgccggcctgggccatgacagcgaggaggacagcggcggggaggccagcgaggaggaggccggggccgccctgctgggcggcggccaggtgtctggggacaccagcccagacagcccagacctgaccttcagcaagaagttcctgaatgtgtttgtgaacagcaccagccgcagcagcagcacagagagctttggcctcttcagctgcctggtgaatggagaggagcgggagcagacccacagagctgtgttccgcttcatccccaggcacccagatgagctggagctggatgtggatgatcctgtgctggtggaggccgaggaggatgacttctggttccggggcttcaacatgaggactggagagcggggcgtcttccctgccttctacgcccatgctgtgcccggccctgccaaggacctgctgggcagcaagaggagcccctgctgggtggagagatttgatgtgcagttcctgggctctgtggaggtgccctgccaccagggcaatggcatcctgtgtgccgccatgcagaagatcgccacagccaggaagctgactgtgcacctgcggcccccagccagctgtgacctggagatcagcctgcggggcgtgaagctgagcctgagcggcggcggccctgagttccagcgctgcagccacttcttccagatgaagaacatctccttctgtggctgccaccccaggaacagctgctacttcggcttcatcaccaagcaccccctgctgagcagatttgcctgccacgtgtttgtgtcccaggagagcatgaggcctgtggcccagagcgtgggccgggccttcctggagtactaccaggagcacctggcctatgcctgccccacagaggacatctacctggagtag

SEQ ID NO: 160140 - DNA, 1677 bp, Artificial Sequence
  Description of Artificial Sequence: Synthetic coding sequence
atgatcagcagcatcagcgagacagagctggagctgagcagtgatggcggcagcagcagcagcggccgcagcagccacctgaccaacagcattgaggaggccagcagccctgccagcgagcctgagcccccccgggagcccccaagaagacctgccttcctgcctgtgggcccagatgacaccaacagtgaatatgaaagtggcagcgagagcgagccagacctgtctgaagatgctgacagcccctggctgctgagcaacctggtgtccaggatgatcagcgagggcagcagccccatccgctgccccggccagtgcctgagccctgcccccaggcctcctggagagcctgtgtccccagctggaggagctgcccaggacagccaggaccctgaggccgctgctggccctggaggagtggagctggtggacatggagaccctgtgtgcccctcctcctccagccccagctgcccccaggcctggccctgcccagcccggcccctgcctcttcctgagcaaccccacccgggacaccatcacccccctgtgggccgcccctggccgggccgcccggcccggccgggcctgcagcgctgcctgcagcgaggaggaggatgaggaggatgatgaggaggaggaggatgctgaagattctgctggcagccctgggggccggggcaccggccccagcgcccccagagatgccagcctggtgtatgatgctgtgaagtacaccctggtggtggatgagcacacccagctggagctggtgtccctgcggcgctgtgccggcctgggccatgacagcgaggaggacagcggcggggaggccagcgaggaggaggccggggccgccctgctgggcggcggccaggtgtctggggacaccagcccagacagcccagacctgaccttcagcaagaagttcctgaatgtgtttgtgaacagcaccagccgcagcagcagcacagagagctttggcctcttcagctgcctggtgaatggagaggagcgggagcagacccacagagctgtgttccgcttcatccccaggcacccagatgagctggagctggatgtggatgatcctgtgctggtggaggccgaggaggatgacttctggttccggggcttcaacatgaggactggagagcggggcgtcttccctgccttctacgcccatgctgtgcccggccctgccaaggacctgctgggcagcaagaggagcccctgctgggtggagagatttgatgtgcagttcctgggctctgtggaggtgccctgccaccagggcaatggcatcctgtgtgccgccatgcagaagatcgccacagccaggaagctgactgtgcacctgcggcccccagccagctgtgacctggagatcagcctgcggggcgtgaagctgagcctgagcggcggcggccctgagttccagcgctgcagccacttcttccagatgaagaacatctccttctgtggctgccaccccaggaacagctgctacttcggcttcatcaccaagcaccccctgctgagcagatttgcctgccacgtgtttgtgtcccaggagagcatgaggcctgtggcccagagcgtgggccgggccttcctggagtactaccaggagcacctggcctatgcctgccccacagaggacatctacctggagtag

SEQ ID NO: 160141 - DNA, 1677 bp, Artificial Sequence; identical to SEQ ID NO: 160140
  Description of Artificial Sequence: Synthetic coding sequence

SEQ ID NO: 160142 - DNA, 1641 bp, Artificial Sequence
  Description of Artificial Sequence: Synthetic coding sequence
atggctgacagagctgagatgttcagcctgagcaccttccacagcctgagccccccaggctgcaggcctccccaggacatcagcctggaggagtttgatgatgaggacctgtctgagatcacagatgactgtggcctgggcctgtcctatgacagcgaccactgtgagaaggacagcctgagcctgggccgctctgagcagccccaccccatctgcagcttccaggatgacttccaggagtttgagatgattgatgacaatgaggaggaggatgatgaagatgaggaggaggaggaggaggaggaggagggagatggagagggccaggagggcggggaccccggcagcgaggccccagcccctggccccctcatccccagccccagcgtggaggagccccacaagcaccggcccaccaccctgcggctgaccaccctgggcgcccaggacagcctgaacaacaatggaggctttgacctggtgcggcctgcctcctggcaggagacagccctgtgcagccctgcccctgaggccctgcgggagctgcccggccccctgcctgccacagacaccggccctggaggagcccagagccctgtgcggcccggctgtgactgtgagggcaacagacctgctgagcccccagcccctgggggcaccagccccagcagtgaccccggcatcgaggccgacctgcggagccgcagcagcggcggccggggcggcagaagaagcagccaggagctgagcagccctggcagtgacagtgaagatgctgggggccgcctgggccgcatgatcagcagcatcagcgagacagagctggagctgagcagtgatggcggcagcagcagcagcggccgcagcagccacctgaccttcagcaagaagttcctgaatgtgtttgtgaacagcaccagccgcagcagcagcacagagagctttggcctcttcagctgcctggtgaatggagaggagcgggagcagacccacagagctgtgttccgcttcatccccaggcacccagatgagctggagctggatgtggatgatcctgtgctggtggaggccgaggaggatgacttctggttccggggcttcaacatgaggactggagagcggggcgtcttccctgccttctacgcccatgctgtgcccggccctgccaaggacctgctgggcagcaagaggagcccctgctgggtggagagatttgatgtgcagttcctgggctctgtggaggtgccctgccaccagggcaatggcatcctgtgtgccgccatgcagaagatcgccacagccaggaagctgactgtgcacctgcggcccccagccagctgtgacctggagatcagcctgcggggcgtgaagctgagcctgagcggcggcggccctgagttccagcgctgcagccacttcttccagatgaagaacatctccttctgtggctgccaccccaggaacagctgctacttcggcttcatcaccaagcaccccctgctgagcagatttgcctgccacgtgtttgtgtcccaggagagcatgaggcctgtggcccagagcgtgggccgggccttcctggagtactaccaggagcacctggcctatgcctgccccacagaggacatctacctggagtag

SEQ ID NO: 160143 - DNA, 1149 bp, Artificial Sequence
  Description of Artificial Sequence: Synthetic coding sequence
atgtctgacagcaaatgtgacagccagttctacagcgtgcaggtggccgacagcaccttcaccgtgctgaagcgctaccagcagctgaagcccatcggcagcggggcccagggcatcgtgtgtgccgcctttgacacagtgctgggcatcaacgtggccgtgaagaagctgagccggcccttccagaaccagacccacgccaagagggcctaccgggagctggtgctgctgaagtgtgtgaaccacaagaacatcatcagcctgctgaatgtgttcaccccccagaagaccctggaggagttccaggatgtgtacctggtgatggagctgatggatgccaacctgtgccaggtgatccacatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagcctgcaccaacttcatgatgaccccctacgtggtgacccgctactaccgggcccctgaggtgatcctgggcatgggctacaaggaaaatgtggacatctggagcgtgggctgcatcatggccgagatggtgctgcacaaggtgctcttccctggccgggactacatcgaccagtggaacaaggtgattgagcagctgggcaccccatctgctgagttcatgaagaagctgcagcccaccgtgagaaattatgtggagaaccggcccaagtacccaggcatcaagtttgaggagctgttcccagactggatcttccccagcgagagcgagcgggacaagatcaagaccagccaggcccgggacctgctgagcaagatgctggtgattgatcctgacaagaggatctctgtggatgaggccctgcggcacccctacatcaccgtgtggtatgaccctgctgaggccgaggcccccccaccccagatctatgatgcccagctggaggagcgggagcacgccatcgaggagtggaaggagctgatctacaaggaggtgatggactgggaggagaggagcaagaatggagtggtgaaggaccagcccagcgcccagatgcagcagtag

SEQ ID NO: 160144 - DNA, 1149 bp, Artificial Sequence
  Description of Artificial Sequence: Synthetic coding sequence
atgtctgacagcaaatgtgacagccagttctacagcgtgcaggtggccgacagcaccttcaccgtgctgaagcgctaccagcagctgaagcccatcggcagcggggcccagggcatcgtgtgtgccgcctttgacacagtgctgggcatcaacgtggccgtgaagaagctgagccggcccttccagaaccagacccacgccaagagggcctaccgggagctggtgctgctgaagtgtgtgaaccacaagaacatcatcagcctgctgaatgtgttcaccccccagaagaccctggaggagttccaggatgtgtacctggtgatggagctgatggatgccaacctgtgccaggtgatccacatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagcctgcaccaacttcatgatgaccccctacgtggtgacccgctactaccgggcccctgaggtgatcctgggcatgggctacaaggaaaatgtggacatctggagcgtgggctgcatcatgggagagctggtgaagggctgcgtcatcttccagggcacagaccacatcgaccagtggaacaaggtgattgagcagctgggcaccccatctgctgagttcatgaagaagctgcagcccaccgtgagaaattatgtggagaaccggcccaagtacccaggcatcaagtttgaggagctgttcccagactggatcttccccagcgagagcgagcgggacaagatcaagaccagccaggcccgggacctgctgagcaagatgctggtgattgatcctgacaagaggatctctgtggatgaggccctgcggcacccctacatcaccgtgtggtatgaccctgctgaggccgaggcccccccaccccagatctatgatgcccagctggaggagcgggagcacgccatcgaggagtggaaggagctgatctacaaggaggtgatggactgggaggagaggagcaagaatggagtggtgaaggaccagcccagcgcccagatgcagcagtag

SEQ ID NO: 160145 - DNA, 375 bp, Artificial Sequence
  Description of Artificial Sequence: Synthetic coding sequence
atgtctgacagcaaatgtgacagccagttctacagcgtgcaggtggccgacagcaccttcaccgtgctgaagcgctaccagcagctgaagcccatcggcagcggggcccagggcatcgtgtggaggcaccactgcagcgccctgcccttcatcggccgcatgaggcctgtgtctgtcatcgtgaccccctggatcaaccaggagggcatgctgtgtgagggcctgggctggcccagcctgccctggtgcctgaccagcacagtgtgcccagcccagaatgtgcgcatcgtgtccctgaccctgaatgtgtccctgctgcacggcaagacagtgtccagaagaagcatcaccggccagctgaagtgctgcatctag

SEQ ID NO: 160146 - DNA, 729 bp, Artificial Sequence
  Description of Artificial Sequence: Synthetic coding sequence
atgtctgacagcaaatgtgacagccagttctacagcgtgcaggtggccgacagcaccttcaccgtgctgaagcgctaccagcagctgaagcccatcggcagcggggcccagggcatcgtgtgtgccgcctttgacacagtgctgggcatcaacgtggccgtgaagaagctgagccggcccttccagaaccagacccacgccaagagggcctaccgggagctggtgctgctgaagtgtgtgaaccacaagaacatcatcagcctgctgaatgtgttcaccccccagaagaccctggaggagttccaggatgtgtacctggtgatggagctgatggatgccaacctgtgccaggtgatccacatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagcctgcaccaacttcatgatgaccccctacgtggtgacccgctactaccgggcccctgaggtgatcctgggcatgggctacaaggaaaatgtggacatctggagcgtgggctgcatcatgggagagctggtgaagggctgcgtcatcttccagggcacagaccgcatcctgccccgggacctgggccctgccatgctgtcctag

SEQ ID NO: 160147 - DNA, 1275 bp, Artificial Sequence
  Description of Artificial Sequence: Synthetic coding sequence
atgtctgacagcaaatgtgacagccagttctacagcgtgcaggtggccgacagcaccttcaccgtgctgaagcgctaccagcagctgaagcccatcggcagcggggcccagggcatcgtgtgtgccgcctttgacacagtgctgggcatcaacgtggccgtgaagaagctgagccggcccttccagaaccagacccacgccaagagggcctaccgggagctggtgctgctgaagtgtgtgaaccacaagaacatcatcagcctgctgaatgtgttcaccccccagaagaccctggaggagttccaggatgtgtacctggtgatggagctgatggatgccaacctgtgccaggtgatccacatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagcctgcaccaacttcatgatgaccccctacgtggtgacccgctactaccgggcccctgaggtgatcctgggcatgggctacaaggaaaatgtggacatctggagcgtgggctgcatcatgggagagctggtgaagggctgcgtcatcttccagggcacagaccacatcgaccagtggaacaaggtgattgagcagctgggcaccccatctgctgagttcatgaagaagctgcagcccaccgtgagaaattatgtggagaaccggcccaagtacccaggcatcaagtttgaggagctgttcccagactggatcttccccagcgagagcgagcgggacaagatcaagaccagccaggcccgggacctgctgagcaagatgctggtgattgatcctgacaagaggatctctgtggatgaggccctgcggcacccctacatcaccgtgtggtatgaccctgctgaggccgaggcccccccaccccagatctatgatgcccagctggaggagcgggagcacgccatcgaggagtggaaggagctgatctacaaggaggtgatggactgggaggagaggagcaagaatggagtggtgaaggaccagcccagtgatgctgctgtgagcagcaatgccacccccagccagagcagcagcatcaatgacatcagctccatgagcacagagcagaccctggccagtgacacagacagcagcctggatgccagcacaggccccctggagggctgcaggtag

SEQ ID NO: 160148 - DNA, 1275 bp, Artificial Sequence
  Description of Artificial Sequence: Synthetic coding sequence
atgtctgacagcaaatgtgacagccagttctacagcgtgcaggtggccgacagcaccttcaccgtgctgaagcgctaccagcagctgaagcccatcggcagcggggcccagggcatcgtgtgtgccgcctttgacacagtgctgggcatcaacgtggccgtgaagaagctgagccggcccttccagaaccagacccacgccaagagggcctaccgggagctggtgctgctgaagtgtgtgaaccacaagaacatcatcagcctgctgaatgtgttcaccccccagaagaccctggaggagttccaggatgtgtacctggtgatggagctgatggatgccaacctgtgccaggtgatccacatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagcctgcaccaacttcatgatgaccccctacgtggtgacccgctactaccgggcccctgaggtgatcctgggcatgggctacaaggaaaatgtggacatctggagcgtgggctgcatcatggccgagatggtgctgcacaaggtgctcttccctggccgggactacatcgaccagtggaacaaggtgattgagcagctgggcaccccatctgctgagttcatgaagaagctgcagcccaccgtgagaaattatgtggagaaccggcccaagtacccaggcatcaagtttgaggagctgttcccagactggatcttccccagcgagagcgagcgggacaagatcaagaccagccaggcccgggacctgctgagcaagatgctggtgattgatcctgacaagaggatctctgtggatgaggccctgcggcacccctacatcaccgtgtggtatgaccctgctgaggccgaggcccccccaccccagatctatgatgcccagctggaggagcgggagcacgccatcgaggagtggaaggagctgatctacaaggaggtgatggactgggaggagaggagcaagaatggagtggtgaaggaccagcccagtgatgctgctgtgagcagcaatgccacccccagccagagcagcagcatcaatgacatcagctccatgagcacagagcagaccctggccagtgacacagacagcagcctggatgccagcacaggccccctggagggctgcaggtag

SEQ ID NO: 160149 - DNA, 315 bp, Artificial Sequence
  Description of Artificial Sequence: Synthetic coding sequence
atgtctgacagcaaatgtgacagccagttctacagcgtgcaggtggccgacagcaccttcaccgtgctgaagcgctaccagcagctgaagcccatcggcagcggggcccagggcatcgtgtgtgccgcctttgacacagtgctgggcatcaacgtggccgtgaagaagctgagccggcccttccagaaccagacccacgccaagagggcctaccgggagctggtgctgctgaagtgtgtgaaccacaagaacatcatcagcctgctgaatgtgttcaccccccagaagaccctggaggagttccaggatgtgtag

SEQ ID NO: 160150 - DNA, 645 bp, Artificial Sequence
  Description of Artificial Sequence: Synthetic coding sequence
atgtctgacagcaaatgtgacagccagttctacagcgtgcaggtggccgacagcaccttcaccgtgctgaagcgctaccagcagctgaagcccatcggcagcggggcccagggcatcgtgtgtgccgcctttgacacagtgctgggcatcaacgtggccgtgaagaagctgagccggcccttccagaaccagacccacgccaagagggcctaccgggagctggtgctgctgaagtgtgtgaaccacaagaacatcatcagcctgctgaatgtgttcaccccccagaagaccctggaggagttccaggatgtgtacctggtgatggagctgatggatgccaacctgtgccaggtgatccacatggagctggaccacgagaggatgagctacctgctgtaccagatgctgtgtggcatcaagcacctgcacagcgctggcatcatccaccgggacctgaagcccagcaacatcgtggtgaagagtgactgcaccctgaagatcctggactttggcctggccaggacagcctgcaccaacttcatgatgaccccctacgtggtgacccgctactaccgggcccctgaggtgatcctgggcatgggctacaaggaaaatgccatcaagtactggaccctgtggcactag

SEQ ID NO: 160151 - DNA, 1347 bp, Artificial Sequence
  Description of Artificial Sequence: Synthetic coding sequence
atgctgtggctggccctgggccccttccctgccatggagaaccaggtgctggtgatccgcatcaagatccccaacagcggggctgtggactggacagtgcacagcggcccccagctgctcttcagagatgtgctggatgtgattggccaggtgctgcctgaggccaccaccacagcctttgaatatgaagatgaagatggagaccgcatcaccgtgcggagtgatgaggagatgaaggccatgctgagctactactacagcacagtgatggagcagcaggtgaatggccagctgattgagcccctgcagatcttcccccgggcctgcaagcccccaggagagaggaacatccacggcctgaaggtgaacacccgggccggccccagccagcacagcagccctgctgtgtctgacagcctgcccagcaacagcctgaagaagagcagcgctgagctgaagaagatcctggccaacggccagatgaatgagcaggacatccgctacagagacaccctgggccacggcaatggaggcaccgtgtacaaggcctaccacgtgcccagcggcaagatcctggccgtgaaggtgatcctgctggacatcaccctggagctgcagaagcagatcatgtctgagctggagatcctgtacaagtgtgacagcagctacatcatcggcttctacggggccttctttgtggagaaccgcatcagcatctgcacagagttcatggatggcggcagcctggatgtgtacaggaagatgcctgagcacgtgctgggcagaattgctgtggccgtggtgaagggcctgacctacctgtggagcctgaagatcctgcacagagatgtgaagcccagcaacatgctggtgaacacccggggccaggtgaagctgtgtgactttggagtgtccacccagctggtgaacagcatcgccaagacctacgtgggcaccaatgcctacatggcccctgagcgcatctctggagagcagtatggcatccacagtgatgtgtggagcctgggcatctccttcatggagctggccctgggccgcttcccctacccccagatccagaagaaccagggcagcctgatgcccctgcagctgctgcagtgcatcgtggatgaggacagccctgtgctgcctgtgggggagttcagcgagccctttgtgcacttcatcacccagtgcatgaggaagcagcccaaggagaggcctgcccctgaggagctgatgggccaccccttcatcgtgcagttcaatgatggaaatgctgctgtggtgtccatgtgggtgtgccgggccctggaggagaggaggagccagcagggccccccatag

SEQ ID NO: 160152 - DNA, 1317 bp, Artificial Sequence
  Description of Artificial Sequence: Synthetic coding sequence
atgctgtggctggccctgggccccttccctgccatggagaaccaggtgctggtgatccgcatcaagatccccaacagcggggctgtggactggacagtgcacagcggcccccagctgctcttcagagatgtgctggatgtgattggccaggtgctgcctgaggccaccaccacagcctttgaatatgaagatgaagatggagaccgcatcaccgtgcggagtgatgaggagatgaaggccatgctgagctactactacagcacagtgatggagcagcaggtgaatggccagctgattgagcccctgcagatcttcccccgggcctgcaagcccccaggagagaggaacatccacggcctgaaggtgaacacccgggccggccccagccagcacagcagccctgctgtgtctgacagcctgcccagcaacagcctgaagaagagcagcgctgagctgaagaagatcctggccaacggccagatgaatgagcaggacatccgctacagagacaccctgggccacggcaatggaggcaccgtgtacaaggcctaccacgtgcccagcggcaagatcctggccgtgaaggtgatcctgctggacatcaccctggagctgcagaagcagatcatgtctgagctggagatcctgtacaagtgtgacagcagctacatcatcggcttctacggggccttctttgtggagaaccgcatcagcatctgcacagagttcatggatggcggcagcctggatgtgtacaggaagatgcctgagcacgtgctgggcagaattgctgtggccgtggtgaagggcctgacctacctgtggagcctgaagatcctgcacagagatgtgaagcccagcaacatgctggtgaacacccggggccaggtgaagctgtgtgactttggagtgtccacccagctggtgaacagcatcgccaagacctacgtgggcaccaatgcctacatggcccctgagcgcatctctggagagcagtatggcatccacagtgatgtgtggagcctgggcatctccttcatggagatccagaagaaccagggcagcctgatgcccctgcagctgctgcagtgcatcgtggatgaggacagccctgtgctgcctgtgggggagttcagcgagccctttgtgcacttcatcacccagtgcatgaggaagcagcccaaggagaggcctgcccctgaggagctgatgggccaccccttcatcgtgcagttcaatgatggaaatgctgctgtggtgtccatgtgggtgtgccgggccctggaggagaggaggagccagcagggccccccatag

SEQ ID NO: 160153 - DNA, 1335 bp, Artificial Sequence
  Description of Artificial Sequence: Synthetic coding sequence
atgctgtggctggccctgggccccttccctgccatggagaaccaggtgctggtgatccgcatcaagatccccaacagcggggctgtggactggacagtgcacagcggcccccagctgctcttcagagatgtgctggatgtgattggccaggtgctgcctgaggccaccaccacagcctttgaatatgaagatgaagatggagaccgcatcaccgtgcggagtgatgaggagatgaaggccatgctgagctactactacagcacagtgatggagcagcaggtgaatggccagctgattgagcccctgcagatcttcccccgggcctgcaagcccccaggagagaggaacatccacggcctgaaggtgaacacccgggccggccccagccagcacagcagccctgctgtgtctgacagcctgcccagcaacagcctgaagaagagcagcgctgagctgaagaagatcctggccaacggccagatgaatgagcaggacatccgctacagagacaccctgggccacggcaatggaggcaccgtgtacaaggcctaccacgtgcccagcggcaagatcctggccgtgaaggtgatcctgctggacatcaccctggagctgcagaagcagatcatgtctgagctggagatcctgtacaagtgtgacagcagctacatcatcggcttctacggggccttctttgtggagaaccgcatcagcatctgcacagagttcatggatggcggcagcctggatgtgtacaggaagatgcctgagcacgtgctgggcagaattgctgtggccgtggtgaagggcctgacctacctgtggagcctgaagatcctgcacagagatgtgaagcccagcaacatgctggtgaacacccggggccaggtgaagctgtgtgactttggagtgtccacccagctggtgaacagcatcgccaagacctacgtgggcaccaatgcctacatggcccctgagcgcatctctggagagcagtatggcatccacagtgatgtgtggagcctgggcatctccttcatggagatccagaagaaccagggcagcctgatgcccctgcagctgctgcagtgcatcgtggatgaggacagccctgtgctgcctgtgggggagttcagcgagccctttgtgcacttcatcacccagtgcatgaggaagcagcccaaggagaggcctgcccctgaggagctgatgggccaccccttcatcgtgcagttcaatgatggaaatgctgctgtggtgtccatgtgggtgtgccgggccctggaggagaggaggagccctgccagcctgcccagccccagcagcagcatctag

SEQ ID NO: 160154 - DNA, 1239 bp, Artificial Sequence
  Description of Artificial Sequence: Synthetic coding sequence
atgatggagggccacttcccccagagtgatgtgattggccaggtgctgcctgaggccaccaccacagcctttgaatatgaagatgaagatggagaccgcatcaccgtgcggagtgatgaggagatgaaggccatgctgagctactactacagcacagtgatggagcagcaggtgaatggccagctgattgagcccctgcagatcttcccccgggcctgcaagcccccaggagagaggaacatccacggcctgaaggtgaacacccgggccggccccagccagcacagcagccctgctgtgtctgacagcctgcccagcaacagcctgaagaagagcagcgctgagctgaagaagatcctggccaacggccagatgaatgagcaggacatccgctacagagacaccctgggccacggcaatggaggcaccgtgtacaaggcctaccacgtgcccagcggcaagatcctggccgtgaaggtgatcctgctggacatcaccctggagctgcagaagcagatcatgtctgagctggagatcctgtacaagtgtgacagcagctacatcatcggcttctacggggccttctttgtggagaaccgcatcagcatctgcacagagttcatggatggcggcagcctggatgtgtacaggaagatgcctgagcacgtgctgggcagaattgctgtggccgtggtgaagggcctgacctacctgtggagcctgaagatcctgcacagagatgtgaagcccagcaacatgctggtgaacacccggggccaggtgaagctgtgtgactttggagtgtccacccagctggtgaacagcatcgccaagacctacgtgggcaccaatgcctacatggcccctgagcgcatctctggagagcagtatggcatccacagtgatgtgtggagcctgggcatctccttcatggagctggccctgggccgcttcccctacccccagatccagaagaaccagggcagcctgatgcccctgcagctgctgcagtgcatcgtggatgaggacagccctgtgctgcctgtgggggagttcagcgagccctttgtgcacttcatcacccagtgcatgaggaagcagcccaaggagaggcctgcccctgaggagctgatgggccaccccttcatcgtgcagttcaatgatggaaatgctgctgtggtgtccatgtgggtgtgccgggccctggaggagaggaggagccagcagggccccccatag

SEQ ID NO: 160155 - DNA, 1005 bp, Artificial Sequence
  Description of Artificial Sequence: Synthetic coding sequence
atgagccagagcaagggcaagaagagaaatcctggcctgaagatccccaaggaggcctttgagcagccccagaccagcagcaccccaccccgggacctggacagcaaggcctgcatcagcatcggcaaccagaactttgaggtgaaggcagatgacctggagcccatcatggagctgggccgcggggcctacggcgtggtggagaagatgagacatgtgcccagcggccagatcatggctgtgaagaggatccgggccaccgtgaacagccaggagcagaagaggctgctgatggacctggacatctccatgaggacagtggactgccccttcaccgtgaccttctacggggccctcttccgggagggagatgtgtggatctgcatggagctgatggacaccagcctggacaagttctacaagcaggtgattgacaagggccagaccatccctgaggacatcctgggcaagattgctgtgtccatcgtgaaggccctggagcacctgcacagcaagctgagcgtcatccacagagatgtgaagcccagcaatgtgctgatcaatgccctgggccaggtgaagatgtgtgactttggcatcagcggctacctggtggacagcgtggccaagaccattgatgctggctgcaagccctacatggcccctgagcgcatcaaccctgagctgaaccagaagggctacagcgtgaagagtgacatctggagcctgggcatcaccatgattgagctggccatcctgcgcttcccctatgacagctggggcacccccttccagcagctgaagcaggtggtggaggagcccagcccccagctgcctgctgacaagttctctgctgagtttgtggacttcaccagccagtgcctgaagaagaacagcaaggagcggcccacctacccagagctgatgcagcaccccttcttcaccctgcacgagagcaagggcacagatgtggccagctttgtgaagctgatcctgggggactag

SEQ ID NO: 160156 - DNA, 1005 bp, Artificial Sequence; identical to SEQ ID NO: 160155
  Description of Artificial Sequence: Synthetic coding sequence

SEQ ID NO: 160157 - DNA, 2865 bp, Artificial Sequence
  Description of Artificial Sequence: Synthetic coding sequence
atggaggaggaggagggcgctgtggccaaggagtggggcaccaccccagctggccctgtgtggacagctgtgtttgattatgaagctgctggagatgaggagctgaccctgcggcggggggacagagtgcaggtgctgagccaggactgtgctgtgtctggagatgagggctggtggacaggccagctgcccagcggccgggtgggcgtcttccccagcaactacgtggcccctggggccccagctgccccagctggcctgcagctgccccaggagatccccttccacgagctgcagctggaggagatcatcggcgtgggcggctttgggaaggtgtaccgggccctgtggagaggagaggaggtggccgtgaaggccgcccggctggaccctgagaaggaccctgctgtgacagctgagcaggtgtgccaggaggcccggctgtttggagccctgcagcaccccaacatcatcgccctgcggggggcctgcctgaaccccccccacctgtgcctggtgatggagtatgcccggggcggggccctgagccgggtgctggccggcagaagagtgcccccccacgtgctggtgaactgggccgtgcaggtggcccggggcatgaactacctgcacaatgatgcccctgtgcccatcatccaccgggacctgaagagcatcaacatcctgatcctggaggccatcgagaaccacaacctggccgacacagtgctgaagatcacagactttggcctggcccgggagtggcacaagaccaccaagatgtctgctgctggcacctacgcctggatggcccctgaggtgatccggctgagcctcttcagcaagagcagtgatgtgtggagctttggagtgctgctgtgggagctgctgaccggggaggtgccctaccgggagattgatgccctggccgtggcctatggagtggccatgaacaagctgaccctgcccatccccagcacctgcccagagccctttgcccggctgctggaggagtgctgggaccctgacccccacggccgcccagactttggcagcatcctgaagaggctggaggtgattgagcagagcgccctcttccagatgcccctggagagcttccacagcctgcaggaggactggaagctggagatccagcacatgtttgatgacctgcggaccaaggagaaggagctgcggagccgggaggaggagctgctgcgggccgcccaggagcagcgcttccaggaggagcagctgcggcggcgggagcaggagctggccgagcgggagatggacatcgtggagcgggagctgcacctgctgatgtgccagctgagccaggagaagccccgggtgaggaagaggaagggcaacttcaagaggagccggctgctgaagctgcgggagggcggcagccacatcagcctgcccagcggctttgagcacaagatcaccgtgcaggccagccccaccctggacaagaggaagggcagtgatggagccagccccccagccagccccagcatcatcccccggctgcgggccatccggctgacccctgtggactgtggcggcagcagcagcggcagcagcagcggcggcagcggcacctggagcagaggaggcccccccaagaaggaggagctggtgggcggcaagaagaagggccgcacctggggccccagcagcaccctgcagaaggagcgggtgggcggggaggagcggctgaagggcctgggggagggcagcaagcagtggagcagcagcgcccccaacctgggcaagagccccaagcacacccccatcgcccctggctttgccagcctgaatgagatggaggagtttgctgaggctgaagatggcggcagctctgtgccccccagcccctacagcacccccagctacctgtctgtgcccctgcctgctgagcccagccctggggcccgggccccctgggagcccaccccatctgcccccccagcccgctggggccatggagccaggagaagatgtgacctggccctgctgggctgtgccaccctgctgggcgctgtgggcctgggcgcagatgtggccgaggcccgggctgctgatggagaggagcagaggcgctggctggatggcctcttcttcccccgggccggccgcttcccccggggcctgagccccccagcccggccccacggccggcgggaggatgtgggccctggcctgggcctggcccccagcgccaccctggtgtccctgagctctgtgtctgactgcaacagcaccaggagcctgctgcggagtgacagtgatgaagctgccccagctgcccccagccccccacccagccccccagcccccacccccacccccagccccagcaccaaccccctggtggacctggagctggagagcttcaagaaggacccccggcagagcctgacccccacccacgtgacagctgcctgtgctgtgtcccggggccacaggaggacccccagtgatggagccctgggccagaggggccccccagagcctgctggccacggccctggcccccgggacctgctggacttcccccggctgcctgacccccaggccctcttccctgccaggagaagacctcctgagttccctggccggcccaccaccctgacctttgccccccggcccaggcctgctgccagccggccccggctggacccctggaagctggtgtcctttggccgcaccctgaccatcagcccccccagcaggccagacaccccagagagccctggcccccccagcgtgcagcccaccctgctggacatggacatggagggccagaaccaggacagcacagtgcccctgtgtggggcccacggcagccactag

SEQ ID NO: 160158 - DNA, 2544 bp, Artificial Sequence
  Description of Artificial Sequence: Synthetic coding sequence
atggagcccctgaagagcctcttcctgaagagccccctgggctcctggaatggaagtggcagcggcggcggcggcggcggcggcggcggccggcctgagggcagccccaaggctgctggctacgccaaccctgtgtggacagccctgtttgattatgagcccagcggccaggatgagctggccctgaggaagggggacagagtggaggtgctgagcagagatgctgccatctctggagatgagggctggtgggccggccaggtgggcggccaggtgggcatcttccccagcaactacgtgtccagaggaggcggccccccaccctgtgaggtggccagcttccaggagctgcggctggaggaggtgattggaattggaggctttgggaaggtgtaccggggctcctggagaggagagctggtggccgtgaaggccgcccggcaggaccctgatgaggacatctctgtgacagctgagagcgtgcggcaggaggcccggctgtttgccatgctggcccaccccaacatcatcgccctgaaggctgtgtgcctggaggagcccaacctgtgcctggtgatggagtatgctgctgggggccccctgagccgggccctggccggccggcgggtgccccctcatgtgctggtgaactgggccgtgcagatcgcccggggcatgcactacctgcactgtgaggccctggtgcctgtgatccaccgggacctgaagagcaacaacatcctgctgctgcagcccattgaaagtgatgacatggagcacaagaccctgaagatcacagactttggcctggcccgggagtggcacaagaccacccagatgtctgctgctggcacctacgcctggatggcccctgaggtgatcaaggccagcaccttcagcaaaggaagtgatgtgtggagctttggagtgctgctgtgggagctgctgactggagaggtgccctaccggggcatcgactgcctggccgtggcctacggcgtggccgtgaacaagctgaccctgcccatccccagcacctgcccagagccctttgcccagctgatggctgactgctgggcccaggacccccacagaagaccagactttgccagcatcctgcagcagctggaggccctggaggcccaggtgctgcgggagatgccccgggacagcttccacagcatgcaggagggctggaagcgggagatccagggcctgtttgatgagctgcgggccaaggagaaggagctgctgagccgggaggaggagctgaccagggctgcccgggagcagaggagccaggccgagcagctgcggcggcgggagcacctgctggcccagtgggagctggaggtgtttgagcgggagctgaccctgctgctgcagcaggtggaccgggagcggccccacgtgagaagaagaagaggcaccttcaagaggagcaagctgcgggccagagatggaggagagcgcatctccatgcccctggacttcaagcaccgcatcaccgtgcaggccagccctggcctggacagaagaagaaatgtgtttgaggtgggccctggggacagccccaccttcccccgcttccgggccatccagctggagcctgctgagcccggccaggcctggggccggcagagcccccggcggctggaggacagcagcaatggagagcggcgggcctgctgggcctggggccccagcagccccaagccaggagaggcccagaatggaagaagaagaagcaggatggatgaggccacctggtacctggacagtgatgacagcagccccctgggcagccccagcaccccaccagccctgaatggaaatccaccccggcccagcctggagcctgaggagcccaagaggcctgtgcctgctgagcggggcagcagcagcggcacccccaagctgatccagagggccctgctgcggggcacagccctgctggccagcctgggcctgggccgggacctgcagcccccaggcggccctggccgggagcggggggagagccccaccaccccacccacccccaccccagccccctgccccacagagcccccacccagccccctcatctgcttcagcctgaagaccccagacagcccccccaccccagcccccctgctgctggacctgggcatccctgtgggccagaggtctgccaagagcccccggcgggaggaggagccccggggcggcaccgtgtccccacctcctggcaccagccgcagcgcccctggcaccccaggcacccccaggagcccccccctgggcctcatcagccggccccggcccagccccctgcggagcagaattgacccctggagctttgtgtctgctggcccccggcccagccccctgcccagcccccagcctgccccccggcgggccccctggaccctcttcccagacagcgaccccttctgggacagccccccagccaaccccttccagggcggcccccaggactgccgggcccagaccaaggacatgggcgcccaggccccctgggtgcctgaggccggcccctag

SEQ ID NO: 160159 - DNA, 1773 bp, Artificial Sequence
  Description of Artificial Sequence: Synthetic coding sequence
atggagcacaagaccctgaagatcacagactttggcctggcccgggagtggcacaagaccacccagatgtctgctgctggcacctacgcctggatggcccctgaggtgatcaaggccagcaccttcagcaagggcagtgatgtgtggagctttggagtgctgctgtgggagctgctgaccggggaggtgccctaccggggcatcgactgcctggccgtggcctatggagtggccgtgaacaagctgaccctgcccatccccagcacctgcccagagccctttgcccagctgatggctgactgctgggcccaggacccccaccggcggccagactttgccagcatcctgcagcagctggaggccctggaggcccaggtgctgcgggagatgccccgggacagcttccacagcatgcaggagggctggaagcgggagatccagggcctgtttgatgagctgcgggccaaggagaaggagctgctgagccgggaggaggagctgacccgggccgcccgggagcagaggagccaggccgagcagctgcggcggcgggagcacctgctggcccagtgggagctggaggtgtttgagcgggagctgaccctgctgctgcagcaggtggaccgggagcggccccacgtgagaagaagaagaggcaccttcaagaggagcaagctgcgggccagagatggaggagagcgcatctccatgcccctggacttcaagcaccgcatcaccgtgcaggccagccctggcctggacagaagaagaaatgtgtttgaggtgggccctggggacagccccaccttcccccgcttccgggccatccagctggagcctgctgagcccggccaggcctggggccggcagagcccccggcggctggaggacagcagcaatggagagcggcgggcctgctgggcctggggccccagcagccccaagccaggagaggcccagaatggaagaagaagaagcaggatggatgaggccacctggtacctggacagtgatgacagcagccccctgggcagccccagcaccccaccagccctgaatggaaaccccccccggcccagcctggagcctgaggagcccaagaggcctgtgcctgctgagcggggcagcagcagcggcacccccaagctgatccagagggccctgctgcggggcacagccctgctggccagcctgggcctgggccgggacctgcagcccccaggcggccctggccgggagcggggggagagccccaccaccccacccacccccaccccagccccctgccccacagagcccccacccagccccctcatctgcttcagcctgaagaccccagacagcccccccaccccagcccccctgctgctggacctgggcatccctgtgggccagaggtctgccaagagcccccggcgggaggaggagccccggggcggcaccgtgagccccccacctggcaccagccgcagcgcccctggcaccccaggcacccccaggagcccccccctgggcctcatcagccggccccggcccagccccctgcggagcagaattgacccctggagctttgtgtctgctggcccccggcccagccccctgcccagcccccagcctgccccccggcgggccccctggaccctcttcccagacagcgaccccttctgggacagccccccagccaaccccttccagggcggcccccaggactgccgggcccagaccaaggacatgggcgcccaggccccctgggtgcctgaggccggcccctag

SEQ ID NO: 160160 - DNA, 2580 bp, Artificial Sequence
  Description of Artificial Sequence: Synthetic coding sequence
atggcctgcctgcacgagaccaggacccccagccccagctttggaggctttgtgtccaccctgtctgaggcctccatgaggaagctggaccctgacaccagtgactgcaccccagagaaggacctgacccccacccacgtgctgcagctgcacgagcaggatgctgggggccctgggggcgccgccggcagccctgagagccgggccagccgggtgcgggcagatgaggtgcggctgcagtgccagagcggcagcggcttcctggagggcctgtttggctgcctgcggcctgtgtggaccatgattggcaaggcctacagcacagagcacaagcagcagcaggaggacctgtgggaggtgccctttgaggagatcctggacctgcagtgggtgggcagcggggcccagggcgctgtgttcctgggccgcttccatggagaggaggtggccgtgaagaaggtgcgggacctgaaggagacagacatcaagcacctgaggaagctgaagcaccccaacatcatcaccttcaagggcgtgtgcacccaggccccctgctactgcatcctgatggagttctgtgcccagggccagctgtatgaggtgctgcgggccggccggcctgtgacccccagcctgctggtggactggagcatgggcattgctgggggcatgaactacctgcacctgcacaagatcatccaccgggacctgaagagccccaacatgctgatcacctatgatgatgtggtgaagatcagtgactttggcaccagcaaggagctgagtgacaagagcaccaagatgagctttgctggcaccgtggcctggatggcccctgaggtgatcagaaatgaacctgtgtctgagaaggtggacatctggagctttggagtggtgctgtgggagctgctgactggagagatcccctacaaggatgtggacagcagcgccatcatctggggcgtgggcagcaacagcctgcacctgcctgtgcccagcagctgcccagatggcttcaagatcctgctgcggcagtgctggaacagcaagcccaggaaccggcccagcttccggcagatcctgctgcacctggacatcgccagcgcagatgtgctgagcaccccccaggagacctacttcaagagccaggccgagtggagggaggaggtgaagctgcactttgagaagatcaagtctgagggcacctgcctgcaccggctggaggaggagctggtgatgagaagaagagaggagctgcggcatgccctggacatccgggagcactatgaaaggaagctggagcgggccaacaacctgtacatggagctgaatgccctgatgctgcagctggagctgaaggagcgggagctgctgcggcgggagcaggccctggagcggcgctgccccggcctgctgaagccccaccccagccggggcctgctgcacggcaacaccatggagaagctgatcaagaagagaaatgtgccccagaagctgagcccccacagcaagaggccagacatcctgaagacagagagcctgctgcccaagctggatgctgccctgtctggagtgggcctgcccggctgccccaagggcccccccagccctggccgcagcagaagaggcaagaccaggcacaggaaggccagcgccaagggcagctgtggggacctgcccggcctgaggacagctgtgccccctcatgagcccggcggccctggcagccctgggggcctgggcggcggccccagcgcctgggaggcctgccccccagccctgcggggcctgcaccacgacctgctgctgaggaagatgagcagcagcagcccagacctgctgtctgctgccctgggcagccggggccgcggggccaccggcggggccggggaccccggcagccccccaccagcccggggggacaccccaccttctgagggcagcgcccctggcagcaccagcccagacagccctgggggcgccaagggggagcccccacctcctgtgggccctggagagggcgtgggcctgctgggcaccggccgggagggcaccagcggccggggcggcagcagagctggcagccagcacctgaccccagctgccctgctgtacagagctgctgtgaccaggagccagaagaggggcatcagcagcgaggaggaggagggggaggtggacagcgaggtggagctgaccagcagccagcgctggccccagagcctgaacatgaggcagagcctgagcaccttcagcagcgagaaccccagtgatggagaggagggcacagccagcgagcccagccccagcggcaccccagaggtgggcagcaccaacacagatgagaggccagatgagaggagtgatgacatgtgcagccagggcagcgagatccccctggaccccccaccttctgaggtgattcctggccctgagcccagcagcctgcccatcccccaccaggagctgctgcgggagcggggcccccccaacagtgaagattctgactgtgacagcacagagctggacaacagcaacagcgtggatgccctgcggcccccagccagcctgcccccatag

SEQ ID NO: 160161 - DNA, 2901 bp, Artificial Sequence
  Description of Artificial Sequence: Synthetic coding sequence
atggccaacttccaggagcacctgagctgcagcagcagcccccacctgcccttcagcgagagcaagaccttcaacggcctgcaggatgagctgacagccatgggcaaccaccccagccccaagctgctggaggaccagcaggagaagggcatggtgaggacagagctgattgaatctgtgcacagccctgtgaccaccaccgtgctgacctctgtgtctgaggacagccgggaccagtttgaaaattctgtgctgcagctgcgggagcatgatgaaagtgaaacagctgtgtcccagggcaacagcaacacagtggatggagagagcaccagcggcacagaggacatcaagatccagttcagccgcagcggcagcggcagcggcggcttcctggagggcctgtttggctgcctgcggcctgtgtggaacatcatcggcaaggcctacagcacagactacaagctgcagcagcaggacacctgggaggtgccctttgaggagatcagcgagctgcagtggctgggcagcggggcccagggcgctgtgttcctgggcaagttccgggcagaggaggtggccatcaagaaggtgcgggagcagaatgaaacagacatcaagcacctgaggaagctgaagcaccccaacatcatcgccttcaagggcgtgtgcacccaggccccctgctactgcatcatcatggagtactgtgcccacggccagctgtatgaggtgctgcgggccggcaggaagatcaccccccggctgctggtggactggagcactggaattgccagcggcatgaactacctgcacctgcacaagatcatccaccgggacctgaagagccccaacgtgctggtgacccacacagatgctgtgaagatcagtgactttggcaccagcaaggagctgagtgacaagagcaccaagatgagctttgctggcaccgtggcctggatggcccctgaggtgatcagaaatgaacctgtgtctgagaaggtggacatctggagctttggagtggtgctgtgggagctgctgaccggggagatcccctacaaggatgtggacagcagcgccatcatctggggcgtgggcagcaacagcctgcacctgcctgtgcccagcacctgcccagatggcttcaagatcctgatgaagcagacctggcagagcaagcccaggaaccggcccagcttccggcagaccctgatgcacctggacatcgccagcgcagatgtgctggccaccccccaggagacctacttcaagagccaggccgagtggagggaggaggtgaagaagcactttgagaagatcaagtctgagggcacctgcatccaccggctggatgaggagctgatcagaagaagaagagaggagctgcggcatgccctggacatccgggagcactatgaaaggaagctggagcgggccaacaacctgtacatggagctgagcgccatcatgctgcagctggagatgagggagaaggagctgatcaagcgggagcaggccgtggagaagaagtacccaggcacctacaagaggcaccctgtgcggcccatcatccaccccaatgccatggagaagctgatgaagaggaagggcgtgccccacaagagcggcatgcagaccaagaggccagacctgctgcggtctgagggcatccccaccacagaggtggcccccacagccagccccctgagcggcagccccaagatgagcaccagcagcagcaagagccgctaccgcagcaagcccaggcacagaagaggcaacagccggggcagccacagcgactttgctgccatcctgaagaaccagcctgcccaggagaacagcccccaccccacctacctgcaccaggcccagagccagtaccccagcctgcaccaccacaacagcctgcagcagcagtaccagcagcccccaccagccatgagccagagccaccacccccggctgaacatgcacggccaggacatcgccacctgtgccaacaacctgcgctactttggacctgctgctgccctgcggagccccctgagcaaccacgcccagaggcagctgcccggcagcagcccagacctgatcagcacagccatggctgctgactgctggaggagcagcgagccagacaagggccaggccggcccctggggctgctgccaggctgatgcctatgacccctgcctgcagtgcaggcctgagcagtatggcagcctggacatccccagcgctgagcctgtgggccgcagcccagacctgagcaagagccctgcccacaaccccctgctggagaatgcccagagcagcgagaagacagaggagaatgagttcagcggctgccgctctgagagcagcctgggcaccagccacctgggcaccccaccagccctgcccaggaagacccggcccctgcagaagtctggagatgacagcagcgaggaggaggagggggaggtggacagcgaggtggagttcccccggcggcagaggccccaccgctgcatcagcagctgccagagctacagcaccttcagcagcgagaacttctctgtgtctgatggagaggagggcaacaccagtgaccacagcaacagcccagatgagctggccgacaagctggaggaccggctggccgagaagctggatgacctgctgagccagaccccagagatccccatcgacatcagcagccacagtgatggcctgagtgacaaggaatgtgctgtgcggcgggtgaagacccagatgagcctgggcaagctgtgtgtggaggagcggggctatgagaaccccatgcagtttgaggagagtgactgtgacagcagtgatggagaatgttctgatgccaccgtgaggaccaacaagcactacagcagcgccacctggtag

SEQ ID NO: 160162 - DNA, 2901 bp, Artificial Sequence; identical to SEQ ID NO: 160161
  Description of Artificial Sequence: Synthetic coding sequence

SEQ ID NO: 160163 - DNA, 414 bp, Artificial Sequence
  Description of Artificial Sequence: Synthetic coding sequence
atggccaacttccaggagcacctgagctgcagcagcagcccccacctgcccttcagcgagagcaagaccttcaacggcctgcaggatgagctgacagccatgggcaaccaccccagccccaagctgctggaggaccagcaggagaagggcatggtgaggacagagctgattgaatctgtgcacagccctgtgaccaccaccgtgctgacctctgtgtctgaggacagccgggaccagtttgaaaattctgtgctgcagctgcgggagcatgatgaaagtgaaacagctgtgtcccagggcaacagcaacacagtggatggagagagcaccagcggcacagaggacatcaagatccagttcagccgcagcggcagcggcagcggcggcttcctggagggcctgtttggctgctag

SEQ ID NO: 160164 - DNA, 342 bp, Artificial Sequence
  Description of Artificial Sequence: Synthetic coding sequence
atggccaacttccaggagcacctgagctgcagcagcagcccccacctgcccttcagcgagagcaagaccttcaacggcctgcaggatgagctgacagccatgggcaaccaccccagccccaagctgctggaggaccagcaggagaagggcatggtgaggacagagctgattgaatctgtgcacagccctgtgaccaccaccgtgctgacctctgtgtctgaggacagccgggaccagtttgaaaattctgtgctgcagctgcgggagcatgatgaaagtgaaacagctgtgtcccagggcaacagcaacacagtggatggagagagcaccagcggcacctag

SEQ ID NO: 160165 - DNA, 2469 bp, Artificial Sequence
  Description of Artificial Sequence: Synthetic coding sequence
atgtcctatgtggagtgcaagtgcctgcagctggagaacaagaacacctgggaggtgccctttgaggagatcagcgagctgcagtggctgggcagcggggcccagggcgctgtgttcctgggcaagttccgggcagaggaggtggccatcaagaaggtgcgggagcagaatgaaacagacatcaagcacctgaggaagctgaagcaccccaacatcatcgccttcaagggcgtgtgcacccaggccccctgctactgcatcatcatggagtactgtgcccacggccagctgtatgaggtgctgcgggccggcaggaagatcaccccccggctgctggtggactggagcactggaattgccagcggcatgaactacctgcacctgcacaagatcatccaccgggacctgaagagccccaacgtgctggtgacccacacagatgctgtgaagatcagtgactttggcaccagcaaggagctgagtgacaagagcaccaagatgagctttgctggcaccgtggcctggatggcccctgaggtgatcagaaatgaacctgtgtctgagaaggtggacatctggagctttggagtggtgctgtgggagctgctgaccggggagatcccctacaaggatgtggacagcagcgccatcatctggggcgtgggcagcaacagcctgcacctgcctgtgcccagcacctgcccagatggcttcaagatcctgatgaagcagacctggcagagcaagcccaggaaccggcccagcttccggcagaccctgatgcacctggacatcgccagcgcagatgtgctggccaccccccaggagacctacttcaagagccaggccgagtggagggaggaggtgaagaagcactttgagaagatcaagtctgagggcacctgcatccaccggctggatgaggagctgatcagaagaagaagagaggagctgcggcatgccctggacatccgggagcactatgaaaggaagctggagcgggccaacaacctgtacatggagctgagcgccatcatgctgcagctggagatgagggagaaggagctgatcaagcgggagcaggccgtggagaagaagtacccaggcacctacaagaggcaccctgtgcggcccatcatccaccccaatgccatggagaagctgatgaagaggaagggcgtgccccacaagagcggcatgcagaccaagaggccagacctgctgcggtctgagggcatccccaccacagaggtggcccccacagccagccccctgagcggcagccccaagatgagcaccagcagcagcaagagccgctaccgcagcaagcccaggcacagaagaggcaacagccggggcagccacagcgactttgctgccatcctgaagaaccagcctgcccaggagaacagcccccaccccacctacctgcaccaggcccagagccagtaccccagcctgcaccaccacaacagcctgcagcagcagtaccagcagcccccaccagccatgagccagagccaccacccccggctgaacatgcacggccaggacatcgccacctgtgccaacaacctgcgctactttggacctgctgctgccctgcggagccccctgagcaaccacgcccagaggcagctgcccggcagcagcccagacctgatcagcacagccatggctgctgactgctggaggagcagcgagccagacaagggccaggccggcccctggggctgctgccaggctgatgcctatgacccctgcctgcagtgcaggcctgagcagtatggcagcctggacatccccagcgctgagcctgtgggccgcagcccagacctgagcaagagccctgcccacaaccccctgctggagaatgcccagagcagcgagaagacagaggagaatgagttcagcggctgccgctctgagagcagcctgggcaccagccacctgggcaccccaccagccctgcccaggaagacccggcccctgcagaagtctggagatgacagcagcgaggaggaggagggggaggtggacagcgaggtggagttcccccggcggcagaggccccaccgctgcatcagcagctgccagagctacagcaccttcagcagcgagaacttctctgtgtctgatggagaggagggcaacaccagtgaccacagcaacagcccagatgagctggccgacaagctggaggaccggctggccgagaagctggatgacctgctgagccagaccccagagatccccatcgacatcagcagccacagtgatggcctgagtgacaaggaatgtgctgtgcggcgggtgaagacccagatgagcctgggcaagctgtgtgtggaggagcggggctatgagaaccccatgcagtttgaggagagtgactgtgacagcagtgatggagaatgttctgatgccaccgtgaggaccaacaagcactacagcagcgccacctggtag

SEQ ID NO: 160166 - DNA, 2280 bp, Artificial Sequence
  Description of Artificial Sequence: Synthetic coding sequence
atgtactgcggcatccagatcctggccctgtgggagcggggcgtgtgcacccaggccccctgctactgcatcatcatggagtactgtgcccacggccagctgtatgaggtgctgcgggccggcaggaagatcaccccccggctgctggtggactggagcacaggcatcgccagcggcatgaactacctgcacctgcacaagatcatccaccgggacctgaagagccccaacgtgctggtgacccacacagatgctgtgaagatcagtgactttggcaccagcaaggagctgagtgacaagagcaccaagatgagctttgctggcaccgtggcctggatggcccctgaggtgatcagaaatgaacctgtgtctgagaaggtggacatctggagctttggagtggtgctgtgggagctgctgactggagagatcccctacaaggatgtggacagcagcgccatcatctggggcgtgggcagcaacagcctgcacctgcctgtgcccagcacctgcccagatggcttcaagatcctgatgaagcagacctggcagagcaagcccaggaaccggcccagcttccggcagaccctgatgcacctggacatcgccagcgcagatgtgctggccaccccccaggagacctacttcaagagccaggccgagtggagggaggaggtgaagaagcactttgagaagatcaagtctgagggcacctgcatccaccggctggatgaggagctgatcagaagaagaagagaggagctgcggcatgccctggacatccgggagcactatgaaaggaagctggagcgggccaacaacctgtacatggagctgagcgccatcatgctgcagctggagatgagggagaaggagctgatcaagcgggagcaggccgtggagaagaagtacccaggcacctacaagaggcaccctgtgcggcccatcatccaccccaatgccatggagaagctgatgaagaggaaaggagtgccccacaagagcggcatgcagaccaagaggccagacctgctgcggtctgagggcatccccaccacagaggtggcccccacagccagccccctgagcggcagccccaagatgagcaccagcagcagcaagagccgctaccgcagcaagcccaggcaccggcggggcaacagccggggcagccacagcgactttgctgccatcctgaagaaccagcctgcccaggagaacagcccccaccccacctacctgcaccaggcccagagccagtaccccagcctgcaccaccacaacagcctgcagcagcagtaccagcagcccccaccagccatgagccagagccaccacccccggctgaacatgcacggccaggacatcgccacctgtgccaacaacctgcgctacttcggccctgctgctgccctgcggagccccctgagcaaccacgcccagaggcagctgcccggcagcagcccagacctgatcagcacagccatggctgctgactgctggaggagcagcgagccagacaagggccaggccggcccctggggctgctgccaggctgatgcctatgacccctgcctgcagtgcaggcctgagcagtatggcagcctggacatccccagcgctgagcctgtgggccgcagcccagacctgagcaagagccctgcccacaaccccctgctggagaatgcccagagcagcgagaagacagaagaaaatgagttcagcggctgccgctctgagagcagcctgggcaccagccacctgggcaccccaccagccctgcccaggaagacccggcccctgcagaagtctggagatgacagcagcgaggaggaggagggggaggtggacagcgaggtggagttcccccggcggcagaggccccaccgctgcatcagcagctgccagagctacagcaccttcagcagcgagaacttctctgtgtctgatggagaggagggcaacaccagtgaccacagcaacagcccagatgagctggccgacaagctggaggaccggctggccgagaagctggatgacctgctgagccagaccccagagatccccatcgacatcagcagccacagtgatggcctgagtgacaaggaatgtgctgtgagaagagtgaagacccagatgagcctgggcaagctgtgtgtggaggagcggggctatgagaaccccatgcagtttgaggagagtgactgtgacagcagtgatggagagtgcagtgatgccaccgtgaggaccaacaagcactacagcagcgccacctggtag

SEQ ID NO: 160167 - DNA, 2841 bp, Artificial Sequence
  Description of Artificial Sequence: Synthetic coding sequence
atggctgtgatggagatggcctgccctggggcccctggcagcgctgtgggccagcagaaggagctgcccaaggccaaggagaagaccccacccctgggcaagaagcagagctctgtgtacaagctggaggccgtggagaagagccctgtgttctgtgggaagtgggagatcctgaatgatgtgatcaccaagggcacagccaaggagggcagcgaggccggccctgctgccatcagcatcatcgcccaggctgaatgtgagaacagccaggagttcagccccaccttcagcgagcgcatcttcatcgccggcagcaagcagtacagccagagcgagagcctggaccagatccccaacaacgtggcccacgccacagagggcaagatggcccgggtgtgctggaagggcaagaggaggagcaaggccaggaagaagaggaagaagaagagcagcaagagcctggcccatgctggggtggccctggccaagcccctgcccaggaccccagagcaggagagctgcaccatccctgtgcaggaggatgagagccccctgggcgccccctacgtgaggaacaccccccagttcaccaagcccctgaaggagcccggcctgggccagctgtgcttcaagcagctgggggagggcctgcgggccctgcccaggtctgagctgcacaagctgatcagccccctgcagtgcctgaaccacgtgtggaagctgcaccacccccaggacggcggccccctgcccctgcccacccaccccttcccctacagccggctgccccaccccttccccttccaccccctgcagccctggaagccccaccccctggagagcttcctgggcaagctggcctgtgtggacagccagaagcccctgcctgacccccacctgagcaagctggcctgtgtggacagccccaagcccctgcccggcccccacctggagcccagctgcctgagcagaggagcccacgagaagttctctgtggaggagtacctggtgcacgccctgcagggctctgtgagcagcggccaggcccacagcctgaccagcctggccaagacctgggccgcccggggcagccgcagccgggagcccagccccaagacagaggacaatgaaggagtgctgctgacagagaagctgaagcctgtggactatgagtaccgggaggaggtgcactgggccacccaccagctgcggctgggccggggcagctttggagaggtgcacaggatggaggacaagcagacaggcttccagtgtgctgtgaagaaggtgcggctggaggtgttccgggcagaggagctgatggcctgtgccggcctgaccagccccagaattgtgcccctgtatggagctgtgcgggagggcccctgggtgaacatcttcatggagctgctggagggcggcagcctgggccagctggtgaaggagcagggctgcctgcctgaggaccgggccctgtactacctgggccaggccctggagggcctggagtacctgcacagccgccgcatcctgcatggagatgtgaaggctgacaacgtgctgctgagcagtgatggcagccatgctgccctgtgtgactttggacatgctgtgtgcctgcagccagatggcctgggcaagagcctgctgactggagactacatccctggaacagagacccacatggcccctgaggtggtgctgggccgcagctgtgatgccaaggtggatgtgtggagcagctgctgcatgatgctgcacatgctgaatggctgccacccctggacccagttcttccggggccccctgtgcctgaagatcgccagcgagcccccacctgtgcgggagatcccccccagctgtgcccccctgacagcccaggccatccaggagggcctgaggaaggagcccatccaccgggtgtctgctgctgagctgggcggcaaggtgaacagagccctgcagcaggtgggcggcctgaagagcccctggagaggagagtacaaggagcccaggcaccccccacccaaccaggccaactaccaccagaccctgcacgcccagccccgggagctgagcccccgggcccctggccccaggcctgctgaggagaccaccggccgggcccccaagctgcagccccccctgcccccagagcccccagagcccaacaagagcccccccctgaccctgagcaaggaggagagcggcatgtgggagcccctgcccctgagcagcctggagcccgccccagccaggaaccccagcagccctgagaggaaggccaccgtgcctgagcaggagctgcagcagctggagattgagctgttcctgaacagcctgagccagcccttcagcctggaggagcaggagcagatcctgagctgcctgagcattgacagcctgagcctgagtgatgacagcgagaagaaccccagcaaggccagccagagcagccgggacaccctgagcagtggagtgcacagctggagcagccaggccgaggcccggagcagctcctggaacatggtgctggcccggggccggcccacagacacccccagctacttcaacggggtgaaggtgcagatccagagcctgaatggagagcacctgcacatccgggagttccaccgggtgaaggtgggggacatcgccaccggcatcagcagccagatcccagctgctgccttcagcctggtgaccaaggatggccagcctgtgcgctatgacatggaggtgcctgattctggaattgacctgcagtgcaccctggccccagatggcagctttgcctggagctggagggtgaagcacggccagctggagaaccggccctag

SEQ ID NO: 160168 - DNA, 1302 bp, Artificial Sequence
  Description of Artificial Sequence: Synthetic coding sequence
tgcttcaagcagctgggggagggcctgcgggccctgcccaggtctgagctgcacaagctgatcagccccctgcagtgcctgaaccacgtgtggaagctgcaccacccccaggacggcggccccctgcccctgcccacccaccaccccttccccttccaccccctgcagccctggaagccccaccccctggagagcttcctgggcaagctggcctgtgtggacagccagaagcccctgcctgacccccacctgagcaagctggcctgtgtggacagccccaagcccctgcccggcccccacctggagcccagctgcctgagcagaggagcccacgagaagttctctgtggaggagtacctggtgcacgccctgcagggctctgtgagcagcggccaggcccacagcctgaccagcctggccaagacctgggccgcccggggcagccgcagccgggagcccagccccaagacagaggacaatgaaggagtgctgctgacagagaagctgaagcctgtggactatgagtaccgggaggaggtgcactgggccacccaccagctgcggctgggccggggcagctttggagaggtgcacaggatggaggacaagcagacaggcttccagtgtgctgtgaagaaggtgcggctggaggtgttccgggcagaggagctgatggcctgtgccggcctgaccagccccagaattgtgcccctgtatggagctgtgcgggagggcccctgggtgaacatcttcatggagctgctggagggcggcagcctgggccagctggtgaaggagcagggctgcctgcctgaggaccgggccctgtactacctgggccaggccctggagggcctggagtacctgcacagccgccgcatcctgcatggagatgtgaaggctgacaacgtgctgctgagcagtgatggcagccatgctgccctgtgtgactttggacatgctgtgtgcctgcagccagatggcctgggcaagagcctgctgactggagactacatccctggaacagagacccacatggcccctgaggtggtgctgggccgcagctgtgatgccaaggtggatgtgtggagcagctgctgcatgatgctgcacatgctgaatggctgccacccctggacccagttcttccggggccccctgtgcctgaaggtgggagatggcacccagcacggccagcagggcgagctgcagggccctggggcccaggccgccggctggaggggctgcagcgctgtggctgatggagcccggggcggcctggtgatccacgtgggcagctag

SEQ ID NO: 160169 - DNA, 3942 bp, Artificial Sequence
  Description of Artificial Sequence: Synthetic coding sequence
atggagagcggcggcggcaatgccccagctggggccctgggcgccgccagcgagagcccccagtgccccccacctcctggggtggagggcgccgccggccctgctgagccagatggagctgctgagggcgctgctgggggcagcggggagggggagagcggcggcggcccccggcgggccctgcgggctgtgtatgtgcgctctgagagcagccagggcggggccgccggcggccctgaggccggggcccggcagtgcctgctgcgggcctgtgaggccgagggcgcccacctgacctctgtgccctttggagagctggactttggagaaacagctgtgctggatgccttctatgatgctgatgtggccgtggtggacatgtctgatgtgtcccggcagcccagcctcttctaccacctgggcgtgcgggagagctttgacatggccaacaacgtcatcctgtaccatgacacagatgctgacacagccctgagcctgaaggacatggtgacccagaagaacacagccagcagcggcaactactacttcatcccctacatcgtgaccccctgtgccgactacttctgctgtgagagtgatgcccagaggcgggccagcgagtacatgcagcccaactgggacaacatcctgggccccctgtgcatgcccctggtggaccgcttcatcagcctgctgaaggacatccacgtgaccagctgtgtgtactacaaggagaccctgctgaatgacatcaggaaggcccgggagaagtaccagggcgaggagctggccaaggagctggcccgcatcaagctgaggatggacaacacagaggtgctgaccagtgacatcatcatcaacctgctgctgagctacagagacatccaggactatgatgccatggtgaagctggtggagaccctggagatgctgcccacctgtgacctggccgaccagcacaacatcaagttccactacgcctttgccctgaacagaagaaacagcactggagaccgggagaaggccctgcagatcatgctgcaggtgctgcagagctgtgaccaccctggccctgacatgttctgcctgtgtggccgcatctacaaggacatcttcctggacagcgactgcaaggatgacaccagccgggacagcgccatcgagtggtacaggaagggctttgagctgcagagcagcctgtacagcggcatcaacctggccgtgctgctgattgtggccggccagcagtttgagaccagcctggagctgaggaagattggagtgcggctgaacagcctgctgggcaggaagggcagcctggagaagatgaacaactactgggatgtgggccagttcttctctgtgtccatgctggcccatgatgtgggcaaggctgtgcaggccgctgagcggctcttcaagctgaagccccctgtgtggtacctgcggagcctggtgcagaacctgctgctgatccgccgcttcaagaagaccatcatcgagcacagcccccggcaggagcggctgaacttctggctggacatcatctttgaggccaccaatgaggtgaccaacggcctgcgcttccctgtgctggtgattgagcccaccaaggtgtaccagcccagctatgtgtccatcaacaatgaagctgaggagaggacagtgtccctgtggcacgtgagccccacagagatgaagcagatgcatgagtggaacttcaccgccagcagcatcaagggcatcagcctgagcaagtttgatgagcgctgctgcttcctgtatgtgcatgacaacagtgatgacttccagatctacttcagcacagaggagcagtgcagccgcttcttcagcctggtgaaggagatgatcaccaacacagctggcagcacagtggagctggagggggagacagatggagacaccctggagtatgaatatgaccatgatgccaacggggagcgggtggtgctgggcaagggcacctatggaattgtgtatgccggccgggacctgagcaaccaggtgcgcatcgccatcaaggagatccctgagcgggacagccgctacagccagcccctgcacgaggagatcgccctgcacaagtacctgaagcacagaaatattgtgcagtacctgggctctgtgtctgaaaatggctacatcaagatcttcatggagcaggtgcctgggggcagcctgagcgccctgctgcggagcaagtggggccccatgaaggagcccaccatcaagttctacaccaagcagatcctggagggcctgaagtacctgcacgagaaccagatcgtgcaccgggacatcaagggggacaacgtgctggtgaacacctacagcggcgtggtgaagatcagtgactttggcaccagcaagaggctggccggcgtgaacccctgcacagagaccttcaccggcaccctgcagtacatggcccctgagatcatcgaccagggcccccggggctacggggccccagctgacatctggagcctgggctgcaccatcatcgagatggccaccagcaagccacccttccacgagctgggggagccccaggccgccatgttcaaggtgggcatgttcaagatccaccctgagatccctgaggccctgtctgctgaggcccgggccttcatcctgagctgctttgagccagacccccacaagagggccaccacagctgagctgctgcgggagggcttcctgcggcaggtgaacaagggcaagaagaacagaattgccttcaagcccagcgagggcccccggggcgtggtgctggccctgcccacccagggcgagcccatggccaccagcagcagcgagcacggctctgtgtccccagacagtgatgcccagccagatgccctgtttgagaggacccgggcccccaggcaccacctgggccacctgctgtctgtgcctgatgagagcagcgccctggaggaccggggcctggccagcagccctgaggaccgggaccagggcctcttcctgctgaggaaggacagcgagcggcgggccatcctgtacaagatcctgtgggaggagcagaaccaggtggccagcaacctgcaggagtgtgtggcccagagcagcgaggagctgcacctgtctgtgggccacatcaagcagatcatcggcatcctgcgggacttcatccgcagccctgagcaccgggtgatggccaccaccatcagcaagctgaaggtggacctggactttgacagcagcagcatcagccagatccacctggtgctgtttggcttccaggatgctgtgaacaagatcctgaggaaccacctgatccggccccactggatgtttgccatggacaacatcatcagaagagctgtgcaggccgctgtgaccatcctgatccctgagctgcgggcccactttgagcccacctgtgaaacagaaggagtggacaaggacatggatgaagctgaggagggctaccccccagccactggacctggccaggaggcccagccccaccagcagcacctgagcctgcagctgggggagctgcggcaggagaccaaccggctgctggagcacctggtggagaaggagcgggagtaccagaacctgctgcggcagaccctggagcagaagacccaggagctgtaccacctgcagctgaagctgaagagcaactgcatcacagagaacccagctggcccctacggccagaggacagacaaggagctgattgactggctgcggctgcagggcgcagatgccaagaccatcgagaagatcgtggaggagggctacaccctgagtgacatcctgaatgagatcaccaaggaggacctgcgctacctgcggctgcggggcggcctgctgtgccgcctgtggagcgctgtgtcccagtacagaagagcccaggaggccagcgagaccaaggacaaggcctag

SEQ ID NO: 160170 - DNA, 4677 bp, Artificial Sequence
  Description of Artificial Sequence: Synthetic coding sequence
atgagggaggccgccgccgccctggtgcccccaccagcctttgctgtgaccccagctgctgccatggaggagcccccacctcctcctcctcctcctcctcctcctcctgagcctgagacagagagcgagcctgagtgctgcctggccgcccggcaggagggcaccctgggggacagcgcctgcaagagccctgagagtgacctggaggacttcagtgatgagaccaacacagagaacctgtatggcaccagcccccccagcaccccccggcagatgaagaggatgagcaccaagcaccagagaaataatgtgggccgcccagccagccgcagcaacctgaaggagaagatgaatgcccccaaccagcccccccacaaggacaccgggaagacagtggagaatgtggaggagtacagctacaagcaggagaagaagatccgggccgccctgcggaccacagagcgggacaggaagaagaatgtgcagtgcagcttcatgctggacagcgtgggcggcagcctgcccaagaagagcatcccagatgtggacctgaacaagccctacctgagcctgggctgcagcaatgccaagctgcctgtgtctgtgcccatgcccatcgcccggcctgcccggcagaccagcaggacagactgcccagctgaccggctgaagttctttgagaccctgcggctgctgctgaagctgacctctgtgtccaagaagaaggaccgggagcagaggggccaggagaacaccagcggcttctggctgaacagaagcaatgaactcatctggctggagctgcaggcctggcatgctggccgcaccatcaatgaccaggacttcttcctgtacacagcccggcaggccatcccagacatcatcaatgagatcctgaccttcaaggtggactatggcagctttgcctttgtgcgggacagagctggcttcaacggcacctctgtggagggccagtgcaaggccaccccaggcaccaagatcgtgggctacagcacccaccacgagcacctgcagaggcagagggtgtcctttgagcaggtgaagaggatcatggagctgctggagtacatcgaggccctgtaccccagcctgcaggccctgcagaaggactatgagaagtatgctgccaaggacttccaggacagagtgcaggccctgtgcctgtggctgaacatcaccaaggacctgaaccagaagctgcgcatcatgggcaccgtgctgggcatcaagaacctgagtgacatcggctggcctgtgtttgagatccccagcccccggcccagcaaaggaaatgaaccagaatatgaaggagatgacacagaaggagagctgaaggagctggagagcagcacagatgaaagtgaggaggagcagatcagtgacccccgggtgcctgagatccggcagcccatcgacaacagctttgacatccagagccgggactgcatcagcaagaagctggagcggctggagagtgaagatgacagcctgggctggggcgccccagactggagcacagaagctggcttcagccgccactgcctgaccagcatctaccggccctttgtggacaaggccctgaagcagatgggcctgaggaagctgatcctgcggctgcacaagctgatggatggcagcctgcagagggccagaattgccctggtgaagaatgacaggcctgtggagttcagcgagttcccagaccccatgtggggcagtgactatgtgcagctgagcaggaccccacccagcagcgaggagaagtgcagcgctgtgtcctgggaggagctgaaggccatggacctgcccagctttgagcccgccttcctggtgctgtgccgggtgctgctgaatgtcatccatgaatgtctgaagctgcggctggagcagaggcctgctggggagcccagcctgctgagcatcaagcagctggtgcgggagtgcaaggaggtgctgaagggcggcctgctgatgaagcagtactaccagttcatgctgcaggaggtgctggaggacctggagaagccagactgcaacattgatgcctttgaggaggacctgcacaagatgctgatggtgtactttgactacatgaggtcctggatccagatgctgcagcagctgccccaggccagccacagcctgaagaacctgctggaggaggagtggaacttcaccaaggagatcacccactacatccggggcggggaggcccaggccggcaagctgttctgtgacattgctggcatgctgctgaagagcacaggcagcttcctggagtttggcctgcaggagagctgtgccgagttctggaccagcgcagatgacagcagcgccagtgatgagatcagaagatctgtgattgagatcagccgggccctgaaggagctgttccacgaggcccgggagcgggccagcaaggccctgggctttgccaagatgctgaggaaggacctggagattgctgctgagttccggctgagcgcccctgtgcgggacctgctggatgtgctgaagagcaagcagtatgtgaaggtgcagatccctggcctggagaacctgcagatgtttgtgcctgacaccctggccgaggagaagagcatcatcctgcagctgctgaatgctgctgctgggaaggactgcagcaaggacagtgatgatgtgctgattgatgcctacctgctgctgaccaagcacggggaccgggcccgggacagcgaggacagctggggcacctgggaggcccagcctgtgaaggtggtgccccaggtggagaccgtggacaccctgcgctccatgcaggtggacaacctgctgctggtggtgatgcagagcgcccacctgaccatccagaggaaggccttccagcagagcattgagggcctgatgaccctgtgccaggagcagaccagcagccagcctgtgattgccaaggccctgcagcagctgaagaatgatgccctggagctgtgcaaccgcatcagcaatgccatcgacagagtggaccacatgttcaccagcgagtttgatgctgaggtggatgaaagtgaatctgtgaccctgcagcagtactaccgggaggccatgatccagggctacaactttggatttgagtaccacaaggaggtggtgcggctgatgtctggagagttccggcagaagatcggggacaagtacatcagctttgccaggaagtggatgaactacgtgctgaccaagtgtgagagcggccggggcacccggccccgctgggccacccagggctttgacttcctgcaggccatcgagcccgccttcatcagcgccctgcctgaagatgacttcctgagcctgcaggccctgatgaatgaatgcatcggccacgtgattggcaagccccacagccctgtgacaggcctgtacctggccatccacaggaacagcccccggcccatgaaggtgccccgctgccacagcgacccccccaacccccacctgatcatccccaccccagagggcttccggggcagctctgtgcctgaaaatgaccggctggccagcattgctgctgagctgcagttccgcagcctgagccgccacagcagccccacagaggagagagatgagcccgcctaccccaggggggacagcagcggcagcacccggcgctcctgggagctgcggaccctcatcagccagagcaaggacacagccagcaagctgggccccatcgaggccatccagaagtctgtgcggctgtttgaggagaagcgctaccgggagatgaggaggaagaacatcatcggccaggtgtgtgacacccccaagagctatgacaacgtgatgcacgtgggcctgaggaaggtgaccttcaagtggcagaggggcaacaagattggagagggccagtatggcaaggtgtacacctgcatctctgtggacacaggagagctgatggccatgaaggagatccgcttccagcccaatgaccacaagaccatcaaggagacagcagatgagctgaagatctttgagggcatcaagcaccccaacctggtgcgctactttggagtggagctgcaccgggaggagatgtacatcttcatggagtactgtgatgagggcaccctggaggaggtgtcccggctgggcctgcaggagcacgtgatccggctgtacagcaagcagatcaccatcgccatcaacgtgctgcatgaacatggaattgtgcaccgggacatcaagggggccaacatcttcctgaccagcagcggcctcatcaagctgggggactttggctgcagcgtgaagctgaagaacaatgcccagaccatgcctggagaggtgaacagcaccctgggcacagctgcctacatggcccctgaggtgatcacccgggccaagggggagggccacggccgggctgctgacatctggagcctgggctgtgtggtgattgagatggtgacaggcaagaggccctggcatgaatatgagcacaacttccagatcatgtacaaggtgggcatgggccacaagccacccatccctgagcggctgagccctgagggcaaggacttcctgagccactgcctggagagtgaccccaagatgcgctggacagccagccagctgctggaccacagctttgtgaaggtgtgcacagatgaggagtag

SEQ ID NO: 160171 - DNA, 4827 bp, Artificial Sequence
  Description of Artificial Sequence: Synthetic coding sequence
atgagggaggccgccgccgccctggtgcccccaccagcctttgctgtgaccccagctgctgccatggaggagcccccacctcctcctcctcctcctcctcctcctcctgagcctgagacagagagcgagcctgagtgctgcctggccgcccggcaggagggcaccctgggggacagcgcctgcaagagccctgagagtgacctggaggacttcagtgatgagaccaacacagagaacctgtatggcaccagcccccccagcaccccccggcagatgaagaggatgagcaccaagcaccagagaaataatgtgggccgcccagccagccgcagcaacctgaaggagaagatgaatgcccccaaccagcccccccacaaggacaccgggaagacagtggagaatgtggaggagtacagctacaagcaggagaagaagatccgggccgccctgcggaccacagagcgggacaggaagaagaatgtgcagtgcagcttcatgctggacagcgtgggcggcagcctgcccaagaagagcatcccagatgtggacctgaacaagccctacctgagcctgggctgcagcaatgccaagctgcctgtgtctgtgcccatgcccatcgcccggcctgcccggcagaccagcaggacagactgcccagctgaccggctgaagttctttgagaccctgcggctgctgctgaagctgacctctgtgtccaagaagaaggaccgggagcagaggggccaggagaacaccagcggcttctggctgaacagaagcaatgaactcatctggctggagctgcaggcctggcatgctggccgcaccatcaatgaccaggacttcttcctgtacacagcccggcaggccatcccagacatcatcaatgagatcctgaccttcaaggtggactatggcagctttgcctttgtgcgggacagagctggcttcaacggcacctctgtggagggccagtgcaaggccaccccaggcaccaagatcgtgggctacagcacccaccacgagcacctgcagaggcagagggtgtcctttgagcaggtgaagaggatcatggagctgctggagtacatcgaggccctgtaccccagcctgcaggccctgcagaaggactatgagaagtatgctgccaaggacttccaggacagagtgcaggccctgtgcctgtggctgaacatcaccaaggacctgaaccagaagctgcgcatcatgggcaccgtgctgggcatcaagaacctgagtgacatcggctggcctgtgtttgagatccccagcccccggcccagcaaaggaaatgaaccagaatatgaaggagatgacacagaaggagagctgaaggagctggagagcagcacagatgaaagtgaggaggagcagatcagtgacccccgggtgcctgagatccggcagcccatcgacaacagctttgacatccagagccgggactgcatcagcaagaagctggagcggctggagagtgaagatgacagcctgggctggggcgccccagactggagcacagaagctggcttcagccgccactgcctgaccagcatctaccggccctttgtggacaaggccctgaagcagatgggcctgaggaagctgatcctgcggctgcacaagctgatggatggcagcctgcagagggccagaattgccctggtgaagaatgacaggcctgtggagttcagcgagttcccagaccccatgtggggcagtgactatgtgcagctgagcaggaccccacccagcagcgaggagaagtgcagcgctgtgtcctgggaggagctgaaggccatggacctgcccagctttgagcccgccttcctggtgctgtgccgggtgctgctgaatgtcatccatgaatgtctgaagctgcggctggagcagaggcctgctggggagcccagcctgctgagcatcaagcagctggtgcgggagtgcaaggaggtgctgaagggcggcctgctgatgaagcagtactaccagttcatgctgcaggaggtgctggaggacctggagaagccagactgcaacattgatgcctttgaggaggacctgcacaagatgctgatggtgtactttgactacatgaggtcctggatccagatgctgcagcagctgccccaggccagccacagcctgaagaacctgctggaggaggagtggaacttcaccaaggagatcacccactacatccggggcggggaggcccaggccggcaagctgttctgtgacattgctggcatgctgctgaagagcacaggcagcttcctggagtttggcctgcaggagagctgtgccgagttctggaccagcgcagatgacagcagcgccagtgatgagatcagaagatctgtgattgagatcagccgggccctgaaggagctgttccacgaggcccgggagcgggccagcaaggccctgggctttgccaagatgctgaggaaggacctggagattgctgctgagttccggctgagcgcccctgtgcgggacctgctggatgtgctgaagagcaagcagtatgtgaaggtgcagatccctggcctggagaacctgcagatgtttgtgcctgacaccctggccgaggagaagagcatcatcctgcagctgctgaatgctgctgctgggaaggactgcagcaaggacagtgatgatgtgctgattgatgcctacctgctgctgaccaagcacggggaccgggcccgggacagcgaggacagctggggcacctgggaggcccagcctgtgaaggtggtgccccaggtggagaccgtggacaccctgcgctccatgcaggtggacaacctgctgctggtggtgatgcagagcgcccacctgaccatccagaggaaggccttccagcagagcattgagggcctgatgaccctgtgccaggagcagaccagcagccagcctgtgattgccaaggccctgcagcagctgaagaatgatgccctggagctgtgcaaccgcatcagcaatgccatcgacagagtggaccacatgttcaccagcgagtttgatgctgaggtggatgaaagtgaatctgtgaccctgcagcagtactaccgggaggccatgatccagggctacaactttggatttgagtaccacaaggaggtggtgcggctgatgtctggagagttccggcagaagatcggggacaagtacatcagctttgccaggaagtggatgaactacgtgctgaccaagtgtgagagcggccggggcacccggccccgctgggccacccagggctttgacttcctgcaggccatcgagcccgccttcatcagcgccctgcctgaagatgacttcctgagcctgcaggccctgatgaatgaatgcatcggccacgtgattggcaagccccacagccctgtgacaggcctgtacctggccatccacaggaacagcccccggcccatgaaggtgccccgctgccacagcgacccccccaacccccacctgatcatccccaccccagagggcttcagcaccaggtccatgcccagtgatgcccggagccacggcagccctgctgctgctgctgctgctgctgctgctgctgtggccgccagccggcccagccccagcggcggggacagcgtgctgcccaagagcatcagcagcgcccatgacacccggggcagctctgtgcctgaaaatgaccggctggccagcattgctgctgagctgcagttccgcagcctgagccgccacagcagccccacagaggagagagatgagcccgcctaccccaggggggacagcagcggcagcacccggcgctcctgggagctgcggaccctcatcagccagagcaaggacacagccagcaagctgggccccatcgaggccatccagaagtctgtgcggctgtttgaggagaagcgctaccgggagatgaggaggaagaacatcatcggccaggtgtgtgacacccccaagagctatgacaacgtgatgcacgtgggcctgaggaaggtgaccttcaagtggcagaggggcaacaagattggagagggccagtatggcaaggtgtacacctgcatctctgtggacacaggagagctgatggccatgaaggagatccgcttccagcccaatgaccacaagaccatcaaggagacagcagatgagctgaagatctttgagggcatcaagcaccccaacctggtgcgctactttggagtggagctgcaccgggaggagatgtacatcttcatggagtactgtgatgagggcaccctggaggaggtgtcccggctgggcctgcaggagcacgtgatccggctgtacagcaagcagatcaccatcgccatcaacgtgctgcatgaacatggaattgtgcaccgggacatcaagggggccaacatcttcctgaccagcagcggcctcatcaagctgggggactttggctgcagcgtgaagctgaagaacaatgcccagaccatgcctggagaggtgaacagcaccctgggcacagctgcctacatggcccctgaggtgatcacccgggccaagggggagggccacggccgggctgctgacatctggagcctgggctgtgtggtgattgagatggtgacaggcaagaggccctggcatgaatatgagcacaacttccagatcatgtacaaggtgggcatgggccacaagccacccatccctgagcggctgagccctgagggcaaggacttcctgagccactgcctggagagtgaccccaagatgcgctggacagccagccagctgctggaccacagctttgtgaaggtgtgcacagatgaggagtag

SEQ ID NO: 160172 - DNA, 4497 bp, Artificial Sequence
  Description of Artificial Sequence: Synthetic coding sequence
atgagggaggccgccgccgccctggtgcccccaccagcctttgctgtgaccccagctgctgccatggaggagcccccacctcctcctcctcctcctcctcctcctcctgagcctgagacagagagcgagcctgagtgctgcctggccgcccggcaggagggcaccctgggggacagcgcctgcaagagccctgagagtgacctggaggacttcagtgatgagaccaacacagagaacctgtatggcaccagcccccccagcaccccccggcagatgaagaggatgagcaccaagcaccagagaaataatgtgggccgcccagccagccgcagcaacctgaaggagaagatgaatgcccccaaccagcccccccacaaggacaccgggaagacagtggagaatgtggaggagtacagctacaagcaggagaagaagatccgggccgccctgcggaccacagagcgggacaggaagaagaatgtgcagtgcagcttcatgctggacagcgtgggcggcagcctgcccaagaagagcatcccagatgtggacctgaacaagccctacctgagcctgggctgcagcaatgccaagctgcctgtgtctgtgcccatgcccatcgcccggcctgcccggcagaccagcaggacagactgcccagctgaccggctgaagttctttgagaccctgcggctgctgctgaagctgacctctgtgtccaagaagaaggaccgggagcagaggggccaggagaacaccagcggcttctggctgaacagaagcaatgaactcatctggctggagctgcaggcctggcatgctggccgcaccatcaatgaccaggacttcttcctgtacacagcccggcaggccatcccagacatcatcaatgagatcctgaccttcaaggtggactatggcagctttgcctttgtgcgggacagagctggcttcaacggcacctctgtggagggccagtgcaaggccaccccaggcaccaagatcgtgggctacagcacccaccacgagcacctgcagaggcagagggtgtcctttgagcaggtgaagaggatcatggagctgctggagtacatcgaggccctgtaccccagcctgcaggccctgcagaaggactatgagaagtatgctgccaaggacttccaggacagagtgcaggccctgtgcctgtggctgaacatcaccaaggacctgaaccagaagctgcgcatcatgggcaccgtgctgggcatcaagaacctgagtgacatcggctggcctgtgtttgagatccccagcccccggcccagcaaaggaaatgaaccagaatatgaaggagatgacacagaaggagagctgaaggagctggagagcagcacagatgaaagtgaggaggagcagatcagtgacccccgggtgcctgagatccggcagcccatcgacaacagctttgacatccagagccgggactgcatcagcaagaagctggagcggctggagagtgaagatgacagcctgggctggggcgccccagactggagcacagaagctggcttcagccgccactgcctgaccagcatctaccggccctttgtggacaaggccctgaagcagatgggcctgaggaagctgatcctgcggctgcacaagctgatggatggcagcctgcagagggccagaattgccctggtgaagaatgacaggcctgtggagttcagcgagttcccagaccccatgtggggcagtgactatgtgcagctgagcaggaccccacccagcagcgaggagaagtgcagcgctgtgtcctgggaggagctgaaggccatggacctgcccagctttgagcccgccttcctggtgctgtgccgggtgctgctgaatgtcatccatgaatgtctgaagctgcggctggagcagaggcctgctggggagcccagcctgctgagcatcaagcagctggtgcgggagtgcaaggaggtgctgaagggcggcctgctgatgaagcagtactaccagttcatgctgcaggaggtgctggaggacctggagaagccagactgcaacattgatgcctttgaggaggacctgcacaagatgctgatggtgtactttgactacatgaggtcctggatccagatgctgcagcagctgccccaggccagccacagcctgaagaacctgctggaggaggagtggaacttcaccaaggagatcacccactacatccggggcggggaggcccaggccggcaagctgttctgtgacattgctggcatgctgctgaagagcacaggcagcttcctggagtttggcctgcaggagagctgtgccgagttctggaccagcgcagatgacagcagcgccagtgatgagatcagaagatctgtgattgagatcagccgggccctgaaggagctgttccacgaggcccgggagcgggccagcaaggccctgggctttgccaagatgctgaggaaggacctggagattgctgctgagttccggctgagcgcccctgtgcgggacctgctggatgtgctgaagagcaagcagtatgtgaaggtgcagatccctggcctggagaacctgcagatgtttgtgcctgacaccctggccgaggagaagagcatcatcctgcagctgctgaatgctgctgctgggaaggactgcagcaaggacagtgatgatgtgctgattgatgcctacctgctgctgaccaagcacggggaccgggcccgggacagcgaggacagctggggcacctgggaggcccagcctgtgaaggtggtgccccaggtggagaccgtggacaccctgcgctccatgcaggtggacaacctgctgctggtggtgatgcagagcgcccacctgaccatccagaggaaggccttccagcagagcattgagggcctgatgaccctgtgccaggagcagaccagcagccagcctgtgattgccaaggccctgcagcagctgaagaatgatgccctggagctgtgcaaccgcatcagcaatgccatcgacagagtggaccacatgttcaccagcgagtttgatgctgaggtggatgaaagtgaatctgtgaccctgcagcagtactaccgggaggccatgatccagggctacaactttggatttgagtaccacaaggaggtggtgcggctgatgtctggagagttccggcagaagatcggggacaagtacatcagctttgccaggaagtggatgaactacgtgctgaccaagtgtgagagcggccggggcacccggccccgctgggccacccagggctttgacttcctgcaggccatcgagcccgccttcatcagcgccctgcctgaagatgacttcctgagcctgcaggccctgatgaatgaatgcatcggccacgtgattggcaagccccacagccctgtgacaggcctgtacctggccatccacaggaacagcccccggcccatgaaggtgccccgctgccacagcgacccccccaacccccacctgatcatccccaccccagagggcttccggggcagctctgtgcctgaaaatgaccggctggccagcattgctgctgagctgcagttccgcagcctgagccgccacagcagccccacagaggagagagatgagcccgcctaccccaggggggacagcagcggcagcacccggcgctcctgggagctgcggaccctcatcagccagagcaaggacacagccagcaagctgggccccatcgaggccatccagaagtctgtgcggctgtttgaggagaagcgctaccgggagatgaggaggaagaacatcatcggccaggtgtgtgacacccccaagagctatgacaacgtgatgcacgtgggcctgaggaaggtgaccttcaagtggcagaggggcaacaagattggagagggccagtatggcaaggtgtacacctgcatctctgtggacacaggagagctgatggccatgaaggagatccgcttccagcccaatgaccacaagaccatcaaggagacagcagatgagctgaagatctttgagggcatcaagcaccccaacctggtgcgctactttggagtggagctgcaccgggaggagatgtacatcttcatggagtactgtgatgagggcaccctggaggaggtgtcccggctgggcctgcaggagcacgtgatccggctgtacagcaagcagatcaccatcgccatcaacgtgctgcatgaacatggaattgtgcaccgggacatcaagggggccaacatcttcctgaccagcagcggcctcatcaagctgggggactttggctgcagcgtgaagctgaagaacaatgcccagaccatgcctggagaggtgaacagcaccctgggcacagctgcctacatggcccctgaggtgatcacccgggccaagggggagggccacggccgggctgctgacatctggagcctgggctgtgtggtgattgagatggtgacaggcaagatctgcaaggacacagaatag

SEQ ID NO: 160173 - DNA, 324 bp, Artificial Sequence
  Description of Artificial Sequence: Synthetic coding sequence
atggaggagcccccacctcctcctcctcctcctcctcctcctcctgagcctgagacagaaagtgagcctgagtgctgcctggccgcccggcaggagggcaccctgggggacagcgcctgcaagagccctgagagtgacctggaggacttcagtgatgagaccaacacagagaacctgtatggcaccagcccccccagcaccccccggcagatgaagaggatgagcaccaagcaccagaggaacaacgtgggccggcctgccagccgcagcaacctgaagggcgtgcggcagatcagccatgctgtgagcagcagcctgaactag

SEQ ID NO: 160174 - DNA, 1866 bp, Artificial Sequence
  Description of Artificial Sequence: Synthetic coding sequence
atggagcaggtgcctgggggcagcctgagcgccctgctgcggagcaagtggggccccctgaaggacaatgagcagaccatcggcttctacaccaagcagatcctggagggcctgaagtacctgcatgacaaccagatcgtgcaccgggacatcaagggggacaacgtgctgatcaacacctacagcggcgtgctgaagatcagtgactttggcaccagcaagaggctggccggcatcaacccctgcacagagaccttcaccggcaccctgcagtacatggcccctgagatcatcgacaagggcccccggggctacggcaaggctgctgacatctggagcctgggctgcaccatcatcgagatggccaccgggaagccacccttctatgagctgggggagccccaggccgccatgttcaaggtgggcatgttcaaggtgcaccctgagatccctgagagcatgtctgctgaggccaaggccttcatcctgaagtgctttgagccagaccctgacaagagggcctgtgccaatgacctgctggtggatgagttcctgaaggtgagcagcaagaagaagaagacccagcccaagctgagcgccctgtctgctggcagcaatgagtacctgcggagcatcagcctgcctgtgcctgtgctggtggaggacaccagcagcagcagtgaatatggctctgtgtccccagacacagagctgaaggtggaccccttctccttcaagacccgggccaagagctgtggggagagagatgtgaagggcatccgcaccctcttcctgggcatcccagatgagaactttgaggaccacagcgccccacccagccctgaggagaaggacagcggcttcttcatgctgaggaaggacagcgagcggcgggccaccctgcaccgcatcctgacagaggaccaggacaagatcgtgaggaacctgatggagagcctggcccagggcgctgaggagcccaagctgaagtgggagcacatcaccaccctcatcgccagcctgcgggagtttgtgcgcagcacagacaggaagatcatcgccaccaccctgagcaagctgaagctggagctggactttgacagccacggcatcagccaggtgcaggtggtgctgtttggcttccaggatgctgtgaacaaggtgctgaggaaccacaacatcaagccccactggatgtttgccctggacagcatcatcaggaaggctgtgcagacagccatcaccatcctggtgcctgagctgcggccccacttcagcctggccagcgagagtgacacagctgaccaggaggacctggatgtggaggatgaccacgaggagcagcccagcaaccagacagtgagaagaccccaggccgtgattgaagatgctgtggccaccagcggcgtgtccaccctgagcagcacagtgtcccatgacagccagagcgcccacaggagcctgaatgtgcagctgggccgcatgaagattgagaccaaccggctgctggaggagctggtgaggaaggagaaggagctgcaggccctgctgcaccgggccatcgaggagaaggaccaggagatcaagcacctgaagctgaagagccagcccatcgagatccctgagctgcccgtcttccacctgaacagcagcggcaccaacacagaggacagcgagctgacagactggctgcgggtgaatggagcagatgaggacaccatcagccgcttcctggccgaggactacaccctgctggatgtgctgtactacgtgaccagagatgacctgaagtgcctgcggctgcggggcggcatgctgtgcaccctgtggaaggccatcatcgacttcaggaacaagcagacctag

SEQ ID NO: 160175 - DNA, 4125 bp, Artificial Sequence
  Description of Artificial Sequence: Synthetic coding sequence
atgagcacagaagcagatgagggcatcaccttctctgtgcccccatttgcccccagcggcttctgcaccatccctgagggcggcatctgcagaagaggaggagctgctgctgtgggggagggggaggagcaccagctgcccccacctcctcctggcagcttctggaatgtggagagcgctgctgcccctggcatcggctgcccagctgccaccagcagcagcagcgccacccggggccggggcagctctgtgggcggcggcagcaggaggaccaccgtggcctacgtgatcaatgaggccagccagggccagctggtggtggccgagagcgaggccctgcagagcctgcgggaggcctgtgagaccgtgggcgccaccctggagaccctgcactttgggaagctggactttggagagaccaccgtgctggaccgcttctacaatgctgacattgctgtggtggagatgtctgatgccttccggcagcccagcctcttctaccacctgggcgtgcgggagagcttctccatggccaacaacatcatcctgtactgtgacaccaacagcgacagcctgcagagcctgaaggagatcatctgccagaagaacaccatgtgcaccggcaactacacctttgtgccctacatgatcaccccccacaacaaggtgtactgctgtgacagcagcttcatgaagggcctgacagagctgatgcagcccaactttgagctgctgctgggccccatctgcctgcccctggtggaccgcttcatccagctgctgaaggtggcccaggccagcagcagccagtacttccgggagagcatcctgaatgacatcaggaaggccaggaacctgtacaccgggaaggagctggccgctgagctggcccgcatccggcagagggtggacaacatcgaggtgctgacagctgacatcgtcatcaacctgctgctgagctacagagacatccaggactatgacagcatcgtgaagctggtggagaccctggagaagctgcccacctttgacctggccagccaccaccacgtgaagttccactacgcctttgccctgaacagaagaaacctgcccggggaccgggccaaggccctggacatcatgatccccatggtgcagagcgagggccaggtggccagtgacatgtactgcctggtgggccgcatctacaaggacatgttcctggacagcaacttcacagacacagagagccgggaccacggggcctcctggttcaagaaggcctttgaaagtgagcccaccctgcagagcggcatcaactatgctgtgctgctgctggccgccggccaccagtttgagagcagctttgagctgaggaaggtgggcgtgaagctgagcagcctgctgggcaagaagggcaacctggagaagctgcagagctactgggaggtgggcttcttcctgggcgcctctgtgctggccaatgaccacatgagggtcatccaggccagcgagaagctgttcaagctgaagaccccagcctggtacctgaagagcatcgtggagaccatcctgatctacaagcactttgtgaagctgaccacagagcagcctgtggccaagcaggagctggtggacttctggatggacttcctggtggaggccaccaagacagatgtgacagtggtgcgcttccctgtgctgatcctggagcccaccaagatctaccagcccagctacctgagcatcaacaatgaggtggaggagaagaccatcagcatctggcacgtgctgcctgatgacaagaagggcatccacgagtggaacttcagcgccagctctgtgcggggcgtgtccatcagcaagtttgaggagcgctgctgcttcctgtatgtgctgcacaacagtgatgacttccagatctacttctgcacagagctgcactgcaagaagttctttgagatggtgaacaccatcacagaggagaagggccgcagcacagaggagggggactgtgagagtgacctgctggagtatgactatgaatatgatgaaaatggagacagagtggtgctgggcaagggcacctatggaattgtgtatgccggccgggacctgagcaaccaggtgcgcatcgccatcaaggagatccctgagcgggacagccgctacagccagcccctgcacgaggagatcgccctgcacaagcacctgaagcacaagaacatcgtgcagtacctgggcagcttctctgaaaatggcttcatcaagatcttcatggagcaggtgcctgggggcagcctgagcgccctgctgcggagcaagtggggccccctgaaggacaatgagcagaccatcggcttctacaccaagcagatcctggagggcctgaagtacctgcatgacaaccagatcgtgcaccgggacatcaagggggacaacgtgctgatcaacacctacagcggcgtgctgaagatcagtgactttggcaccagcaagaggctggccggcatcaacccctgcacagagaccttcaccggcaccctgcagtacatggcccctgagatcatcgacaagggcccccggggctacggcaaggctgctgacatctggagcctgggctgcaccatcatcgagatggccaccgggaagccacccttctatgagctgggggagccccaggccgccatgttcaaggtgggcatgttcaaggtgcaccctgagatccctgagagcatgtctgctgaggccaaggccttcatcctgaagtgctttgagccagaccctgacaagagggcctgtgccaatgacctgctggtggatgagttcctgaaggtgagcagcaagaagaagaagacccagcccaagctgagcgccctgtctgctggcagcaatgagtacctgcggagcatcagcctgcctgtgcctgtgctggtggaggacaccagcagcagcagtgaatatggctctgtgtccccagacacagagctgaaggtggaccccttctccttcaagacccgggccaagagctgtggggagagagatgtgaagggcatccgcaccctcttcctgggcatcccagatgaaaattttgaggaccacagcgccccacccagccctgaggagaaggacagcggcttcttcatgctgaggaaggacagcgagcggcgggccaccctgcaccgcatcctgacagaggaccaggacaagatcgtgaggaacctgatggagagcctggcccagggcgctgaggagcccaagctgaagtgggagcacatcaccaccctgattgccagcctgcgggagtttgtgcgcagcacagacaggaagatcatcgccaccaccctgagcaagctgaagctggagctggactttgacagccacggcatcagccaggtgcaggtggtgctgtttggcttccaggatgctgtgaacaaggtgctgaggaaccacaacatcaagccccactggatgtttgccctggacagcatcatcaggaaggctgtgcagacagccatcaccatcctggtgcctgagctgcggccccacttcagcctggccagcgagagtgacacagctgaccaggaggacctggatgtggaggatgaccacgaggagcagcccagcaaccagacagtgcggcggccccaggccgtgattgaagatgctgtggccaccagcggcgtgtccaccctgagcagcacagtgtcccatgacagccagagcgcccacaggagcctgaatgtgcagctgggccgcatgaagattgagaccaaccggctgctggaggagctggtgaggaaggagaaggagctgcaggccctgctgcaccgggccatcgaggagaaggaccaggagatcaagcacctgaagctgaagagccagcccatcgagatccctgagctgcctgtgttccacctgaacagcagcggcaccaacacagaagattctgagctgacagactggctgcgggtgaatggagcagatgaggacaccatcagccgcttcctggccgaggactacaccctgctggatgtgctgtactacgtgaccagagatgacctgaagtgcctgcggctgcggggcggcatgctgtgcaccctgtggaaggccatcatcgacttcaggaacaagcagacctag

SEQ ID NO: 160176 - DNA, 3771 bp, Artificial Sequence
  Description of Artificial Sequence: Synthetic coding sequence
accctgcagagggccagcggggccgccacagaggccccccggcgctctgagcccccacctggcagcggcgtgcccagcggggagcgggcccctgagaggagaagaagaagaggaggagagggcgccgccagagatggcagctgcctggcccggcgggcccggagcagccctgagctgtggctggcccggcgctgtggctgggccggagatgctgctgctgtggccgcccggcctggagagatgagcacagaagcagatgagggcatcaccttctctgtgcccccatttgcccccagcggcttctgcaccatccctgagggcggcatctgcagaagaggaggagctgctgctgtgggggagggggaggagcaccagctgcccccacctcctcctggcagcttctggaatgtggagagcgctgctgcccctggcatcggctgcccagctgccaccagcagcagcagcgccacccggggccggggcagctctgtgggcggcggcagcaggaggaccaccgtggcctacgtgatcaatgaggccagccagggccagctggtggtggccgagagcgaggccctgcagagcctgcgggaggcctgtgagaccgtgggcgccaccctggagaccctgcactttgggaagctggactttggagagaccaccgtgctggaccgcttctacaatgctgacattgctgtggtggagatgtctgatgccttccggcagcccagcctcttctaccacctgggcgtgcgggagagcttctccatggccaacaacatcatcctgtactgtgacaccaacagcgacagcctgcagagcctgaaggagatcatctgccagaagaacaccatgtgcaccggcaactacacctttgtgccctacatgatcaccccccacaacaaggtgtactgctgtgacagcagcttcatgaagggcctgacagagctgatgcagcccaactttgagctgctgctgggccccatctgcctgcccctggtggaccgcttcatccagctgctgaaggtggcccaggccagcagcagccagtacttccgggagagcatcctgaatgacatcaggaaggccaggaacctgtacaccgggaaggagctggccgctgagctggcccgcatccggcagagggtggacaacatcgaggtgctgacagctgacatcgtcatcaacctgctgctgagctacagagacatccaggactatgacagcatcgtgaagctggtggagaccctggagaagctgcccacctttgacctggccagccaccaccacgtgaagttccactacgcctttgccctgaacagaagaaacctgcccggggaccgggccaaggccctggacatcatgatccccatggtgcagagcgagggccaggtggccagtgacatgtactgcctggtgggccgcatctacaaggacatgttcctggacagcaacttcacagacacagagagccgggaccacggggcctcctggttcaagaaggcctttgaaagtgagcccaccctgcagagcggcatcaactatgctgtgctgctgctggccgccggccaccagtttgagagcagctttgagctgaggaaggtgggcgtgaagctgagcagcctgctgggcaagaagggcaacctggagaagctgcagagctactgggaggtgggcttcttcctgggcgcctctgtgctggccaatgaccacatgagggtcatccaggccagcgagaagctgttcaagctgaagaccccagcctggtacctgaagagcatcgtggagaccatcctgatctacaagcactttgtgaagctgaccacagagcagcctgtggccaagcaggagctggtggacttctggatggacttcctggtggaggccaccaagacagatgtgacagtggtgcgcttccctgtgctgatcctggagcccaccaagatctaccagcccagctacctgagcatcaacaatgaggtggaggagaagaccatcagcatctggcacgtgctgcctgatgacaagaagggcatccacgagtggaacttcagcgccagctctgtgcggggcgtgtccatcagcaagtttgaggagcgctgctgcttcctgtatgtgctgcacaacagtgatgacttccagatctacttctgcacagagctgcactgcaagaagttctttgagatggtgaacaccatcacagaggagaagggccgcagcacagaggagggggactgtgagagtgacctgctggagtatgactatgaatatgatgaaaatggagacagagtggtgctgggcaagggcacctatggaattgtgtatgccggccgggacctgagcaaccaggtgcgcatcgccatcaaggagatccctgagcgggacagccgctacagccagcccctgcacgaggagatcgccctgcacaagcacctgaagcacaagaacatcgtgcagtacctgggcagcttctctgaaaatggcttcatcaagatcttcatggagcaggtgcctgggggcagcctgagcgccctgctgcggagcaagtggggccccctgaaggacaatgagcagaccatcggcttctacaccaagcagatcctggagggcctgaagtacctgcatgacaaccagatcgtgcaccgggacatcaagggggacaacgtgctgatcaacacctacagcggcgtgctgaagatcagtgactttggcaccagcaagaggctggccggcatcaacccctgcacagagaccttcaccggcaccctgcagtacatggcccctgagatcatcgacaagggcccccggggctacggcaaggctgctgacatctggagcctgggctgcaccatcatcgagatggccaccgggaagccacccttctatgagctgggggagccccaggccgccatgttcaaggtgggcatgttcaaggtgcaccctgagatccctgagagcatgtctgctgaggccaaggccttcatcctgaagtgctttgagccagaccctgacaagagggcctgtgccaatgacctgctggtggatgagttcctgaaggtgagcagcaagaagaagaagacccagcccaagctgagtgacctgagcatcgcccaggccgagtacctgcggagcatcagcctgcctgtgcctgtgctggtggaggacaccagcagcagcagtgaatatggctctgtgtccccagacacagagctgaaggtggaccccttctccttcaagacccgggccaagagctgtggggagagagatgtgaagggcatccgcaccctcttcctgggcatcccagatgaaaattttgaggaccacagcgccccacccagccctgaggagaaggacagcggcttcttcatgctgaggaaggacagcgagcggcgggccaccctgcaccgcatcctgacagaggaccaggacaagatcgtgaggaacctgatggagagcctggcccagggcgctgaggagcccaagctgaagtgggagcacatcaccaccctgattgccagcctgcgggagtttgtgcgcagcacagacaggaagatcatcgccaccaccctgagcaagctgaagctggagctggactttgacagccacggcatcagccaggtgcaggtggtgctgtttggcttccaggatgctgtgaacaaggtgctgaggaaccacaacatcaagccccactggatgtttgccctggacagcatcatcaggaaggctgtgcagacagccatcaccatcctggtgcccggcatcaagccctag

SEQ ID NO: 160177 - DNA, 3867 bp, Artificial Sequence
  Description of Artificial Sequence: Synthetic coding sequence
atggccggcccctgccccaggtctggagctgagagagctggcagctgctggcaggaccccctggccgtggccctgagccggggccggcagctggccgcccctcctggccggggctgtgcccggagccggcccctgtctgtggtgtatgtgctgacccgggagccccagcccggcctggagccccgggagggcacagaagctgagcccctgcccctgcgctgcctgcgggaggcctgtgcccaggtgccccggccccggcccccaccccagctgcggagcctgcccttcggcaccctggagctgggggacacagctgccctggatgccttctacaatgctgatgtggtggtgctggaggtgagcagcagcctggtgcagcccagcctcttctaccacctgggcgtgcgggagagcttctccatgaccaacaacgtgctgctgtgcagccaggccgacctgcctgacctgcaggccctgagagaagatgtgttccagaagaacagcgactgtgtgggcagctacaccctcatcccctacgtggtgacagccaccggccgggtgctgtgtggagatgctggcctgctgcggggcctggctgatggcctggtgcaggccggcgtgggcacagaggccctgctgacccccctggtgggccgcctggcccggctgctggaggccacccccacagacagctgtggctacttccgggagaccatccggcgggacatccggcaggcccgggagcgcttcagcggcccccagctgcggcaggagctggcccggctgcagaggcggctggacagcgtggagctgctgagcccagacatcatcatgaacctgctgctgagctacagagatgtgcaggactacagcgccatcatcgagctggtggagaccctgcaggccctgcccacctgtgatgtggccgagcagcacaacgtgtgcttccactacacctttgccctgaacagaagaaacagacctggggaccgggccaaggccctgtctgtgctgctgcccctggtgcagctggagggctctgtggccccagacctgtactgcatgtgtggccgcatctacaaggacatgttcttcagcagcggcttccaggatgctggccaccgggagcaggcctaccactggtacaggaaggcctttgatgtggagcccagcctgcacagcggcatcaatgctgctgtgctgctgattgctgctggccagcactttgaggacagcaaggagctgcggctcatcggcatgaagctgggctgcctgctggccaggaagggctgtgtggagaagatgcagtactactgggatgtgggcttctacctgggcgcccagatcctggccaatgaccccacccaggtggtgctggccgctgagcagctgtacaagctgaatgcccccatctggtacctggtgtctgtgatggagaccttcctgctgtaccagcacttccggcccaccccagagcccccaggcggccccccaagaagagcccacttctggctgcacttcctgctgcagagctgccagcccttcaagacagcctgtgcccagggcgaccagtgcctggtgctggtgctggagatgaacaaggtgctgctgcctgccaagctggaggtgcggggcacagatcctgtgtccacagtgaccctgagcctgctggagcctgagacccaggacatccccagctcctggaccttccctgtggccagcatctgtggggtgtctgccagcaagagagatgagcgctgctgcttcctgtatgccctgcccccagcccaggatgtgcagctgtgcttccccagcgtgggccactgccagtggttctgtggcctcatccaggcctgggtgaccaacccagacagcacagccccagctgaggaggccgagggcgctggggagatgctggagtttgattatgagtacacagagaccggggagcggctggtgctgggcaagggcacctatggagtggtgtatgccggccgggacagacacaccagggtgcgcatcgccatcaaggagatccctgagcgggacagccgcttcagccagcccctgcacgaggagatcgccctgcaccggcggctgcggcacaagaacatcgtgcgctacctgggcagcgccagccagggcggctacctgaagatcttcatggaggaggtgcctgggggcagcctgagcagcctgctgcggtctgtgtggggccccctgaaggacaatgaaagcaccatctccttctacacccggcagatcctgcagggcctgggctacctgcatgacaaccacatcgtgcaccgggacatcaagggggacaacgtgctgatcaacaccttcagcggcctgctgaagatcagtgactttggcaccagcaagaggctggccggcatcaccccctgcacagagaccttcaccggcaccctgcagtacatggcccctgagatcatcgaccagggcccccggggctacggcaaggctgctgacatctggagcctgggctgcaccgtcatcgagatggccaccggccggccccccttccacgagctgggcagcccccaggccgccatgttccaggtgggcatgtacaaggtgcacccccccatgcccagcagcctgtctgctgaggcccaggccttcctgctgcggacctttgagccagacccccggctgcgggccagcgcccagaccctgctgggggaccccttcctgcagcccgggaagaggagccgcagccccagcagccccaggcatgccccccggcccagtgatgcccccagcgccagccccaccccatctgccaacagcaccacccagagccagaccttcccctgcccccaggcccccagccagcacccccccagcccccccaagcgctgcctgtcctatggaggcaccagccagctgcgggtgcctgaggagcctgctgctgaggagcccgccagccctgaggagagcagcggcctgagcctgctgcaccaggagagcaagaggcgggccatgctggccgctgtgctggagcaggagctgcctgccctggccgagaacctgcaccaggagcagaagcaggagcagggcgcccggctgggcagaaatcatgtggaggagctgctgcgctgcctgggcgcccacatccacacccccaacagacggcagctggcccaggagctgcgggccctgcagggccgcctgcgggcccagggcctgggccctgccctgctgcaccggcccctgtttgccttcccagatgctgtgaagcagatcctgaggaagaggcagatccggccccactggatgtttgtgctggacagcctgctgagcagagctgtgcgggccgccctgggcgtgctgggccctgaggtggagaaggaggccgtgagccccaggtctgaggagctgagcaatgaaggagacagccagcagagccctggccagcagagccccctgcctgtggagcctgagcagggccctgcccccctgatggtgcagctgagcctgctgcgggcagagacagaccggctgcgggagatcctggccggcaaggagcgggagtaccaggccctggtgcagagggccctgcagaggctgaatgaggaggcccggacctacgtgctggcccctgagcccccaacagccctgagcacagaccagggcctggtgcagtggctgcaggagctgaatgtggacagcggcaccatccagatgctgctgaaccacagcttcaccctgcacaccctgctgacctacgccaccagagatgacctgatctacacccgcatccggggcggcatggtgtgccgcatctggagggccatcctggcccagagagctggcagcacccctgtgaccagcggcccctag

SEQ ID NO: 160178 - DNA, 315 bp, Artificial Sequence
  Description of Artificial Sequence: Synthetic coding sequence
atggtgcagctgagcctgctgcgggcagagacagaccggctgcgggagatcctggccggcaaggagcgggagtaccaggccctggtgcagagggccctgcagaggctgaatgaggaggcccggacctacgtgctggcccctgagcccccaacagccctgagcacagaccagggcctggtgcagtggctgcaggagctgaatgtggacagcggcaccatccagatgggcagagatggcatgccccacctggagggccacctgggcacagccagccgcatccacaccagccacctgtggaccctgcgggcagagtag

SEQ ID NO: 160179 - DNA, 3843 bp, Artificial Sequence
  Description of Artificial Sequence: Synthetic coding sequence
atggccggcccctgccccaggtctggagctgagagagctggcagctgctggcaggaccccctggccgtggccctgagccggggccggcagctggccgcccctcctggccggggctgtgcccggagccggcccctgtctgtggtgtatgtgctgacccgggagccccagcccggcctggagccccgggagggcacagaagctgagcccctgcccctgcgctgcctgcgggaggcctgtgcccaggtgccccggccccggcccccaccccagctgcggagcctgcccttcggcaccctggagctgggggacacagctgccctggatgccttctacaatgctgatgtggtggtgctggaggtgagcagcagcctggtgcagcccagcctcttctaccacctgggcgtgcgggagagcttctccatgaccaacaacgtgctgctgtgcagccaggccgacctgcctgacctgcaggccctgcgggactgtgtgggcagctacaccctcatcccctacgtggtgacagccaccggccgggtgctgtgtggagatgctggcctgctgcggggcctggctgatggcctggtgcaggccggcgtgggcacagaggccctgctgacccccctggtgggccgcctggcccggctgctggaggccacccccacagacagctgtggctacttccgggagaccatccggcgggacatccggcaggcccgggagcgcttcagcggcccccagctgcggcaggagctggcccggctgcagaggcggctggacagcgtggagctgctgagcccagacatcatcatgaacctgctgctgagctacagagatgtgcaggactacagcgccatcatcgagctggtggagaccctgcaggccctgcccacctgtgatgtggccgagcagcacaacgtgtgcttccactacacctttgccctgaacagaagaaacagacctggggaccgggccaaggccctgtctgtgctgctgcccctggtgcagctggagggctctgtggccccagacctgtactgcatgtgtggccgcatctacaaggacatgttcttcagcagcggcttccaggatgctggccaccgggagcaggcctaccactggtacaggaaggcctttgatgtggagcccagcctgcacagcggcatcaatgctgctgtgctgctgattgctgctggccagcactttgaggacagcaaggagctgcggctcatcggcatgaagctgggctgcctgctggccaggaagggctgtgtggagaagatgcagtactactgggatgtgggcttctacctgggcgcccagatcctggccaatgaccccacccaggtggtgctggccgctgagcagctgtacaagctgaatgcccccatctggtacctggtgtctgtgatggagaccttcctgctgtaccagcacttccggcccaccccagagcccccaggcggccccccaagaagagcccacttctggctgcacttcctgctgcagagctgccagcccttcaagacagcctgtgcccagggcgaccagtgcctggtgctggtgctggagatgaacaaggtgctgctgcctgccaagctggaggtgcggggcacagatcctgtgtccacagtgaccctgagcctgctggagcctgagacccaggacatccccagctcctggaccttccctgtggccagcatctgtggggtgtctgccagcaagagagatgagcgctgctgcttcctgtatgccctgcccccagcccaggatgtgcagctgtgcttccccagcgtgggccactgccagtggttctgtggcctcatccaggcctgggtgaccaacccagacagcacagccccagctgaggaggccgagggcgctggggagatgctggagtttgattatgagtacacagagaccggggagcggctggtgctgggcaagggcacctatggagtggtgtatgccggccgggacagacacaccagggtgcgcatcgccatcaaggagatccctgagcgggacagccgcttcagccagcccctgcacgaggagatcgccctgcaccggcggctgcggcacaagaacatcgtgcgctacctgggcagcgccagccagggcggctacctgaagatcttcatggaggaggtgcctgggggcagcctgagcagcctgctgcggtctgtgtggggccccctgaaggacaatgaaagcaccatctccttctacacccggcagatcctgcagggcctgggctacctgcatgacaaccacatcgtgcaccgggacatcaagggggacaacgtgctgatcaacaccttcagcggcctgctgaagatcagtgactttggcaccagcaagaggctggccggcatcaccccctgcacagagaccttcaccggcaccctgcagtacatggcccctgagatcatcgaccagggcccccggggctacggcaaggctgctgacatctggagcctgggctgcaccgtcatcgagatggccaccggccggccccccttccacgagctgggcagcccccaggccgccatgttccaggtgggcatgtacaaggtgcacccccccatgcccagcagcctgtctgctgaggcccaggccttcctgctgcggacctttgagccagacccccggctgcgggccagcgcccagaccctgctgggggaccccttcctgcagcccgggaagaggagccgcagccccagcagccccaggcatgccccccggcccagtgatgcccccagcgccagccccaccccatctgccaacagcaccacccagagccagaccttcccctgcccccaggcccccagccagcacccccccagcccccccaagcgctgcctgtcctatggaggcaccagccagctgcgggtgcctgaggagcctgctgctgaggagcccgccagccctgaggagagcagcggcctgagcctgctgcaccaggagagcaagaggcgggccatgctggccgctgtgctggagcaggagctgcctgccctggccgagaacctgcaccaggagcagaagcaggagcagggcgcccggctgggcagaaatcatgtggaggagctgctgcgctgcctgggcgcccacatccacacccccaacagacggcagctggcccaggagctgcgggccctgcagggccgcctgcgggcccagggcctgggccctgccctgctgcaccggcccctgtttgccttcccagatgctgtgaagcagatcctgaggaagaggcagatccggccccactggatgtttgtgctggacagcctgctgagcagagctgtgcgggccgccctgggcgtgctgggccctgaggtggagaaggaggccgtgagccccaggtctgaggagctgagcaatgaaggagacagccagcagagccctggccagcagagccccctgcctgtggagcctgagcagggccctgcccccctgatggtgcagctgagcctgctgcgggcagagacagaccggctgcgggagatcctggccggcaaggagcgggagtaccaggccctggtgcagagggccctgcagaggctgaatgaggaggcccggacctacgtgctggcccctgagcccccaacagccctgagcacagaccagggcctggtgcagtggctgcaggagctgaatgtggacagcggcaccatccagatgctgctgaaccacagcttcaccctgcacaccctgctgacctacgccaccagagatgacctgatctacacccgcatccggggcggcatggtgtgccgcatctggagggccatcctggcccagagagctggcagcacccctgtgaccagcggcccctag

SEQ ID NO: 160180 - DNA, 2397 bp, Artificial Sequence
  Description of Artificial Sequence: Synthetic coding sequence
tgaatgaacctgctgctgagctacagagatgtgcaggactacagcgccatcatcgagctggtggagaccctgcaggccctgcccacctgtgatgtggccgagcagcacaacgtgtgcttccactacacctttgccctgaacagaagaaacagacctggggaccgggccaaggccctgtctgtgctgctgcccctggtgcagctggagggctctgtggccccagacctgtactgcatgtgtggccgcatctacaaggacatgttcttcagcagcggcttccaggatgctggccaccgggagcaggcctaccactggtacaggaaggcctttgatgtggagcccagcctgcacagcggcatcaatgctgctgtgctgctgattgctgctggccagcactttgaggacagcaaggagctgcggctcatcggcatgaagctgggctgcctgctggccaggaagggctgtgtggagaagatgcagtactactgggatgtgggcttctacctgggcgcccagatcctggccaatgaccccacccaggtggtgctggccgctgagcagctgtacaagctgaatgcccccatctggtacctggtgtctgtgatggagaccttcctgctgtaccagcacttccggcccaccccagagcccccaggcggccccccaagaagagcccacttctggctgcacttcctgctgcagagctgccagcccttcaagacagcctgtgcccagggcgaccagtgcctggtgctggtgctggagatgaacaaggtgctgctgcctgccaagctggaggtgcggggcacagatcctgtgtccacagtgaccctgagcctgctggagcctgagacccaggacatccccagctcctggaccttccctgtggccagcatctgtggggtgtctgccagcaagagagatgagcgctgctgcttcctgtatgccctgcccccagcccaggatgtgcagctgtgcttccccagcgtgggccactgccagtggttctgtggcctcatccaggcctgggtgaccaacccagacagcacagccccagctgaggaggccgagggcgctggggagatgctggagtttgattatgagtacacagagaccggggagcggctggtgctgggcaagggcacctatggagtggtgtatgccggccgggacagacacaccagggtgcgcatcgccatcaaggagatccctgagcgggacagccgcttcagccagcccctgcacgaggagatcgccctgcaccggcggctgcggcacaagaacatcgtgcgctacctgggcagcgccagccagggcggctacctgaagatcttcatggaggaggtgcctgggggcagcctgagcagcctgctgcggtctgtgtggggccccctgaaggacaatgaaagcaccatctccttctacacccggcagatcctgcagggcctgggctacctgcatgacaaccacatcgtgcaccgggacatcaagggggacaacgtgctgatcaacaccttcagcggcctgctgaagatcagtgactttggcaccagcaagaggctggccggcatcaccccctgcacagagaccttcaccggcaccctgcagtacatggcccctgagatcatcgaccagggcccccggggctacggcaaggctgctgacatctggagcctgggctgcaccgtcatcgagatggccaccggccggccccccttccacgagctgggcagcccccaggccgccatgttccaggtgggcatgtacaaggtgcacccccccatgcccagcagcctgtctgctgaggcccaggccttcctgctgcggacctttgagccagacccccggctgcgggccagcgcccagaccctgctgggggaccccttcctgcagcccgggaagaggagccgcagccccagcagccccaggcatgccccccggcccagtgatgcccccagcgccagccccaccccatctgccaacagcaccacccagagccagaccttcccctgcccccaggcccccagccagcacccccccagcccccccaagcgctgcctgtcctatggaggcaccagccagctgcgggtgcctgaggagcctgctgctgaggagcccgccagccctgaggagagcagcggcctgagcctgctgcaccaggagagcaagaggcgggccatgctggccgctgtgctggagcaggagctgcctgccctggccgagaacctgcaccaggagcagaagcaggagcagggcgcccggctgggcagaaatcatgtggaggagctgctgcgctgcctgggcgcccacatccacacccccaacagacggcagctggcccaggagctgcgggccctgcagggctggatgaatggagaagataaaggcagcttctag

SEQ ID NO: 160181 - DNA, 249 bp, Artificial Sequence
  Description of Artificial Sequence: Synthetic coding sequence
tgagaataccaggccctggtgcagagggccctgcagaggctgaatgaggaggcccggacctacgtgctggcccctgagcccccaacagccctgagcacagaccagggcctggtgcagtggctgcaggagctgaatgtggacagcggcaccatccagatgggcagagatggcatgccccacctggagggccacctgggcacagccagccgcatccacaccagccacctgtggaccctgcgggcagagtag

SEQ ID NO: 160182 - DNA, 3867 bp, Artificial Sequence; identical to SEQ ID NO: 160177
  Description of Artificial Sequence: Synthetic coding sequence

SEQ ID NO: 160183 - DNA, 2394 bp, Artificial Sequence
  Description of Artificial Sequence: Synthetic coding sequence
atgaacctgctgctgagctacagagatgtgcaggactacagcgccatcatcgagctggtggagaccctgcaggccctgcccacctgtgatgtggccgagcagcacaacgtgtgcttccactacacctttgccctgaacagaagaaacagacctggggaccgggccaaggccctgtctgtgctgctgcccctggtgcagctggagggctctgtggccccagacctgtactgcatgtgtggccgcatctacaaggacatgttcttcagcagcggcttccaggatgctggccaccgggagcaggcctaccactggtacaggaaggcctttgatgtggagcccagcctgcacagcggcatcaatgctgctgtgctgctgattgctgctggccagcactttgaggacagcaaggagctgcggctgattggcatgaagctgggctgcctgctggccaggaagggctgtgtggagaagatgcagtactactgggatgtgggcttctacctgggcgcccagatcctggccaatgaccccacccaggtggtgctggccgctgagcagctgtacaagctgaatgcccccatctggtacctggtgtctgtgatggagaccttcctgctgtaccagcacttccggcccaccccagagcccccaggcggccccccccggcgggcccacttctggctgcacttcctgctgcagagctgccagcccttcaagacagcctgtgcccagggcgaccagtgcctggtgctggtgctggagatgaacaaggtgctgctgcctgccaagctggaggtgcggggcacagatcctgtgtccacagtgaccctgagcctgctggagcctgagacccaggacatccccagctcctggaccttccctgtggccagcatctgtggggtgtctgccagcaagagagatgagcgctgctgcttcctgtatgccctgcccccagcccaggatgtgcagctgtgcttccccagcgtgggccactgccagtggttctgtggcctcatccaggcctgggtgaccaacccagacagcacagccccagctgaggaggccgagggcgctggggagatgctggagtttgattatgagtacacagaaacaggagagcggctggtgctgggcaagggcacctacggcgtggtgtatgccggccgggacagacacaccagggtgagaattgccatcaaggagatccctgagcgggacagccgcttcagccagcccctgcacgaggagatcgccctgcaccggcggctgcggcacaagaacatcgtgcgctacctgggcagcgccagccagggcggctacctgaagatcttcatggaggaggtgcctgggggcagcctgagcagcctgctgcggtctgtgtggggccccctgaaggacaatgaaagcaccatctccttctacacccggcagatcctgcagggcctgggctacctgcatgacaaccacatcgtgcaccgggacatcaagggggacaacgtgctgatcaacaccttcagcggcctgctgaagatcagtgactttggcaccagcaagaggctggccggcatcaccccctgcacagagaccttcaccggcaccctgcagtacatggcccctgagatcatcgaccagggcccccggggctacggcaaggctgctgacatctggagcctgggctgcaccgtgattgagatggccaccggccggccccccttccacgagctgggcagcccccaggccgccatgttccaggtgggcatgtacaaggtgcacccccccatgcccagcagcctgtctgctgaggcccaggccttcctgctgcggacctttgagccagacccccggctgcgggccagcgcccagaccctgctgggggaccccttcctgcagcccgggaagaggagccgcagccccagcagccccaggcatgccccccggcccagtgatgcccccagcgccagccccacccccagcgccaacagcaccacccagagccagaccttcccctgcccccaggcccccagccagcacccccccagcccccccaagcgctgcctgtcctatggaggcaccagccagctgcgggtgcctgaggagcctgctgctgaggagcccgccagccctgaggagagcagcggcctgagcctgctgcaccaggagagcaagagaagagccatgctggccgctgtgctggagcaggagctgcctgccctggccgagaacctgcaccaggagcagaagcaggagcagggcgcccggctgggcaggaaccacgtggaggagctgctgcgctgcctgggcgcccacatccacacccccaacagacggcagctggcccaggagctgcgggccctgcagggctggatgaatggagaggacaagggcagcttctag

SEQ ID NO: 160184 - DNA, 783 bp, Artificial Sequence
  Description of Artificial Sequence: Synthetic coding sequence
atggacatcgccagcaccaacaccagcaacaagagtgacaccaacatggagcaggtgcctgccaccaatgacaccatcaagaggctggagagcaagctgctgaagaaccaggccaagcagcagagcgagagcggccgcctgagcctgggcgccagccggggcagctctgtggagagcctgccccccaccagcgagggcaagaggatgtctgctgacatgtctgaaattgaggccagaattgctgccaccactggaaatggccagcccaggagaagaagcatccaggacctgactgtgactggaacagagcccggccaggtgagcagccgcagcagcagccccagcgtgaggatgatcaccaccagcggccccaccagcgagaagcccaccaggagccacccctggaccccagatgacagcacagacaccaacggcagtgacaacagcatccccatggcctacctgaccctggaccaccagctgcagcccctggccccctgccccaacagcaaggagagcatggctgtgtttgagcagcactgcaagatggcccaggagtacatgaaggtgcagacagagatcgccctgctgctgcagaggaagcaggagctggtggccgagctggaccaggatgagaaggaccagcagaacaccagccggctggtgcaggagcacaagaagctgctggatgagaacaagagcctgagcacctactaccagcagtgcaagaagcagctggaggtgatccgcagccagcagcagaagaggcagggcaccagctag

SEQ ID NO: 160185 - DNA, 1557 bp, Artificial Sequence
  Description of Artificial Sequence: Synthetic coding sequence
atgagcacagccagcgctgccagcagcagcagcagcagcagcgctggggagatgattgaggcccccagccaggtgctgaactttgaggagattgactacaaggagattgaggtggaggaggtggtgggccgcggggcctttggagtggtgtgcaaggccaagtggagggccaaggatgtggccatcaagcagattgaaagtgaaagtgagaggaaggccttcatcgtggagctgcggcagctgagccgggtgaaccaccccaacatcgtgaagctgtatggagcctgcctgaaccctgtgtgcctggtgatggagtatgcagagggcggcagcctgtacaacgtgctgcatggagctgagcccctgccctactacacagctgcccacgccatgtcctggtgcctgcagtgcagccagggcgtggcctacctgcacagcatgcagcccaaggccctgatccaccgggacctgaagccacccaacctgctgctggtggccggcggcaccgtgctgaagatctgtgactttggaacagcctgtgacatccagacccacatgaccaacaacaagggcagcgctgcctggatggcccctgaggtgtttgagggcagcaactacagcgagaagtgtgatgtgttctcctggggcatcatcctgtgggaggtgatcaccaggaggaagccctttgatgagatcggcggccctgccttccgcatcatgtgggccgtgcacaacggcaccaggcctcctctcatcaagaacctgcccaagcccatcgagagcctgatgacccgctgctggagcaaggaccccagccagaggcccagcatggaggagatcgtgaagatcatgacccacctgatgagatacttccctggagcagatgagcccctgcagtacccctgccagtacagtgatgagggccagagcaacagcgccaccagcacaggcagcttcatggacatcgccagcaccaacaccagcaacaagagtgacaccaacatggagcaggtgcctgccaccaatgacaccatcaagaggctggagagcaagctgctgaagaaccaggccaagcagcagagcgagagcggccgcctgagcctgggcgccagccggggcagctctgtggagagcctgccccccaccagcgagggcaagaggatgtctgctgacatgtctgaaattgaggccagaattgctgccaccacagcctacagcaagcccaagaggggccacaggaagacagccagctttggaaacatcctggatgtgcctgagatcgtcatctctggaaatggccagcccaggagaagaagcatccaggacctgactgtgactggaacagagcccggccaggtgagcagccgcagcagcagccccagcgtgaggatgatcaccaccagcggccccaccagcgagaagcccaccaggagccacccctggaccccagatgacagcacagacaccaacggcagtgacaacagcatccccatggcctacctgaccctggaccaccagctgcaggcccggaccagctgcaggactggacctggatag

SEQ ID NO: 160186 - DNA, 1476 bp, Artificial Sequence
  Description of Artificial Sequence: Synthetic coding sequence
atgagcacagccagcgctgccagcagcagcagcagcagcagcgctggggagatgattgaggcccccagccaggtgctgaactttgaggagattgactacaaggagattgaggtggaggaggtggtgggccgcggggcctttggagtggtgtgcaaggccaagtggagggccaaggatgtggccatcaagcagattgaaagtgaaagtgagaggaaggccttcatcgtggagctgcggcagctgagccgggtgaaccaccccaacatcgtgaagctgtatggagcctgcctgaaccctgtgtgcctggtgatggagtatgcagagggcggcagcctgtacaacgtgctgcatggagctgagcccctgccctactacacagctgcccacgccatgtcctggtgcctgcagtgcagccagggcgtggcctacctgcacagcatgcagcccaaggccctgatccaccgggacctgaagccacccaacctgctgctggtggccggcggcaccgtgctgaagatctgtgactttggaacagcctgtgacatccagacccacatgaccaacaacaagggcagcgctgcctggatggcccctgaggtgtttgagggcagcaactacagcgagaagtgtgatgtgttctcctggggcatcatcctgtgggaggtgatcaccaggaggaagccctttgatgagatcggcggccctgccttccgcatcatgtgggccgtgcacaacggcaccaggcctcctctcatcaagaacctgcccaagcccatcgagagcctgatgacccgctgctggagcaaggaccccagccagaggcccagcatggaggagatcgtgaagatcatgacccacctgatgagatacttccctggagcagatgagcccctgcagtacccctgccagtacagtgatgagggccagagcaacagcgccaccagcacaggcagcttcatggacatcgccagcaccaacaccagcaacaagagtgacaccaacatggagcaggtgcctgccaccaatgacaccatcaagaggctggagagcaagctgctgaagaaccaggccaagcagcagagcgagagcggccgcctgagcctgggcgccagccggggcagctctgtggagagcctgccccccaccagcgagggcaagaggatgtctgctgacatgtctgaaattgaggccagaattgctgccaccactggaaatggccagccccggcggcgcagcatccaggacctgactgtgactggaacagagcccggccaggtgagcagccgcagcagcagccccagcgtgaggatgatcaccaccagcggccccaccagcgagaagcccaccaggagccacccctggaccccagatgacagcacagacaccaatggaagtgacaacagcatccccatggcctacctgaccctggaccaccagctgcaggcccggaccagctgcaggacaggccctggatag

SEQ ID NO: 160187 - DNA, 1821 bp, Artificial Sequence
  Description of Artificial Sequence: Synthetic coding sequence
atgagcacagccagcgctgccagcagcagcagcagcagcagcgctggggagatgattgaggcccccagccaggtgctgaactttgaggagattgactacaaggagattgaggtggaggaggtggtgggccgcggggcctttggagtggtgtgcaaggccaagtggagggccaaggatgtggccatcaagcagattgaaagtgaaagtgagaggaaggccttcatcgtggagctgcggcagctgagccgggtgaaccaccccaacatcgtgaagctgtatggagcctgcctgaaccctgtgtgcctggtgatggagtatgcagagggcggcagcctgtacaacgtgctgcatggagctgagcccctgccctactacacagctgcccacgccatgtcctggtgcctgcagtgcagccagggcgtggcctacctgcacagcatgcagcccaaggccctgatccaccgggacctgaagccacccaacctgctgctggtggccggcggcaccgtgctgaagatctgtgactttggaacagcctgtgacatccagacccacatgaccaacaacaagggcagcgctgcctggatggcccctgaggtgtttgagggcagcaactacagcgagaagtgtgatgtgttctcctggggcatcatcctgtgggaggtgatcaccaggaggaagccctttgatgagatcggcggccctgccttccgcatcatgtgggccgtgcacaacggcaccaggcctcctctcatcaagaacctgcccaagcccatcgagagcctgatgacccgctgctggagcaaggaccccagccagaggcccagcatggaggagatcgtgaagatcatgacccacctgatgagatacttccctggagcagatgagcccctgcagtacccctgccagtacagtgatgagggccagagcaacagcgccaccagcacaggcagcttcatggacatcgccagcaccaacaccagcaacaagagtgacaccaacatggagcaggtgcctgccaccaatgacaccatcaagaggctggagagcaagctgctgaagaaccaggccaagcagcagagcgagagcggccgcctgagcctgggcgccagccggggcagctctgtggagagcctgccccccaccagcgagggcaagaggatgtctgctgacatgtctgaaattgaggccagaattgctgccaccacagcctacagcaagcccaagaggggccacaggaagacagccagctttggaaacatcctggatgtgcctgagatcgtcatctctggaaatggccagcccaggagaagaagcatccaggacctgactgtgactggaacagagcccggccaggtgagcagccgcagcagcagccccagcgtgaggatgatcaccaccagcggccccaccagcgagaagcccaccaggagccacccctggaccccagatgacagcacagacaccaacggcagtgacaacagcatccccatggcctacctgaccctggaccaccagctgcagcccctggccccctgccccaacagcaaggagagcatggctgtgtttgagcagcactgcaagatggcccaggagtacatgaaggtgcagacagagatcgccctgctgctgcagaggaagcaggagctggtggccgagctggaccaggatgagaaggaccagcagaacaccagccggctggtgcaggagcacaagaagctgctggatgagaacaagagcctgagcacctactaccagcagtgcaagaagcagctggaggtgatccgcagccagcagcagaagaggcagggcaccagctag

SEQ ID NO: 160188 - DNA, 1740 bp, Artificial Sequence
  Description of Artificial Sequence: Synthetic coding sequence
atgagcacagccagcgctgccagcagcagcagcagcagcagcgctggggagatgattgaggcccccagccaggtgctgaactttgaggagattgactacaaggagattgaggtggaggaggtggtgggccgcggggcctttggagtggtgtgcaaggccaagtggagggccaaggatgtggccatcaagcagattgaaagtgaaagtgagaggaaggccttcatcgtggagctgcggcagctgagccgggtgaaccaccccaacatcgtgaagctgtatggagcctgcctgaaccctgtgtgcctggtgatggagtatgcagagggcggcagcctgtacaacgtgctgcatggagctgagcccctgccctactacacagctgcccacgccatgtcctggtgcctgcagtgcagccagggcgtggcctacctgcacagcatgcagcccaaggccctgatccaccgggacctgaagccacccaacctgctgctggtggccggcggcaccgtgctgaagatctgtgactttggaacagcctgtgacatccagacccacatgaccaacaacaagggcagcgctgcctggatggcccctgaggtgtttgagggcagcaactacagcgagaagtgtgatgtgttctcctggggcatcatcctgtgggaggtgatcaccaggaggaagccctttgatgagatcggcggccctgccttccgcatcatgtgggccgtgcacaacggcaccaggcctcctctcatcaagaacctgcccaagcccatcgagagcctgatgacccgctgctggagcaaggaccccagccagaggcccagcatggaggagatcgtgaagatcatgacccacctgatgagatacttccctggagcagatgagcccctgcagtacccctgccagtacagtgatgagggccagagcaacagcgccaccagcacaggcagcttcatggacatcgccagcaccaacaccagcaacaagagtgacaccaacatggagcaggtgcctgccaccaatgacaccatcaagaggctggagagcaagctgctgaagaaccaggccaagcagcagagcgagagcggccgcctgagcctgggcgccagccggggcagctctgtggagagcctgccccccaccagcgagggcaagaggatgtctgctgacatgtctgaaattgaggccagaattgctgccaccactggaaatggccagccccggcggcgcagcatccaggacctgactgtgactggaacagagcccggccaggtgagcagccgcagcagcagccccagcgtgaggatgatcaccaccagcggccccaccagcgagaagcccaccaggagccacccctggaccccagatgacagcacagacaccaatggaagtgacaacagcatccccatggcctacctgaccctggaccaccagctgcagcccctggccccctgccccaacagcaaggagagcatggctgtgtttgagcagcactgcaagatggcccaggagtacatgaaggtgcagacagaaattgccctgctgctgcagaggaagcaggagctggtggccgagctggaccaggatgagaaggaccagcagaacaccagccggctggtgcaggagcacaagaagctgctggatgagaacaagagcctgagcacctactaccagcagtgcaagaagcagctggaggtgatccgcagccagcagcagaagaggcagggcaccagctag

SEQ ID NO: 160189 - DNA, 1257 bp, Artificial Sequence
  Description of Artificial Sequence: Synthetic coding sequence
atgagcacagccagcgctgccagcagcagcagcagcagcagcgctggggagatgattgaggcccccagccaggtgctgaactttgaggagattgactacaaggagattgaggtggaggaggtggtgggccgcggggcctttggagtggtgtgcaaggccaagtggagggccaaggatgtggccatcaagcagattgaaagtgaaagtgagaggaaggccttcatcgtggagctgcggcagctgagccgggtgaaccaccccaacctgctgctggtggccggcggcaccgtgctgaagatctgtgactttggaacagcctgtgacatccagacccacatgaccaacaacaagggcagcgctgcctggatggcccctgaggtgtttgagggcagcaactacagcgagaagtgtgatgtgttctcctggggcatcatcctgtgggaggtgatcaccaggaggaagccctttgatgaaattggaggccctgccttccgcatcatgtgggccgtgcacaacggcacccggcccccactcatcaagaacctgcccaagcccatcgagagcctgatgacccgctgctggagcaaggaccccagccagaggcccagcatggaggagatcgtgaagatcatgacccacctgatgagatacttccctggagcagatgagcccctgcagtacccctgccagtacagtgatgagggccagagcaacagcgccaccagcacaggcagcttcatggacatcgccagcaccaacaccagcaacaagagtgacaccaacatggagcaggtgcctgccaccaatgacaccatcaagaggctggagagcaagctgctgaagaaccaggccaagcagcagagcgagagcggccgcctgagcctgggcgccagccggggcagctctgtggagagcctgccccccaccagcgagggcaagaggatgtctgctgacatgtctgaaattgaggccagaattgctgccaccactggaaatggccagcccaggagaagaagcatccaggacctgactgtgactggaacagagcccggccaggtgagcagccgcagcagcagccccagcgtgaggatgatcaccaccagcggccccaccagcgagaagcccaccaggagccacccctggaccccagatgacagcacagacaccaacggcagtgacaacagcatccccatggcctacctgaccctggaccaccagctgcaggcccggaccagctgcaggactggacctggatag

SEQ ID NO: 160190 - DNA, 1404 bp, Artificial Sequence
  Description of Artificial Sequence: Synthetic coding sequence
atggagtacatgagcacaggcagtgacaacaaggaggagattgacctgctgatcaagcacctgaatgtgtctgatgtgattgacatcatggagaacctgtatgccagcgaggagcctgctgtgtatgagcccagcctgatgaccatgtgccaggacagcaaccagaatgatgagaggagcaagagcctgctgctgagcggccaggaggtgccctggctgagctctgtgcgctatggcaccgtggaggacctgctggcctttgccaaccacatcagcaacacagccaagcacttctacggccagaggccccaggagagcggcatcctgctgaacatggtgatcaccccccagaatggccgctaccagattgacagtgatgtgctgctgatcccctggaagctgacctacagaaatattggaagtgacttcatccccaggggggccttcggcaaggtgtacctggcccaggacatcaagaccaagaagaggatggcctgcaagctgatccctgtggaccagttcaagcccagtgatgtggagatccaggcctgcttcagacatgagaacattgctgagctgtatggagctgtgctgtggggcgagaccgtgcacctgttcatggaggccggggagggcggctctgtgctggagaagctggagagctgtggccccatgagggagtttgagatcatctgggtgaccaagcacgtgctgaagggcctggacttcctgcacagcaagaaggtgatccaccacgacatcaagcccagcaacatcgtgttcatgagcaccaaggctgtgctggtggactttggcctgtctgtgcagatgacagaagatgtgtacttccccaaggacctgcggggcacagagatctacatgagccctgaggtgatcctgtgccggggccacagcaccaaggctgacatctacagcctgggcgccaccctcatccacatgcagacaggcaccccaccctgggtgaagcgctaccccaggtctgcctaccccagctacctgtacatcatccacaagcaggccccacccctggaggacattgctgatgactgcagccctggcatgagggagctgattgaggccagcctggagaggaaccccaaccaccggcccagggctgctgacctgctgaagcatgaggccctgaaccccccccgggaggaccagccccgctgccagagcctggacagcgccctgctggagaggaagaggctgctgagcaggaaggagctggagctgcctgaaaatattgctgacagcagctgcaccggcagcacagaggagagcgagatgctgaagaggcagaggagcctgtacatcgacctgggcgccctggccggctacttcaacctggtgcggggcccccccaccctggagtatggatag

SEQ ID NO: 160191 - DNA, 1404 bp, Artificial Sequence; identical to SEQ ID NO: 160190
  Description of Artificial Sequence: Synthetic coding sequence

SEQ ID NO: 160192 - DNA, 399 bp, Artificial Sequence
  Description of Artificial Sequence: Synthetic coding sequence
atggagtacatgagcacaggcagtgacaacaaggaggagattgacctgctgatcaagcacctgaatgtgtctgatgtgattgacatcatggagaacctgtatgccagcgaggagcctgctgtgtatgagcccagcctgatgaccatgtgccaggacagcaaccagaatgatgagaggagcaagagcctgctgctgagcggccaggaggtgccctggctgagctctgtgcgctatggcaccgtggaggacctgctggcctttgccaaccacatcagcaacacagccaagcacttctacggccagaggccccaggagagcggcatcctgctgaacatggtgcgcttcttccccatctcctgggtgctgtgtgcccagctgagctactgcagcttcatctag

SEQ ID NO: 160193 - DNA, 1404 bp, Artificial Sequence; identical to SEQ ID NO: 160190
  Description of Artificial Sequence: Synthetic coding sequence

SEQ ID NO: 160194 - DNA, 672 bp, Artificial Sequence
  Description of Artificial Sequence: Synthetic coding sequence
atggagtacatgagcacaggcagtgacaacaaggaggagattgacctgctgatcaagcacctgaatgtgtctgatgtgattgacatcatggagaacctgtatgccagcgaggagcctgctgtgtatgagcccagcctgatgaccatgtgccaggacagcaaccagaatgatgagaggagcaagagcctgctgctgagcggccaggaggtgccctggctgagctctgtgcgctatggcaccgtggaggacctgctggcctttgccaaccacatcagcaacacagccaagcacttctacggccagaggccccaggagagcggcatcctgctgaacatggtgatcaccccccagaatggccgctaccagattgacagtgatgtgctgctgatcccctggaagctgacctacagaaatattggaagtgacttcatccccaggggggccttcggcaaggtgtacctggcccaggacatcaagaccaagaagaggatggcctgcaagctgatccctgtggaccagttcaagcccagtgatgtggagatccaggcctgcttcagacatgagaacattgctgagctgtatggagctgtgctgtggggcgagaccgtgcacctgttcatggaggccggggagggcggctctgtgctggagaagctggagagctgtggctag

SEQ ID NO: 160195 - DNA, 768 bp, Artificial Sequence
  Description of Artificial Sequence: Synthetic coding sequence
atggagtacatgagcacaggcagtgacaacaaggaggagattgacctgctgatcaagcacctgaatgtgtctgatgtgattgacatcatggagaacctgtatgccagcgaggagcctgctgtgtatgagcccagcctgatgaccatgtgccaggacagcaaccagaatgatgagaggagcaagagcctgctgctgagcggccaggaggtgccctggctgagctctgtgcgctatggcaccgtggaggacctgctggcctttgccaaccacatcagcaacacagccaagcacttctacggccagaggccccaggagagcggcatcctgctgaacatggtgatcaccccccagaatggccgctaccagattgacagtgatgtgctgctgatcccctggaagctgacctacagaaatattggaagtgacttcatccccaggggggccttcggcaaggtgtacctggcccaggacatcaagaccaagaagaggatggcctgcaagctgatccctgtggaccagttcaagcccagtgatgtggagatccaggcctgcttcagacatgagaacattgctgagctgtatggagctgtgctgtggggcgagaccgtgcacctgttcatggaggccggggagggcggctctgtgctggagaagctggagagctgtggccccatgagggagtttgagatcatctgggtgaccaagcacgtgctgaagggcctggacttcctgcacagcaagaaggtgatccaccacgacatcaagtag

SEQ ID NO: 160196 - DNA, 573 bp, Artificial Sequence
  Description of Artificial Sequence: Synthetic coding sequence
tgagtggaggacctgctggcctttgccaaccacatcagcaacacagccaagcacttctacggccagaggccccaggagagcggcatcctgctgaacatggtgatcaccccccagaatggccgctaccagattgacagtgatgtgctgctgatcccctggaagctgacctacagaaacatcggcagtgacttcatccccaggggggccttcggcaaggtgtacctggcccaggacatcaagaccaagaagaggatggcctgcaagctgatccctgtggaccagttcaagcccagtgatgtggagatccaggcctgcttcagacatgaaaatattgctgagctgtatggagctgtgctgtggggcgagaccgtgcacctgttcatggaggccggggagggcggctctgtgctggagaagctggagagctgtggccccatgagggagtttgagatcatctgggtgaccaagcacgtgctgaagggcctggacttcctgcacagcaagaaggtgatccaccacgacatcaagaggaagtacctgtggacctacaccttcctggcccagagggactag

SEQ ID NO: 160197 - DNA, 1404 bp, Artificial Sequence; identical to SEQ ID NO: 160190
  Description of Artificial Sequence: Synthetic coding sequence

SEQ ID NO: 160198 - DNA, 3357 bp, Artificial Sequence
  Description of Artificial Sequence: Synthetic coding sequence
atggagcccagccgggccctgctgggctgcctggccagcgctgctgctgctgcccctcctggagaagatggagctggagctggagctgaggaggaggaggaggaggaggaggaggccgctgctgctgtgggccctggagagctgggctgtgatgcccccctgccctactggacagctgtgtttgaatatgaagctgctggggaggatgagctgaccctgcggctgggagatgtggtggaggtgctgagcaaggacagccaggtgtctggagatgagggctggtggacaggccagctgaaccagagggtgggcatcttccccagcaactacgtgacccccaggtctgccttcagcagccgctgccagcctggaggagaggaccccagctgctacccacccatccagctgctggagattgactttgctgagctgaccctggaggagatcatcggcatcggcggctttgggaaggtgtaccgggccttctggattggagatgaggtggccgtgaaggccgcccggcatgaccctgatgaggacatcagccagaccattgaaaatgtgcggcaggaggccaagctgtttgccatgctgaagcaccccaacatcatcgccctgcggggcgtgtgcctgaaggagcccaacctgtgcctggtgatggagtttgcccggggcggccccctgaacagagtgctgagcggcaagaggatccccccagacatcctggtgaactgggccgtgcagatcgcccggggcatgaactacctgcatgatgaggccatcgtgcccatcatccaccgggacctgaagagcagcaacatcctgatcctgcagaaggtggagaatggagacctgagcaacaagatcctgaagatcacagactttggcctggcccgggagtggcacaggaccaccaagatgtctgctgctggcacctacgcctggatggcccctgaggtgatccgggcctccatgttcagcaagggcagtgatgtgtggagctatggagtgctgctgtgggagctgctgaccggggaggtgcccttccggggcattgatggcctggccgtggcctatggagtggccatgaacaagctggccctgcccatccccagcacctgcccagagccctttgccaagctgatggaggactgctggaacccagacccccacagccggcccagcttcaccaacatcctggaccagctgaccaccatcgaggagagcggcttctttgagatgcccaaggacagcttccactgcctgcaggacaactggaagcatgagatccaggagatgtttgaccagctgcgggccaaggagaaggagctgcggacctgggaggaggagctgacccgggccgccctgcagcagaagaaccaggaggagctgctgcggcggcgggagcaggagctggccgagcgggagattgacatcctggagcgggagctgaacatcatcatccaccagctgtgccaggagaagccccgggtgaagaagaggaagggcaagttcaggaagagccggctgaagctgaaggatggcaaccgcatcagcctgcccagcgacttccagcacaagttcaccgtgcaggccagccccaccatggacaagaggaagagcctcatcaacagccgcagcagccccccagccagccccaccatcatcccccggctgcgggccatccagctgaccccaggagagagcagcaagacctggggccgcagctctgtggtgcccaaggaggagggggaggaggaggagaagagggcccccaagaagaagggccgcacctggggccctggcaccctgggccagaaggagctggccagcggagatgagggcagcccccagaggcgggagaaggccaacggcctgagcacccccagcgagagcccccacttccacctgggcctgaagagcctggtggatggctacaagcagtggagcagcagcgcccccaacctggtgaagggccccaggagcagccctgccctgcccggcttcaccagcctgatggagatggccctgctggccgcctcctgggtggtgcccatcgacatcgaggaggatgaggacagcgagggccctggcagcggggagagccggctgcagcacagccccagccagagctacctgtgcatccccttccccagaggagaagatggagatggccccagcagtgatggcatccacgaggagcccacccctgtgaacagcgccaccagcaccccccagctgacccccaccaacagcctgaagaggggcggggcccaccacagaagatgtgaggtggccctgctgggctgtggggctgtgctggccgccaccggcctgggctttgacctgctggaggccggcaagtgccagctgctgcccctggaggagcctgagcccccagcccgggaggagaagaagagaagagagggcctcttccagaggagcagccggcccaggaggagcaccagcccccccagcaggaagctgttcaagaaggaggagcccatgctgctgctgggggaccccagcgccagcctgaccctgctgagcctgagcagcatcagcgagtgcaacagcaccaggagcctgctgcggagtgacagtgatgaaattgtggtgtatgagatgcctgtgtcccctgtggaggccccacccctgagcccctgcacccacaaccccctggtgaatgtgcgggtggagcgcttcaagagggaccccaaccagagcctgacccccacccacgtgaccctgaccacccccagccagcccagcagccacaggaggacccccagtgatggagccctgaagccagagaccctgctggccagccgcagccccagcagcaatggcctgagccccagccctggagctggcatgctgaagacccccagccccagccgggaccctggagagttcccccggctgcctgaccccaacgtggtgtttcctcccaccccccggcgctggaacacccagcaggacagcaccctggagcggcccaagaccctggagttcctgccccggccccggcccagcgccaaccggcagaggctggacccctggtggtttgtgagccccagccacgcccggagcaccagccctgccaacagcagcagcacagagacccccagcaacctggacagctgctttgccagcagcagcagcacagtggaggagaggcctggcctgcctgccctgctgcccttccaggccggccccctgcccccaacagagaggaccctgctggacctggatgctgagggccagagccaggacagcacagtgcccctgtgcagagctgagctgaacacccacaggcctgccccctatgagatccagcaggagttctggagctag

SEQ ID NO: 160199 - DNA, 2463 bp, Artificial Sequence
  Description of Artificial Sequence: Synthetic coding sequence
ctggtgctgatcctgcagaaggtggagaatggagacctgagcaacaagatcctgaagatcacagactttggcctggcccgggagtggcacaggaccaccaagatgtctgctgctggcacctacgcctggatggcccctgaggtgatccgggcctccatgttcagcaagggcagtgatgtgtggagctatggagtgctgctgtgggagctgctgaccggggaggtgcccttccggggcattgatggcctggccgtggcctatggagtggccatgaacaagctggccctgcccatccccagcacctgcccagagccctttgccaagctgatggaggactgctggaacccagacccccacagccggcccagcttcaccaacatcctggaccagctgaccaccatcgaggagagcggcttctttgagatgcccaaggacagcttccactgcctgcaggacaactggaagcatgagatccaggagatgtttgaccagctgcgggccaaggagaaggagctgcggacctgggaggaggagctgacccgggccgccctgcagcagaagaaccaggaggagctgctgcggcggcgggagcaggagctggccgagcgggagattgacatcctggagcgggagctgaacatcatcatccaccagctgtgccaggagaagccccgggtgaagaagaggaagggcaagttcaggaagagccggctgaagctgaaggatggcaaccgcatcagcctgcccagcgacttccagcacaagttcaccgtgcaggccagccccaccatggacaagaggaagagcctcatcaacagccgcagcagccccccagccagccccaccatcatcccccggctgcgggccatccagctgaccccaggagagagcagcaagacctggggccgcagctctgtggtgcccaaggaggagggggaggaggaggagaagagggcccccaagaagaagggccgcacctggggccctggcaccctgggccagaaggagctggccagcggagatgagggcctgaagagcctggtggatggctacaagcagtggagcagcagcgcccccaacctggtgaagggccccaggagcagccctgccctgcccggcttcaccagcctgatggagatggcctgcttcagcagcaccctggtgatcttcacagaagatgaggacagcgagggccctggcagcggggagagccggctgcagcacagccccagccagagctacctgtgcatccccttccccagaggagaagatggagatggccccagcagtgatggcatccacgaggagcccacccctgtgaacagcgccaccagcaccccccagctgacccccaccaacagcctgaagaggggcggggcccaccacagaagatgtgaggtggccctgctgggctgtggggctgtgctggccgccaccggcctgggctttgacctgctggaggccggcaagtgccagctgctgcccctggaggagcctgagcccccagcccgggaggagaagaagagaagagagggcctcttccagaggagcagccggcccaggaggagcaccagcccccccagcaggaagctgttcaagaaggaggagcccatgctgctgctgggggaccccagcgccagcctgaccctgctgagcctgagcagcatcagcgagtgcaacagcaccaggagcctgctgcggagtgacagtgatgaaattgtggtgtatgagatgcctgtgtcccctgtggaggccccacccctgagcccctgcacccacaaccccctggtgaatgtgcgggtggagcgcttcaagagggaccccaaccagagcctgacccccacccacgtgaccctgaccacccccagccagcccagcagccacaggaggacccccagtgatggagccctgaagccagagaccctgctggccagccgcagccccagcagcaatggcctgagccccagccctggagctggcatgctgaagacccccagccccagccgggaccctggagagttcccccggctgcctgaccccaacgtggtgtttcctcccaccccccggcgctggaacacccagcaggacagcaccctggagcggcccaagaccctggagttcctgccccggccccggcccagcgccaaccggcagaggctggacccctggtggtttgtgagccccagccacgcccggagcaccagccctgccaacagcagcagcacagagacccccagcaacctggacagctgctttgccagcagcagcagcacagtggaggagaggcctggcctgcctgccctgctgcccttccaggccggccccctgcccccaacagagaggaccctgctggacctggatgctgagggccagagccaggacagcacagtgcccctgtgcagagctgagctgaacacccacaggcctgccccctatgagatccagcaggagttctggagctag

SEQ ID NO: 160200 - DNA, 3315 bp, Artificial Sequence
  Description of Artificial Sequence: Synthetic coding sequence
atggagcccagccgggccctgctgggctgcctggccagcgctgctgctgctgcccctcctggagaagatggagctggagctggagctgaggaggaggaggaggaggaggaggaggccgctgctgctgtgggccctggagagctgggctgtgatgcccccctgccctactggacagctgtgtttgaatatgaagctgctggggaggatgagctgaccctgcggctgggagatgtggtggaggtgctgagcaaggacagccaggtgtctggagatgagggctggtggacaggccagctgaaccagagggtgggcatcttccccagcaactacgtgacccccaggtctgccttcagcagccgctgccagcctggaggagaggaccccagctgctacccacccatccagctgctggagattgactttgctgagctgaccctggaggagatcatcggcatcggcggctttgggaaggtgtaccgggccttctggattggagatgaggtggccgtgaaggccgcccggcatgaccctgatgaggacatcagccagaccattgaaaatgtgcggcaggaggccaagctgtttgccatgctgaagcaccccaacatcatcgccctgcggggcgtgtgcctgaaggagcccaacctgtgcctggtgatggagtttgcccggggcggccccctgaacagagtgctgagcggcaagaggatccccccagacatcctggtgaactgggccgtgcagatcgcccggggcatgaactacctgcatgatgaggccatcgtgcccatcatccaccgggacctgaagagcagcaacatcctgatcctgcagaaggtggagaatggagacctgagcaacaagatcctgaagatcacagactttggcctggcccgggagtggcacaggaccaccaagatgtctgctgctggcacctacgcctggatggcccctgaggtgatccgggcctccatgttcagcaagggcagtgatgtgtggagctatggagtgctgctgtgggagctgctgaccggggaggtgcccttccggggcattgatggcctggccgtggcctatggagtggccatgaacaagctggccctgcccatccccagcacctgcccagagccctttgccaagctgatggaggactgctggaacccagacccccacagccggcccagcttcaccaacatcctggaccagctgaccaccatcgaggagagcggcttctttgagatgcccaaggacagcttccactgcctgcaggacaactggaagcatgagatccaggagatgtttgaccagctgcgggccaaggagaaggagctgcggacctgggaggaggagctgacccgggccgccctgcagcagaagaaccaggaggagctgctgcggcggcgggagcaggagctggccgagcgggagattgacatcctggagcgggagctgaacatcatcatccaccagctgtgccaggagaagccccgggtgaagaagaggaagggcaagttcaggaagagccggctgaagctgaaggatggcaaccgcatcagcctgcccagcgacttccagcacaagttcaccgtgcaggccagccccaccatggacaagaggaagagcctcatcaacagccgcagcagccccccagccagccccaccatcatcccccggctgcgggccatccagctgaccccaggagagagcagcaagacctggggccgcagctctgtggtgcccaaggaggagggggaggaggaggagaagagggcccccaagaagaagggccgcacctggggccctggcaccctgggccagaaggagctggccagcggagatgagggcagcccccagaggcgggagaaggccaacggcctgagcacccccagcgagagcccccacttccacctgggcctgaagagcctggtggatggctacaagcagtggagcagcagcgcccccaacctggtgaagggccccaggagcagccctgccctgcccggcttcaccagcctgatggagatggaggatgaggacagcgagggccctggcagcggggagagccggctgcagcacagccccagccagagctacctgtgcatccccttccccagaggagaagatggagatggccccagcagtgatggcatccacgaggagcccacccctgtgaacagcgccaccagcaccccccagctgacccccaccaacagcctgaagaggggcggggcccaccacagaagatgtgaggtggccctgctgggctgtggggctgtgctggccgccaccggcctgggctttgacctgctggaggccggcaagtgccagctgctgcccctggaggagcctgagcccccagcccgggaggagaagaagagaagagagggcctcttccagaggagcagccggcccaggaggagcaccagcccccccagcaggaagctgttcaagaaggaggagcccatgctgctgctgggggaccccagcgccagcctgaccctgctgagcctgagcagcatcagcgagtgcaacagcaccaggagcctgctgcggagtgacagtgatgaaattgtggtgtatgagatgcctgtgtcccctgtggaggccccacccctgagcccctgcacccacaaccccctggtgaatgtgcgggtggagcgcttcaagagggaccccaaccagagcctgacccccacccacgtgaccctgaccacccccagccagcccagcagccacaggaggacccccagtgatggagccctgaagccagagaccctgctggccagccgcagccccagcagcaatggcctgagccccagccctggagctggcatgctgaagacccccagccccagccgggaccctggagagttcccccggctgcctgaccccaacgtggtgtttcctcccaccccccggcgctggaacacccagcaggacagcaccctggagcggcccaagaccctggagttcctgccccggccccggcccagcgccaaccggcagaggctggacccctggtggtttgtgagccccagccacgcccggagcaccagccctgccaacagcagcagcacagagacccccagcaacctggacagctgctttgccagcagcagcagcacagtggaggagaggcctggcctgcctgccctgctgcccttccaggccggccccctgcccccaacagagaggaccctgctggacctggatgctgagggccagagccaggacagcacagtgcccctgtgcagagctgagctgaacacccacaggcctgccccctatgagatccagcaggagttctggagctag

SEQ ID NO: 160201 - DNA, 1005 bp, Artificial Sequence
  Description of Artificial Sequence: Synthetic coding sequence
atggccctgcgctggggcatcgtgtctgtgggcctcatcagcagtgacttcaccgctgtgctgcagaccctgcccaggtctgagcaccaggtggtggccgtggccgcccgggacctgagccgggccaaggagtttgcccagaagcatgacatccccaaggcctacggcagctatgaggagctggccaaggaccccagcgtggaggtggcctacatcggcacccagcacccccagcacaaggctgctgtgatgctgtgcctggccgccggcaaggctgtgctgtgtgagaagcccactggagtgaatgctgctgaggtgcgggagatggtggccgaggcccggagccgggccctcttcctgatggaggccatctggacccgcttcttccctgccagcgaggccctgcggtctgtgctggcccagggcaccctgggggacctgcgggtggcccgggcagagtttgggaagaacctgatccacgtgcccagggctgtggaccgggcccaggccggcggggccctgctggacatcggcatctactgtgtgcagttcacctccatggtgtttggaggccagaagccagagaagatctctgtggtgggcagaagacatgagaccggggtggatgacacagtgacagtgctgctgcagtacccaggagaggtgcacggcagcttcacctgcagcatcaccgtgcagctgagcaacacagcctctgtgtctggcaccaagggcatggtgcagctgctgaacccctgctggtgccccacagagctggtggtgaagggggagcacaaggagttccccctgccccctgtgcccaaggactgcaactttgacaatggagctggcatgtcctatgaggccaagcacgtgtgggagtgcctgaggaagggcatgaaggagagccctgtgatccccctgtctgagagcgagctgctggccgacatcctggaggaggtgaggaaggccatcggcgtgaccttcccccaggacaagaggtag

SEQ ID NO: 160202 - DNA, 2466 bp, Artificial Sequence
  Description of Artificial Sequence: Synthetic coding sequence
atggatgtggtggaccctgacatcttcaacagagacccccgggaccactatgacctgctgcagaggctgggcggcggcacctacggggaggtgttcaaggcccgggacaaggtgtctggggacctggtggccctgaagatggtgaagatggagccagatgatgatgtgtccaccctgcagaaggagatcctgatcctgaagacctgcagacatgccaacatcgtggcctaccacggcagctacctgtggctgcagaagctgtggatctgcatggagttctgtggggccggcagcctgcaggacatctaccaggtgacaggcagcctgtctgagctgcagatctcctatgtgtgccgggaggtgctgcagggcctggcctacctgcacagccagaagaagatccaccgggacatcaagggggccaacatcctgatcaatgatgctggggaggtgcggctggccgactttggcatcagcgcccagatcggggccaccctggcccggcggctgtccttcatcggcaccccctactggatggcccctgaggtggccgctgtggccctgaagggcggctacaatgagctgtgtgacatctggagcctgggcatcacagccatcgagctggccgagctgcagccccccctgtttgatgtgcaccccctgcgggtgctcttcctgatgaccaagagcggctaccagcccccccggctgaaggagaagggcaagtggagcgctgccttccacaacttcatcaaggtgaccctgaccaagagccccaagaagaggcccagcgccaccaagatgctgagccaccagctggtgtcccagcccggcctgaacagaggcctcatcctggacctgctggacaagctgaagaaccctgggaagggccccagcatcggggacattgaagatgaggagcctgagctgcccccagccatcccccggcgcatccgcagcacccacaggagcagcagcctgggcatcccagatgctgactgctgccgccgccacatggagttcaggaagctgcggggcatggagacccggcccccagccaacacagcccggctgcagcccccccgggacctgcggagcagcagccccaggaagcagctgtctgagagcagtgatgatgattatgatgatgtggacatccccaccccagctgaggacaccccaccacccctgccccccaagcccaagttccgcagccccagtgatgagggccctggctccatgggagatgatggccagctgagccctggggtgctggtgcgctgtgccagcggccccccacccaacagccccaggcctggccccccacccagcaccagcagcccccacctgacagcccacagcgagcccagcctgtggaacccccccagccgggagctggacaagccacccctgctgccccccaagaaggagaagatgaagaggaagggctgtgccctgctggtgaagctgttcaacggctgccccctgcgcatccacagcacagctgcctggacccaccccagcaccaaggaccagcacctgctgctgggcgctgaggagggcatcttcatcctgaacagaaatgaccaggaggccaccctggagatgctgttccccagcaggaccacctgggtgtacagcatcaacaacgtgctgatgagcctgagcggcaagaccccccacctgtacagccacagcatcctgggcctgctggagaggaaggagacccgggccggcaaccccatcgcccacatcagcccccaccggctgctggccaggaagaacatggtgtccaccaagatccaggacaccaagggctgccgggcctgctgcgtggccgagggcgccagcagcggcggccccttcctgtgtggggccctggagacctctgtggtgctgctgcagtggtaccagcccatgaacaagttcctgctggtgcggcaggtgctcttccccctgcccacccccctgtctgtgtttgccctgctgaccggccctggcagcgagctgcctgctgtgtgcattggagtgtccccaggccggcctgggaagtctgtgctcttccacacagtgcgctttggagccctgagctgctggctgggggagatgagcacagagcaccggggccctgtgcaggtgacccaggtggaggaggacatggtgatggtgctgatggatggctctgtgaagctggtgaccccagagggcagccctgtgcggggcctgcggaccccagagatccccatgacagaggccgtggaggccgtggccatggtgggcggccagctgcaggccttctggaagcatggagtgcaggtgtgggccctgggcagtgaccagctgctgcaggagctgcgggaccccaccctgaccttccggctgctgggcagccccaggcctgtggtggtggagaccaggcctgtggatgaccccacagcccccagcaacctgtacatccaggagtag

SEQ ID NO: 160203 - DNA, 720 bp, Artificial Sequence
  Description of Artificial Sequence: Synthetic coding sequence
atggagttcaggaagctgcggggcatggagacccggcccccagccaacacagcccggctgcagcccccccgggacctgcggagcagcagccccaggaagcagctgtctgagagcagtgatgatgattatgatgatgtggacatccccaccccagctgaggacaccccaccacccctgccccccaagcccaagttccgcagccccagtgatgagggccctggctccatgggagatgatggccagctgagccctggggtgctggtgcgctgtgccagcggccccccacccaacagccccaggcctggccccccacccagcaccagcagcccccacctgacagcccacagcgagcccagcctgtggaacccccccagccgggagctggacaagccacccctgctgccccccaagaaggagaagatgaagaggaagggctgtgccctgctggtgaagctgttcaacggctgccccctgcgcatccacagcacagctgcctggacccaccccagcaccaaggaccagcacctgctgctgggcgctgaggagggcatcttcatcctgaacagaaatgaccaggaggccaccctggagatggagaggcctcccacctgcatcctgattgccagcctggcctgctggaatggcaagaggcctgagcaggagacccccagcctgaccctggcccccacagcctactggcagggcaccagcagccagtag

SEQ ID NO: 160204 - DNA, 2502 bp, Artificial Sequence
  Description of Artificial Sequence: Synthetic coding sequence
atggatgtggtggaccctgacatcttcaacagagacccccgggaccactatgacctgctgcagaggctgggcggcggcacctacggggaggtgttcaaggcccgggacaaggtgtctggggacctggtggccctgaagatggtgaagatggagccagatgatgatgtgtccaccctgcagaaggagatcctgatcctgaagacctgcagacatgccaacatcgtggcctaccacggcagctacctgtggctgcagaagctgtggatctgcatggagttctgtggggccggcagcctgcaggacatctaccaggtgacaggcagcctgtctgagctgcagatctcctatgtgtgccgggaggtgctgcagggcctggcctacctgcacagccagaagaagatccaccgggacatcaagggggccaacatcctgatcaatgatgctggggaggtgcggctggccgactttggcatcagcgcccagatcggggccaccctggcccggcggctgtccttcatcggcaccccctactggatggcccctgaggtggccgctgtggccctgaagggcggctacaatgagctgtgtgacatctggagcctgggcatcacagccatcgagctggccgagctgcagccccccctgtttgatgtgcaccccctgcgggtgctcttcctgatgaccaagagcggctaccagcccccccggctgaaggagaagggcaagtggagcgctgccttccacaacttcatcaaggtgaccctgaccaagagccccaagaagaggcccagcgccaccaagatgctgagccaccagctggtgtcccagcccggcctgaacagaggcctcatcctggacctgctggacaagctgaagaaccctgggaagggccccagcatcggggacattgaagatgaggagcctgagctgcccccagccatcccccggcgcatccgcagcacccacaggagcagcagcctgggcatcccagatgctgactgctgccgccgccacatggagttcaggaagctgcggggcatggagacccggcccccagccaacacagcccggctgcagcccccccgggacctgcggagcagcagccccaggaagcagctgtctgagagcagtgatgatgattatgatgatgtggacatccccaccccagctgaggacaccccaccacccctgccccccaagcccaagttccgcagccccagtgatgagggccctggctccatgggagatgatggccagctgagccctggggtgctggtgcgctgtgccagcggccccccacccaacagccccaggcctggccccccacccagcaccagcagcccccacctgacagcccacagcgagcccagcctgtggaacccccccagccgggagctggacaagccacccctgctgccccccaagaaggagaagatgaagaggaagggctgtgccctgctggtgaagctgttcaacggctgccccctgcgcatccacagcacagctgcctggacccaccccagcaccaaggaccagcacctgctgctgggcgctgaggagggcatcttcatcctgaacagaaatgaccaggaggccaccctggagatgctgttccccagcaggaccacctgggtgtacagcatcaacaacgtgctgatgagcctgagcggcaagaccccccacctgtacagccacagcatcctgggcctgctggagaggaaggagacccgggccggcaaccccatcgcccacatcagcccccaccggctgctggccaggaagaacatggtgtccaccaagatccaggacaccaagggctgccgggcctgctgcgtggccgagggcgccagcagcggcggccccttcctgtgtggggccctggagacctctgtggtgctgctgcagtggtaccagcccatgaacaagttcctgctggtgcggcaggtgctcttccccctgcccacccccctgtctgtgtttgccctgctgaccggccctggcagcgagctgcctgctgtgtgcattggagtgtccccaggccggcctgggaagtctgtgctcttccacacagtgcgctttggagccctgagctgctggctgggggagatgagcacagagcaccggggccctgtgcaggtgacccaggtggaggaggacatggtgatggtgctgatggatggctctgtgaagctggtgaccccagagggcagccctgtgcggggcctgcggaccccagagatccccatgacagaggccgtggaggccgtggccatggtgggcggccagctgcaggccttctggaagcatggagtgcaggtgtgggccctgggcagtgaccagctgctgcaggagctgcgggaccccaccctgaccttccggctgctgggcagcccccggctggagtgcagcggcaccatcagcccccactgcaacctgctgctgcccggcagcagcaacagccctgccagcgccagccgggtggccggcatcaccggcctgtag

SEQ ID NO: 160205 - DNA, 2463 bp, Artificial Sequence
  Description of Artificial Sequence: Synthetic coding sequence
atggccctgctgagagatgtgtccctgcaggacccccgggacagatttgagctgctgcagagggtgggcgccggcacctatggagatgtgtacaaggcccgggacacagtgaccagcgagctggccgctgtgaagatcgtgaagctggaccctggagatgacatcagcagcctgcagcaggagatcaccatcctgagagaatgtcgccaccccaacgtggtggcctacatcggcagctacctgagaaatgaccggctgtggatctgcatggagttctgtggcggcggcagcctgcaggagatctaccacgccaccggccccctggaggagcggcagatcgcctacgtgtgccgggaggccctgaagggcctgcaccacctgcacagccagggcaagatccaccgggacatcaagggggccaacctgctgctgaccctgcagggagatgtgaagctggccgactttggagtgtctggagagctgacagcctctgtggccaagaggaggagcttcatcggcaccccctactggatggcccctgaggtggccgctgtggagaggaagggcggctacaatgagctgtgtgatgtgtgggccctgggcatcacagccatcgagctgggggagctgcagcccccactcttccacctgcaccccatgagggccctgatgctgatgagcaagagcagcttccagccccccaagctgcgggacaagacccgctggacccagaacttccaccacttcctgaagctggccctgaccaagaaccccaagaagaggcccacagctgagaagctgctgcagcaccccttcaccacccagcagctgccccgggccctgctgacccagctgctggacaaggccagtgacccccacctgggcacccccagccctgaggactgtgagctggagacctatgacatgtttcctgacaccatccacagccggggccagcacggccctgctgagaggacccccagcgagatccagttccaccaggtgaagtttggagcccccaggaggaaggagacagaccccctgaatgagccctgggaggaggagtggaccctgctgggcaaggaggagctgagcggcagcctgctgcagagcgtgcaggaggccctggaggagaggagcctgaccatccgcagcgccagcgagttccaggagctggacagcccagatgacaccatgggcaccatcaagagggcccccttcctgggccccctgcccacagatcctcctgctgaggagcccctgagcagccccccaggcaccctgcccccacctccttctggccccaacagcagccccctgctgcccacagcctgggccaccatgaagcagcgggaggaccctgagaggagcagctgccacggcctgccccccacccccaaggtgcacatgggcgcctgcttcagcaaggtgttcaacggctgccccctgcgcatccatgctgctgtgacctggatccaccctgtgacccgggaccagttcctggtggtgggcgctgaggagggcatctacaccctgaacctgcacgagctgcacgaggacaccctggagaagctgatcagccaccgctgctcctggctgtactgtgtgaacaacgtgctgctgagcctgagcggcaagagcacccacatctgggcccatgacctgcccggcctgtttgagcagaggcggctgcagcagcaggtgcccctgagcatccccaccaaccggctgacccagaggatcatccccaggagatttgccctgagcaccaagatcccagacaccaagggctgcctgcagtgccgggtggtgaggaacccctacacaggagccaccttcctgctggccgccctgcccaccagcctgctgctgctgcagtggtatgagcccctgcagaagttcctgctgctgaagaacttcagcagccccctgcccagccctgctggcatgctggagcccctggtgctggatggcaaggagctgccccaggtgtgtgtgggcgctgagggccctgagggccctggctgccgggtgctcttccacgtgctgcccctggaggccggcctgaccccagacatcctgatccccccagagggcatccctggcagcgcccagcaggtgatccaggtggaccgggacaccatcctggtgtcctttgagcgctgtgtgagaattgtgaacatgcagggcgagcccacagccaccctggcccctgagctgacctttgacttccccatcgagaccgtggtgtgcctgcaggacagcgtgctggccttctggagccacggcatgcagggccgcagcctggacaccaatgaggtgacccaggagatcacagatgagacccgcatcttccgggtgctgggcgcccaccgggacatcatcctggagagcatccccacagacaaccctgaggcccacagcaacctgtacatcctgaccggccaccagagcacctactag

SEQ ID NO: 160206 - DNA, 2541 bp, Artificial Sequence
  Description of Artificial Sequence: Synthetic coding sequence
atggaggcccccctgcggcctgctgctgacatcctgcggaggaacccccagcaggactatgagctggtgcagagggtgggcagcggcacctatggagatgtgtacaaggccagaaatgtgcacactggagagctggccgctgtgaagatcatcaagctggagcctggagatgacttcagcctcatccagcaggagatcttcatggtgaaggagtgcaagcactgcaacatcgtggcctacttcggcagctacctgagccgggagaagctgtggatctgcatggagtactgcggcggcggcagcctgcaggacatctaccacgtgacaggccccctgtctgagctgcagatcgcctacgtgtgccgggagaccctgcagggcctggcctacctgcacaccaagggcaagatgcaccgggacatcaagggggccaacatcctgctgacagaccatggagatgtgaagctggccgactttggagtggccgccaagatcacagccaccatcgccaagaggaagagcttcatcggcaccccctactggatggcccctgaggtggccgctgtggagaagaatggaggctacaaccagctgtgtgacatctgggccgtgggcatcacagccatcgagctgggggagctgcagccccccatgtttgacctgcaccccatgagggccctcttcctgatgagcaagagcaacttccagccccccaagctgaaggacaagaccaagtggagcagcaccttccacaactttgtgaagatcgccctgaccaagaaccccaagaagaggcccacagctgagcggctgctgacccacacctttgtggcccagcccggcctgagccgggccctggccgtggagctgctggacaaggtgaacaacccagacaaccacgcccactacacagaagcagatgatgatgactttgagccccacgccatcatccgccacaccatccgcagcaccaacagaaatgcccgggcagagaggacagccagcgagatcaactttgacaagctgcagtttgagccccccctgaggaaggagacagaggccagagatgagatgggcctgagcagtgaccccaacttcatgctgcagtggaacccctttgtggatggagccaacacaggcaagagcaccagcaagagggccatccccccacccctgccccccaagccccgcatcagcagctacccagaggacaacttcccagatgaggagaaggccagcaccatcaagcactgcccagattctgagagccgggccccccagatcctgcggcggcagagcagccccagctgtggccctgtggccgagaccagcagcattggaaatggagatggcatcagcaagctgatgtctgagaacacagagggcagcgcccaggccccccagctgcccaggaagaaggacaagagggacttccccaagccagccatcaatggcctgccccccacccccaaggtgctgatgggcgcctgcttcagcaaggtgtttgatggctgccccctgaagatcaactgtgccacctcctggatccacccagacaccaaggaccagtacatcatctttggaacagaagatggcatctacaccctgaacctgaatgagctgcacgaggccaccatggagcagctgttccccaggaagtgcacctggctgtatgtgatcaacaacaccctgatgagcctgtctgtgggcaagaccttccagctgtacagccacaacctgattgccctgtttgagcacgccaagaagccaggcctggccgcccacatccagacccaccgcttcccagaccgcatcctgcccaggaagtttgccctgaccaccaagatcccagacaccaagggctgccacaagtgctgcatcgtgaggaacccctacacaggccacaagtacctgtgtggggccctgcagagcggcatcgtgctgctgcagtggtatgagcccatgcagaagttcatgctgatcaagcactttgacttccccctgcccagccccctgaatgtgtttgagatgctggtgattcctgagcaggagtaccccatggtgtgtgtggccatcagcaagggcacagagagcaaccaggtggtgcagtttgagaccatcaacctgaacagcgccagctcctggttcacagaaattggagctggcagccagcagctggacagcatccacgtgacccagctggagcgggacacagtgctggtgtgcctggacaagtttgtgaagatcgtgaacctgcagggcaagctgaagagcagcaagaagctggccagcgagctgagctttgacttccgcatcgagagcgtggtgtgcctgcaggacagcgtgctggccttctggaagcacggcatgcagggcaagagcttcaagagtgatgaggtgacccaggagatcagtgatgagaccagggtcttccggctgctgggcagtgacagagtggtggtgctggagagccggcccacagagaaccccacagcccacagcaacctgtacatcctggccggccatgaaaattcctactag

SEQ ID NO: 160207 - DNA, 699 bp, Artificial Sequence
  Description of Artificial Sequence: Synthetic coding sequence
atggccacagctgagagccgggccctgcagtttgctgagggcgccgccttccctgcctaccgggcccctcatgctggaggagccctgctgcccccacccagccctgctgctgccctgctgcctgcccctcctgctggccctggccctgccacctttgctggcttcctgggccgggaccccggccctgcccctcctcctccagccagcctgggcagccctgccccacccaagggagctgctgcccccagcgccagccagaggaggaagaggaccagcttctctgctgagcagctgcagctgctggagctggtgttccggaggacccgctacccagacatccacctgcgggagcggctggccgccctgaccctgctgcctgagagccgcatccaggtgtggttccagaacagaagagccaagagccggcggcagagcggcaagagcttccagcccctggcccggcctgagatcatcctgaaccactgtgcccctggaacagagaccaagtgcctgaagccccagctgcccctggaggtggatgtgaactgcctgcctgagcccaacggggtgggcggcggcatcagtgacagcagcagccagggccagaactttgagacctgcagccccctgtctgaggacatcggcagcaagctggacagctgggaggagcacatcttcagcgcctttggaaacttctag

SEQ ID NO: 160208 - DNA, 723 bp, Artificial Sequence
  Description of Artificial Sequence: Synthetic coding sequence
atggccacagctgagagccgggccctgcagtttgctgagggcgccgccttccctgcctaccgggcccctcatgctggaggagccctgctgcccccacccagccctgctgctgccctgctgcctgcccctcctgctggccctggccctgccacctttgctggcttcctgggccgggaccccggccctgcccctcctcctccagccagcctgggcagccctgccccacccaagggagctgctgcccccagcgccagccagaggaggaagaggaccagcttctctgctgagcagctgcagctgctggagctggtgttccggaggacccgctacccagacatccacctgcgggagcggctggccgccctgaccctgctgcctgagagccgcatccagctgctcttcagccccctcttccaggtgtggttccagaacagaagagccaagagccggcggcagagcggcaagagcttccagcccctggcccggcctgagatcatcctgaaccactgtgcccctggaacagagaccaagtgcctgaagccccagctgcccctggaggtggatgtgaactgcctgcctgagcccaacggggtgggcggcggcatcagtgacagcagcagccagggccagaactttgagacctgcagccccctgtctgaggacatcggcagcaagctggacagctgggaggagcacatcttcagcgcctttggaaacttctag

SEQ ID NO: 160209 - DNA, 882 bp, Artificial Sequence
  Description of Artificial Sequence: Synthetic coding sequence
atggccaccttcagcggccctgctggccccatcctgagcctgaacccccaggaggatgtggagttccagaaggaggtggcccaggtgaggaagaggatcacccagaggaagaagcaggagcagctgaccccaggagtggtgtatgtgcgccacctgcccaacctgctggatgagacccagatcttctcctacttcagccagtttggcaccgtgacccgcttccggctgagccgcagcaagaggacaggcaacagcaagggctacgcctttgtggagtttgaaagtgaagatgtggccaagatcgtggccgagaccatgaacaactacctgtttggagagcggctgctggagtgccacttcatgcctcctgagaaggtgcacaaggagctgttcaaggactggaacatccccttcaagcagcccagctaccccagcgtgaagcgctacaacagaaacagaaccctgacccagaagctgaggatggaggagcgcttcaagaagaaggagcggctgctgaggaagaagctggccaagaagggcattgattatgacttccccagcctcatcctgcagaagacagagagcatcagcaagaccaaccggcagaccagcaccaagggccaggtgctgaggaagaagaagaagaaggtgtctggcaccctggacaccccagagaagacagtggacagccagggccccacccctgtgtgcacccccaccttcctggagaggaggaagagccaggtggccgagctgaatgatgatgacaaggatgatgaaattgtgttcaagcagcccatcagctgtgtgaaggaggagatccaggagacccagacccccacccacagcaggaagaagagaagaagaagcagcaaccagtag

SEQ ID NO: 160210 - DNA, 1257 bp, Artificial Sequence
  Description of Artificial Sequence: Synthetic coding sequence
atggccccccggggcagaagaagaccccggccccacaggtctgagggcgcccggcgcagcaagaacaccctggagaggacccacagcatgaaggacaaggccggccagaagtgcaagcccattgatgtgtttgacttcccagacaacagtgatgtgagcagcatcggccgcctgggggagaatgagaaggatgaggagacctatgagacctttgatcctcccctgcacagcacagccatctatgcagatgaggaggagttcagcaagcactgcggcctgagcctgagcagcaccccacctgggaaggaggccaagaggagcagtgacaccagcggaaatgaggccagcgagattgagagcgtgaagatcagcgccaagaagccaggcaggaagctgcggcccatcagtgatgattctgagagcattgaggagagtgacaccaggaggaaggtgaagtctgctgagaagatcagcacccagagacatgaggtgatccgcaccacagccagcagcgagctgtctgagaagccagctgagagcgtgaccagcaagaagacaggccccctgagcgcccagcccagcgtggagaaggagaacctggccatcgagagccagagcaagacccagaagaagggcaagatcagccatgacaagaggaagaagagccgcagcaaggccatcggcagtgacaccagtgacatcgtgcacatctggtgcccagagggcatgaagaccagtgacatcaaggagctgaacatcgtgctgcctgagtttgagaagacccacctggagcaccagcagagaattgagagcaaggtgtgcaaggccgccatcgccaccttctacgtgaatgtgaaggagcagttcatcaagatgctgaaggagagccagatgctgaccaacctgaagaggaagaatgccaagatgatcagtgacatcgagaagaagaggcagaggatgattgaggtgcaggatgagctgctgcggctggagccccagctgaagcagctgcagaccaagtatgatgagctgaaggagaggaagagcagcctgagaaatgctgcctacttcctgagcaacctgaagcagctgtaccaggactacagtgatgtgcaggcccaggagcccaacgtgaaggagacctatgacagcagcagcctgcctgccctgctcttcaaggcccggaccctgctgggcgctgagagccacctgaggaacatcaaccaccagctggagaagctgctggaccagggctag

SEQ ID NO: 160211 - DNA, 963 bp, Artificial Sequence
  Description of Artificial Sequence: Synthetic coding sequence
atggccccccggggcagaagaagaccccggccccacaggtctgagggcgcccggcgcagcaagaacaccctggagaggacccacagcatgaaggacaaggccggccagaagtgcaagcccattgatgtgtttgacttcccagacaacagtgatgtgagcagcatcggccgcctgggggagaatgagaaggatgaggagacctatgagacctttgatcctcccctgcacagcacagccatctatgcagatgaggaggagttcagcaagcactgcggcctgagcctgagcagcaccccacctgggaaggaggccaagaggagcagtgacaccagcggaaatgaggccagcgagattgagagcgtgaagatcagcgccaagaagccaggcaggaagctgcggcccatcagtgatgattctgagagcattgaggagagtgacaccaggaggaaggtgaagtctgctgagaagatcagcacccagagacatgaggtgatccgcaccacagccagcagcgagctgtctgagaagccagctgagagcgtgaccagcaagaagacaggccccctgagcgcccagcccagcgtggagaaggagaacctggccatcgagagccagagcaagacccagaagaagggcaagatcagccatgacaagaggaagaagagccgcagcaaggccatcggcagtgacaccagtgacatcgtgcacatctggtgcccagagggcatgaagaccagtgacatcaaggagctgaacatcgtgctgcctgagtttgagaagacccacctggagcaccagcagagaattgagagcaaggtgtgcaaggccgccatcgccaccttctacgtgaatgtgaaggagcagttcatcaagatgctgaaggagagccagatgctgaccaacctgaagaggaagaatgccaaggtgcgggccacagctgagaccaccaccaacaagatctag

SEQ ID NO: 160212 - DNA, 963 bp, Artificial Sequence
  Description of Artificial Sequence: Synthetic coding sequence
atggccccccggggcagaagaagaccccggccccacaggtctgagagcgcccggcgcagcaagaacaccctggagaggacccacagcatgaaggacaaggccggccagaagtgcaagcccattgatgtgtttgacttcccagacaacagtgatgtgagcagcatcggccgcctgggggagaatgagaaggatgaggagacctatgagacctttgatcctcccctgcacagcacagccatctatgcagatgaggaggagttcagcaagcactgcggcctgagcctgagcagcaccccacctgggaaggaggccaagaggagcagtgacaccagcggaaatgaggccagcgagattgagagcgtgaagatcagcgccaagaagccaggcaggaagctgcggcccatcagtgatgattctgagagcattgaggagagtgacaccaggaggaaggtgaagtctgctgagaagatcagcacccagagacatgaggtgatccgcaccacagccagcagcgagctgtctgagaagccagctgagagcgtgaccagcaagaagacaggccccctgagcgcccagcccagcgtggagaaggagaacctggccatcgagagccagagcaagacccagaagaagggcaagatcagccatgacaagaggaagaagagccgcagcaaggccatcggcagtgacaccagtgacatcgtgcacatctggtgcccagagggcatgaagaccagtgacatcaaggagctgaacatcgtgctgcctgagtttgagaagacccacctggagcaccagcagagaattgagagcaaggtgtgcaaggccgccatcgccaccttctacgtgaatgtgaaggagcagttcatcaagatgctgaaggagagccagatgctgaccaacctgaagaggaagaatgccaaggtgcgggccacagctgagaccaccaccaacaagatctag

SEQ ID NO: 160213 - DNA, 1014 bp, Artificial Sequence
  Description of Artificial Sequence: Synthetic coding sequence
atggccccccggggcagaagaagaccccggccccacaggtctgagggcgcccggcgcagcaagaacaccctggagaggacccacagcatgaaggacaaggccggccagaagtgcaagcccattgatgtgtttgacttcccagacaacagtgatgtgagcagcatcggccgcctgggggagaatgagaaggatgaggagacctatgagacctttgatcctcccctgcacagcacagccatctatgcagatgaggaggagttcagcaagcactgcggcctgagcctgagcagcaccccacctgggaaggaggccaagaggagcagtgacaccagcggaaatgaggccagcgagattgagagcgtgaagatcagcgccaagaagccaggcaggaagctgcggcccatcagtgatgattctgagagcattgaggagagtgacaccaggaggaaggtgaagtctgctgagaagatcagcacccagagacatgaggtgatccgcaccacagccagcagcgagctgtctgagaagccagctgagagcgtgaccagcaagaagacaggccccctgagcgcccagcccagcgtggagaaggagaacctggccatcgagagccagagcaagacccagaagaagggcaagatcagccatgacaagaggaagaagagccgcagcaaggccatcggcagtgacaccagtgacatcgtgcacatctggtgcccagagggcatgaagaccagtgacatcaaggagctgaacatcgtgctgcctgagtttgagaagacccacctggagcaccagcagagaattgagagcaaggtgtgcaaggccgccatcgccaccttctacgtgaatgtgaaggagcagttcatcaagatgctgaaggagagccagatgctgaccaacctgaagaggaagaatgccaagatgatcagtgacatcgagaagaagaggcagaggatgattgaggtgcaggatgagctgctgcggctgtggacaggagctggcctgtggtag

SEQ ID NO: 160214 - DNA, 2760 bp, Artificial Sequence
  Description of Artificial Sequence: Synthetic coding sequence
atggctgctgatgtgttcatgtgcagcccccggcggcccaggagccggggccggcaggtgctgctgaagccccaggtgtctgaagatgatgatgacagcgacacagatgagcccagccccccaccagccagcggggccgccaccccagcccgggcccacgccagcgctgcccctcctccacccagggctggccctggccgggaggagcccccccggcggcagcagatcatccacagcggccacttcatggtgagcagcccccaccgggagcacccccccaagaagggctatgactttgacacagtgaacaagcagacctgccagacctacagctttgggaagaccagcagctgccacctgagcattgatgccagcctgaccaagctgtttgagtgcatgaccctggcctacagcggcaagctggtgagccccaagtggaagaacttcaagggcctgaagctgcagtggagggacaagatccggctgaacaatgccatctggagggcctggtacatgcagtacctggagaagaggaagaaccctgtgtgccactttgtgacccccctggatggctctgtggatgtggatgagcacagaagacctgaggccatcaccacagagggcaagtactggaagagcagaattgaaattgtcatccgggagtaccacaagtggaggacctacttcaagaagaggctgcagcagcacaaggatgaggacctgagcagcctggtgcaggatgatgacatgctgtactggcacaagcatggagatggctggaagacccctgtgcccatggaggaggaccccctgctggacacagacatgctgatgtctgagttcagtgacaccctcttcagcaccctgagcagccaccagcctgtggcctggcccaacccccgggagatcgcccacctgggcaatgctgacatgatccagcccggcctcatccccctgcagcccaacctggacttcatggacacctttgagcccttccaggacctcttcagcagcagccgcagcatcttcggctccatgctgcctgccagcgccagcgcccctgtgcctgaccccaacaaccccccagcccaggagagcatcctgcccaccacagccctgcccaccgtgtccctgcctgacagcctgattgccccacccacagcccccagcctggcccacatggatgagcagggctgtgagcacaccagcaggacagaggaccccttcatccagcccacagactttggccccagcgagccccccctgtctgtgccccagcccttcctgcccgtcttcaccatgcccctgctgagccccagccctgcccccccacccatcagccctgtgctgcccctggtgcccccaccagccacagccctgaaccccccagccccacccaccttccaccagccccagaagtttgctggggtgaacaaggcccccagcgtcatcacccacacagccagcgccaccctgacccatgatgccccagccaccaccttcagccagagccagggcctggtgatcaccacccaccacccagcccccagcgctgccccctgtggcctggccctgagccctgtgaccaggcctccccagccccggctgacctttgtgcaccccaagcctgtgtccctgactggaggccggcccaagcagccccacaagatcgtgcctgcccccaagccagagcctgtgtccctggtgctgaagaatgccagaattgccccagctgccttcagcggccagccccaggccgtcatcatgaccagcggccccctgaagcgggagggcatgctggccagcacagtgtcccagagcaatgtggtgattgccccagctgccatcgcccgggcccctggggtgcctgagttccacagcagcatcctggtgacagacctgggccacggcaccagcagccccccagcccctgtgtcccggctcttccccagcacagcccaggaccccctgggcaaaggagagcaggtgcccctgcacggcggcagcccccaggtgacagtgacaggccccagccgggactgccccaacagcggccaggccagcccctgtgccagcgagcagagccccagcccccagagcccccagaacaactgcagcggcaagagtgaccccaagaatgtggccgccctgaagaaccggcagatgaagcacatctctgctgagcagaagaggcgcttcaacatcaagatgtgctttgacatgctgaacagcctcatcagcaacaacagcaagctgaccagccacgccatcaccctgcagaagacagtggagtacatcaccaagctgcagcaggagcggggccagatgcaggaggaggcccggcggctgcgggaggagattgaggagctgaatgccaccatcatcagctgccagcagctgctgcctgccaccggggtgcctgtgacccggcggcagtttgaccacatgaaggacatgtttgatgaatatgtgaagaccaggaccctgcagaactggaagttctggatcttcagcatcatcatcaagcccctgtttgagagcttcaagggcatggtgtccaccagcagcctggaggagctgcacaggacagccctgtcctggctggaccagcactgcagcctgcccatcctgcggcccatggtgctgagcaccctgcggcagctgagcaccagcaccagcatcctgacagatcctgcccagctgcctgagcaggccagcaaggctgtgacccgcatcggcaagaggctgggggagagctag

SEQ ID NO: 160215 - DNA, 657 bp, Artificial Sequence
  Description of Artificial Sequence: Synthetic coding sequence
atggatgagcagggctgtgagcacaccagcaggacagaggaccccttcatccagcccacagactttggccccagcgagccccccctgtctgtgcccccaccacccatcagccctgtgctgcccctggtgcccccaccagccacagccctgaaccccccagccccacccaccttccaccagccccagaagtttgctggggtgaacaaggcccccagcgtcatcacccacacagccagcgccaccctgacccatgatgccccagccaccaccttcagccagagccagggcctggtgatcaccacccaccacccagcccccagcgctgccccctgtggcctggccctgagccctgtgaccaggcctccccagccccggctgacctttgtgcaccccaagcctgtgtccctgactggaggccggcccaagcagccccacaagatcgtgcctgcccccaagccagagcctgtgtccctggtgctgaagaatgccagaattgcccctggagagcccggcggggagacccagtgtggggcccccccagaccctgagggctgcttccccatccccaaggccttcaagctggtgaccaccaccaccaccctggtgtgcacctgcatgaggacccacatccacctgaatgagaccaaggtgtcctag

SEQ ID NO: 160216 - DNA, 1581 bp, Artificial Sequence
  Description of Artificial Sequence: Synthetic coding sequence
atggatgagcagggctgtgagcacaccagcaggacagaggaccccttcatccagcccacagactttggccccagcgagccccccctgtctgtgccccagcccttcctgcctgtgttcaccatgcccctgctgagccccagccctgcccccccacccatcagccctgtgctgcccctggtgcccccaccagccacagccctgaaccccccagccccacccaccttccaccagccccagaagtttgctggggtgaacaaggcccccagcgtcatcacccacacagccagcgccaccctgacccatgatgccccagccaccaccttcagccagagccagggcctggtgatcaccacccaccacccagcccccagcgctgccccctgtggcctggccctgagccctgtgacccggcccccccagccccggctgacctttgtgcaccccaagcctgtgtccctgaccggcggccggcccaagcagccccacaagatcgtgcctgcccccaagccagagcctgtgtccctggtgctgaagaatgcccgcatcgccccagctgccttcagcggccagccccaggccgtcatcatgaccagcggccccctgaagcgggagggcatgctggccagcacagtgtcccagagcaatgtggtgattgccccagctgccatcgcccgggcccctggggtgcctgagttccacagcagcatcctggtgacagacctgggccacggcaccagcagccccccagcccctgtgagccgcctcttccccagcacagcccaggaccccctgggcaagggggagcaggtgcccctgcatggaggcagcccccaggtgacagtgacaggccccagccgggactgccccaacagcggccaggccagcccctgtgccagcgagcagagccccagcccccagagcccccagaacaactgcagcggcaagagtgaccccaagaatgtggccgccctgaagaaccggcagatgaagcacatctctgctgagcagaagaggcgcttcaacatcaagatgtgctttgacatgctgaacagcctcatcagcaacaacagcaagctgaccagccacgccatcaccctgcagaagacagtggagtacatcaccaagctgcagcaggagcggggccagatgcaggaggaggcccggcggctgcgggaggagattgaggagctgaatgccaccatcatcagctgccagcagctgctgcctgccactggagtgcctgtgacccggcggcagtttgaccacatgaaggacatgtttgatgaatatgtgaagaccaggaccctgcagaactggaagttctggatcttcagcatcatcatcaagcccctgtttgagagcttcaagggcatggtgtccaccagcagcctggaggagctgcacaggacagccctgtcctggctggaccagcactgcagcctgcccatcctgcggcccatggtgctgagcaccctgcggcagctgagcaccagcaccagcatcctgacagatcctgcccagctgcctgagcaggccagcaaggctgtgaccagaattggcaagaggctgggggagagctag

SEQ ID NO: 160217 - DNA, 2559 bp, Artificial Sequence
  Description of Artificial Sequence: Synthetic coding sequence
atggccggggccctggccggcctggccgccggcctgcaggtgccccgggtggcccccagcccagacagcgacagcgacacagattctgaggaccccagcctgcggcgctctgctgggggcctgctgcggagccaggtgatccacagcggccacttcatggtgagcagcccccacagcgacagcctgcccaggagaagagaccaggagggctctgtgggccccagcgactttggccccaggagcattgaccccaccctgacccggctgtttgaatgtctgagcctggcctacagcggcaagctggtgagccccaagtggaagaacttcaagggcctgaagctgctgtgccgggacaagatccggctgaacaatgccatctggagggcctggtacatccagtatgtgaagaggaggaagagccctgtgtgtggctttgtgacccccctgcagggccctgaggctgatgcccacaggaagccagaggccgtggtgctggagggcaactactggaagaggcgcatcgaggtggtgatgagggagtaccacaagtggaggatctactacaagaagaggctgaggaagcccagccgggaggatgacctgctggcccccaagcaggccgagggccgctggcccccacctgagcagtggtgcaagcagctgttcagctctgtggtgcctgtgctgctgggggaccctgaggaggagcccggcggccggcagctgctggacctgaactgcttcctgagtgacatcagtgacaccctcttcaccatgacccagagcggccccagccccctgcagctgcccccagaagatgcctacgtgggcaatgctgacatgatccagcctgacctgacccccctgcagcccagcctggatgacttcatggacatcagtgacttcttcaccaacagccggctgccccagccccccatgcccagcaacttccctgagccccccagcttcagccctgtggtggacagcctcttcagcagcggcaccctgggccctgaggtgcccccagccagcagcgccatgacccacctgagcggccacagccggctgcaggccaggaacagctgccccggccccctggacagcagcgccttcctgagcagtgacttcctgctgcctgaggaccccaagccccggctgcccccacctcctgtgcccccacccctgctgcactacccacctccagccaaggtgcccggcctggagccctgccccccaccacccttcccccccatggccccacccacagccctgctgcaggaggagcccctcttcagcccccgcttccccttccccaccgtgcccccagcccctggggtgagccccctgcctgccccagctgccttcccccccaccccccagagcgtgcccagccctgcccccacccccttccccatcgagctgctgcccctgggctacagcgagcccgccttcggcccctgcttctccatgccccggggcaagcccccagcccccagcccccggggccagaaggccagcccccccaccctggccccagccacagccagcccccccaccacagctggcagcaacaacccctgcctgacccagctgctgacagctgccaagccagagcaggccctggagccccccctggtgagcagcaccctgctgcggagccctggcagcccccaggagaccgtgcctgagttcccctgcaccttcctgccccccaccccagcccccaccccaccccggcccccacctggccctgccaccctggcccccagccggcccctgctggtgcccaaggccgagcggctgagccccccagcccccagcggcagcgagcggcggctgagcggggacctgagctccatgcctggccctggcaccctgtctgtgcgggtgagccccccccagcccatcctgagccggggccgcccagacagcaacaagacagagaacagacgcatcacccacatctctgctgagcagaagaggcgcttcaacatcaagctgggctttgacaccctgcacggcctggtgtccaccctgagcgcccagcccagcctgaaggtgtccaaggccaccaccctgcagaagacagctgagtacatcctgatgctgcagcaggagcgggccggcctgcaggaggaggcccagcagctgagagatgaaattgaggagctgaatgctgccatcaacctgtgccagcagcagctgcctgccaccggggtgcccatcacccaccagagatttgaccagatgagggacatgtttgatgattatgtgaggaccaggaccctgcacaactggaagttctgggtgttcagcatcctgatccggcccctgtttgagagcttcaacggcatggtgtccacagcctctgtgcacaccctgcggcagaccagcctggcctggctggaccagtactgcagcctgcctgccctgcggcccaccgtgctgaacagcctgcggcagctgggcaccagcaccagcatcctgacagaccccggccgcatccctgagcaggccaccagggctgtgacagagggcaccctgggcaagcccctgtag

SEQ ID NO: 160218 - DNA, 2496 bp, Artificial Sequence
  Description of Artificial Sequence: Synthetic coding sequence
atggccggggccctggccggcctggccgccggcctgcaggtgccccgggtggcccccagcccagacagcgacagcgacacagattctgaggaccccagcctgcggcgctctgctgggggcctgctgcggagccaggtgatccacagcggccacttcatggtgagcagcccccacagcgacagcctgcccaggagaagagaccaggagggctctgtgggccccagcgactttggccccaggagcattgaccccaccctgacccggctgtttgaatgtctgagcctggcctacagcggcaagctggtgagccccaagtggaagaacttcaagggcctgaagctgctgtgccgggacaagatccggctgaacaatgccatctggagggcctggtacatccagtatgtgaagaggaggaagagccctgtgtgtggctttgtgacccccctgcagggccctgaggctgatgcccacaggaagccagaggccgtggtgctggagggcaactactggaagaggcgcatcgaggtggtgatgagggagtaccacaagtggaggatctactacaagaagaggctgaggaagcccagccgggaggatgacctgctggcccccaagcaggccgagggccgctggcccccacctgagcagtggtgcaagcagctgttcagctctgtggtgcctgtgctgctgggggaccctgaggaggagcccggcggccggcagctgctggacctgaactgcttcctgagtgacatcagtgacaccctcttcaccatgacccagagcggccccagccccctgcagctgcccccagaagatgcctacgtgggcaatgctgacatgatccagcctgacctgacccccctgcagcccagcctggatgacttcatggacatcagtgacttcttcaccaacagccggctgccccagccccccatgcccagcaacttccctgagccccccagcttcagccctgtggtggacagcctcttcagcagcggcaccctgggccctgaggtgcccccagccagcagcgccatgacccacctgagcggccacagccggctgcaggccaggaacagctgccccggccccctggacagcagcgccttcctgagcagtgacttcctgctgcctgaggaccccaagccccggctgcccccacctcctgtgcccccacccctgctgcactacccacctccagccaaggtgcccggcctggagccctgccccccaccacccttcccccccatggccccacccacagccctgctgcaggaggagcccctcttcagcccccgcttccccttccccaccgtgcccccagcccctggggtgagccccctgcctgccccagctgccttcccccccaccccccagagcgtgcccagccctgcccccacccccttccccatcgagctgctgcccctgggctacagcgagcccgccttcggcccctgcttctccatgccccggggcaagcccccagcccccagcccccggggccagaaggccagcccccccaccctggccccagccacagccagcccccccaccacagctggcagcaacaacccctgcctgacccagctgctgacagctgccaagccagagcaggccctggagccccccctggtgagcagcaccctgctgcggagccctggcagcccccaggagaccgtgcctgagttcccctgcaccttcctgccccccaccccagcccccaccccaccccggcccccacctggccctgccaccctggcccccagccggcccctgctggtgcccaaggccgagcggctgagccccccagcccccagcggcagcgagcggcggctgagcggggacctgagctccatgcctggccctggcaccctgtctgtgcgggtgagccccccccagcccatcctgagccggggccgcccagacagcaacaagaacagacgcatcacccacatctctgctgagcagaagaggcgcttcaacatcaagctgggctttgacaccctgcacggcctggtgtccaccctgagcgcccagcccagcctgaaggagagagctggcctgcaggaggaggcccagcagctgagagatgaaattgaggagctgaatgctgccatcaacctgtgccagcagcagctgcctgccactggagtgcccatcacccaccagagatttgaccagatgagggacatgtttgatgattatgtgaggaccaggaccctgcacaactggaagttctgggtgttcagcatcctgatccggcccctgtttgagagcttcaacggcatggtgtccacagcctctgtgcacaccctgcggcagaccagcctggcctggctggaccagtactgcagcctgcctgccctgcggcccaccgtgctgaacagcctgcggcagctgggcaccagcaccagcatcctgacagatcctggccgcatccctgagcaggccaccagggctgtgacagagggcaccctgggcaagcccctgtag

SEQ ID NO: 160219 - DNA, 2280 bp, Artificial Sequence
  Description of Artificial Sequence: Synthetic coding sequence
atggccggggccctggccggcctggccgccggcctgcaggtgccccgggtggcccccagcccagacagcgacagcgacacagattctgaggaccccagcctgcggcgctctgctgggggcctgctgcggagccaggtgatccacagcggccacttcatggtgagcagcccccacagcgacagcctgcccaggagaagagaccaggagggctctgtgggccccagcgactttggccccaggagcattgaccccaccctgacccggctgtttgaatgtctgagcctggcctacagcggcaagctggtgagccccaagtggaagaacttcaagggcctgaagctgctgtgccgggacaagatccggctgaacaatgccatctggagggcctggtacatccagtatgtgaagaggaggaagagccctgtgtgtggctttgtgacccccctgcagggccctgaggctgatgcccacaggaagccagaggccgtggtgctggagggcaactactggaagaggcgcatcgagctgcccccagaagatgcctacgtgggcaatgctgacatgatccagcctgacctgacccccctgcagcccagcctggatgacttcatggacatcagtgacttcttcaccaacagccggctgccccagccccccatgcccagcaacttccctgagcccccatccttcagccctgtggtggacagcctcttcagcagcggcaccctgggccctgaggtgcccccagccagcagcgccatgacccacctgagcggccacagccggctgcaggccaggaacagctgccccggccccctggacagcagcgccttcctgagcagtgacttcctgctgcctgaggaccccaagccccggctgcccccacctcctgtgcccccacccctgctgcactacccacctccagccaaggtgcccggcctggagccctgccccccaccacccttcccccccatggccccacccacagccctgctgcaggaggagcccctcttcagcccccgcttccccttccccaccgtgcccccagcccctggggtgagccccctgcctgccccagctgccttcccccccaccccccagagcgtgcccagccctgcccccacccccttccccatcgagctgctgcccctgggctacagcgagcccgccttcggcccctgcttctccatgccccggggcaagcccccagcccccagcccccggggccagaaggccagcccccccaccctggccccagccacagccagcccccccaccacagctggcagcaacaacccctgcctgacccagctgctgacagctgccaagccagagcaggccctggagccccccctggtgagcagcaccctgctgcggagccctggcagcccccaggagaccgtgcctgagttcccctgcaccttcctgccccccaccccagcccccaccccacccaggcctcctcctggccctgccaccctggcccccagccggcccctgctggtgcccaaggccgagcggctgagccccccagcccccagcggcagcgagcggcggctgagcggggacctgagctccatgcctggccctggcaccctgtctgtgcgggtgtccccaccccagcccatcctgagccggggccgcccagacagcaacaagacagaaaatcgccgcatcacccacatctctgctgagcagaagaggcgcttcaacatcaagctgggctttgacaccctgcacggcctggtgtccaccctgagcgcccagcccagcctgaaggtgtccaaggccaccaccctgcagaagacagctgagtacatcctgatgctgcagcaggagagagctggcctgcaggaggaggcccagcagctgagagatgaaattgaggagctgaatgctgccatcaacctgtgccagcagcagctgcctgccactggagtgcccatcacccaccagagatttgaccagatgagggacatgtttgatgattatgtgaggaccaggaccctgcacaactggaagttctgggtgttcagcatcctgatccggcccctgtttgagagcttcaacggcatggtgtccacagcctctgtgcacaccctgcggcagaccagcctggcctggctggaccagtactgcagcctgcctgccctgcggcccaccgtgctgaacagcctgcggcagctgggcaccagcaccagcatcctgacagatcctggccgcatccctgagcaggccaccagggctgtgacagagggcaccctgggcaagcccctgtag

SEQ ID NO: 160220 - DNA, 2553 bp, Artificial Sequence
  Description of Artificial Sequence: Synthetic coding sequence
atggccggggccctggccggcctggccgccggcctgcaggtgccccgggtggcccccagcccagacagcgacagcgacacagattctgaggaccccagcctgcggcgctctgctgggggcctgctgcggagccaggtgatccacagcggccacttcatggtgagcagcccccacagcgacagcctgcccaggagaagagaccaggagggctctgtgggccccagcgactttggccccaggagcattgaccccaccctgacccggctgtttgaatgtctgagcctggcctacagcggcaagctggtgagccccaagtggaagaacttcaagggcctgaagctgctgtgccgggacaagatccggctgaacaatgccatctggagggcctggtacatccagtatgtgaagaggaggaagagccctgtgtgtggctttgtgacccccctgcagggccctgaggctgatgcccacaggaagccagaggccgtggtgctggagggcaactactggaagaggcgcatcgaggtggtgatgagggagtaccacaagtggaggatctactacaagaagaggctgaggaagcccagccgggaggatgacctgctggcccccaagcaggccgagggccgctggcccccacctgagcagtggtgcaagcagctgttcagctctgtggtgcctgtgctgctgggggaccctgaggaggagcccggcggccggcagctgctggacctgaactgcttcctgagtgacatcagtgacaccctcttcaccatgacccagagcggccccagccccctgcagctgcccccagaagatgcctacgtgggcaatgctgacatgatccagcctgacctgacccccctgcagcccagcctggatgacttcatggacatcagtgacttcttcaccaacagccggctgccccagccccccatgcccagcaacttccctgagccccccagcttcagccctgtggtggacagcctcttcagcagcggcaccctgggccctgaggtgcccccagccagcagcgccatgacccacctgagcggccacagccggctgcaggccaggaacagctgccccggccccctggacagcagcgccttcctgagcagtgacttcctgctgcctgaggaccccaagccccggctgcccccacctcctgtgcccccacccctgctgcactacccacctccagccaaggtgcccggcctggagccctgccccccaccacccttcccccccatggccccacccacagccctgctgcaggaggagcccctcttcagcccccgcttccccttccccaccgtgcccccagcccctggggtgagccccctgcctgccccagctgccttcccccccaccccccagagcgtgcccagccctgcccccacccccttccccatcgagctgctgcccctgggctacagcgagcccgccttcggcccctgcttctccatgccccggggcaagcccccagcccccagcccccggggccagaaggccagcccccccaccctggccccagccacagccagcccccccaccacagctggcagcaacaacccctgcctgacccagctgctgacagctgccaagccagagcaggccctggagccccccctggtgagcagcaccctgctgcggagccctggcagcccccaggagaccgtgcctgagttcccctgcaccttcctgccccccaccccagcccccaccccaccccggcccccacctggccctgccaccctggcccccagccggcccctgctggtgcccaaggccgagcggctgagccccccagcccccagcggcagcgagcggcggctgagcggggacctgagctccatgcctggccctggcaccctgtctgtgcgggtgagccccccccagcccatcctgagccggggccgcccagacagcaacaagaacagacgcatcacccacatctctgctgagcagaagaggcgcttcaacatcaagctgggctttgacaccctgcacggcctggtgtccaccctgagcgcccagcccagcctgaaggtgtccaaggccaccaccctgcagaagacagctgagtacatcctgatgctgcagcaggagcgggccggcctgcaggaggaggcccagcagctgagagatgaaattgaggagctgaatgctgccatcaacctgtgccagcagcagctgcctgccaccggggtgcccatcacccaccagagatttgaccagatgagggacatgtttgatgattatgtgaggaccaggaccctgcacaactggaagttctgggtgttcagcatcctgatccggcccctgtttgagagcttcaacggcatggtgtccacagcctctgtgcacaccctgcggcagaccagcctggcctggctggaccagtactgcagcctgcctgccctgcggcccaccgtgctgaacagcctgcggcagctgggcaccagcaccagcatcctgacagaccccggccgcatccctgagcaggccaccagggctgtgacagagggcaccctgggcaagcccctgtag

SEQ ID NO: 160221 - DNA, 2502 bp, Artificial Sequence
  Description of Artificial Sequence: Synthetic coding sequence
atggccggggccctggccggcctggccgccggcctgcaggtgccccgggtggcccccagcccagacagcgacagcgacacagattctgaggaccccagcctgcggcgctctgctgggggcctgctgcggagccaggtgatccacagcggccacttcatggtgagcagcccccacagcgacagcctgcccaggagaagagaccaggagggctctgtgggccccagcgactttggccccaggagcattgaccccaccctgacccggctgtttgaatgtctgagcctggcctacagcggcaagctggtgagccccaagtggaagaacttcaagggcctgaagctgctgtgccgggacaagatccggctgaacaatgccatctggagggcctggtacatccagtatgtgaagaggaggaagagccctgtgtgtggctttgtgacccccctgcagggccctgaggctgatgcccacaggaagccagaggccgtggtgctggagggcaactactggaagaggcgcatcgaggtggtgatgagggagtaccacaagtggaggatctactacaagaagaggctgaggaagcccagccgggaggatgacctgctggcccccaagcaggccgagggccgctggcccccacctgagcagtggtgcaagcagctgttcagctctgtggtgcctgtgctgctgggggaccctgaggaggagcccggcggccggcagctgctggacctgaactgcttcctgagtgacatcagtgacaccctcttcaccatgacccagagcggccccagccccctgcagctgcccccagaagatgcctacgtgggcaatgctgacatgatccagcctgacctgacccccctgcagcccagcctggatgacttcatggacatcagtgacttcttcaccaacagccggctgccccagccccccatgcccagcaacttccctgagccccccagcttcagccctgtggtggacagcctcttcagcagcggcaccctgggccctgaggtgcccccagccagcagcgccatgacccacctgagcggccacagccggctgcaggccaggaacagctgccccggccccctggacagcagcgccttcctgagcagtgacttcctgctgcctgaggaccccaagccccggctgcccccacctcctgtgcccccacccctgctgcactacccacctccagccaaggtgcccggcctggagccctgccccccaccacccttcccccccatggccccacccacagccctgctgcaggaggagcccctcttcagcccccgcttccccttccccaccgtgcccccagcccctggggtgagccccctgcctgccccagctgccttcccccccaccccccagagcgtgcccagccctgcccccacccccttccccatcgagctgctgcccctgggctacagcgagcccgccttcggcccctgcttctccatgccccggggcaagcccccagcccccagcccccggggccagaaggccagcccccccaccctggccccagccacagccagcccccccaccacagctggcagcaacaacccctgcctgacccagctgctgacagctgccaagccagagcaggccctggagccccccctggtgagcagcaccctgctgcggagccctggcagcccccaggagaccgtgcctgagttcccctgcaccttcctgccccccaccccagcccccaccccaccccggcccccacctggccctgccaccctggcccccagccggcccctgctggtgcccaaggccgagcggctgagccccccagcccccagcggcagcgagcggcggctgagcggggacctgagctccatgcctggccctggcaccctgtctgtgcgggtgagccccccccagcccatcctgagccggggccgcccagacagcaacaagacagagaacagacgcatcacccacatctctgctgagcagaagaggcgcttcaacatcaagctgggctttgacaccctgcacggcctggtgtccaccctgagcgcccagcccagcctgaaggagagagctggcctgcaggaggaggcccagcagctgagagatgaaattgaggagctgaatgctgccatcaacctgtgccagcagcagctgcctgccactggagtgcccatcacccaccagagatttgaccagatgagggacatgtttgatgattatgtgaggaccaggaccctgcacaactggaagttctgggtgttcagcatcctgatccggcccctgtttgagagcttcaacggcatggtgtccacagcctctgtgcacaccctgcggcagaccagcctggcctggctggaccagtactgcagcctgcctgccctgcggcccaccgtgctgaacagcctgcggcagctgggcaccagcaccagcatcctgacagatcctggccgcatccctgagcaggccaccagggctgtgacagagggcaccctgggcaagcccctgtag

SEQ ID NO: 160222 - DNA, 1059 bp, Artificial Sequence
  Description of Artificial Sequence: Synthetic coding sequence
atgaacaccatcgtgttcaacaagctgagcggggctgtgctgtttgaagatggaggagccagcgagcgggagcggggcggccggccctacagcggcgtgctggacagcccccacgcccggcctgaggtgggcatcccagatggcccccccctgaaggacaacctgggcctgcggcacagaagaactggagcccggcagaatggaggcaaggtgcgccacaagaggcaggccctgcaggacatggcccggcccctgaagcagtggctgtacaagcaccgggacaacccctaccccaccaagacagagaagatcctgctggccctgggcagccagatgaccctggtgcaggtgagcaactggtttgccaatgcccggcggcggctgaagaacacagtgcggcagcctgacctgtcctgggccctgcgcatcaagctgtacaacaagtatgtgcagggcaatgctgagcggctgtctgtgtccagtgatgacagctgcagtgaagatggagagaacccccccaggacccacatgaatgaaggaggctacaacacccctgtgcaccaccctgtgatcaagtctgagaacagcgtcatcaaggccggcgtgcggcctgagagccgggccagcgaggactatgtggccccacccaagtacaagagcagcctgctgaaccgctacctgaatgacagcctgcggcacgtgatggccaccaacaccaccatgatgggcaagacccggcagaggaaccacagcggcagcttcagcagcaatgaatttgaggaggagctggtgagccccagcagcagcgagacagagggcaactttgtgtacagaacagacaccctggagaatggcagcaacaagggggagagcgctgccaacaggaagggccccagcaaggatgacacctactggaaggagatcaatgctgccatggccctgaccaacctggcccagggcaaggacaagctgcagggcaccaccagctgcatcatccagaagagcagccacatcgccgaggtgaagacagtgaaggtgcccctggtgcagcagttctag

SEQ ID NO: 160223 - DNA, 1059 bp, Artificial Sequence; identical to SEQ ID NO: 160222
  Description of Artificial Sequence: Synthetic coding sequence

SEQ ID NO: 160224 - DNA, 177 bp, Artificial Sequence
  Description of Artificial Sequence: Synthetic coding sequence
atgaacaccatcgtgttcaacaagctgagcggggctgtgctgtttgaagatggaggagccagcgagcgggagcggggcggccggccctacagcggcgtgctggacagcccccacgcccggcctgaggtgggcatcccagatggcccccccctgaaggacaacctgggcctgaggtag

SEQ ID NO: 160225 - DNA, 288 bp, Artificial Sequence
  Description of Artificial Sequence: Synthetic coding sequence
atgaactttgacttccccttcaagaagggcagcggcatccccctgctgaccaccaacctgagcccccagtgcctgagcctgctgcacgccatggtggcctatgaccctgatgaaagaattgctgcccaccaggccctgcagcacccctacttccaggagcagaggacccagaatggaagtgaagatgaggccagcgctgtgctgctgcccatccagaccaggagcagcctgaaccccctgctgagcacctgcatgctgcccggccgctctgtgaccctgctggtgtag

SEQ ID NO: 160226 - DNA, 1260 bp, Artificial Sequence
  Description of Artificial Sequence: Synthetic coding sequence
atgaagaactacaaggccatcggcaagatcggggagggcaccttcagcgaggtgatgaagatgcagagcctgagagatggcaactactatgcctgcaagcagatgaagcagagatttgagagcattgagcaggtgaacaacctgcgggagatccaggccctgcggcggctgaacccccaccccaacatcctgatgctgcacgaggtggtgtttgacaggaagagcggcagcctggccctgatctgtgagctgatggacatgaacatctatgagctgatccggggccgccgctaccccctgtctgagaagaagatcatgcactacatgtaccagctgtgcaagagcctggaccacatccacagaaatggcatcttccacagagatgtgaagccagagaacatcctgatcaagcaggatgtgctgaagctgggggactttggcagctgccgctctgtgtacagcaagcagccctacacagagtacatcagcacccgctggtaccgggccccagaatgtctgctgacagatggcttctacacctacaagatggacctgtggagcgctggctgtgtgttctatgaaattgccagcctgcagcccctcttccctggggtgaatgagctggaccagatcagcaagatccatgatgtgattggcaccccagcccagaagatcctgaccaagttcaagcagagccgggccatgaactttgacttccccttcaagaagggcagcggcatccccctgctgaccaccaacctgagcccccagtgcctgagcctgctgcacgccatggtggcctatgaccctgatgaaagaattgctgcccaccaggccctgcagcacccctacttccaggagcagaggaagacagagaagagggccctgggcagccacaggaaggccggcttccctgagcaccctgtggcccctgagcccctgagcaacagctgccagatcagcaaggagggcaggaagcagaagcagagcctgaagcaggaggaggaccggcccaagaggcggggccctgcctacgtgatggagctgcccaagctgaagctgtctggagtggtgcggctgagcagctacagcagccccaccctgcagagcgtgctgggcagcggcaccaacggccgggtgcctgtgctgcggcccctgaagtgcatcccagccagcaagaagacagacccccagaaggacctgaagccagccccccagcagtgccgcctgcccaccatcgtgaggaagggcggccgctag

SEQ ID NO: 160227 - DNA, 2667 bp, Artificial Sequence
  Description of Artificial Sequence: Synthetic coding sequence
atggccggggctgctgctgagagcggccgggagctgtggacctttgctggcagccgggaccccagcgccccccggctggcctacggctacggccctggcagcctgcgggagctgcgggcccgggagttcagccggctggccggcaccgtgtacctggaccatgctggggccaccctcttcagccagagccagctggagagcttcaccagtgacctgatggagaacacctacggcaacccccacagccagaacatcagcagcaagctgacccatgacacagtggagcaggtgcgctaccgcatcctggcccacttccacaccacagctgaggactacaccgtcatcttcaccgctggcagcacagctgccctgaagctggtggccgaggccttcccctgggtgtcccagggccctgagagcagcggcagccgcttctgctacctgacagacagccacacctctgtggtgggcatgagaaatgtgaccatggccatcaacgtcatcagcacccctgtgcggcctgaggacctgtggagcgctgaggagaggtctgccagcgccagcaacccagactgccagctgccccacctgttctgctacccagcccagagcaacttctctggagtgcgctaccccctgtcctggattgaggaggtgaagagcggccgcctgcaccctgtgtccacccctgggaagtggtttgtgctgctggatgctgccagctatgtgtccaccagccccctggacctgagcgcccaccaggccgactttgtgcccatctccttctacaagatcttcggcttccccaccggcctgggcgccctgctggtgcacaacagagctgcccccctgctgaggaagacctactttggaggcggcacagccagcgcctacctggccggggaggacttctacatcccccggcagagcgtggcccagagatttgaagatggcaccatctccttcctggatgtgattgccctgaagcacggctttgacaccctggagcggctgactggaggcatggagaacatcaagcagcacaccttcaccctggcccagtacacctacgtggccctgagcagcctgcagtacccaaatggagcccctgtggtgcgcatctacagcgacagcgagttcagcagccctgaggtgcagggccccatcatcaacttcaacgtgctggatgacaagggcaacatcatcggctacagccaggtggacaagatggccagcctgtacaacatccacctgaggacaggctgcttctgcaacacaggagcctgccagaggcacctgggcatcagcaatgagatggtgaggaagcacttccaggccggccacgtgtgtggggacaacatggacctgattgatggccagcccaccggctctgtgcgcatcagctttggctacatgagcaccctggatgatgtgcaggccttcctgcgcttcatcatcgacacccggctgcacagcagcggggactggcctgtgccccaggcccatgctgacacaggagagaccggggcccccagcgctgacagccaggctgatgtgatcccagctgtgatgggccgccgcagcctgagcccccaggaggatgccctgaccggcagccgggtgtggaacaacagcagcacagtgaatgctgtgcctgtggcccctcctgtgtgtgatgtggcccggacccagcccacccccagcgagaaggccgccggcgtgctggagggcgccctgggcccccacgtggtgaccaacctgtacctgtaccccatcaagagctgtgccgcctttgaggtgacccgctggcctgtgggcaaccagggcctgctgtatgaccgctcctggatggtggtgaaccacaacggggtgtgcctgagccagaagcaggagccccggctgtgcctgatccagcccttcatcgacctgcggcagaggatcatggtgatcaaggccaagggcatggagcccatcgaggtgcccctggaggagaacagcgagaggacccagatccggcagagccgggtgtgtgccgacagagtgtccacctatgactgtggggagaagatcagctcctggctgagcaccttcttcggccggccctgccacctgatcaagcagagcagcaacagccagagaaatgccaagaagaagcacggcaaggaccagctgcccggcaccatggccaccctgagcctggtgaatgaggcccagtacctgctgatcaacaccagcagcatcctggagctgcaccggcagctgaacaccagtgatgaaaatggcaaggaggagctgttcagcctgaaggacctgagcctgcgcttccgggccaacatcatcatcaacgggaagagggcctttgaggaggagaagtgggatgagatcagcatcggcagcctgcgcttccaggtgctgggcccctgccaccgctgccagatgatctgcatcgaccagcagacaggccagaggaaccagcacgtgttccagaagctgtctgagagccgggagaccaaggtgaactttggcatgtacctgatgcacgccagcctggacctgagcagcccctgcttcctgtctgtgggcagccaggtgctgcctgtgctgaaggaaaatgtggagggccatgacctgcctgccagcgagaagcaccaggatgtgaccagctag

SEQ ID NO: 160228 - DNA, 1863 bp, Artificial Sequence
  Description of Artificial Sequence: Synthetic coding sequence
atggccgcccggcccctgagcaggatgctgcggcggctgctgcggagcagcgcccggagctgcagcagcggggcccctgtgacccagccctgccctggagagagcgcccgggccgccagcgaggaggtgtccagaagacggcagttcctgcgggagcacgccgcccccttcagcgccttcctgacagacagctttggccggcagcacagctacctgcgcatcagcctgacagagaagtgcaacctgcgctgccagtactgcatgcctgaggagggcgtgcccctgacccccaaggccaacctgctgaccacagaggagatcctgaccctggcccggctgtttgtgaaggagggcatcgacaagatccggctgactggaggagagcccctcatccggccagatgtggtggacatcgtggcccagctgcagaggctggagggcctgcggaccatcggcgtgaccaccaacggcatcaacctggcccggctgctgccccagctgcagaaggccggcctgagcgccatcaacatcagcctggacaccctggtgcctgccaagtttgagttcatcgtgcggaggaagggcttccacaaggtgatggagggcatccacaaggccatcgagctgggctacaaccctgtgaaggtgaactgtgtggtgatgaggggcctgaatgaagatgagctgctggactttgctgccctgacagagggcctgcccctggatgtgcgcttcatcgagtacatgccctttgatggcaacaagtggaacttcaagaagatggtgtcctacaaggagatgctggacacagtgcggcagcagtggccagagctggagaaggtgcctgaggaggagagcagcacagccaaggccttcaagatccctggcttccagggccagatctccttcatcacctccatgtctgagcacttctgtggcacctgcaaccggctgcgcatcacagcagatggcaacctgaaggtgtgcctgtttggaaacagcgaggtgtccctgcgggaccacctgcgggccggggccagcgagcaggagctgctgcgcatcattggagctgctgtgggcaggaagaagaggcagcacgccgagctgttcctgatgttccccaacagccccccagccaaccccagcatcttctcctgggaccccctgcacgtgcagggcctgcggcccaggatgtccttcagcagccaggtggccaccctgtggaagggctgccgggtgccccagaccccacccctggcccagcagaggctgggcagcggcagcttccagaggcactacaccagcagagctgacagtgatgccaacagcaagtgcctgagccctggctcctgggccagcgctgcccccagcggcccccagctgaccagcgagcagctgacccacgtggacagcgagggccgggccgccatggtggatgtgggcaggaagccagacacagagcgggtggccgtggccagcgctgtggtgctgctgggccctgtggccttcaagctggtgcagcagaaccagctgaagaagggagatgccctggtggtggcccagctggccggcgtgcaggccgccaaggtgaccagccagctgatccccctgtgccaccacgtggccctgagccacatccaggtgcagctggagctggacagcaccaggcatgctgtgaagatccaggccagctgccgggcccggggccccactggagtggagatggaggccctgaccagcgctgctgtggccgccctgaccctgtatgacatgtgcaaggctgtgtcccgggacatcgtgctggaggagatcaagctgatcagcaagacaggaggccagagaggagacttccaccgggcctag

SEQ ID NO: 160229 - DNA, 1911 bp, Artificial Sequence
  Description of Artificial Sequence: Synthetic coding sequence
atggccgcccggcccctgagcaggatgctgcggcggctgctgcggagcagcgcccggagctgcagcagcggggcccctgtgacccagccctgccctggagagagcgcccgggccgccagcgaggaggtgtccagaagacggcagttcctgcgggagcacgccgcccccttcagcgccttcctgacagacagctttggccggcagcacagctacctgcgcatcagcctgacagagaagtgcaacctgcgctgccagtactgcatgcctgaggagggcgtgcccctgacccccaaggccaacctgctgaccacagaggagatcctgaccctggcccggctgtttgtgaaggagggcatcgacaagatccggctgactggaggagagcccctcatccggccagatgtggtggacatcgtggcccagctgcagaggctggagggcctgcggaccatcggcgtgaccaccaacggcatcaacctggcccggctgctgccccagctgcagaaggccggcctgagcgccatcaacatcagcctggacaccctggtgcctgccaagtttgagttcatcgtgcggaggaagggcttccacaaggtgatggagggcatccacaaggccatcgagctgggctacaaccctgtgaaggtgaactgtgtggtgatgaggggcctgaatgaagatgagctgctggactttgctgccctgacagagggcctgcccctggatgtgcgcttcatcgagtacatgccctttgatggcaacaagtggaacttcaagaagatggtgtcctacaaggagatgctggacacagtgcggcagcagtggccagagctggagaaggtgcctgaggaggagagcagcacagccaaggccttcaagatccctggcttccagggccagatctccttcatcacctccatgtctgagcacttctgtggcacctgcaaccggctgcgcatcacagcagatggcaacctgaaggtgtgcctgtttggaaacagcgaggtgtccctgcgggaccacctgcgggccggggccagcgagcaggagctgctgcgcatcattggagctgctgtgggcaggaagaagaggcagcacgccggcatgttcagcatcagccagatgaagaaccggcccatgatcctgattgagctgttcctgatgttccccaacagccccccagccaaccccagcatcttctcctgggaccccctgcacgtgcagggcctgcggcccaggatgtccttcagcagccaggtggccaccctgtggaagggctgccgggtgccccagaccccacccctggcccagcagaggctgggcagcggcagcttccagaggcactacaccagcagagctgacagtgatgccaacagcaagtgcctgagccctggctcctgggccagcgctgcccccagcggcccccagctgaccagcgagcagctgacccacgtggacagcgagggccgggccgccatggtggatgtgggcaggaagccagacacagagcgggtggccgtggccagcgctgtggtgctgctgggccctgtggccttcaagctggtgcagcagaaccagctgaagaagggagatgccctggtggtggcccagctggccggcgtgcaggccgccaaggtgaccagccagctgatccccctgtgccaccacgtggccctgagccacatccaggtgcagctggagctggacagcaccaggcatgctgtgaagatccaggccagctgccgggcccggggccccactggagtggagatggaggccctgaccagcgctgctgtggccgccctgaccctgtatgacatgtgcaaggctgtgtcccgggacatcgtgctggaggagatcaagctgatcagcaagacaggaggccagagaggagacttccaccgggcctag

SEQ ID NO: 160230 - DNA, 456 bp, Artificial Sequence
  Description of Artificial Sequence: Synthetic coding sequence
atgccctttgatggcaacaagtggaacttcaagaagatggtgtcctacaaggagatgctggacacagtgcggcagcagtggccagagctggagaaggtgcctgaggaggagagcagcacagccaaggccttcaagatccctggcttccagggccagatctccttcatcaccagcatcctgactgtggcccggagctgctggcccctcttcctgtggccacccagcagcgagaccggctgtgcccacatgggccacagccccaaggacagctgccagaccacccagcccaccccaggccctgtgcacggctgcagcacccaccccagcctcttctggagcatcagcggcaaggagaagctgatgattgactgcctgcacccccacagcgcccagatcaagctgcgctgccagctgtgccgctgcaagaatgaagacacagtgtgggtgggccactag

SEQ ID NO: 160231 - DNA, 1071 bp, Artificial Sequence
  Description of Artificial Sequence: Synthetic coding sequence
atgtggaagtcctggaagctgaggacagatgtgcgggaggtgtccagaagacggcagttcctgcgggagcacgccgcccccttcagcgccttcctgacagacagctttggccggcagcacagctacctgcgcatcagcctgacagagaagtgcaacctgcgctgccagtactgcatgcctgaggagggcgtgcccctgacccccaaggccaacctgctgaccacagaggagatcctgaccctggcccggctgtttgtgaaggagggcatcgacaagatccggctgaccggcggggagcccctcatccggccagatgtggtggacatcgtggcccagctgcagaggctggagggcctgcggaccatcggcgtgaccaccaacggcatcaacctggcccggctgctgccccagctgcagaaggccggcctgagcgccatcaacatcagcctggacaccctggtgcctgccaagtttgagttcatcgtgcggaggaagggcttccacaaggtgatggagggcatccacaaggccatcgagctgggctacaaccctgtgaaggtgaactgtgtggtgatgaggggcctgaatgaagatgagctgctggactttgctgccctgacagagggcctgcccctggatgtgcgcttcatcgagtacatgccctttgatggcaacaagtggaacttcaagaagatggtgtcctacaaggagatgctggacacagtgcggcagcagtggccagagctggagaaggtgcctgaggaggagagcagcacagccaaggccttcaagatccctggcttccagggccagatctccttcatcacctccatgtctgagcacttctgtggcacctgcaaccggctgcgcatcacagcagatggcaacctgaaggtgtgcctgtttggaaattctgaggtgtccctgcgggaccacctgcgggccggggccagcgagcaggagctgctgcgcatcatcggggctgctgtgggcaggaagaagaggcagcacgccggcatgttcagcatcagccagatgaagaaccggcccatgatcctgattggaggatag

SEQ ID NO: 160232 - DNA, 1158 bp, Artificial Sequence
  Description of Artificial Sequence: Synthetic coding sequence
atgtggaagtcctggaagctgaggacagatgtgcgggtgcgggagggcgccggcggcagcccctgtgccagcagccagcccggcagccggggcccctgcttcctgcccggcctgagcagccaggaggtgtccagaagacggcagttcctgcgggagcacgccgcccccttcagcgccttcctgacagacagctttggccggcagcacagctacctgcgcatcagcctgacagagaagtgcaacctgcgctgccagtactgcatgcctgaggagggcgtgcccctgacccccaaggccaacctgctgaccacagaggagatcctgaccctggcccggctgtttgtgaaggagggcatcgacaagatccggctgactggaggagagcccctcatccggccagatgtggtggacatcgtggcccagctgcagaggctggagggcctgcggaccatcggcgtgaccaccaacggcatcaacctggcccggctgctgccccagctgcagaaggccggcctgagcgccatcaacatcagcctggacaccctggtgcctgccaagtttgagttcatcgtgcggaggaagggcttccacaaggtgatggagggcatccacaaggccatcgagctgggctacaaccctgtgaaggtgaactgtgtggtgatgaggggcctgaatgaagatgagctgctggactttgctgccctgacagagggcctgcccctggatgtgcgcttcatcgagtacatgccctttgatggcaacaagtggaacttcaagaagatggtgtcctacaaggagatgctggacacagtgcggcagcagtggccagagctggagaaggtgcctgaggaggagagcagcacagccaaggccttcaagatccctggcttccagggccagatctccttcatcacctccatgtctgagcacttctgtggcacctgcaaccggctgcgcatcacagcagatggcaacctgaaggtgtgcctgtttggaaacagcgaggtgtccctgcgggaccacctgcgggccggggccagcgagcaggagctgctgcgcatcattggagctgctgtgggcaggaagaagaggcagcacgccggcatgttcagcatcagccagatgaagaaccggcccatgatcctgattggaggatag

SEQ ID NO: 160233 - DNA, 1158 bp, Artificial Sequence
  Description of Artificial Sequence: Synthetic coding sequence
atggccgcccggcccctgagcaggatgctgcggcggctgctgcggagcagcgcccggagctgcagcagcggggcccctgtgacccagccctgccctggagagagcgcccgggccgccagcgaggaggtgtccagaagacggcagttcctgcgggagcacgccgcccccttcagcgccttcctgacagacagctttggccggcagcacagctacctgcgcatcagcctgacagagaagtgcaacctgcgctgccagtactgcatgcctgaggagggcgtgcccctgacccccaaggccaacctgctgaccacagaggagatcctgaccctggcccggctgtttgtgaaggagggcatcgacaagatccggctgactggaggagagcccctcatccggccagatgtggtggacatcgtggcccagctgcagaggctggagggcctgcggaccatcggcgtgaccaccaacggcatcaacctggcccggctgctgccccagctgcagaaggccggcctgagcgccatcaacatcagcctggacaccctggtgcctgccaagtttgagttcatcgtgcggaggaagggcttccacaaggtgatggagggcatccacaaggccatcgagctgggctacaaccctgtgaaggtgaactgtgtggtgatgaggggcctgaatgaagatgagctgctggactttgctgccctgacagagggcctgcccctggatgtgcgcttcatcgagtacatgccctttgatggcaacaagtggaacttcaagaagatggtgtcctacaaggagatgctggacacagtgcggcagcagtggccagagctggagaaggtgcctgaggaggagagcagcacagccaaggccttcaagatccctggcttccagggccagatctccttcatcacctccatgtctgagcacttctgtggcacctgcaaccggctgcgcatcacagcagatggcaacctgaaggtgtgcctgtttggaaacagcgaggtgtccctgcgggaccacctgcgggccggggccagcgagcaggagctgctgcgcatcattggagctgctgtgggcaggaagaagaggcagcacgccggcatgttcagcatcagccagatgaagaaccggcccatgatcctgattggaggatag

SEQ ID NO: 160234 - DNA, 1602 bp, Artificial Sequence
  Description of Artificial Sequence: Synthetic coding sequence
atgcctgaggagggcgtgcccctgacccccaaggccaacctgctgaccacagaggagatcctgaccctggcccggctgtttgtgaaggagggcatcgacaagatccggctgaccggcggggagcccctcatccggccagatgtggtggacatcgtggcccagctgcagaggctggagggcctgcggaccatcggcgtgaccaccaacggcatcaacctggcccggctgctgccccagctgcagaaggccggcctgagcgccatcaacatcagcctggacaccctggtgcctgccaagtttgagttcatcgtgcggaggaagggcttccacaaggtgatggagggcatccacaaggccatcgagctgggctacaaccctgtgaaggtgaactgtgtggtgatgaggggcctgaatgaagatgagctgctggactttgctgccctgacagagggcctgcccctggatgtgcgcttcatcgagtacatgccctttgatggcaacaagtggaacttcaagaagatggtgtcctacaaggagatgctggacacagtgcggcagcagtggccagagctggagaaggtgcctgaggaggagagcagcacagccaaggccttcaagatccctggcttccagggccagatctccttcatcacctccatgtctgagcacttctgtggcacctgcaaccggctgcgcatcacagcagatggcaacctgaaggtgtgcctgtttggaaattctgaggtgtccctgcgggaccacctgcgggccggggccagcgagcaggagctgctgcgcatcatcggggctgctgtgggcaggaagaagaggcagcacgccgagctgttcctgatgttccccaacagccccccagccaaccccagcatcttctcctgggaccccctgcacgtgcagggcctgcggcccaggatgtccttcagcagccaggtggccaccctgtggaagggctgccgggtgccccagaccccacccctggcccagcagaggctgggcagcggcagcttccagaggcactacaccagcagagctgacagtgatgccaacagcaagtgcctgagccctggctcctgggccagcgctgcccccagcggcccccagctgaccagcgagcagctgacccacgtggacagcgagggccgggccgccatggtggatgtgggcaggaagccagacacagagcgggtggccgtggccagcgctgtggtgctgctgggccctgtggccttcaagctggtgcagcagaaccagctgaagaagggagatgccctggtggtggcccagctggccggcgtgcaggccgccaaggtgaccagccagctgatccccctgtgccaccacgtggccctgagccacatccaggtgcagctggagctggacagcaccaggcatgctgtgaagatccaggccagctgccgggcccggggccccaccggggtggagatggaggccctgaccagcgctgctgtggccgccctgaccctgtatgacatgtgcaaggctgtgtcccgggacatcgtgctggaggagatcaagctgatcagcaagacaggaggccagagaggagacttccaccgggcctag

SEQ ID NO: 160235 - DNA, 1911 bp, Artificial Sequence
  Description of Artificial Sequence: Synthetic coding sequence
atgtggaagtcctggaagctgaggacagatgtgcgggtgcgggagggcgccggcggcagcccctgtgccagcagccagcccggcagccggggcccctgcttcctgcccggcctgagcagccaggaggtgtccagaagacggcagttcctgcgggagcacgccgcccccttcagcgccttcctgacagacagctttggccggcagcacagctacctgcgcatcagcctgacagagaagtgcaacctgcgctgccagtactgcatgcctgaggagggcgtgcccctgacccccaaggccaacctgctgaccacagaggagatcctgaccctggcccggctgtttgtgaaggagggcatcgacaagatccggctgactggaggagagcccctcatccggccagatgtggtggacatcgtggcccagctgcagaggctggagggcctgcggaccatcggcgtgaccaccaacggcatcaacctggcccggctgctgccccagctgcagaaggccggcctgagcgccatcaacatcagcctggacaccctggtgcctgccaagtttgagttcatcgtgcggaggaagggcttccacaaggtgatggagggcatccacaaggccatcgagctgggctacaaccctgtgaaggtgaactgtgtggtgatgaggggcctgaatgaagatgagctgctggactttgctgccctgacagagggcctgcccctggatgtgcgcttcatcgagtacatgccctttgatggcaacaagtggaacttcaagaagatggtgtcctacaaggagatgctggacacagtgcggcagcagtggccagagctggagaaggtgcctgaggaggagagcagcacagccaaggccttcaagatccctggcttccagggccagatctccttcatcacctccatgtctgagcacttctgtggcacctgcaaccggctgcgcatcacagcagatggcaacctgaaggtgtgcctgtttggaaacagcgaggtgtccctgcgggaccacctgcgggccggggccagcgagcaggagctgctgcgcatcattggagctgctgtgggcaggaagaagaggcagcacgccggcatgttcagcatcagccagatgaagaaccggcccatgatcctgattgagctgttcctgatgttccccaacagccccccagccaaccccagcatcttctcctgggaccccctgcacgtgcagggcctgcggcccaggatgtccttcagcagccaggtggccaccctgtggaagggctgccgggtgccccagaccccacccctggcccagcagaggctgggcagcggcagcttccagaggcactacaccagcagagctgacagtgatgccaacagcaagtgcctgagccctggctcctgggccagcgctgcccccagcggcccccagctgaccagcgagcagctgacccacgtggacagcgagggccgggccgccatggtggatgtgggcaggaagccagacacagagcgggtggccgtggccagcgctgtggtgctgctgggccctgtggccttcaagctggtgcagcagaaccagctgaagaagggagatgccctggtggtggcccagctggccggcgtgcaggccgccaaggtgaccagccagctgatccccctgtgccaccacgtggccctgagccacatccaggtgcagctggagctggacagcaccaggcatgctgtgaagatccaggccagctgccgggcccggggccccactggagtggagatggaggccctgaccagcgctgctgtggccgccctgaccctgtatgacatgtgcaaggctgtgtcccgggacatcgtgctggaggagatcaagctgatcagcaagacaggaggccagagaggagacttccaccgggcctag

SEQ ID NO: 160236 - DNA, 1071 bp, Artificial Sequence; identical to SEQ ID NO: 160231
  Description of Artificial Sequence: Synthetic coding sequence

SEQ ID NO: 160237 - DNA, 267 bp, Artificial Sequence
  Description of Artificial Sequence: Synthetic coding sequence
atggtgcccctgtgccaggtggaggtgctgtactttgccaagtctgctgagatcactggagtgcgctctgagaccatctctgtgccccaggagatcaaggccctgcagctgtggaaggagattgagaccaggcaccctggcctggctgatgtgaggaaccagatcatctttgctgtgcggcaggagtatgtggagctgggggaccagctgctggtgctgcagcctggagatgaaattgctgtgattcctcccatcagcggcggctag

SEQ ID NO: 160238 - DNA, 567 bp, Artificial Sequence
  Description of Artificial Sequence: Synthetic coding sequence
atgagcagcctggagatcagcagcagctgcttcagcctggagaccaagctgcccctgagcccccccctggtggaggacagcgcctttgagcccagcaggaaggacatggatgaggtggaggagaagagcaaggatgtgatcaacttcaccgctgagaagctgtctgtggatgaggtgtcccagctggtgatcagccccctgtgtggggccatcagcctgtttgtgggcaccaccaggaacaactttgagggcaagaaggtgatcagcctggagtatgaggcctacctgcccatggccgagaatgaggtgaggaagatctgcagcgacatccggcagaagtggcctgtgaagcacatcgctgtgttccaccggctgggcctggtgcctgtgtctgaggccagcatcatcatcgctgtgtcctctgcccacagagctgccagcctggaggccgtgtcctatgccatcgacaccctgaaggccaaggtgcccatctggaagaaggagatctatgaggagagcagcacctggaagggcaacaaggagtgcttctgggccagcaacagctag

SEQ ID NO: 160239 - DNA, 267 bp, Artificial Sequence; identical to SEQ ID NO: 160237
  Description of Artificial Sequence: Synthetic coding sequence

SEQ ID NO: 160240 - DNA, 267 bp, Artificial Sequence; identical to SEQ ID NO: 160237
  Description of Artificial Sequence: Synthetic coding sequence

SEQ ID NO: 160241 - DNA, 267 bp, Artificial Sequence; identical to SEQ ID NO: 160237
  Description of Artificial Sequence: Synthetic coding sequence

SEQ ID NO: 160242 - DNA, 462 bp, Artificial Sequence
  Description of Artificial Sequence: Synthetic coding sequence
atgagcagcctggagatcagcagcagctgcttcagcctggagaccaagctgcccctgagcccccccctggtggaggacagcgcctttgagcccagcaggaaggacatggatgaggtggaggagaagagcaaggatgtgatcaacttcaccgctgagaagctgtctgtggatgaggtgtcccagctggtgatcagccccctgtgtggggccatcagcctgtttgtgggcaccaccaggaacaactttgagggcaagaaggtgatcagcctggagtatgaggcctacctgcccatggccgagaatgaggtgaggaagatctgcagcgacatccggcagaagtggcctgtgaagcacatcgctgtgttccaccggctgggcctggtgcctgtgtctgaggccagcatcatcatcgctgtgtcctctgcccacagagctgccagcctggaggccgtgtcctactag

SEQ ID NO: 160243 - DNA, 1644 bp, Artificial Sequence
  Description of Artificial Sequence: Synthetic coding sequence
atggaggtgggcggggacacagctgccccagcccctgggggcgctgaggacctggaggacacccagttccccagcgaggaggcccgggagggcggcggcgtgcatgctgtgcccccagaccctgaagatgagggcctggaggagaccggcagcaaggacaaggaccagccccccagccccagccccccaccccagagcgaggccctgagcagcaccagccggctgtggagccctgctgcccctgagaacagccccacctgcagccctgagagcagcagcggcggccagggcggggaccccagtgatgaggagtggaggagccagaggaagcacgtgtttgtgctgtctgaggccggcaagcccatctacagccgctatggctctgtggaggccctgagcgccaccatgggcgtgatgacagccctggtgtcctttgtgcagagcgctggagatgccatccgggccatctatgcagaggaccacaagctggtgttcctgcagcagggccccctgctgctggtggccatgagcaggaccagccagagcgctgcccagctgcggggggagctgctggccgtgcacgcccagatcgtgtccaccctgacccgggcctctgtggcccgcatctttgcccacaagcagaactatgacctgcggcggctgctggccggcagcgagaggaccctggaccggctgctggacagcatggagcaggaccccggggccctgctgctgggcgctgtgcgctgtgtgcccctggcccggcccctgagagatgccctgggcgccctgctgcggcgctgcacagcccctggcctggccctgtctgtgctggccgtgggcggccgcctcatcacagctgcccaggagagaaatgtgctggccgagtgccgcctggaccctgctgacctgcagctgctgctggactgggtgggcgccccagcctttgctgctggggaggcctgggcccctgtgtgcctgccccgcttcaacccagatggcttcttctacgcctacgtggcccggctggatgccatgcctgtgtgcctgctgctgctgggcacccagcgggaggccttccacgccatggccgcctgccggcggctggtggaggatggcatgcacgccctgggcgccatgagggccctgggggaggccgccagcttcagcaatgccagcagcgccagcgccccagcctacagcgtgcaggccgtgggcgcccctggcctgcggcacttcctgtacaagcccctggacatcccagaccaccaccggcagctgccccagttcaccagccctgagctggaggccccctacagccgggaggaggagcggcagaggctgagtgacctgtaccaccggctgcacgcccggctgcacagcaccagccggcccctgcggctcatctaccacgtggccgagaaggagaccctgctggcctgggtgaccagcaagtttgagctgtacacctgcctgagccccctggtgaccaaggccggggccatcctggtggtgaccaagctgctgcgctgggtgaagaaggaggaggacaggctcttcatccgctacccacccaagtacagcaccccaccagccaccagcacagaccaggccgcccacaacggcctcttcaccggcctgtag

SEQ ID NO: 160244 - DNA, 438 bp, Artificial Sequence
  Description of Artificial Sequence: Synthetic coding sequence
atggaggtgggcggggacacagctgccccagcccctgggggcgctgaggacctggaggacacccagttccccagcgaggaggcccgggagggcggcggcgtgcatgctgtgcccccagaccctgaagatgagggcctggaggagaccggcagcaaggacaaggaccagccccccagccccagccccccaccccagagcgaggccctgagcagcaccagccggctgtggagccctgctgcccctgagaacagccccacctgcagccctgagagcagcagcggcggccagggcggggaccccagtgatgaggagtggaggagccagagaaatggctgcaggacctgcaccacagcctgcatgctggtgtccacagcccccccagacccctgtgccagcttcaccacctggctgcggcggcggcactactggccaggatag

SEQ ID NO: 160245 - DNA, 1317 bp, Artificial Sequence
  Description of Artificial Sequence: Synthetic coding sequence
atggaggtgggcggggacacagctgccccagcccctgggggcgctgaggacctggaggacacccagttccccagcgaggaggcccgggagggcggcggcgtgcatgctgtgcccccagaccctgaagatgagggcctggaggagacagaggaccacaagctggtgttcctgcagcagggccccctgctgctggtggccatgagcaggaccagccagagcgctgcccagctgcggggggagctgctggccgtgcacgcccagatcgtgtccaccctgacccgggcctctgtggcccgcatctttgcccacaagcagaactatgacctgcggcggctgctggccggcagcgagaggaccctggaccggctgctggacagcatggagcaggaccccggggccctgctgctgggcgctgtgcgctgtgtgcccctggcccggcccctgagagatgccctgggcgccctgctgcggcgctgcacagcccctggcctggccctgtctgtgctggccgtgggcggccgcctcatcacagctgcccaggagagaaatgtgctggctgaatgtcggctggaccctgctgacctgcagctgctgctggactgggtgggcgccccagcctttgctgctggggaggcctgggcccctgtgtgcctgccccgcttcaacccagatggcttcttctacgcctacgtggcccggctggatgccatgcctgtgtgcctgctgctgctgggcacccagcgggaggccttccacgccatggccgcctgccggcggctggtggaggatggcatgcacgccctgggcgccatgagggccctgggggaggccgccagcttcagcaatgccagcagcgccagcgccccagcctacagcgtgcaggccgtgggcgcccctggcctgcggcacttcctgtacaagcccctggacatcccagaccaccaccggcagctgccccagttcaccagccctgagctggaggccccctacagccgggaggaggagcggcagaggctgagtgacctgtaccaccggctgcacgcccggctgcacagcaccagccggcccctgcggctcatctaccacgtggccgagaaggagaccctgctggcctgggtgaccagcaagtttgagctgtacacctgcctgagccccctggtgaccaaggccggggccatcctggtggtgaccaagctgctgcgctgggtgaagaaggaggaggacaggctcttcatccgctacccacccaagtacagcaccccaccagccaccagcacagaccaggccgcccacaacggcctcttcaccggcctgtag

SEQ ID NO: 160246 - DNA, 1206 bp, Artificial Sequence
  Description of Artificial Sequence: Synthetic coding sequence
atggtgtctggccagctgcgcttcggcgtgaagacagaggaccacaagctggtgttcctgcagcagggccccctgctgctggtggccatgagcaggaccagccagagcgctgcccagctgcggggggagctgctggccgtgcacgcccagatcgtgtccaccctgacccgggcctctgtggcccgcatctttgcccacaagcagaactatgacctgcggcggctgctggccggcagcgagaggaccctggaccggctgctggacagcatggagcaggaccccggggccctgctgctgggcgctgtgcgctgtgtgcccctggcccggcccctgagagatgccctgggcgccctgctgcggcgctgcacagcccctggcctggccctgtctgtgctggccgtgggcggccgcctcatcacagctgcccaggagagaaatgtgctggccgagtgccgcctggaccctgctgacctgcagctgctgctggactgggtgggcgccccagcctttgctgctggggaggcctgggcccctgtgtgcctgccccgcttcaacccagatggcttcttctacgcctacgtggcccggctggatgccatgcctgtgtgcctgctgctgctgggcacccagcgggaggccttccacgccatggccgcctgccggcggctggtggaggatggcatgcacgccctgggcgccatgagggccctgggggaggccgccagcttcagcaatgccagcagcgccagcgccccagcctacagcgtgcaggccgtgggcgcccctggcctgcggcacttcctgtacaagcccctggacatcccagaccaccaccggcagctgccccagttcaccagccctgagctggaggccccctacagccgggaggaggagcggcagaggctgagtgacctgtaccaccggctgcacgcccggctgcacagcaccagccggcccctgcggctcatctaccacgtggccgagaaggagaccctgctggcctgggtgaccagcaagtttgagctgtacacctgcctgagccccctggtgaccaaggccggggccatcctggtggtgaccaagctgctgcgctgggtgaagaaggaggaggacaggctcttcatccgctacccacccaagtacagcaccccaccagccaccagcacagaccaggccgcccacaacggcctcttcaccggcctgtag

SEQ ID NO: 160247 - DNA, 1584 bp, Artificial Sequence
  Description of Artificial Sequence: Synthetic coding sequence
atggagaaccaggagaaggccagcattgctggccacatgtttgatgtggtggtgattggaggcggcatcagcggcctgtctgctgccaagctgctgacagaatatggagtgtctgtgctggtgctggaggcccgggacagagtgggcggccgcacctacaccatcagaaatgaacatgtggactatgtggatgtgggcggggcctacgtgggccccacccagaaccgcatcctgcggctgagcaaggagctgggcatcgagacctacaaggtgaatgtgtctgagcggctggtgcagtatgtgaagggcaagacctaccccttccggggggccttcccccctgtgtggaaccccatcgcctacctggactacaacaacctgtggaggaccatcgacaacatgggcaaggagatccccacagatgccccctgggaggcccagcacgccgacaagtgggacaagatgaccatgaaggagctgattgacaagatctgctggaccaagacagccaggagatttgcctacctgtttgtgaacatcaacgtgaccagcgagccccatgaggtgtctgccctgtggttcctgtggtacgtgaagcagtgtggcggcaccacccgcatcttctctgtgaccaacggcggccaggagaggaagtttgtgggcggcagcggccaggtgtctgagcgcatcatggacctgctgggggaccaggtgaagctgaaccaccctgtgacccacgtggaccagagcagtgacaacatcatcatcgagaccctgaaccacgagcactatgagtgcaagtatgtgatcaatgccatcccccccaccctgacagccaagatccacttccggcctgagctgcctgctgagaggaaccagctgatccagaggctgcccatgggcgccgtcatcaagtgcatgatgtactacaaggaggccttctggaagaagaaggactactgcggctgcatgatcattgaagatgaagatgcccccatcagcatcaccctggatgacaccaagccagatggcagcctgcctgccatcatgggcttcatcctggccaggaaggctgaccggctggccaagctgcacaaggagatcaggaagaagaagatctgtgagctgtatgccaaggtgctgggcagccaggaggccctgcaccctgtgcactatgaggagaagaactggtgtgaggagcagtacagcggcggctgctacacagcctacttccccccaggcatcatgacccagtatggccgggtcatccggcagcctgtgggccgcatcttctttgctggaacagaaacagccaccaagtggagcggctacatggagggcgctgtggaggccggggagagagctgcccgggaggtgctgaatggcctgggcaaggtgacagagaaggacatctgggtgcaggagcctgagagcaaggatgtgcctgctgtggagatcacccacaccttctgggagaggaacctgcccagcgtgtctggcctgctgaagatcatcggcttcagcacctctgtgacagccctgggctttgtgctgtacaagtacaagctgctgcccaggagctag

SEQ ID NO: 160248 - DNA, 1185 bp, Artificial Sequence
  Description of Artificial Sequence: Synthetic coding sequence
atgggcaaggagatccccacagatgccccctgggaggcccagcacgccgacaagtgggacaagatgaccatgaaggagctgattgacaagatctgctggaccaagacagccaggagatttgcctacctgtttgtgaacatcaacgtgaccagcgagccccatgaggtgtctgccctgtggttcctgtggtacgtgaagcagtgtggcggcaccacccgcatcttctctgtgaccaatggaggccaggagaggaagtttgtgggcggcagcggccaggtgtctgagcgcatcatggacctgctgggggaccaggtgaagctgaaccaccctgtgacccacgtggaccagagcagtgacaacatcatcatcgagaccctgaaccacgagcactatgagtgcaagtatgtgatcaatgccatcccccccaccctgacagccaagatccacttccggcctgagctgcctgctgagaggaaccagctgatccagaggctgcccatgggcgctgtgatcaagtgcatgatgtactacaaggaggccttctggaagaagaaggactactgcggctgcatgatcattgaagatgaagatgcccccatcagcatcaccctggatgacaccaagccagatggcagcctgcctgccatcatgggcttcatcctggccaggaaggctgaccggctggccaagctgcacaaggagatcaggaagaagaagatctgtgagctgtatgccaaggtgctgggcagccaggaggccctgcaccctgtgcactatgaggagaagaactggtgtgaggagcagtacagcggcggctgctacacagcctacttccccccaggcatcatgacccagtatggccgggtcatccggcagcctgtgggccgcatcttctttgctggaacagaaacagccaccaagtggagcggctacatggagggcgctgtggaggccggggagcgggccgcccgggaggtgctgaatggcctgggcaaggtgacagagaaggacatctgggtgcaggagcctgagagcaaggatgtgcctgctgtggagatcacccacaccttctgggagaggaacctgcccagcgtgtctggcctgctgaagatcatcggcttcagcacctctgtgacagccctgggctttgtgctgtacaagtacaagctgctgcccaggagctag

SEQ ID NO: 160249 - DNA, 1563 bp, Artificial Sequence
  Description of Artificial Sequence: Synthetic coding sequence
atgagcaacaagtgtgatgtggtggtggtgggcggcggcatcagcggcatggctgctgccaagctgctgcatgacagcggcctgaatgtggtggtgctggaggcccgggacagagtgggcggccgcacctacaccctgaggaaccagaaggtgaagtatgtggacctgggcggcagctatgtgggccccacccagaaccgcatcctgcggctggccaaggagctgggcctggagacctacaaggtgaatgaggtggagcggctcatccaccacgtgaagggcaagagctaccccttccggggccccttcccccctgtgtggaaccccatcacctacctggaccacaacaacttctggaggaccatggatgacatgggccgggagatccccagtgatgccccctggaaggcccccctggccgaggagtgggacaacatgaccatgaaggagctgctggacaagctgtgctggacagagagcgccaagcagctggccaccctgtttgtgaacctgtgtgtgacagctgagacccatgaggtgtctgccctgtggttcctgtggtacgtgaagcagtgtggcggcaccacccgcatcatcagcaccaccaatggaggccaggagaggaagtttgtgggcggcagcggccaggtgtctgagcgcatcatggacctgctgggggacagagtgaagctggagaggcctgtgatctacatcgaccagaccagagaaaatgtgctggtggagaccctgaaccacgagatgtatgaggccaagtatgtgatcagcgccatcccccccaccctgggcatgaagatccacttcaacccccccctgcccatgatgaggaaccagatgatcaccagggtgcccctgggcagcgtcatcaagtgcatcgtgtactacaaggagcccttctggaggaagaaggactactgcggcaccatgatcattgatggagaggaggcccctgtggcctacaccctggatgacaccaagccagagggcaactatgctgccatcatgggcttcatcctggcccacaaggccaggaagctggcccggctgaccaaggaggagcggctgaagaagctgtgtgagctgtatgccaaggtgctgggcagcctggaggccctggagcctgtgcactatgaggagaagaactggtgtgaggagcagtacagcggcggctgctacaccacctacttccccccaggcatcctgacccagtatggccgggtgctgcggcagcctgtggaccgcatctactttgctggaacagaaacagccacccactggagcggctacatggagggcgctgtggaggccggggagcgggccgcccgggagatcctgcacgccatgggcaagatcccagaagatgagatctggcagagcgagcctgagagcgtggatgtgcctgcccagcccatcaccaccaccttcctggagcggcacctgcccagcgtgcccggcctgctgcggctcatcggcctgaccaccatcttcagcgccacagccctgggcttcctggcccacaagaggggcctgctggtgcgggtgtag

SEQ ID NO: 160250 - DNA, 1515 bp, Artificial Sequence
  Description of Artificial Sequence: Synthetic coding sequence
atggctgctgccaagctgctgcatgacagcggcctgaatgtggtggtgctggaggcccgggacagagtgggcggccgcacctacaccctgaggaaccagaaggtgaagtatgtggacctgggcggcagctatgtgggccccacccagaaccgcatcctgcggctggccaaggagctgggcctggagacctacaaggtgaatgaggtggagcggctcatccaccacgtgaagggcaagagctaccccttccggggccccttcccccctgtgtggaaccccatcacctacctggaccacaacaacttctggaggaccatggatgacatgggccgggagatccccagtgatgccccctggaaggcccccctggccgaggagtgggacaacatgaccatgaaggagctgctggacaagctgtgctggacagagagcgccaagcagctggccaccctgtttgtgaacctgtgtgtgacagctgagacccatgaggtgtctgccctgtggttcctgtggtacgtgaagcagtgtggcggcaccacccgcatcatcagcaccaccaatggaggccaggagaggaagtttgtgggcggcagcggccaggtgtctgagcgcatcatggacctgctgggggacagagtgaagctggagaggcctgtgatctacatcgaccagaccagagaaaatgtgctggtggagaccctgaaccacgagatgtatgaggccaagtatgtgatcagcgccatcccccccaccctgggcatgaagatccacttcaacccccccctgcccatgatgaggaaccagatgatcaccagggtgcccctgggcagcgtcatcaagtgcatcgtgtactacaaggagcccttctggaggaagaaggactactgcggcaccatgatcattgatggagaggaggcccctgtggcctacaccctggatgacaccaagccagagggcaactatgctgccatcatgggcttcatcctggcccacaaggccaggaagctggcccggctgaccaaggaggagcggctgaagaagctgtgtgagctgtatgccaaggtgctgggcagcctggaggccctggagcctgtgcactatgaggagaagaactggtgtgaggagcagtacagcggcggctgctacaccacctacttccccccaggcatcctgacccagtatggccgggtgctgcggcagcctgtggaccgcatctactttgctggaacagaaacagccacccactggagcggctacatggagggcgctgtggaggccggggagcgggccgcccgggagatcctgcacgccatgggcaagatcccagaagatgagatctggcagagcgagcctgagagcgtggatgtgcctgcccagcccatcaccaccaccttcctggagcggcacctgcccagcgtgcccggcctgctgcggctcatcggcctgaccaccatcttcagcgccacagccctgggcttcctggcccacaagaggggcctgctggtgcgggtgtag

SEQ ID NO: 160251 - DNA, 1236 bp, Artificial Sequence
  Description of Artificial Sequence: Synthetic coding sequence
atggctgctgccaagctgctgcatgacagcggcctgaatgtggtggtgctggaggcccgggacagagtgggcggccgcacctacaccctgaggaaccagaaggtgaagtatgtggacctgggcggcagctatgtgggccccacccagaaccgcatcctgcggctggccaaggagctgggcctggagacctacaaggtgaatgaggtggagcggctcatccaccacgtgaagggcaagagctaccccttccggggccccttcccccctgtgtggaaccccatcacctacctggaccacaacaacttctggaggaccatggatgacatgggccgggagatccccagtgatgccccctggaaggcccccctggccgaggagtgggacaacatgaccatgaaggagctgctggacaagctgtgctggacagagagcgccaagcagctggccaccctgtttgtgaacctgtgtgtgacagctgagacccatgaggtgtctgccctgtggttcctgtggtacgtgaagcagtgtggcggcaccacccgcatcatcagcaccaccaatggaggccaggagaggaagtttgtgggcggcagcggccaggtgtctgagcgcatcatggacctgctgggggacagagtgaagctggagaggcctgtgatctacatcgaccagaccagagaaaatgtgctggtggagaccctgaaccacgagatgtatgaggccaagtatgtgatcagcgccatcccccccaccctgggcatgaagatccacttcaacccccccctgcccatgatgaggaaccagatgatcaccagggtgcccctgggcagcgtcatcaagtgcatcgtgtactacaaggagcccttctggaggaagaaggactactgcggcaccatgatcattgatggagaggaggcccctgtggcctacaccctggatgacaccaagccagagggcaactatgctgccatcatgggcttcatcctggcccacaaggccaggaagctggcccggctgaccaaggaggagcggctgaagaagctgtgtgagctgtatgccaaggtgctgggcagcctggaggccctggagggcagcaccccagccagcggccaggacctgctgtgccgccaccgggactgccacaccctggagcggctgcatggaggcggctgccggggccgcggggagagcagcccccgggaccctgcctgccacggggaggacagccggggctag

SEQ ID NO: 160252 - DNA, 741 bp, Artificial Sequence
  Description of Artificial Sequence: Synthetic coding sequence
atgtttgccccccggctgctggacttccagaagaccaagtatgcccgcttcatgaaccaccgggtgcctgcccacaagcgctaccagcccacagaatatgaacatgctgccaactgtgccacccacgccttctggatcatccccagcatcctgggcagcagcaacctgtacttcctgagtgatgatgactgggagaccatcagcgcctggatctacggcctgggcctgtgtggcctgtttgtggtgtccaccgtcttccacaccatctcctggaagaagagccacctgaggatggtggagcactgcctgcacatgtttgacaggatggtgatctacttcttcatcgccgccagctatgccccctggctgaacctgcgggagctgggcccctgggccagccacatgcgctggctggtgtggatcatggcctctgtgggcaccatctacgtgttcttcttccacgagcgctacaagctggtggagctgctgtgctacgtggtgatgggcttcttccctgccctggtgatcctgtccatgcccaacacagagggcatctgggagctggtgactggaggagtcttctactgcctgggcatggtgttcttcaagagtgatggccgcatcccctttgcccacgccatctggcacctgtttgtggcctttggagctggcacccactactatgccatctggagatacctgtacctgcccagcaccctgcagaccaaggtgtccaagtag

SEQ ID NO: 160253 - DNA, 813 bp, Artificial Sequence
  Description of Artificial Sequence: Synthetic coding sequence
atgtttgccccccggctgctggacttccagaagaccaagtatgcccgcttcatgaaccaccgggtgcctgcccacaagcgctaccagcccacagaatatgaacatgctgccaactgtgccacccacgccttctggatcatccccagcatcctgggcagcagcaacctgtacttcctgagtgatgatgactgggagaccatcagcgcctggatctacggcctgggcctgtgtggcctgtttgtggtgtccaccgtcttccacaccatctcctggaagaagagccacctgaggatggtggagcactgcctgcacatgtttgacaggatggtgatctacttcttcatcgccgccagctatgccccctggctgaacctgcgggagctgggcccctgggccagccacatgcgctggctggtgtggatcatggcctctgtgggcaccatctacgtgttcttcttccacgagaggacaggcagctgtgtgcagttcctgcggggggaggcctgccccaaggccggcacagcctgcctgcctgcccgctacaagctggtggagctgctgtgctacgtggtgatgggcttcttccctgccctggtgatcctgtccatgcccaacacagagggcatctgggagctggtgactggaggagtcttctactgcctgggcatggtgttcttcaagagtgatggccgcatcccctttgcccacgccatctggcacctgtttgtggcctttggagctggcacccactactatgccatctggagatacctgtacctgcccagcaccctgcagaccaaggtgtccaagtag

SEQ ID NO: 160254 - DNA, 582 bp, Artificial Sequence
  Description of Artificial Sequence: Synthetic coding sequence
atgtttgccccccggctgctggacttccagaagaccaagtatgcccgcttcatgaaccaccgggtgcctgcccacaagcgctaccagcccacagaatatgaacatgctgccaactgtgccacccacgccttctggatcatccccagcatcctgggcagcagcaacctgtacttcctgagtgatgatgactgggagaccatcagcgcctggatctacggcctgggcctgtgtggcctgtttgtggtgtccaccgtcttccacaccatctcctggaagaagagccacctgaggatggtggagcactgcctgcacatgtttgacaggatggtgatctacttcttcatcgccgccagctatgccccctggctgaacctgcgggagctgggcccctgggccagccacatgcgctggctggtgtggatcatggcctctgtgggcaccatctacgtgttcttcttccacgagcgctacaagctggtggagctgctgtgctacgtggtgatgggcttcttccctgccctggtgatcctgtccatggccggcaagctgcggcccggcatgacctgcctgaagaggcagtag

SEQ ID NO: 160255 - DNA, 942 bp, Artificial Sequence
  Description of Artificial Sequence: Synthetic coding sequence
atggagactggacctgaggaccccagctccatgcctgaggagagcagccccaggaggaccccccagagcatcccctaccaggacctgccccacctggtgaatgctgatggccagtacctgttctgccgctactggaagcccaccggcacccccaaggccctgatctttgtgtcccatggagctggggagcacagcggccgctatgaggagctggccaggatgctgatgggcctggacctgctggtgtttgcccatgaccacgtgggccacggccagagcgagggggagaggatggtggtgtctgacttccacgtgtttgtgagagatgtgctgcagcacgtggacagcatgcagaaggactacccaggcctgcctgtgttcctgctgggccacagcatgggcggggccatcgccatcctgacagctgctgagcggcccggccactttgctggcatggtgctgatcagccccctggtgctggccaaccctgagagcgccaccaccttcaaggtgctggccgccaaggtgctgaacctggtgctgcccaacctgagcctgggccccatcgacagctctgtgctgagcaggaacaagacagaggtggacatctacaacagcgaccccctcatctgcagagctggcctgaaggtgtgcttcggcatccagctgctgaatgctgtgtcccgggtggagcgggccctgcccaagctgactgtgcccttcctgctgctgcagggcagcgctgaccggctgtgtgacagcaaaggagcctacctgctgatggagctggccaagagccaggacaagaccctgaagatctatgagggcgcctaccacgtgctgcacaaggagctgcctgaggtgaccaacagcgtcttccacgagatcaacatgtgggtgtcccagaggacagccacagctggaacagccagccccccatag

SEQ ID NO: 160256 - DNA, 912 bp, Artificial Sequence
  Description of Artificial Sequence: Synthetic coding sequence
atgcctgaggagagcagccccaggaggaccccccagagcatcccctaccaggacctgccccacctggtgaatgctgatggccagtacctgttctgccgctactggaagcccaccggcacccccaaggccctgatctttgtgtcccatggagctggggagcacagcggccgctatgaggagctggccaggatgctgatgggcctggacctgctggtgtttgcccatgaccacgtgggccacggccagagcgagggggagaggatggtggtgtctgacttccacgtgtttgtgagagatgtgctgcagcacgtggacagcatgcagaaggactacccaggcctgcctgtgttcctgctgggccacagcatgggcggggccatcgccatcctgacagctgctgagcggcccggccactttgctggcatggtgctgatcagccccctggtgctggccaaccctgagagcgccaccaccttcaaggtgctggccgccaaggtgctgaacctggtgctgcccaacctgagcctgggccccatcgacagctctgtgctgagcaggaacaagacagaggtggacatctacaacagcgaccccctcatctgcagagctggcctgaaggtgtgcttcggcatccagctgctgaatgctgtgtcccgggtggagcgggccctgcccaagctgactgtgcccttcctgctgctgcagggcagcgctgaccggctgtgtgacagcaaaggagcctacctgctgatggagctggccaagagccaggacaagaccctgaagatctatgagggcgcctaccacgtgctgcacaaggagctgcctgaggtgaccaacagcgtcttccacgagatcaacatgtgggtgtcccagaggacagccacagctggaacagccagccccccatag

SEQ ID NO: 160257 - DNA, 912 bp, Artificial Sequence; identical to SEQ ID NO: 160256
  Description of Artificial Sequence: Synthetic coding sequence

SEQ ID NO: 160258 - DNA, 852 bp, Artificial Sequence
  Description of Artificial Sequence: Synthetic coding sequence
atggagactggacctgaggaccccagctccatgcctgaggagagcagccccaggaggaccccccagagcatcccctaccaggacctgccccacctggtgaatgctgatggccagtacctgttctgccgctactggaagcccaccggcacccccaaggccctgatctttgtgtcccatggagctggggagcacagcggccgctatgaggagctggccaggatgctgatgggcctggacctgctggtgtttgcccatgaccacgtgggccacggccagagcgagggggagaggatggtggtgtctgacttccacgtgtttgtgagagatgtgctgcagcacgtggacagcatgcagaaggactacccaggcctgcctgtgttcctgctgggccacagcatgggcggggccatcgccatcctgacagctgctgagcggcccggccactttgctggcatggtgctgatcagccccctggtgctggccaaccctgagagcgccaccaccttcaaggtggacatctacaacagcgaccccctcatctgcagagctggcctgaaggtgtgcttcggcatccagctgctgaatgctgtgtcccgggtggagcgggccctgcccaagctgactgtgcccttcctgctgctgcagggcagcgctgaccggctgtgtgacagcaaaggagcctacctgctgatggagctggccaagagccaggacaagaccctgaagatctatgagggcgcctaccacgtgctgcacaaggagctgcctgaggtgaccaacagcgtcttccacgagatcaacatgtgggtgtcccagaggacagccacagctggaacagccagccccccatag

SEQ ID NO: 160259 - DNA, 234 bp, Artificial Sequence
  Description of Artificial Sequence: Synthetic coding sequence
atgcctgaggagagcagccccaggaggaccccccagagcatcccctaccaggacctgccccacctggtgaatgctgatggccagtacctgttctgccgctactggaagcccaccggcacccccaaggccctgatctttgtgtcccatggagctggggagcacagcggccgctatgaggagctggccaggatgctgatgggcctggacctgctggtgtttgcccatgaccactag

SEQ ID NO: 160260 - DNA, 942 bp, Artificial Sequence
  Description of Artificial Sequence: Synthetic coding sequence
atgaagaccaggcctgaggaccccagctccatgcctgaggagagcagccccaggaggaccccccagagcatcccctaccaggacctgccccacctggtgaatgctgatggccagtacctgttctgccgctactggaagcccaccggcacccccaaggccctgatctttgtgtcccatggagctggggagcacagcggccgctatgaggagctggccaggatgctgatgggcctggacctgctggtgtttgcccatgaccacgtgggccacggccagagcgagggggagaggatggtggtgtctgacttccacgtgtttgtgagagatgtgctgcagcacgtggacagcatgcagaaggactacccaggcctgcctgtgttcctgctgggccacagcatgggcggggccatcgccatcctgacagctgctgagcggcccggccactttgctggcatggtgctgatcagccccctggtgctggccaaccctgagagcgccaccaccttcaaggtgctggccgccaaggtgctgaacctggtgctgcccaacctgagcctgggccccatcgacagctctgtgctgagcaggaacaagacagaggtggacatctacaacagcgaccccctcatctgcagagctggcctgaaggtgtgcttcggcatccagctgctgaatgctgtgtcccgggtggagcgggccctgcccaagctgactgtgcccttcctgctgctgcagggcagcgctgaccggctgtgtgacagcaaaggagcctacctgctgatggagctggccaagagccaggacaagaccctgaagatctatgagggcgcctaccacgtgctgcacaaggagctgcctgaggtgaccaacagcgtcttccacgagatcaacatgtgggtgtcccagaggacagccacagctggaacagccagccccccatag

SEQ ID NO: 160261 - DNA, 1842 bp, Artificial Sequence
  Description of Artificial Sequence: Synthetic coding sequence
atgtgctgctggcccctgctgctgctgtggggcctgctgcccggcacagctgctgggggcagcggccgcacctacccccacaggaccctgctggacagcgagggcaagtactggctgggctggagccagaggggcagccagatcgccttccggctgcaggtgaggacagctggctacgtgggcttcggcttcagccccactggagccatggccagcgctgacatcgtggtgggcggcgtggcccacggccggccctacctgcaggactacttcaccaatgccaaccgggagctgaagaaggatgcccagcaggactaccacctggagtatgccatggagaacagcacccacaccatcatcgagttcacccgggagctgcacacctgtgacatcaatgacaagagcatcacagacagcacagtgcgggtcatctgggcctaccaccatgaagatgctggggaggccggccccaagtaccatgacagcaacagaggcaccaagagcctgcggctgctgaaccctgagaagacctctgtgctgagcacagccctgccctactttgacctggtgaaccaggatgtgcccatccccaacaaggacaccacctactggtgccagatgttcaagatccctgtgttccaggagaagcaccacgtgatcaaggtggagcccgtcatccagaggggccacgagagcctggtgcaccacatcctgctgtaccagtgcagcaacaacttcaatgattctgtgctggagagcggccacgagtgctaccaccccaacatgccagatgccttcctgacctgtgaaacagtcatctttgcctgggccatcggcggggagggcttctcctacccaccccacgtgggcctgagcctgggcacccccctggacccccactacgtgctgctggaggtgcactatgacaaccccacctatgaggagggcctgattgacaacagcggcctgcggctcttctacaccatggacatcagaaaatatgatgctggggtgattgaagctggcctgtgggtgtccctcttccacaccatccccccaggcatgcctgagttccagagcgagggccactgcaccctggagtgcctggaggaggccctggaggccgagaagcccagcggcatccacgtgtttgctgtgctgctgcacgcccacctggccggccggggcatccggctgcggcacttcaggaagggcaaggagatgaagctgctggcctatgatgatgactttgacttcaacttccaggagttccagtacctgaaggaggagcagaccatcctgcccggggacaacctgatcacagagtgccgctacaacaccaaggacagagctgagatgacctggggcggcctgagcaccaggtctgagatgtgcctgagctacctgctgtactacccccgcatcaacctgacccgctgtgccagcatcccagacatcatggagcagctgcagttcatcggcgtgaaggagatctacagacctgtgaccacctggcccttcatcatcaagagccccaagcagtacaagaacctgtccttcatggatgccatgaacaagttcaagtggaccaagaaggagggcctgtccttcaacaagctggtgctgagcctgcctgtgaatgtgcgctgcagcaagacagacaatgctgagtggagcatccagggcatgacagccctgcccccagacatcgagcggccctacaaggccgagcccctggtgtgtggcaccagcagcagcagcagcctgcaccgggacttcagcatcaacctgctggtgtgcctgctgctgctgagctgcaccctgagcaccaagagcctgtag

SEQ ID NO: 160262 - DNA, 1023 bp, Artificial Sequence; identical to SEQ ID NO: 154687
  Description of Artificial Sequence: Synthetic coding sequence

SEQ ID NO: 160263 - DNA, 1089 bp, Artificial Sequence
  Description of Artificial Sequence: Synthetic coding sequence
atggcccccaagcaggaccccaagcccaagttccaggagggggagcgggtgctgtgcttccacggccccctgctgtatgaggccaagtgtgtgaaggtggccatcaaggacaagcaggtgaagtacttcatccactacagcggctggaacaagaagtctgctgtgcggccccggcgctctgagaagagcctgaagacccatgaggacatcgtggccctcttccctgtgcctgagggcgcccccagcgtgcaccaccccctgctgaccagctcctgggatgagtgggtgcctgagagccgggtgctgaagtatgtggacaccaacctgcagaagcagcgggagctgcagaaggccaaccaggagcagtatgcagagggcaagatgagaggagctgcccctgggaagaagaccagcggcctgcagcagaagaatgtggaggtgaagaccaagaagaacaagcagaagaccccaggaaatggagatggcggcagcaccagcgagaccccccagccccccaggaagaagagggcccgggtggaccccaccgtggagaatgaggagaccttcatgaacagagtggaggtgaaggtgaagatccctgaggagctgaagccctggctggtggatgactgggacctgatcacccggcagaagcagctgttctacctgcctgccaagaagaatgtggacagcatcctggaggactatgccaactacaagaagagccggggcaacacagacaacaaggagtatgctgtgaatgaggtggtggccggcatcaaggagtacttcaacgtgatgctgggcacccagctgctgtacaagtttgagcggccccagtatgcagagatcctggccgaccacccagatgcccccatgagccaggtgtatggagccccccacctgctgcggctgtttgtgagaattggagccatgctggcctacacccccctggatgagaagagcctggccctgctgctgaactacctgcatgacttcctgaagtacctggccaagaacagcgccaccctcttcagcgccagtgactatgaggtggcccctcctgagtaccacaggaaggctgtgtag

SEQ ID NO: 160264 - DNA, 1047 bp, Artificial Sequence
  Description of Artificial Sequence: Synthetic coding sequence
atgatccccttcccccacccccaggtgacagatgccctgggccgctacagcaactacatcctgagcagcacagtggagagccccagcctgcgctccatgaactttgagaagcagggcgagcgggtgctgtgcttccacggccccctgctgtatgaggccaagtgtgtgaaggtggccatcaaggacaagcaggtgaagtacttcatccactacagcggctggaacaagaactgggatgagtgggtgcctgagagccgggtgctgaagtatgtggacaccaacctgcagaagcagcgggagctgcagaaggccaaccaggagcagtatgcagagggcaagatgagaggagctgcccctgggaagaagaccagcggcctgcagcagaagaatgtggaggtgaagaccaagaagaacaagcagaagaccccaggaaatggagatggcggcagcaccagcgagaccccccagccccccaggaagaagagggcccgggtggaccccaccgtggagaatgaggagaccttcatgaacagagtggaggtgaaggtgaagatccctgaggagctgaagccctggctggtggatgactgggacctgatcacccggcagaagcagctgttctacctgcctgccaagaagaatgtggacagcatcctggaggactatgccaactacaagaagagccggggcaacacagacaacaaggagtatgctgtgaatgaggtggtggccggcatcaaggagtacttcaacgtgatgctgggcacccagctgctgtacaagtttgagcggccccagtatgcagagatcctggccgaccacccagatgcccccatgagccaggtgtatggagccccccacctgctgcggctgtttgtgagaattggagccatgctggcctacacccccctggatgagaagagcctggccctgctgctgaactacctgcatgacttcctgaagtacctggccaagaacagcgccaccctcttcagcgccagtgactatgaggtggcccctcctgagtaccacaggaaggctgtgtag

SEQ ID NO: 160265 - DNA, 972 bp, Artificial Sequence
  Description of Artificial Sequence: Synthetic coding sequence
atggcccccaagcaggaccccaagcccaagttccaggagggggagcgggtgctgtgcttccacggccccctgctgtatgaggccaagtgtgtgaaggtggccatcaaggacaagcaggtgaagtacttcatccactacagcggctggaacaagaactgggatgagtgggtgcctgagagccgggtgctgaagtatgtggacaccaacctgcagaagcagcgggagctgcagaaggccaaccaggagcagtatgcagagggcaagatgagaggagctgcccctgggaagaagaccagcggcctgcagcagaagaatgtggaggtgaagaccaagaagaacaagcagaagaccccaggaaatggagatggcggcagcaccagcgagaccccccagccccccaggaagaagagggcccgggtggaccccaccgtggagaatgaggagaccttcatgaacagagtggaggtgaaggtgaagatccctgaggagctgaagccctggctggtggatgactgggacctgatcacccggcagaagcagctgttctacctgcctgccaagaagaatgtggacagcatcctggaggactatgccaactacaagaagagccggggcaacacagacaacaaggagtatgctgtgaatgaggtggtggccggcatcaaggagtacttcaacgtgatgctgggcacccagctgctgtacaagtttgagcggccccagtatgcagagatcctggccgaccacccagatgcccccatgagccaggtgtatggagccccccacctgctgcggctgtttgtgcgcatcggggccatgctggcctacacccccctggatgagaagagcctggccctgctgctgaactacctgcatgacttcctgaagtacctggccaagaacagcgccaccctcttcagcgccagtgactatgaggtggcccctcctgagtaccacaggaaggctgtgtag

SEQ ID NO: 160266 - DNA, 708 bp, Artificial Sequence
  Description of Artificial Sequence: Synthetic coding sequence
atgagaggagctgcccctgggaagaagaccagcggcctgcagcagaagaatgtggaggtgaagaccaagaagaacaagcagaagaccccaggaaatggagatggcggcagcaccagcgagaccccccagccccccaggaagaagagggcccgggtggaccccaccgtggagaatgaggagaccttcatgaacagagtggaggtgaaggtgaagatccctgaggagctgaagccctggctggtggatgactgggacctgatcacccggcagaagcagctgttctacctgcctgccaagaagaatgtggacagcatcctggaggactatgccaactacaagaagagccggggcaacacagacaacaaggagtatgctgtgaatgaggtggtggccggcatcaaggagtacttcaacgtgatgctgggcacccagctgctgtacaagtttgagcggccccagtatgcagagatcctggccgaccacccagatgcccccatgagccaggtgtatggagccccccacctgctgcggctgtttgtgcgcatcggggccatgctggcctacacccccctggatgagaagagcctggccctgctgctgaactacctgcatgacttcctgaagtacctggccaagaacagcgccaccctcttcagcgccagtgactatgaggtggcccctcctgagtaccacaggaaggctgtgtag

SEQ ID NO: 160267 - DNA, 708 bp, Artificial Sequence; identical to SEQ ID NO: 160266
  Description of Artificial Sequence: Synthetic coding sequence

SEQ ID NO: 160268 - DNA, 345 bp, Artificial Sequence
  Description of Artificial Sequence: Synthetic coding sequence
atggtgtccaggaaggctgtggccgccctgctggtggtgcacgtggccgccatgctggccagccagacagaggcctttgtgcccatcttcacctacggggagctgcagaggatgcaggagaaggagagaaataaaggccagaagaagagcctgtctgtgtggcagaggtctggagaggagggccctgtggaccctgctgagcccatccgggaggaggagaatgagatgatcaagctgacagcccccctggagatcggcatgaggatgaacagccggcagctggagaagtacccagccaccctggagggcctgctgtctgagatgctgccccagcacgccaagtag

SEQ ID NO: 160269 - DNA, 348 bp, Artificial Sequence
  Description of Artificial Sequence: Synthetic coding sequence
atggtgtccaggaaggctgtggccgccctgctggtggtgcacgtggccgccatgctggccagccagacagaggcctttgtgcccatcttcacctacggggagctgcagaggatgcaggagaaggagagaaataaaggccagaagaagagcctgtctgtgtggcagaggtctggagaggagggccctgtggaccctgctgagcccatccgggaggaggagaatgagatgatcaagctgacagcccccctggagatcggcatgaggatgaacagccggcagctggagaagtacccagccaccctggagggcctgctgtctgagatgctgccccagcacgccgccaagtag

SEQ ID NO: 160270 - DNA, 327 bp, Artificial Sequence
  Description of Artificial Sequence: Synthetic coding sequence
atggtgtccaggaaggctgtggccgccctgctggtggtgcacgtggccgccatgctggccagccagacagaggcctttgtgcccatcttcacctacggggagctgcagaggatgcaggagaaggagagaaataaaggccagaagaagagcctgtctgtgtggcagaggtctggagaggagggccctgtggaccctgctgagcccatccgggaggaggagaatgagatgatcaagctgacagcccccctggagatcggcatgaggatgaacagccggcagctggagaagtacccagccaccctggagggcctgctgacagccaagtag

SEQ ID NO: 160271 - DNA, 1011 bp, Artificial Sequence
  Description of Artificial Sequence: Synthetic coding sequence
atggcccggcggcgcagccagagggtgtgtgccagcggccccagcatgctgaacagcgcccggggggcccctgagctgctgcggggcacagccaccaatgctgaggtgtctgctgctgctgctggggccaccggcagcgaggagctgcccccaggggaccggggctgcagaaatggaggcggccggggccctgctgccaccaccagcagcactggagtggccgtgggcgctgagcacggggaggacagcctgagcaggaagccagaccctgagcccggccgcatggaccaccaccagcccggcaccggccgctaccaggtgctgctgaatgaggaggacaacagcgagagcagcgccatcgagcagccccccaccagcaacccagccccccagatcgtgcaggccgccagcagcgccccagccctggagacagacagcagccccccaccctacagcagcatcaccgtggaggtgcccaccaccagtgacacagaggtgtatggagagttctaccctgtgcccccaccctacagcgtggccaccagcctgcccacctatgatgaagctgagaaggccaaggctgctgccatggctgctgctgctgctgagaccagccagaggatccaggaggaggagtgccccccaagagatgacttcagtgatgctgaccagctgcgggtgggcaatgatggcatcttcatgctggccttcttcatggccttcatcttcaactggctgggcttctgcctgtccttctgcatcaccaacaccatcgccggccgctacggggccatctgtggcttcggcctgagcctcatcaagtggatcctgattgtgcgcttcagtgactacttcaccggctacttcaacggccagtactggctgtggtggatcttcctggtgctgggcctgctgctcttcttccggggctttgtgaactacctgaaggtgaggaacatgtctgagagcatggccgccgcccacaggacccgctacttcttcctgctgtag

SEQ ID NO: 160272 - DNA, 1161 bp, Artificial Sequence
  Description of Artificial Sequence: Synthetic coding sequence
atgggcagcccctggaatggaagtgatggccctgagggcgcccgggagcccccctggccagccctgcccccctgtgatgagcggcgctgcagccccttccccctgggcgccctggtgcctgtgacagctgtgtgcctgtgcctgtttgtggtgggcgtgtctggaaatgtggtgacagtgatgctgattggccgctacagagacatgaggaccaccaccaacctgtacctgggctccatggctgtgtctgacctgctgatcctgctgggcctgccctttgacctgtaccgcctgtggaggagccggccctgggtgtttggccccctgctgtgccgcctgagcctgtatgtgggggagggctgcacctacgccaccctgctgcacatgacagccctgtctgtggagcgctacctggccatctgccggcccctgcgggcccgggtgctggtgaccaggagaagagtgcgggccctgattgctgtgctgtgggccgtggccctgctgtctgctggccccttcctgttcctggtgggcgtggagcaggaccccggcatctctgtggtgcccggcctgaatggaacagccagaattgccagcagccccctggccagcagcccccccctgtggctgagccgggcccccccacccagcccccccagcggccctgagacagctgaggccgccgccctcttcagccgggagtgccggcccagccctgcccagctgggcgccctgcgggtgatgctgtgggtgaccacagcctacttcttcctgcccttcctgtgcctgagcatcctgtatggcctcatcggccgggagctgtggagcagccggcggcccctgcggggccctgctgccagcggccgggagcggggccaccggcagacagtgcgggtgctgaggaagtggagcagaagaggcagcaaggatgcctgcctgcagagcgcccctcctggaacagcccagaccctgggccccctgcccctgctggcccagctgtgggcccccctgcctgcccccttccccatcagcatcccagccagcacccggcggggcggcggcagcggcatctacaacctgctggtggccctgccccgctggcagaaccacctgcacaagcacggccgctttgctgatgatgtgctgctgtctgtgctgtag

SEQ ID NO: 160273 - DNA, 1206 bp, Artificial Sequence
  Description of Artificial Sequence: Synthetic coding sequence
atggagaagagcaagaacttcagaattgatgccctgctggccgtggaccccccccgggccgccagcgcccagagcgcccccctggccctggtgaccagcctggccgctgctgccagcggcactggaggcggcggcggcggcggcggggccagcggcggcaccagcggcagctgcagccctgccagcagcgagcccccagctgccccagctgaccggctgcgggcagagagccccagccccccccggctgctggccgcccactgtgccctgctgcccaagccaggcttcctgggcgccggcggcggcggcggcggcaccggcggcggccacggcggcccccaccaccacgcccaccctggagctgctgctgctgctgctgctgctgctgctgctgctgctgctgggggcctggccctgggcctgcaccctggaggagcccagggcggggccggcctgcctgcccaggccgccctgtatggccaccctgtgtatggctacagcgctgctgctgctgctgctgccctggccggccagcacccagccctgagctacagctacccccaggtgcagggcgcccacccagcccaccctgctgaccccatcaagctgggcgccggcaccttccagctggaccagtggctgcgggccagcacagctggcatgatcctgcccaagatgccagacttcaacagccaggcccagagcaacctgctgggcaagtgccggcggcccaggacagccttcaccagccagcagctgctggagctggagcaccagttcaagctgaacaagtacctgagccggcccaagagatttgaggtggccaccagcctgatgctgacagagacccaggtgaagatctggttccagaacagaaggatgaagtggaagaggagcaagaaggccaaggagcaggccgcccaggaggccgagaagcagaagggcggcggcggcggggccggcaagggcggcgctgaggagcccggggctgaggagctgctgggccccccagcccctggggacaagggcagcggccggcggctgcgggacctgcgggacagcgaccctgaggaggatgaagatgaagatgatgaggaccacttcccctacagcaatggagcctctgtgcacgccgccagcagtgactgcagcagtgaagatgacagccccccaccccggcccagccaccagcctgccccccagtag

SEQ ID NO: 160274 - DNA, 696 bp, Artificial Sequence
  Description of Artificial Sequence: Synthetic coding sequence
gctgctgctgccctggccggccagcacccagccctgagctacagctacccccaggtgcagggcgcccacccagcccaccctgctgaccccatcaagctgggcgccggcaccttccagctggaccagtggctgcgggccagcacagctggcatgatcctgcccaagatgccagacttcaacagccaggcccagagcaacctgctgggcaagtgccggcggcccaggacagccttcaccagccagcagctgctggagctggagcaccagttcaagctgaacaagtacctgagccggcccaagagatttgaggtggccaccagcctgatgctgacagagacccaggtgaagatctggttccagaacagaaggatgaagtggaagaggagcaagaaggccaaggagcaggccgcccaggaggccgagaagcagaagggcggcggcggcggggccggcaagggcggcgctgaggagcccggggctgaggagctgctgggccccccagcccctggggacaagggcagcggccggcggctgcgggacctgcgggacagcgaccctgaggaggatgaagatgaagatgatgaggaccacttcccctacagcaatggagcctctgtgcacgccgccagcagtgactgcagcagtgaagatgacagccccccaccccggcccagccaccagcctgccccccagtag

SEQ ID NO: 160275 - DNA, 570 bp, Artificial Sequence
  Description of Artificial Sequence: Synthetic coding sequence
atgggcggcctgagcacagtgggcgcctgccccggcatcctgggcgcccagcaggcccaggcccagagcaacctgctgggcaagtgccggcggcccaggacagccttcaccagccagcagctgctggagctggagcaccagttcaagctgaacaagtacctgagccggcccaagagatttgaggtggccaccagcctgatgctgacagagacccaggtgaagatctggttccagaacagaaggatgaagtggaagaggagcaagaaggccaaggagcaggccgcccaggaggccgagaagcagaagggcggcggcggcggggccggcaagggcggcgctgaggagcccggggctgaggagctgctgggccccccagcccctggggacaagggcagcggccggcggctgcgggacctgcgggacagcgaccctgaggaggatgaagatgaagatgatgaggaccacttcccctacagcaatggagcctctgtgcacgccgccagcagtgactgcagcagtgaagatgacagccccccaccccggcccagccaccagcctgccccccagtag

SEQ ID NO: 160276 - DNA, 1692 bp, Artificial Sequence
  Description of Artificial Sequence: Synthetic coding sequence
atgcccagcaagttcagctgccggcagctgcgggaggccggccagtgctttgagagcttcctggtggtgcggggcctggacatggagacagaccgggagcggctgcggaccatctacaacagagacttcaagatcagctttggcaccccagcccctggcttcagctccatgctgtatggcatgaagatcgccaacctggcctacgtgaccaagaccagggtgcgcttcttccggctggaccgctgggcagatgtgcgcttccctgagaagaggaggatgaagctgggcagtgacatcagcaagcaccacaagagcctgctggccaagatcttctatgacagagctgagtacctgcacggcaagcacggcgtggatgtggaggtgcagggcccccatgaggccagagatggccagctgctgatccggctggacctgaacaggaaggaggtgctgaccctgcggctgagaaatggaggcacccagagcgtgaccctgacccacctgttccccctgtgcaggaccccccagtttgccttctacaatgaagaccaggagctgccctgccccctgggccctggagagtgctatgagctgcacgtgcactgcaagaccagctttgtgggctacttccctgccaccgtgctgtgggagctgctgggccctggagagagcggcagcgagggcgccggcaccttctacatcgcccgcttcctggccgctgtggcccacagccccctggccgcccagctgaagcccatgacccccttcaagaggacccgcatcaccggcaaccctgtggtgaccaacagaattgaggagggggagaggccagaccgggccaagggctatgacctggagctgtccatggccctgggcacctactaccccccaccccggctgcggcagctgctgcccatgctgctgcagggcaccagcatcttcaccgcccccaaggagattgctgagatcaaggcccagctggagacagccctgaagtggaggaactatgaggtgaagctgcggctgctgctgcacctggaggagctgcagatggagcatgacatccgccactatgacctggagagcgtgcccatgacctgggaccctgtggaccagaacccccggctgctgaccctggaggtgcctggggtgacagagagccggcccagcgtgctgcggggggaccacctgtttgccctgctgagcagcgagacccaccaggaggaccccatcacctacaagggctttgtgcacaaggtggagctggacagagtgaagctgtccttctccatgagcctgctgagcagatttgtggatggcctgaccttcaaggtgaacttcaccttcaaccggcagcccctgcgggtgcagcaccgggccctggagctgaccggccgctggctgctgtggcccatgctgtttcctgtggcccccagagatgtgcccctgctgcccagtgatgtgaagctgaagctgtatgacaggagcctggagagcaaccctgagcagctgcaggccatgaggcacatcgtgacaggcaccaccaggcctgccctgacagcctgcctgaccctgaaccagaacccagctgagctgcccctgcagggcaccggccgcctgggggagggcgtgtacaaccccagccacagcacccccagccctgctggagaaaatgacaccagcagctgctag

SEQ ID NO: 160277 - DNA, 3012 bp, Artificial Sequence
  Description of Artificial Sequence: Synthetic coding sequence
atgcccagcaagttcagctgccggcagctgcgggaggccggccagtgctttgagagcttcctggtggtgcggggcctggacatggagacagaccgggagcggctgcggaccatctacaacagagacttcaagatcagctttggcaccccagcccctggcttcagctccatgctgtatggcatgaagatcgccaacctggcctacgtgaccaagaccagggtgcgcttcttccggctggaccgctgggcagatgtgcgcttccctgagaagaggaggatgaagctgggcagtgacatcagcaagcaccacaagagcctgctggccaagatcttctatgacagagctgagtacctgcacggcaagcacggcgtggatgtggaggtgcagggcccccatgaggccagagatggccagctgctgatccggctggacctgaacaggaaggaggtgctgaccctgcggctgagaaatggaggcacccagagcgtgaccctgacccacctgttccccctgtgcaggaccccccagtttgccttctacaatgaagaccaggagctgccctgccccctgggccctggagagtgctatgagctgcacgtgcactgcaagaccagctttgtgggctacttccctgccaccgtgctgtgggagctgctgggccctggagagagcggcagcgagggcgccggcaccttctacatcgcccgcttcctggccgctgtggcccacagccccctggccgcccagctgaagcccatgacccccttcaagaggacccgcatcaccggcaaccctgtggtgaccaacagaattgaggagggggagaggccagaccgggccaagggctatgacctggagctgtccatggccctgggcacctactaccccccaccccggctgcggcagctgctgcccatgctgctgcagggcaccagcatcttcaccgcccccaaggagattgctgagatcaaggcccagctggagacagccctgaagtggaggaactatgaggtgaagctgcggctgctgctgcacctggaggagctgcagatggagcatgacatccgccactatgacctggagagcgtgcccatgacctgggaccctgtggaccagaacccccggctgctgaccctggaggtgcctggggtgacagagagccggcccagcgtgctgcggggggaccacctgtttgccctgctgagcagcgagacccaccaggaggaccccatcacctacaagggctttgtgcacaaggtggagctggacagagtgaagctgtccttctccatgagcctgctgagcagatttgtggatggcctgaccttcaaggtgaacttcaccttcaaccggcagcccctgcgggtgcagcaccgggccctggagctgaccggccgctggctgctgtggcccatgctgtttcctgtggcccccagagatgtgcccctgctgcccagtgatgtgaagctgaagctgtatgacaggagcctggagagcaaccctgagcagctgcaggccatgaggcacatcgtgacaggcaccaccaggcctgccccctacatcatctttggacctcctggcaccgggaagacagtgaccctggtggaggccatcaagcaggtggtgaagcacctgcccaaggcccacatcctggcctgtgcccccagcaacagcggggctgacctgctgtgccagaggctgcgggtgcacctgcccagcagcatctaccgcctgctggcccccagccgggacatccgcatggtgcctgaggacatcaagccctgctgcaactgggatgccaagaagggggagtatgtgtttcctgccaagaagaagctgcaggagtacagagtgctgatcaccaccctcatcacagctggccgcctggtgtctgcccagttccccatcgaccacttcacccacatcttcattgatgaagctggccactgcatggagcctgagagcctggtggccatcgccggcctgatggaggtgaaggagaccggggaccccggcggccagctggtgctggccggggacccccggcagctgggccctgtgctgcggagccccctgacccagaagcacggcctgggctacagcctgctggagcggctgctgacctacaacagcctgtacaagaagggcccagatggctatgacccccagttcatcaccaagctgctgaggaactaccgcagccaccccaccatcctggacatccccaaccagctgtactatgaaggagagctgcaggcctgtgctgatgtggtggaccgggagcgcttctgccgctgggccggcctgccccggcagggcttccccatcatcttccatggagtgatgggcaaggatgagcgggagggcaacagccccagcttcttcaaccctgaggaggccgccaccgtgaccagctacctgaagctgctgctggcccccagcagcaagaagggcaaggcccggctgagccccaggtctgtgggcgtcatcagcccctacaggaagcaggtggagaagatccgctactgcatcaccaagctggaccgggagctgcggggcctggatgacatcaaggacctgaaggtgggctctgtggaggagttccagggccaggagaggagcgtcatcctgatcagcacagtgcgcagcagccagagctttgtgcagctggacctggacttcaacctgggcttcctgaagaaccccaagcgcttcaacgtggccgtgacccgggccaaggccctgctgatcatcgtgggcaaccccctgctgctgggccatgaccctgactggaaggtgttcctggagttctgcaaggaaaatggaggctacacaggctgccccttccctgccaagctggacctgcagcagggccagaacctgctgcagggcctgagcaagctgagccccagcaccagcggcccccacagccatgactacctgccccaggagcgggagggggagggcggcctgagcctgcaggtggagcctgagtggagaaatgagctgtag

SEQ ID NO: 160278 - DNA, 2844 bp, Artificial Sequence
  Description of Artificial Sequence: Synthetic coding sequence
atgctgtatggcatgaagatcgccaacctggcctacgtgaccaagaccagggtgcgcttcttccggctggaccgctgggcagatgtgcgcttccctgagaagaggaggatgaagctgggcagtgacatcagcaagcaccacaagagcctgctggccaagatcttctatgacagagctgagtacctgcacggcaagcacggcgtggatgtggaggtgcagggcccccatgaggccagagatggccagctgctgatccggctggacctgaacaggaaggaggtgctgaccctgcggctgagaaatggaggcacccagagcgtgaccctgacccacctgttccccctgtgcaggaccccccagtttgccttctacaatgaagaccaggagctgccctgccccctgggccctggagagtgctatgagctgcacgtgcactgcaagaccagctttgtgggctacttccctgccaccgtgctgtgggagctgctgggccctggagagagcggcagcgagggcgccggcaccttctacatcgcccgcttcctggccgctgtggcccacagccccctggccgcccagctgaagcccatgacccccttcaagaggacccgcatcaccggcaaccctgtggtgaccaacagaattgaggagggggagaggccagaccgggccaagggctatgacctggagctgtccatggccctgggcacctactaccccccaccccggctgcggcagctgctgcccatgctgctgcagggcaccagcatcttcaccgcccccaaggagattgctgagatcaaggcccagctggagacagccctgaagtggaggaactatgaggtgaagctgcggctgctgctgcacctggaggagctgcagatggagcatgacatccgccactatgacctggagagcgtgcccatgacctgggaccctgtggaccagaacccccggctgctgaccctggaggtgcctggggtgacagagagccggcccagcgtgctgcggggggaccacctgtttgccctgctgagcagcgagacccaccaggaggaccccatcacctacaagggctttgtgcacaaggtggagctggacagagtgaagctgtccttctccatgagcctgctgagcagatttgtggatggcctgaccttcaaggtgaacttcaccttcaaccggcagcccctgcgggtgcagcaccgggccctggagctgaccggccgctggctgctgtggcccatgctgtttcctgtggcccccagagatgtgcccctgctgcccagtgatgtgaagctgaagctgtatgacaggagcctggagagcaaccctgagcagctgcaggccatgaggcacatcgtgacaggcaccaccaggcctgccccctacatcatctttggacctcctggcaccgggaagacagtgaccctggtggaggccatcaagcaggtggtgaagcacctgcccaaggcccacatcctggcctgtgcccccagcaacagcggggctgacctgctgtgccagaggctgcgggtgcacctgcccagcagcatctaccgcctgctggcccccagccgggacatccgcatggtgcctgaggacatcaagccctgctgcaactgggatgccaagaagggggagtatgtgtttcctgccaagaagaagctgcaggagtacagagtgctgatcaccaccctcatcacagctggccgcctggtgtctgcccagttccccatcgaccacttcacccacatcttcattgatgaagctggccactgcatggagcctgagagcctggtggccatcgccggcctgatggaggtgaaggagaccggggaccccggcggccagctggtgctggccggggacccccggcagctgggccctgtgctgcggagccccctgacccagaagcacggcctgggctacagcctgctggagcggctgctgacctacaacagcctgtacaagaagggcccagatggctatgacccccagttcatcaccaagctgctgaggaactaccgcagccaccccaccatcctggacatccccaaccagctgtactatgaaggagagctgcaggcctgtgctgatgtggtggaccgggagcgcttctgccgctgggccggcctgccccggcagggcttccccatcatcttccatggagtgatgggcaaggatgagcgggagggcaacagccccagcttcttcaaccctgaggaggccgccaccgtgaccagctacctgaagctgctgctggcccccagcagcaagaagggcaaggcccggctgagccccaggtctgtgggcgtcatcagcccctacaggaagcaggtggagaagatccgctactgcatcaccaagctggaccgggagctgcggggcctggatgacatcaaggacctgaaggtgggctctgtggaggagttccagggccaggagaggagcgtcatcctgatcagcacagtgcgcagcagccagagctttgtgcagctggacctggacttcaacctgggcttcctgaagaaccccaagcgcttcaacgtggccgtgacccgggccaaggccctgctgatcatcgtgggcaaccccctgctgctgggccatgaccctgactggaaggtgttcctggagttctgcaaggaaaatggaggctacacaggctgccccttccctgccaagctggacctgcagcagggccagaacctgctgcagggcctgagcaagctgagccccagcaccagcggcccccacagccatgactacctgccccaggagcgggagggggagggcggcctgagcctgcaggtggagcctgagtggagaaatgagctgtag

SEQ ID NO: 160279 - DNA, 3012 bp, Artificial Sequence; identical to SEQ ID NO: 160277
  Description of Artificial Sequence: Synthetic coding sequence

SEQ ID NO: 160280 - DNA, 2826 bp, Artificial Sequence
  Description of Artificial Sequence: Synthetic coding sequence
atggagacagaccgggagcggctgcggaccatctacaacagagacttcaagatcagctttggcaccccagcccctggcttcagctccatgctgtatggcatgaagatcgccaacctggcctacgtgaccaagaccagggtgcgcttcttccggctggaccgctgggcagatgtgcgcttccctgagaagaggaggatgaagctgggcagtgacatcagcaagcaccacaagagcctgctggccaagatcttctatgacagagctgagtacctgcacggcaagcatggaggcacccagagcgtgaccctgacccacctgttccccctgtgcaggaccccccagtttgccttctacaatgaagaccaggagctgccctgccccctgggccctggagagtgctatgagctgcacgtgcactgcaagaccagctttgtgggctacttccctgccaccgtgctgtgggagctgctgggccctggagagagcggcagcgagggcgccggcaccttctacatcgcccgcttcctggccgctgtggcccacagccccctggccgcccagctgaagcccatgacccccttcaagaggacccgcatcaccggcaaccctgtggtgaccaacagaattgaggagggggagaggccagaccgggccaagggctatgacctggagctgtccatggccctgggcacctactaccccccaccccggctgcggcagctgctgcccatgctgctgcagggcaccagcatcttcaccgcccccaaggagattgctgagatcaaggcccagctggagacagccctgaagtggaggaactatgaggtgaagctgcggctgctgctgcacctggaggagctgcagatggagcatgacatccgccactatgacctggagagcgtgcccatgacctgggaccctgtggaccagaacccccggctgctgaccctggaggtgcctggggtgacagagagccggcccagcgtgctgcggggggaccacctgtttgccctgctgagcagcgagacccaccaggaggaccccatcacctacaagggctttgtgcacaaggtggagctggacagagtgaagctgtccttctccatgagcctgctgagcagatttgtggatggcctgaccttcaaggtgaacttcaccttcaaccggcagcccctgcgggtgcagcaccgggccctggagctgaccggccgctggctgctgtggcccatgctgtttcctgtggcccccagagatgtgcccctgctgcccagtgatgtgaagctgaagctgtatgacaggagcctggagagcaaccctgagcagctgcaggccatgaggcacatcgtgacaggcaccaccaggcctgccccctacatcatctttggacctcctggcaccgggaagacagtgaccctggtggaggccatcaagcaggtggtgaagcacctgcccaaggcccacatcctggcctgtgcccccagcaacagcggggctgacctgctgtgccagaggctgcgggtgcacctgcccagcagcatctaccgcctgctggcccccagccgggacatccgcatggtgcctgaggacatcaagccctgctgcaactgggatgccaagaagggggagtatgtgtttcctgccaagaagaagctgcaggagtacagagtgctgatcaccaccctcatcacagctggccgcctggtgtctgcccagttccccatcgaccacttcacccacatcttcattgatgaagctggccactgcatggagcctgagagcctggtggccatcgccggcctgatggaggtgaaggagaccggggaccccggcggccagctggtgctggccggggacccccggcagctgggccctgtgctgcggagccccctgacccagaagcacggcctgggctacagcctgctggagcggctgctgacctacaacagcctgtacaagaagggcccagatggctatgacccccagttcatcaccaagctgctgaggaactaccgcagccaccccaccatcctggacatccccaaccagctgtactatgaaggagagctgcaggcctgtgctgatgtggtggaccgggagcgcttctgccgctgggccggcctgccccggcagggcttccccatcatcttccatggagtgatgggcaaggatgagcgggagggcaacagccccagcttcttcaaccctgaggaggccgccaccgtgaccagctacctgaagctgctgctggcccccagcagcaagaagggcaaggcccggctgagccccaggtctgtgggcgtcatcagcccctacaggaagcaggtggagaagatccgctactgcatcaccaagctggaccgggagctgcggggcctggatgacatcaaggacctgaaggtgggctctgtggaggagttccagggccaggagaggagcgtcatcctgatcagcacagtgcgcagcagccagagctttgtgcagctggacctggacttcaacctgggcttcctgaagaaccccaagcgcttcaacgtggccgtgacccgggccaaggccctgctgatcatcgtgggcaaccccctgctgctgggccatgaccctgactggaaggtgttcctggagttctgcaaggaaaatggaggctacacaggctgccccttccctgccaagctggacctgcagcagggccagaacctgctgcagggcctgagcaagctgagccccagcaccagcggcccccacagccatgactacctgccccaggagcgggagggggagggcggcctgagcctgcaggtggagcctgagtggagaaatgagctgtag

SEQ ID NO: 160281 - DNA, 3012 bp, Artificial Sequence; identical to SEQ ID NO: 160277
  Description of Artificial Sequence: Synthetic coding sequence

SEQ ID NO: 160282 - DNA, 171 bp, Artificial Sequence
  Description of Artificial Sequence: Synthetic coding sequence
atgcccagcaagttcagctgccggcagctgcgggaggccggccagtgctttgagagcttcctggtggtgcggggcctggacatggagacagaccgggagcggctgcggaccatctacaacagagacttcaagatcagcctggccagcagcaagagcatcctgcagagctag

SEQ ID NO: 160283 - DNA, 3636 bp, Artificial Sequence
  Description of Artificial Sequence: Synthetic coding sequence
atgctgagcctggccgccaagctggtggccttcttctggaggacagctgacaccccccgggaggaggccggccagctggagcctgagctggccgagggggacaccaagctgaagacagtgcggggcgtggtgacccgctactgcagcgactatggcatgattgatgacatgatctacttcagcagtgatgctgtgaccagccgggtgctgctgaatgtgggccaggaggtgattgctgtggtggaggagaacaaggtgtccaatggcctgaaggccatccgggtggaggccgtgtctgacaagtgggaggatgacagcagaaatcatggcagccccagcgactgtggcccccgggtgctgattggctgtgtgaccagcctggtggagggcgccggctgcatcagccagaccacctacttcagcctggagagcgtgtgtgagggctttgagccctgcaagggggactgggtggaggccgagtaccgcatccggcccggcacctggagcagcgaggccacctctgtgaagcccctgcgctacaagagggtggacaaggtgtgcatcagcagcctgtgtggcagaaatggagtgctggaggagagcatcttcttcaccctggacagcctgaagctgcctgatggctacacccccaggagaggagatgtggtgaatgctgtggtggtggagagcagccagagctgctacgtgtggagggccctgtgcatgaccctggtgaagagaagagatgctgcccctgtgcatgaggccacccacttctacggcaccatcctgctgaagaacaagggggacatcgaggtgacccaggtgacccacttcggcaccctgaaggagggccgcagcaagaccatggtgatctggattgaaaataaaggagacatcccccagaacctggtgtcctgcaagctggccggctgggacaagagcaagcagttccgcttccagatgctggacaaggaccagatgtgccctgtggtgtcctttgtgtctgtgcctgagaaggagaacagcagtgatgagaacatcaacagcctgaacagccacaccaagaacaagaccagccagatgtctgagagcagcctggtgaacaacagaggcatcagccctggggactgcacctgcaagggagaaaatggagagaaggacaacatcctgagcaggaagcagatgacagagcctgagcccggcggcctggtgcccccaggcggcaagaccttcatcgtggtgatctgtgatggcaagaaccctggccgctgcaaggagctgctgctgctgtgcttcagtgacttcctgattggccgctacctggaggtgaatgtcatcagcggggaggagagcctgattgctgcccgggagcccttctcctggaagaagctgaagagcagccaggccctgaccagcgccaagaccaccgtggtggtgacagcccagaagaggaacagccggcggcagctgcccagcttcctgccccagtaccccatcccagaccggctgaggaaatgtgtggagcagaagattgacatcctgaccttccagcccctgctggccgagctgctgaacatgagcaactacaaggagaagttcagcaccctgctgtggctggaggagatctatgcagagatggagctgaaggagtacaacatgagcggcatcatcctgcggagaaatggagacctgctggtgctggaggtgcccggcctggccgagggccggcccagcctgtatgctggggacaagctgatcctgaagacccaggagtacaacggccacgccatcgagtacatctcctatgtgacagagatccacgaggaggatgtgaccctgaagatcaaccctgagtttgagcaggcctacaactttgagcccatggatgtggagttcacctacaacagaaccaccagccgccgctgccactttgccctggagcacgtgatccacctgggcgtgaaggtgctcttccctgaggagatcatcctgcagagcccccaggtgactggaaactggaaccacgcccaggacaccaagagcagcggccagagcaccagcaagaagaacaggaagaccatgacagaccaggccgagcacggcacagaggagcggcgggtgggggacaaggacctgcctgtgctggcccccttcaccgctgagatgtctgactgggtggatgagatccagacccccaaggccaggaagatggagttcttcaaccctgtgctgaatgaaaaccagaagctggccgtgaagaggatcctgagcggggactgccggcccctgccctacatcctgtttggacctcctggcaccgggaagacagtgaccatcattgaagctgtgctgcaggtgcactttgccctgcctgacagccgcatcctggtgtgtgcccccagcaacagcgctgctgacctggtgtgcctgcggctgcacgagagcaaggtgctgcagcctgccaccatggtgcgggtgaatgccacctgccgctttgaggagatcgtgattgatgctgtgaagccctactgcagagatggagaggacatctggaaggccagccgcttccgcatcatcatcaccacctgcagcagcagcggcctcttctaccagattggagtgcgggtgggccacttcacccacgtgtttgtggatgaggccggccaggccagcgagccagaatgtctcatccccctgggcctgatgtctgacatcagcggccagatcgtgctggccggggaccccatgcagctgggccctgtgatcaagagccggctggccatggcctacggcctgaatgtgtccttcctggagcggctgatgagcaggcctgcctaccagagagatgaaaatgccttcggggcctgtggggcccacaaccccctgctggtgaccaagctggtgaagaactaccgcagccatgaggccctgctgatgctgcccagccgcctcttctaccaccgggagctggaggtgtgtgccgaccccaccgtggtgaccagcctgctgggctgggagaagctgcccaagaagggcttccccctcatcttccatggagtgcggggcagcgaggcccgggagggcaagagccccagctggttcaacccagctgaggccgtgcaggtgctgcgctactgctgcctgctggcccacagcatcagcagccaggtgtctgccagtgacattggagtcatcaccccctacaggaagcaggtggagaagatccgcatcctgctgagaaatgtggacctgatggacatcaaggtgggctctgtggaggagttccagggccaggagtacctggtgatcatcatcagcacagtgcgcagcaatgaagatagatttgaagatgaccgctacttcctgggcttcctgagcaacagcaagcgcttcaacgtggccatcacccggcccaaggccctgctgattgtgctgggcaacccccacgtgctggtgcgggacccctgcttcggggccctgctggagtacagcatcaccaacggggtgtacatgggctgtgacctgcccccagccctgcagagcctgcagaactgtggggagggcgtggccgaccccagctaccctgtggtgcctgagagcacaggccctgagaagcaccaggagcccagctag

SEQ ID NO: 160284 - DNA, 378 bp, Artificial Sequence
  Description of Artificial Sequence: Synthetic coding sequence
atgtctgacatcagcggccaggtgaccaagctggtgaagaactaccgcagccatgaggccctgctgatgctgcccagccgcctcttctaccaccgggagctggaggtgtgtgccgaccccaccgtggtgaccagcctgctgggctgggagaagctgcccaagaagggcttccccctcatcttccacggcgtgcggggcagcgaggcccgggagggcaagagccccagctggttcaacccagctgaggccgtgcaggtgctgcgctactgctgcctgctggcccacagcatcagcagccaggtgtctgccagtgacatcggggtcatcaccccctacaggaagcaggtgcggcctgcccaggcccggctggtgctgtag

SEQ ID NO: 160285 - DNA, 378 bp, Artificial Sequence; identical to SEQ ID NO: 160284
  Description of Artificial Sequence: Synthetic coding sequence

SEQ ID NO: 160286 - DNA, 1017 bp, Artificial Sequence
  Description of Artificial Sequence: Synthetic coding sequence
atgttccgggtgggccacttcacccacgtgtttgtggatgaagctggccaggccagcgagcctgagtgcctgatccccctgggcctgatgtctgacatcagcggccagatcgtgctggccggggaccccatgcagctgggccctgtgatcaagagccggctggccatggcctacggcctgaatgtgtccttcctggagcggctgatgagcaggcctgcctaccagagagatgaaaatgcctttggagcctgtggggcccacaaccccctgctggtgaccaagctggtgaagaactaccgcagccatgaggccctgctgatgctgcccagccgcctcttctaccaccgggagctggaggtgtgtgccgaccccaccgtggtgaccagcctgctgggctgggagaagctgcccaagaagggcttccccctcatcttccacggcgtgcggggcagcgaggcccgggagggcaagagccccagctggttcaacccagctgaggccgtgcaggtgctgcgctactgctgcctgctggcccacagcatcagcagccaggtgtctgccagtgacatcggggtcatcaccccctacaggaagcaggtggagaagatccgcatcctgctgagaaatgtggacctgatggacatcaaggtgggctctgtggaggagttccagggccaggagtacctggtgatcatcatcagcacagtgcgcagcaatgaagatagatttgaagatgaccgctacttcctgggcttcctgagcaacagcaagcgcttcaacgtggccatcacccggcccaaggccctgctgattgtgctgggcaacccccacgtgctggtgcgggacccctgctttggagccctgctggagtacagcatcaccaatggagtgtacatgggctgtgacctgcccccagccctgcagagcctgcagaactgtggggagggcgtggccgaccccagctaccctgtggtgcctgagagcactggacctgagaagcaccaggagcccagctag

SEQ ID NO: 160287 - DNA, 3498 bp, Artificial Sequence
  Description of Artificial Sequence: Synthetic coding sequence
atgctgagcctggccgccaagctggtggccttcttctggaggacagctgacaccccccgggaggaggccggccagctggagcctgagctggccgagggggacaccaagctgaagacagtgcggggcgtggtgacccgctactgcagcgactatggcatgattgatgacatgatctacttcagcagtgatgctgtgaccagccgggtgctgctgaatgtgggccaggaggtgattgctgtggtggaggagaacaaggtgtccaatggcctgaaggccatccgggtggaggccgtgtctgacaagtgggaggatgacagcagaaatcatggcagccccagcgactgtggcccccgggtgctgattggctgtgtgaccagcctggtggagggcgccggctgcatcagccagaccacctacttcagcctggagagcgtgtgtgagggctttgagccctgcaagggggactgggtggaggccgagtaccgcatccggcccggcacctggagcagcgaggccacctctgtgaagcccctgcgctacaagagggtggacaaggtgtgcatcagcagcctgtgtggcagaaatggagtgctggaggagagcatcttcttcaccctggacagcctgaagctgcctgatggctacacccccaggagaggagatgtggtgaatgctgtggtggtggagagcagccagagctgctacgtgtggagggccctgtgcatgaccctggtgaagagaagagatgctgcccctgtgcatgaggccacccacttctacggcaccatcctgctgaagaacaagggggacatcgaggtgacccaggtgacccacttcggcaccctgaaggagggccgcagcaagaccatggtgatctggattgaaaataaaggagacatcccccagaacctggtgtcctgcaagctggccggctgggacaagagcaagcagttccgcttccagatgctggacaaggaccagatgtgccctgtggtgtcctttgtgtctgtgcctgagaaggagaacagcagtgatgagaacatcaacagcctgaacagccacaccaagaacaagaccagccagatgtctgagagcagcctggtgaacaacagaggcatcagccctggggactgcacctgcaagggagaaaatggagagaaggacaacatcctgagcaggaagcagatgacagagcctgagcccggcggcctggtgcccccaggcggcaagaccttcatcgtggtgatctgtgatggcaagaaccctggccgctgcaaggagctgctgctgctgtgcttcagtgacttcctgattggccgctacctggaggtgaatgtcatcagcggggaggagagcctgattgctgcccgggagcccttctcctggaagaagctgaagagcagccaggccctgaccagcgccaagaccaccgtggtggtgacagcccagaagaggaacagccggcggcagctgcccagcttcctgccccagtaccccatcccagaccggctgaggaaatgtgtggagcagaagattgacatcctgaccttccagcccctgctggccgagctgctgaacatgagcaactacaaggagaagttcagcaccctgctgtggctggaggagatctatgcagagatggagctgaaggagtacaacatgagcggcatcatcctgcggagaaatggagacctgctggtgctggaggtgcccggcctggccgagggccggcccagcctgtatgctggggacaagctgatcctgaagacccaggagtacaacggccacgccatcgagtacatctcctatgtgacagagatccacgaggaggatgtgaccctgaagatcaaccctgagtttgagcaggcctacaactttgagcccatggatgtggagttcacctacaacagaaccaccagccgccgctgccactttgccctggagcacgtgatccacctgggcgtgaaggtgctcttccctgaggagatcatcctgcagagcccccaggtgactggaaactggaaccacgcccaggacaccaagagcagcggccagagcaccagcaagaagaacaggaagaccatgacagaccaggccgagcacggcacagaggagcggcgggtgggggacaaggacctgcctgtgctggcccccttcaccgctgagatgtctgactgggtggatgagatccagacccccaaggccaggaagatggagttcttcaaccctgtgctgaatgaaaaccagaagctggccgtgaagaggatcctgagcggggactgccggcccctgccctacatcctgtttggacctcctggcaccgggaagacagtgaccatcattgaagctgtgctgcaggtgcactttgccctgcctgacagccgcatcctggtgtgtgcccccagcaacagcgctgctgacctggtgtgcctgcggctgcacgagagcaaggtgctgcagcctgccaccatggtgcgggtgaatgccacctgccgctttgaggagatcgtgattgatgctgtgaagccctactgcagagatggagaggacatctggaaggccagccgcttccgcatcatcatcaccacctgcagcagcagcggcctcttctaccagattggagtgcgggtgggccacttcacccacgtgtttgtggatgaggccggccaggccagcgagccagaatgtctcatccccctgggcctgatgtctgacatcagcggccagatcgtgctggccggggaccccatgcagctgggccctgtgatcaagagccggctggccatggcctacggcctgaatgtgtccttcctggagcggctgatgagcaggcctgcctaccagagagatgaaaatgccttcggggcctgtggggcccacaaccccctgctggtgaccaagctggtgaagaactaccgcagccatgaggccctgctgatgctgcccagccgcctcttctaccaccgggagctggaggtgtgtgccgaccccaccgtggtgaccagcctgctgggctgggagaagctgcccaagaagggcttccccctcatcttccatggagtgcggggcagcgaggcccgggagggcaagagccccagctggttcaacccagctgaggccgtgcaggtgctgcgctactgctgcctgctggcccacagcatcagcagccaggtgtctgccagtgacattggagtcatcaccccctacaggaagcaggtggagaagatccgcatcctgctgagaaatgtggacctgatggacatcaaggtgggctctgtggaggagttccagggccaggagtacctggtgatcatcatcagcacagacccctgcttcggggccctgctggagtacagcatcaccaacggggtgtacatgggctgtgacctgcccccagccctgcagagcctgcagaactgtggggagggcgtggccgaccccagctaccctgtggtgcctgagagcacaggccctgagaagcaccaggagcccagctag

SEQ ID NO: 160288 - DNA, 636 bp, Artificial Sequence
  Description of Artificial Sequence: Synthetic coding sequence
atgtccttcctgcctgtgcgcagcgtcatcggcggcggggacaccaagctgaagacagtgcggggcgtggtgacccgctactgcagcgactatggcatgattgatgacatgatctacttcagcagtgatgctgtgaccagccgggtgctgctgaatgtgggccaggaggtgattgctgtggtggaggagaacaaggtgtccaatggcctgaaggccatccgggtggaggccgtgtctgacaagtgggaggatgacagcagaaatcatggcagccccagcgactgtggcccccgggtgctgattggctgtgtgaccagcctggtggagggcgccggctgcatcagccagaccacctacttcagcctggagagcgtgtgtgagggctttgagccctgcaagggggactgggtggaggccgagtaccgcatccggcccggcacctggagcagcgaggccacctctgtgaagcccctgcgctacaagagggtggacaaggtggcctgccgcctggtggcccccctgtgtgccagcggccggcctgccatccggggcaacctgcacggccctggcttcagctgcatgtgctggaagccaggcaagatcaagctgtgccacggccagcgggagaagaagtag

SEQ ID NO: 160289 - DNA, 3498 bp, Artificial Sequence
  Description of Artificial Sequence: Synthetic coding sequence
atgtccttcctgcctgtgcgcagcgtcatcggcggcggggacaccaagctgaagacagtgcggggcgtggtgacccgctactgcagcgactatggcatgattgatgacatgatctacttcagcagtgatgctgtgaccagccgggtgctgctgaatgtgggccaggaggtgattgctgtggtggaggagaacaaggtgtccaatggcctgaaggccatccgggtggaggccgtgtctgacaagtgggaggatgacagcagaaatcatggcagccccagcgactgtggcccccgggtgctgattggctgtgtgaccagcctggtggagggcgccggctgcatcagccagaccacctacttcagcctggagagcgtgtgtgagggctttgagccctgcaagggggactgggtggaggccgagtaccgcatccggcccggcacctggagcagcgaggccacctctgtgaagcccctgcgctacaagagggtggacaaggtgtgcatcagcagcctgtgtggcagaaatggagtgctggaggagagcatcttcttcaccctggacagcctgaagctgcctgatggctacacccccaggagaggagatgtggtgaatgctgtggtggtggagagcagccagagctgctacgtgtggagggccctgtgcatgaccctggtgaagagaagagatgctgcccctgtgcatgaggccacccacttctacggcaccatcctgctgaagaacaagggggacatcgaggtgacccaggtgacccacttcggcaccctgaaggagggccgcagcaagaccatggtgatctggattgaaaataaaggagacatcccccagaacctggtgtcctgcaagctggccggctgggacaagagcaagcagttccgcttccagatgctggacaaggaccagatgtgccctgtggtgtcctttgtgtctgtgcctgagaaggagaacagcagtgatgagaacatcaacagcctgaacagccacaccaagaacaagaccagccagatgtctgagagcagcctggtgaacaacagaggcatcagccctggggactgcacctgcaagggagaaaatggagagaaggacaacatcctgagcaggaagcagatgacagagcctgagcccggcggcctggtgcccccaggcggcaagaccttcatcgtggtgatctgtgatggcaagaaccctggccgctgcaaggagctgctgctgctgtgcttcagtgacttcctgattggccgctacctggaggtgaatgtcatcagcggggaggagagcctgattgctgcccgggagcccttctcctggaagaagctgaagagcagccaggccctgaccagcgccaagaccaccgtggtggtgacagcccagaagaggaacagccggcggcagctgcccagcttcctgccccagtaccccatcccagaccggctgaggaaatgtgtggagcagaagattgacatcctgaccttccagcccctgctggccgagctgctgaacatgagcaactacaaggagaagttcagcaccctgctgtggctggaggagatctatgcagagatggagctgaaggagtacaacatgagcggcatcatcctgcggagaaatggagacctgctggtgctggaggtgcccggcctggccgagggccggcccagcctgtatgctggggacaagctgatcctgaagacccaggagtacaacggccacgccatcgagtacatctcctatgtgacagagatccacgaggaggatgtgaccctgaagatcaaccctgagtttgagcaggcctacaactttgagcccatggatgtggagttcacctacaacagaaccaccagccgccgctgccactttgccctggagcacgtgatccacctgggcgtgaaggtgctcttccctgaggagatcatcctgcagagcccccaggtgactggaaactggaaccacgcccaggacaccaagagcagcggccagagcaccagcaagaagaacaggaagaccatgacagaccaggccgagcacggcacagaggagcggcgggtgggggacaaggacctgcctgtgctggcccccttcaccgctgagatgtctgactgggtggatgagatccagacccccaaggccaggaagatggagttcttcaaccctgtgctgaatgaaaaccagaagctggccgtgaagaggatcctgagcggggactgccggcccctgccctacatcctgtttggacctcctggcaccgggaagacagtgaccatcattgaagctgtgctgcaggtgcactttgccctgcctgacagccgcatcctggtgtgtgcccccagcaacagcgctgctgacctggtgtgcctgcggctgcacgagagcaaggtgctgcagcctgccaccatggtgcgggtgaatgccacctgccgctttgaggagatcgtgattgatgctgtgaagccctactgcagagatggagaggacatctggaaggccagccgcttccgcatcatcatcaccacctgcagcagcagcggcctcttctaccagattggagtgcgggtgggccacttcacccacgtgtttgtggatgaggccggccaggccagcgagccagaatgtctcatccccctgggcctgatgtctgacatcagcggccagatcgtgctggccggggaccccatgcagctgggccctgtgatcaagagccggctggccatggcctacggcctgaatgtgtccttcctggagcggctgatgagcaggcctgcctaccagagagatgaaaatgccttcggggcctgtggggcccacaaccccctgctggtgaccaagctggtgaagaactaccgcagccatgaggccctgctgatgctgcccagccgcctcttctaccaccgggagctggaggtgtgtgccgaccccaccgtggtgaccagcctgctgggctgggagaagctgcccaagaagggcttccccctcatcttccatggagtgcggggcagcgaggcccgggagggcaagagccccagctggttcaacccagctgaggccgtgcaggtgctgcgctactgctgcctgctggcccacagcatcagcagccaggtgtctgccagtgacattggagtcatcaccccctacaggaagcaggtggagaagatccgcatcctgctgagaaatgtggacctgatggacatcaaggtgggctctgtggaggagttccagggccaggagtacctggtgatcatcatcagcacagtgcgcagcaatgaagatagatttgaagatgaccgctacttcctgggcttcctgagcaacagcaagcgcttcaacgtggccatcacccggcccaaggccctgctgattgtgctgggcaacccccacgtgctggtgcggctgtggaggggcggcggccggcccctgctgcccagcggggcccgcatccacaggacccgggaggccagcggggcccagctgatctgcagcggctag

SEQ ID NO: 160290 - DNA, 3636 bp, Artificial Sequence; identical to SEQ ID NO: 160283
  Description of Artificial Sequence: Synthetic coding sequence

SEQ ID NO: 160291 - DNA, 483 bp, Artificial Sequence
  Description of Artificial Sequence: Synthetic coding sequence
atggctgctgagaggaagacccggctgagcaagaacctgctgaggatgaagttcatgcagaggggcctggacagcgagaccaagaagcagctggaggaggaggagaagaagatcatcagcgaggagcactggtacctggacctgcctgagctgaaggagaaggagagcttcatcatcgaggagcagagcttcctgctgtgtgaggacctgctgtatggccgcatgtccttccggggcttcaaccctgaggtggagaagctgatgctgcagatgaatgccaagcacaaggccgaggaggtggaggatgagaccgtggagctggatgtgtctgatgaggagatggcccggcgctatgagaccctggtgggcaccatcggcaagaagtttgccaggaagagggaccacgccaactatgaggaggatgaaaatggagacatcacccccatcaaggccaagaagatgttcctgaagccccaggactag

SEQ ID NO: 160292 - DNA, 627 bp, Artificial Sequence
  Description of Artificial Sequence: Synthetic coding sequence
atgaaggcctgcaagaggggcaacagcgacatcgtgcggctggtgattgaatgtggggctgactgcaacatcctgagcaagcaccagaacagcgccctgcactttgccaagcagagcaacaacgtgctggtgtatgacctgctgaagaaccacctggagaccctgagccgggtggccgaggagaccatcaaggactactttgaggcccggctggccctgctggagcccgtcttccccatcgcctgccaccggctgtgtgagggccctgacttcagcacagacttcaactacaagccaccccagaacatccctgagggcagcggcatcctgctcttcatcttccacgccaacttcctgggcaaggaggtgattgcccggctgtgtggcccctgcagcgtgcaggccgtggtgctgaatgacaagttccagctgcctgtgttcctgaccggcagccgctctgtggtgcaggccggcgtgcagtggaggggcctgcagctgactggagtgctgaccagccaggcccaggccatcctgcccccccagccccccaactacctgggcctgaagatgaccgtcatcctcttcacccacagcgccctgctgcaggtgcccatcaacagcagctag

SEQ ID NO: 160293 - DNA, 2583 bp, Artificial Sequence
  Description of Artificial Sequence: Synthetic coding sequence
atggagcaggtggccgagggcgcccgggtgacagctgtgcctgtgtctgctgctgacagcacagaggagctggccgaggtggaggagggcgtgggcgtggtgggggaggacaatgatgctgctgcccggggagctgaggccttcggggacagtgaagaagatggagaagatgtgtttgaggtggagaagatcctggacatgaagacagaaggaggcaaggtgctgtacaaggtgcgctggaagggctacaccagtgatgatgacacctgggagcctgagatccacctggaggactgcaaggaggtgctgctggagttcaggaagaagattgctgagaacaaggccaaggctgtgaggaaggacatccagaggctgagcctgaacaatgacatctttgaggccaacagcgacagcgaccagcagagcgagaccaaggaggacaccagccccaagaagaagaagaagaagctgcggcagcgggaggagaagagcccagatgacctgaagaagaagaaggccaaggccggcaagctgaaggacaagagcaagccagacctggagagcagcctggagagcctggtgtttgacctgcggaccaagaagaggatcagcgaggccaaggaggagctgaaggagagcaagaagcccaagaaggatgaggtgaaggagaccaaggagctgaagaaggtgaagaagggggagatccgggacctgaagaccaagacccgggaggaccccaaggagaacaggaagaccaagaaggagaagtttgtggagagccaggtggagagcgagagctctgtgctgaatgacagccccttcccagaagatgattctgagggcctgcacagcgacagccgggaggagaagcagaacaccaagagcgcccgggagcgggccggccaggacatgggcctggagcacggctttgagaagcccctggacagcgccatgtctgctgaggaggacacagatgtgcggggccgcaggaagaagaagacccccaggaaggccgaggacaccagagaaaataggaagctggagaacaagaatgccttcctggagaagaagacagtgcccaagaagcagaggaaccaggacaggagcaagtctgctgctgagctggagaagctgatgcctgtgtctgcccagacccccaagggccgccgcctgagcggggaggagcggggcctgtggagcacagattctgctgaggaggacaaggagaccaagagaaatgaaagcaaggagaagtaccagaagagacatgacagcgacaaggaggagaagggcaggaaggagcccaagggcctgaagaccctgaaggagatcagaaatgcctttgacctcttcaagctgaccccagaggagaagaatgatgtgtctgagaacaacaggaagcgggaggagatccccctggacttcaagaccattgatgaccacaagaccaaggagaacaagcagagcctgaaggagaggaggaacaccagagatgaaacagacacctgggcctacatcgctgctgagggggaccaggaggtgctggacagcgtgtgccaggctgatgaaaattctgatggccggcagcagatcctgagcctgggcatggacctgcagctggagtggatgaagctggaggacttccagaagcacctggatggcaaggatgaaaattttgctgccacagatgccatccccagcaatgtgctgagagatgctgtgaagaatggagactacatcaccgtgaaggtggccctgaacagcaatgaggagtacaacctggaccaggaggacagcagcggcatgaccctggtgatgctggccgccgccggcggccaggatgacctgctgcggctgctgatcaccaagggggccaaggtgaatggccggcagaagaatggcaccacagccctgattcatgctgctgagaagaacttcctgaccaccgtggccatcctgctggaggccggggcctttgtgaatgtgcagcagagcaatggagaaacagccctgatgaaggcctgcaagaggggcaacagcgacatcgtgcggctggtgattgaatgtggggctgactgcaacatcctgagcaagcaccagaacagcgccctgcactttgccaagcagagcaacaacgtgctggtgtatgacctgctgaagaaccacctggagaccctgagccgggtggccgaggagaccatcaaggactactttgaggcccggctggccctgctggagcctgtgttccccatcgcctgccaccggctgtgtgagggccctgacttcagcacagacttcaactacaagccaccccagaacatccctgagggcagcggcatcctgctcttcatcttccacgccaacttcctgggcaaggaggtgattgcccggctgtgtggcccctgcagcgtgcaggccgtggtgctgaatgacaagttccagctgcccgtcttcctggacagccactttgtgtacagcttcagccctgtggccggccccaacaagctgttcatccggctgacagaggcccccagcgccaaggtgaagctgctgattggagcctacagagtgcagctgcagtag

SEQ ID NO: 160294 - DNA, 2604 bp, Artificial Sequence
  Description of Artificial Sequence: Synthetic coding sequence
atggagcaggtggccgagggcgcccgggtgacagctgtgcctgtgtctgctgctgacagcacagaggagctggccgaggtggaggagggcgtgggcgtggtgggggaggacaatgatgctgctgcccggggagctgaggccttcggggacagtgaagaagatggagaagatgtgtttgaggtggagaagatcctggacatgaagacagaaggaggcaaggtgctgtacaaggtgcgctggaagggctacaccagtgatgatgacacctgggagcctgagatccacctggaggactgcaaggaggtgctgctggagttcaggaagaagattgctgagaacaaggccaaggctgtgaggaaggacatccagaggctgagcctgaacaatgacatctttgaggccaacagcgacagcgaccagcagagcgagaccaaggaggacaccagccccaagaagaagaagaagaagctgcggcagcgggaggagaagagcccagatgacctgaagaagaagaaggccaaggccggcaagctgaaggacaagagcaagccagacctggagagcagcctggagagcctggtgtttgacctgcggaccaagaagaggatcagcgaggccaaggaggagctgaaggagagcaagaagcccaagaaggatgaggtgaaggagaccaaggagctgaagaaggtgaagaagggggagatccgggacctgaagaccaagacccgggaggaccccaaggagaacaggaagaccaagaaggagaagtttgtggagagccaggtggagagcgagagctctgtgctgaatgacagccccttcccagaagatgattctgagggcctgcacagcgacagccgggaggagaagcagaacaccaagagcgcccgggagcgggccggccaggacatgggcctggagcacggctttgagaagcccctggacagcgccatgtctgctgaggaggacacagatgtgcggggccgcaggaagaagaagacccccaggaaggccgaggacaccagagaaaataggaagctggagaacaagaatgccttcctggagaagaagacagtgcccaagaagcagaggaaccaggacaggagcaagtctgctgctgagctggagaagctgatgcctgtgtctgcccagacccccaagggccgccgcctgagcggggaggagcggggcctgtggagcacagattctgctgaggaggacaaggagaccaagagaaatgaaagcaaggagaagtaccagaagagacatgacagcgacaaggaggagaagggcaggaaggagcccaagggcctgaagaccctgaaggagatcagaaatgcctttgacctcttcaagctgaccccagaggagaagaatgatgtgtctgagaacaacaggaagcgggaggagatccccctggacttcaagaccattgatgaccacaagaccaaggagaacaagcagagcctgaaggagaggaggaacaccagagatgaaacagacacctgggcctacatcgctgctgagggggaccaggaggtgctggacagcgtgtgccaggctgatgaaaattctgatggccggcagcagatcctgagcctgggcatggacctgcagctggagtggatgaagctggaggacttccagaagcacctggatggcaaggatgaaaattttgctgccacagatgccatccccagcaatgtgctgagagatgctgtgaagaatggagactacatcaccgtgaaggtggccctgaacagcaatgaggagtacaacctggaccaggaggacagcagcggcatgaccctggtgatgctggccgccgccggcggccaggatgacctgctgcggctgctgatcaccaagggggccaaggtgaatggccggcagaagaatggcaccacagccctgattcatgctgctgagaagaacttcctgaccaccgtggccatcctgctggaggccggggcctttgtgaatgtgcagcagagcaatggagaaacagccctgatgaaggcctgcaagaggggcaacagcgacatcgtgcggctggtgattgaatgtggggctgactgcaacatcctgagcaagcaccagaacagcgccctgcactttgccaagcagagcaacaacgtgctggtgtatgacctgctgaagaaccacctggagaccctgagccgggtggccgaggagaccatcaaggactactttgaggcccggctggccctgctggagcctgtgttccccatcgcctgccaccggctgtgtgagggccctgacttcagcacagacttcaactacaagccaccccagaacatccctgagggcagcggcatcctgctcttcatcttccacgccaacttcctgggcaaggaggtgattgcccggctgtgtggcccctgcagcgtgcaggccgtggtgctgaatgacaagttccagctgcccgtcttcctgaccggcagccgctctgtggtgcaggccggcgtgcagtggaggggcctgcagctgactggagtgctgaccagccaggcccaggccatcctgcccccccagccccccaactacctgggcctgaagatgcacgccaccaccagcggctag

SEQ ID NO: 160295 - DNA, 1812 bp, Artificial Sequence
  Description of Artificial Sequence: Synthetic coding sequence
atggagcaggtggccgagggcgcccgggtgacagctgtgcctgtgtctgctgctgacagcacagaggagctggccgaggtggaggagggcgtgggcgtggtgggggaggacaatgatgctgctgcccggggagctgaggccttcggggacagtgaagaagatggagaagatgtgtttgaggtggagaagatcctggacatgaagacagaaggaggcaaggtgctgtacaaggtgcgctggaagggctacaccagtgatgatgacacctgggagcctgagatccacctggaggactgcaaggaggtgctgctggagttcaggaagaagattgctgagaacaaggccaaggctgtgaggaaggacatccagaggctgagcctgaacaatgacatctttgaggccaacagcgacagcgaccagcagagcgagaccaaggaggacaccagccccaagaagaagaagaagaagctgcggcagcgggaggagaagagcccagatgacctgaagaagaagaaggccaaggccggcaagctgaaggacaagagcaagccagacctggagagcagcctggagagcctggtgtttgacctgcggaccaagaagaggatcagcgaggccaaggaggagctgaaggagagcaagaagcccaagaaggatgaggtgaaggagaccaaggagctgaagaaggtgaagaagggggagatccgggacctgaagaccaagacccgggaggaccccaaggagaacaggaagaccaagaaggagaagtttgtggagagccaggtggagagcgagagctctgtgctgaatgacagccccttcccagaagatgattctgagggcctgcacagcgacagccgggaggagaagcagaacaccaagagcgcccgggagcgggccggccaggacatgggcctggagcacggctttgagaagcccctggacagcgccatgtctgctgaggaggacacagatgtgcggggccgcaggaagaagaagacccccaggaaggccgaggacaccagagaaaataggaagctggagaacaagaatgccttcctggagaagaagacagtgcccaagaagcagaggaaccaggacaggagcaagtctgctgctgagctggagaagctgatgcctgtgtctgcccagacccccaagggccgccgcctgagcggggaggagcggggcctgtggagcacagattctgctgaggaggacaaggagaccaagagaaatgaaagcaaggagaagtaccagaagagacatgacagcgacaaggaggagaagggcaggaaggagcccaagggcctgaagaccctgaaggagatcagaaatgcctttgacctcttcaagctgaccccagaggagaagaatgatgtgtctgagaacaacaggaagcgggaggagatccccctggacttcaagaccattgatgaccacaagaccaaggagaacaagcagagcctgaaggagaggaggaacaccagagatgaaacagacacctgggcctacatcgctgctgagggggaccaggaggtgctggacagcgtgtgccaggctgatgaaaattctgatggccggcagcagatcctgagcctgggcatggacctgcagctggagtggatgaagctggaggacttccagaagcacctggatggcaaggatgaaaattttgctgccacagatgccatccccagcaatgtgctgagagatgctgtgaagaagaagaagaagaagaagttcctgggcacctacaccttcttcctgttcttcttctttgagaagccagacctggtgcccctcttctag

SEQ ID NO: 160296 - DNA, 3087 bp, Artificial Sequence
  Description of Artificial Sequence: Synthetic coding sequence
atgggcttcttcagcctgagcagcgagagaaatgaatctgtcatccactacccagagagcacagagcctgagatccagcaggagatgagcaccagccagcctgactgcaatgtggacagctgcagcgtgagcagcggctacggcaccttctgcatcagcgagctgaacctgtacaagagcaaggaccccaaggagttcatggagcacattgatgtgcccaagggccagtatgtggccccagctgtgcctgctgagagcctggtggatggagtgaagaatgaaaacttctacatccagaccccagaagaatgtcatgtgtccctgaaggaggatgtgtccatcagccctggagaatttgagcacaacttcctgggggagaacaaggtgtctgaggtgtacagcggcaagaccaacagcaatgccatcacctcctgggcccagaagctgaagcagaaccagcccaagagggcccacgtggaggatggcggcagccgcagcaagcagggcaatgagcagagcaagaagacccccatcgagaagagtgactttgctgctgccacccacccccgggccttctacctgagcaagccagatgagaccccaaatgcctggatgtctgacagcggcaccggcctgacctactggaagctggaggagaaggacatgcaccacagcctgcctgagaccctggagaagaccttcatcagcctgagcagcacagatgtgagccccaaccagagcaacaccagcaatgagatgaagctgcccagcctgaaggacatctactacaagaagcagcgggagaacaagcagctgcctgagaggaacctgaccagcgccagcaaccccaaccaccccccagaggtgctgaccctggaccccaccctgcacatgaagcccaagcagcagatcagcggcatccagccccacggcctgcccaatgccctggatgaccgcatctccttctccccagacagcgtgctggagcccagcatgagcagccccagcgacatcgacagcttcagccaggccagcaatgtgaccagccagctgcccggcttccccaagtaccccagccacaccaaggccagccctgtggacagctggaagaaccagaccttccagaatgaaagcaggaccagcagcaccttccccagcgtgtacaccatcaccagcaatgacatctctgtgaacacagtggatgaagaaaatacagtgatggtggccagcgcctctgtgtcccagagccagctgcctggaacagccaacagcgtgcctgagtgcatcagcctgaccagcctggaggaccctgtgatcctgagcaagatccggcagaacctgaaggagaagcacgcccggcacatcgctgacctgcgggcctactatgagagcgagatcaacagcctgaagcagaagctggaggccaaggagatctctggagtggaggactggaagatcaccaaccagatcctggtggacagatgtggccagctggacagcgccctgcacgaggccaccagccgggtgaggaccctggagaacaagaacaacctgctggagattgaggtgaatgacctgcgggagcgcttctctgctgccagcagcgccagcaagatcctgcaggagcgcatcgaggagatgaggaccagcagcaaggagaaggacaacaccatcatccggctgaagagccggctgcaggacctggaggaggcctttgaaaatgcctacaagctgagtgatgacaaggaggcccagctgaagcaggagaacaagatgttccaggacctgctgggggagtatgagagcctgggcaaggagcaccggcgggtgaaggatgccctgaacaccacagagaacaagctgctggatgcctacacccagatcagtgacctgaagaggatgatcagcaagctggaggcccaggtgaagcaggtggagcacgagaacatgctgagcctgcggcacaacagccgcatccacgtgcggcccagccgggccaacaccctggccaccagtgatgtgtccaggaggaagtggctgatccctggagctgagtacagcatcttcaccggccagcccctggacacccaggacagcaatgtggacaaccagctggaggagacctgcagcctgggccacaggagccccctggagaaggacagcagccctggcagcagcagcaccagcctgctgatcaagaagcagcgggagaccagtgacacccccatcatgagggccctgaaggagctggatgagggcaagatcttcaagaactggggcacccagacagagaaggaggacaccagcaacatcaacccccggcagacagagacctctgtgaatgccagccgcagccctgagaagtgtgcccagcagaggcagaagaggctgaacagcgccagccagaggagcagcagcctgccccccagcaacaggaagagcagcacccccaccaagcgggagatcatgctgacccctgtgacagtggcctacagccccaagaggagccccaaggagaacctgagccctggcttcagccacctgctgagcaagaatgaaagcagccccatccgctttgacatcctgctggatgacctggacacagtgcctgtgtccaccctgcagaggaccaaccccaggaagcagctgcagttcctgcccctggatgattctgaggagaagacctacagcgagaaggccacagacaaccacgtgaaccacagcagctgcccagagcctgtgcccaacggggtgaagaaggtgtctgtgaggacagcctgggagaagaacaagtctgtgtcctatgagcagtgcaagcctgtgtctgtgaccccccagggcaatgactttgagtacacagccaagatccgcaccctggccgagacagagcgcttctttgatgagctgaccaaggagaaggaccagatcgaggccgccctgagcaggatgcccagccctgggggccgcatcaccctgcagacccggctgaaccagaccccccagatctgtgaggagagcagccacaagtgtgcctttgctggccactacgtgccctgccacctgtatgactaccgcttccagggctag

SEQ ID NO: 160297 - DNA, 3096 bp, Artificial Sequence
  Description of Artificial Sequence: Synthetic coding sequence
atgggcttcttcagcctgagcagcgagagaaatgaatctgtcatccactacccagagagcacagagcctgagatccagcaggagatgagcaccagccagcctgactgcaatgtggacagctgcagcgtgagcagcggctacggcaccttctgcatcagcgagctgaacctgtacaagagcaaggaccccaaggagttcatggagcacattgatgtgcccaagggccagtatgtggccccagctgtgcctgctgagagcctggtggatggagtgaagaatgaaaacttctacatccagaccccagaagaatgtcatgtgtccctgaaggaggatgtgtccatcagccctggagaatttgagcacaacttcctgggggagaacaaggtgtctgaggtgtacagcggcaagaccaacagcaatgccatcacctcctgggcccagaagctgaagcagaaccagcccaagagggcccacgtggaggatggcggcagccgcagcaagcagggcaatgagcagagcaagaagacccccatcgagaagagtgactttgctgctgccacccacccccgggccttctacctgagcaagccagatgagaccccaaatgcctggatgtctgacagcggcaccggcctgacctactggaagctggaggagaaggacatgcaccacagcctgcctgagaccctggagaagaccttcatcagcctgagcagcacagatgtgagccccaaccagagcaacaccagcaatgagatgaagctgcccagcctgaaggacatctactacaagaagcagcgggagaacaagcagctgcctgagaggaacctgaccagcgccagcaaccccaaccaccccccagaggtgctgaccctggaccccaccctgcacatgaagcccaagcagcagatcagcggcatccagccccacggcctgcccaatgccctggatgaccgcatctccttctccccagacagcgtgctggagcccagcatgagcagccccagcgacatcgacagcttcagccaggccagcaatgtgaccagccagctgcccggcttccccaagtaccccagccacaccaaggccagccctgtggacagctggaagaaccagaccttccagaatgaaagcaggaccagcagcaccttccccagcgtgtacaccatcaccagcaatgacatctctgtgaacacagtggatgaagaaaatacagtgatggtggccagcgcctctgtgtcccagagccagctgcctggaacagccaacagcgtgcctgagtgcatcagcctgaccagcctggaggaccctgtgatcctgagcaagatccggcagaacctgaaggagaagcacgcccggcacatcgctgacctgcgggcctactatgagagcgagatcaacagcctgaagcagaagctggaggccaaggagatctctggagtggaggactggaagatcaccaaccagatcctggtggacagatgtggccagctggacagcgccctgcacgaggccaccagccgggtgaggaccctggagaacaagaacaacctgctggagattgaggtgaatgacctgcgggagcgcttctctgctgccagcagcgccagcaagatcctgcaggagcgcatcgaggagatgaggaccagcagcaaggagaaggacaacaccatcatccggctgaagagccggctgcaggacctggaggaggcctttgaaaatgcctacaagctgagtgatgacaaggaggcccagctgaagcaggagaacaagatgttccaggacctgctgggggagtatgagagcctgggcaaggagcaccggcgggtgaaggatgccctgaacaccacagagaacaagctgctggatgcctacacccagatcagtgacctgaagaggatgatcagcaagctggaggcccaggtgaagcaggtggagcacgagaacatgctgagcctgcggcacaacagccgcatccacgtgcggcccagccgggccaacaccctggccaccagtgatgtgtccaggaggaagtggctgatccctggagctgagtacagcatcttcaccggccagcccctggacacccaggacagcaatgtggacaaccagctggaggagacctgcagcctgggccacaggagccccctggagaaggacagcagccctggcagcagcagcaccagcctgctgatcaagaagcagcgggagaccagtgacacccccatcatgagggccctgaaggagctggatgagggcaagatcttcaagaactggggcacccagacagagaaggaggacaccagcaacatcaacccccggcagacagagacctctgtgaatgccagccgcagccctgagaagtgtgcccagcagaggcagaagaggctgaacagcgccagccagaggagcagcagcctgccccccagcaacaggaagagcagcacccccaccaagcgggagatcatgctgacccctgtgacagtggcctacagccccaagaggagccccaaggagaacctgagccctggcttcagccacctgctgagcaagaatgaaagcagccccatccgctttgacatcctgctggatgacctggacacagtgcctgtgtccaccctgcagaggaccaaccccaggaagcagctgcagttcctgcccctggatgattctgaggagaagacctacagcgagaaggccacagacaaccacgtgaaccacagcagctgcccagagcctgtgcccaacggggtgaagaaggtgtctgtgaggacagcctgggagaagaacaagtctgtgtcctatgagcagtgcaagcctgtgtctgtgaccccccagggcaatgactttgagtacacagccaagatccgcaccctggccgagacagagcgcttctttgatgagctgaccaaggagaaggaccagatcgaggccgccctgagcaggatgcccagccctgggggccgcatcaccctgcagacccggctgaaccaggaggccctggaggaccggctggagcgcatcaaccgggagctgggctctgtgaggatgaccctgaagaagttccacgtgctgcggaccagcgccaacctgtag

SEQ ID NO: 160298 - DNA, 1167 bp, Artificial Sequence
  Description of Artificial Sequence: Synthetic coding sequence
atggagcccagccctgctgctgggggcctggagaccacccggctggtgagcccccgggaccggggcggggccggcggcagcctgcggctgaagagcctcttcacagagcccagcgagcccctgcctgaggagagcaagcctgtggagatgcccttccaccactgccaccgggaccccctgcccccacctggcctgaccccagagcggctgcacgcccggcggcagctgtatgctgcctgtgctgtgtgctttgtgttcatggccggggaggtggtgggcggctacctggcccacagcctggccatcatgacagatgctgcccacctgctggctgatgtgggctccatgatgggcagcctcttcagcctgtggctgagcaccaggcctgccaccaggaccatgaccttcggctggcacaggtctgagaccctgggcgccctggcctctgtggtgtccctgtggatggtgacaggcatcctgctgtacctggcctttgtgcggctgctgcacagcgactaccacattgaaggaggagccatgctgctgacagccagcattgctgtgtgtgccaacctgctgatggcctttgtgctgcaccaggccggccccccccacagccacggcagcagaggagcagaatatgcccccctggaggagggccctgaggagcccctgcccctgggcaacacctctgtgcgggccgcctttgtgcacgtgctgggggacctgctgcagagctttggagtgctggccgccagcatcctgatctacttcaagccccagtacaaggctgctgaccccatcagcaccttcctgttcagcatctgtgccctgggcagcacagcccccaccctgagagatgtgctgcgcatcctgatggagggcaccccaagaaatgtgggctttgagcctgtgcgggacaccctgctgtctgtgcctggggtgcgggccacccatgagctgcacctgtgggccctgaccctgacctaccacgtggccagcgcccacctggccatcgacagcacagctgaccctgaggccgtgctggccgaggccagcagccggctgtacagccgcttcggcttcagcagctgcaccctgcaggtggagcagtaccagcctgagatggcccagtgcctgcgctgccaggagcccccccaggcctag

SEQ ID NO: 160299 - DNA, 363 bp, Artificial Sequence
  Description of Artificial Sequence: Synthetic coding sequence
atgtgccacctgtatgagggccctgtggtgggcggctggtacaaggtgctggaccgcttcatccctggcaccaccaaggtggatgccctgaagaagatgctgctggaccagggcggctttgccccctgcttcctgggctgcttcctgcccctggtgggcgccctgaatggcctgagcgcccaggacaactgggccaagctgcagagggactacccagatgccctgatcaccaactactacctgtggccagctgtgcagctggccaacttctacctggtgcccctgcactaccgcctggccgtggtgcagtgtgtggccgtcatctggaacagctacctgtcctggaaggcccaccggctgtag

SEQ ID NO: 160300 - DNA, 531 bp, Artificial Sequence
  Description of Artificial Sequence: Synthetic coding sequence
atggccctgtggagggcctaccagagggccctggccgcccacccctggaaggtgcaggtgctgacagctggcagcctgatgggcctgggggacatcatcagccagcagctggtggagcggcggggcctgcaggagcaccagaggggccgcaccctgaccatggtgtccctgggctgcggctttgtgggccctgtggtgggcggctggtacaaggtgctggaccgcttcatccctggcaccaccaaggtggatgccctgaagaagatgctgctggaccagggcggctttgccccctgcttcctgggctgcttcctgcccctggtgggcgccctgaatggcctgagcgcccaggacaactgggccaagctgcagagggactacccagatgccctgatcaccaactactacctgtggccagctgtgcagctggccaacttctacctggtgcccctgcactaccgcctggccgtggtgcagtgtgtggccgtcatctggaacagctacctgtcctggaaggcccaccggctgtag

SEQ ID NO: 160301 - DNA, 513 bp, Artificial Sequence
  Description of Artificial Sequence: Synthetic coding sequence
atggccctgtggagggcctaccagagggccctggccgcccacccctggaaggtgcaggtgctgacagctggcagcctgatgggcctgggggacatcatcagccagcagctggtggagcggcggggcctgcaggagcaccagaggggccgcaccctgaccatggtgtccctgggctgcggctttgtgggccctgtggtgggcggctggtacaaggtgctggaccgcttcatccctggcaccaccaaggtggatgccctgaagaagatgctgctggaccagggcggctttgccccctgcttcctgggctgcttcctgcccctggtgggcgccctgaatggcctgagcgcccaggacaactgggccaagctgcagagggactacccagatgccctgatcaccaactactacgtgggccgctgccccatgtgctgctgctacctggagctgctgcctgtgctggagggcaccagcgccctgagcctgccccacagcatcgtgtccaccctgcagtag

SEQ ID NO: 160302 - DNA, 342 bp, Artificial Sequence
  Description of Artificial Sequence: Synthetic coding sequence
atggccctgtggagggcctaccagagggccctggccgcccacccctggaaggtgcaggtgctgacagctggcagcctgatgggcctgggggacatcatcagccagcagctggtggagcggcggggcctgcaggagcaccagaggggccgcaccctgaccatggtgtccctgggctgcggctttgtggactacccagatgccctgatcaccaactactacctgtggccagctgtgcagctggccaacttctacctggtgcccctgcactaccgcctggccgtggtgcagtgtgtggccgtcatctggaacagctacctgtcctggaaggcccaccggctgtag

SEQ ID NO: 160303 - DNA, 576 bp, Artificial Sequence
  Description of Artificial Sequence: Synthetic coding sequence
atggccctgtggagggcctaccagagggccctggccgcccacccctggaaggtgcaggtgctgacagctgcccacccccggcgctgcccagacaacacctgtgtgccctgcatcggcagcctgatgggcctgggggacatcatcagccagcagctggtggagcggcggggcctgcaggagcaccagaggggccgcaccctgaccatggtgtccctgggctgcggctttgtgggccctgtggtgggcggctggtacaaggtgctggaccgcttcatccctggcaccaccaaggtggatgccctgaagaagatgctgctggaccagggcggctttgccccctgcttcctgggctgcttcctgcccctggtgggcgccctgaatggcctgagcgcccaggacaactgggccaagctgcagagggactacccagatgccctgatcaccaactactacctgtggccagctgtgcagctggccaacttctacctggtgcccctgcactaccgcctggccgtggtgcagtgtgtggccgtcatctggaacagctacctgtcctggaaggcccaccggctgtag

SEQ ID NO: 160304 - DNA, 348 bp, Artificial Sequence
  Description of Artificial Sequence: Synthetic coding sequence
atgggcctgggggacatcatcagccagcagctggtggagcggcggggcctgcaggagcaccagaggggccgcaccctgaccatggtgtccctgggctgcggctttgtgggccctgtggtgggcggctggtacaaggtgctggaccgcttcatccctggcaccaccaaggtggatgccctgaagaagatgctgctggaccagggcggctttgccccctgcttcctgggctgcttcctgcccctggtgggcgccctgaatggcctgagcgcccaggacaactgggccaagctgcagagggactacccagatgccctgatcaccaactactacctgtggccagctgtgtag

SEQ ID NO: 160305 - DNA, 366 bp, Artificial Sequence
  Description of Artificial Sequence: Synthetic coding sequence
tgaagcctgatgggcctgggggacatcatcagccagcagctggtggagcggcggggcctgcaggagcaccagaggggccgcaccctgaccatggtgtccctgggctgcggctttgtgggccctgtggtgggcggctggtacaaggtgctggaccgcttcatccctggcaccaccaaggtggatgccctgaagaagatgctgctggaccaggactacccagatgccctgatcaccaactactacctgtggccagctgtgcagctggccaacttctacctggtgcccctgcactaccgcctggccgtggtgcagtgtgtggccgtcatctggaacagctacctgtcctggaaggcccaccggctgtag

SEQ ID NO: 160306 - DNA, 204 bp, Artificial Sequence
  Description of Artificial Sequence: Synthetic coding sequence
tgagacagccagggcaagaagacaggcttcaccggcatcaagaagggggactacccagatgccctgatcaccaactactacctgtggccagctgtgcagctggccaacttctacctggtgcccctgcactaccgcctggccgtggtgcagtgtgtggccgtcatctggaacagctacctgtcctggaaggcccaccggctgtag

SEQ ID NO: 160307 - DNA, 912 bp, Artificial Sequence
  Description of Artificial Sequence: Synthetic coding sequence
atggccccagctgctgacatgaccagcctgcccctgggcgtgaaggtggaggacagcgccttcggcaagccagctgggggcggggccggccaggcccccagcgctgctgctgccacagctgctgccatgggcgcagatgaggagggcgccaagcccaaggtgagccccagcctgctgcccttctctgtggaggccctgatggctgaccacaggaagccaggggccaaggagagcgccctggcccccagcgagggcgtgcaggccgccggcggcagcgcccagcccctgggcgtgcccccaggcagcctgggcgccccagatgcccccagcagcccccggcccctgggccacttctctgtgggcggcctgctgaagctgcctgaagatgccctggtgaaggccgagagccctgagaagccagagaggaccccctggatgcagagcccccgcttcagccccccaccagcccggcggctgagccccccagcctgcaccctgaggaagcacaagaccaacaggaagcccaggacccccttcaccacagcccagctgctggccctggagaggaagttccggcagaagcagtacctgagcattgctgagagagctgagttcagcagcagcctgagcctgacagagacccaggtgaagatctggttccagaacagaagagccaaggccaagaggctgcaggaggccgagctggagaagctgaagatggccgccaagcccatgctgcccccagctgccttcggcctgtccttccccctgggcggccctgctgctgtggccgctgctgctggggccagcctgtatggagccagcggccccttccagagagctgccctgcctgtggcccctgtgggcctgtacacagcccacgtgggctacagcatgtaccacctgacctag

SEQ ID NO: 160308 - DNA, 804 bp, Artificial Sequence
  Description of Artificial Sequence: Synthetic coding sequence
atggccagccccagcaaaggaaatgacctcttctccccagatgaggagggccctgctgtggtggccggccctggccctggccctgggggcgctgagggcgctgctgaggagcggcgggtgaaggtgagcagcctgcccttctctgtggaggccctgatgtctgacaagaagccacccaaggaggccagccccctgcctgctgagagcgccagcgctggggccaccctgcggcccctgctgctgagcggccacggggcccgggaggcccacagccctggccccctggtgaagccctttgaaacagcctctgtgaagtcagaaaattctgaagatggagctgcctggatgcaggagcccggccgctacagccccccacccaggcacatgagccccaccacctgcaccctgaggaagcacaagaccaacaggaagcccaggacccccttcaccaccagccagctgctggccctggagaggaagttccggcagaagcagtacctgagcattgctgagagagctgagttcagcagcagcctgaacctgacagagacccaggtgaagatctggttccagaacagaagagccaaggccaagaggctgcaggaggccgagctggagaagctgaagatggccgccaagcccatgctgcccagcagcttcagcctgcccttccccatcagcagccccctgcaggccgccagcatctacggggccagctaccccttccacaggcctgtgctgcccatcccccctgtgggcctgtatgccacccctgtgggctacggcatgtaccacctgtcctag

SEQ ID NO: 160309 - DNA, 981 bp, Artificial Sequence
  Description of Artificial Sequence: Synthetic coding sequence
atgaacaccagccctggcaccgtgggcagtgaccccgtcatcctggccacagctggctatgaccacacagtgcgcttctggcaggcccacagcggcatctgcaccaggacagtgcagcaccaggacagccaggtgaatgccctggaggtgaccccagaccgctccatgattgctgctgctggctaccagcacatccgcatgtatgacctgaacagcaacaaccccaaccccatcatctcctatgatggagtgaacaagaacatcgcctctgtgggcttccatgaagatggccgctggatgtacacaggaggagaggactgcacagcccgcatctgggacctgcggagcaggaacctgcagtgccagaggatcttccaggtgaatgcccccatcaactgtgtgtgcctgcaccccaaccaggccgagctgattgtgggggaccagagcggggccatccacatctgggacctgaagacagaccacaatgagcagctgatccctgagcctgaggtgtccatcaccagcgcccacatcgaccctgatgccagctacatggctgctgtgaacagcactggaaactgctacgtgtggaacctgaccggcggcattggagatgaggtgacccagctgatccccaagaccaagatcccagcccacaccaggtatgccctgcagtgccgcttctccccagacagcaccctgctggccacctgcagcgctgaccagacctgcaagatctggaggaccagcaacttcagcctgatgacagagctgagcatcaagagcggcaaccctggagagagcagccggggctggatgtggggctgtgccttcagcggggacagccagtacatcgtgacagccagcagtgacaacctggcccggctgtggtgtgtggagactggagagatcaagcgggagtatggaggccaccagaaggctgtggtgtgcctggccttcaatgattctgtgctgggctag

SEQ ID NO: 160310 - DNA, 981 bp, Artificial Sequence; identical to SEQ ID NO: 160309
  Description of Artificial Sequence: Synthetic coding sequence

SEQ ID NO: 160311 - DNA, 984 bp, Artificial Sequence
  Description of Artificial Sequence: Synthetic coding sequence
atgaacaccagccctggcaccgtgggcagtgaccccgtcatcctggccacagctggctatgaccacacagtgcgcttctggcaggcccacagcggcatctgcaccaggacagtgcagcaccaggacagccaggtgaatgccctggaggtgaccccagaccgctccatgattgctgctgctggctaccagcacatccgcatgtatgacctgaacagcaacaaccccaaccccatcatctcctatgatggagtgaacaagaacatcgcctctgtgggcttccatgaagatggccgctggatgtacacaggaggagaggactgcacagcccgcatctgggacctgcggagcaggaacctgcagtgccagaggatcttccaggtgaatgcccccatcaactgtgtgtgcctgcaccccaaccaggccgagctgattgtgggggaccagagcggggccatccacatctgggacctgaagacagaccacaatgagcagctgatccctgagcctgaggtgtccatcaccagcgcccacatcgaccctgatgccagctacatggctgctgtgaacagcactggaaactgctacgtgtggaacctgaccggcggcattggagatgaggtgacccagctgatccccaagaccaagatcccagcccacaccaggtatgccctgcagtgccgcttctccccagacagcaccctgctggccacctgcagcgctgaccagacctgcaagatctggaggaccagcaacttcagcctgatgacagagctgagcatcaagagcggcaaccctggagagagcagccggggctggatgtggggctgtgccttcagcggggacagccagtacatcgtgactggagagccccggcccggcctgccccacccctggcccccagccctggccagccgggccagccccccccggctgcagctgcccctgtgctggggccgcctgctgggcctgcacctgcggagctag

SEQ ID NO: 160312 - DNA, 654 bp, Artificial Sequence
  Description of Artificial Sequence: Synthetic coding sequence
atggagcacgccccctggagccctggggccagcagccgggcccgggccggccacaccatgaacaccagccctggcaccgtgggcagtgaccctgtgatcctggccacagctggctatgaccacacagtgcgcttctggcaggcccacagcggcatctgcaccaggacagtgcagcaccaggacagccaggtgaatgccctggaggtgaccccagaccgctccatgattgctgctgctggctaccagcacatccgcatgtatgacctgaacagcaacaaccccaaccccatcatctcctatgatggagtgaacaagaacatcgcctctgtgggcttccatgaagatggccgctggatgtacacaggaggagaggactgcacagcccgcatctgggacctgcggagcaggaacctgcagtgccagaggatcttccaggtgaatgcccccatcaactgtgtgtgcctgcaccccaaccaggccgagctgattgtgggggaccagagcggggccatccacatctgggacctgaagacagaccacaatgagcagctgatccctgagcctgaggtgtccatcaccagcgcccacattgatcctgatgccagctacatggctgctgtgaacagcacagcccccaggcacctgctgggctag

SEQ ID NO: 160313 - DNA, 981 bp, Artificial Sequence; identical to SEQ ID NO: 160309
  Description of Artificial Sequence: Synthetic coding sequence

SEQ ID NO: 160314 - DNA, 981 bp, Artificial Sequence; identical to SEQ ID NO: 160309
  Description of Artificial Sequence: Synthetic coding sequence

SEQ ID NO: 160315 - DNA, 1473 bp, Artificial Sequence
  Description of Artificial Sequence: Synthetic coding sequence
atggcccagagagctgtgtggctgatcagccatgagcccggcacccccctgtgtggcaccgtgcgcttcagccgccgctaccccaccgtggagaagagggcccgggtcttcaacggggccagctatgtgcctgtgcctgaagatggccccttcctgaaggccctgctgtttgagctgcggctgctggatgatgacaaggactttgtggagagccgggacagctgcagccgcatcaacaagaccagcatctacggcctgctgattggaggagaggagctgtggcctgtggtggccttcctgaagaatgacatgatctatgcctgtgtgcccctggtggagcagaccctgagcccccggcccccactcatctctgtgtctggagtgtcccagggctttgagttcctgtttggcatccaggacttcctgtacagcggccagaagaatgacagcgagctgaacaccaagctgagccagctgcctgacctgctgctgcaggcctgccccttcggcaccctgctggatgccaacctgcagaacagcctggacaacaccaactttgcctctgtgacccagccccagaagcagcctgcctggaagacaggcacctacaagggcaagccccaggtgtccatcagcatcacagagaaggtgaagtccatgcagtatgacaagcagggcattgctgacacctggcaggtggtgggcaccgtgacctgcaagtgtgacctggagggcatcatgcccaacgtgaccatcagcctgagcctgcccaccaacggcagccccctgcaggacatcctggtgcacccctgtgtgaccagcctggacagcgccatcctgaccagcagcagcattgatgccatggatgattctgccttcagcggcccctacaagttccccttcaccccacccctggagagcttcaacctgtgcttctacaccagccaggtgcctgtgccccccatcctgggcttctaccagatgaaggaggaggaggtgcagctgcgcatcaccatcaacctgaagctgcacgagagcgtgaagaacaactttgagttctgtgaggcccacatccccttctacaacagaggccccatcacccacctggagtacaagaccagctttggccagctggaggtgttccgggagaagagcctgctgatctggatcatcggccagaagttccccaagtccatggagatcagcctgagcggcaccgtgacctttggagccaagagccatgagaagcagccctttgaccccatctgcaccggggagacagcctacctgaagctgcacttccgcatcctggactacaccctgaccggctgctacgccgaccagcacagcgtgcaggtgtttgccagcggcaagcccaagatcagcgcccacaggaagctgatcagcagtgactactacatctggaacagcaaggccccagcccctgtgacctacggcagcctgctgctgtag

SEQ ID NO: 160316 - DNA, 16437 bp, Artificial Sequence
  Description of Artificial Sequence: Synthetic coding sequence
atgctggtgatctggatcctgaccctggccctgcggctgtgtgcctctgtgaccaccgtgaccccagagggcagcgctgtgcacaaggccatcagccagcagggcaccctgtggacaggagaggtgctggagaagcagacagtggagcagggcaagagcaccctgcggcggcagaagaaccacttccacaggtctgctggggagctgcgctgcagaaatgccctgaaggatgaaggagccagcgctggctggagcgtgatgtttgctggggagagcgtggtggtgctggtgcacctgtggatgaccggggcccgggtgaagaacctgggcctggtggagtttgccagccctggagatgatggagatggccgggcagagggcttcagcctgggcctgcccctgtctgagcaggcccgggctgctggggcccgggagaaggagcggcaggagaccgtcatcaaccacagcaccttcagcggcttcagccagatcaccggcagcacagtgaacaccagcattggaggcaacaccaccagcgccagcacccccagcagcagtgaccccttcaccaccttcagtgactatggagtgtctgtgaccttcatcaccggcagcacagccaccaagcacttcctggacagcagcaccaacagcggccacagcgaggagagcacagtgagccacagcggccctggggccaccggcaccaccctcttccccagccacagcgccacctctgtgtttgtgggggagcccaagaccagccccatcaccagcgcctccatggagaccacagccctgcccggcagcaccaccacagctggcctgtctgagaagagcaccaccttctacagcagccccaggagcccagacaggaccctgagccctgcccggaccaccagcagcggcgtgtctgagaagagcaccaccagccacagcaggcctggccccacccacaccatcgccttcccagacagcaccaccatgcctggggtgtcccaggagagcacagccagccacagcatccctggcagcacagacaccaccctgagccctggcaccaccacccccagcagcctgggccctgagagcaccaccttccacagcagccctggctacaccaagaccacccggctgcctgacaacaccaccaccagcggcctgctggaggccagcacccctgtgcacagcagcacaggcagcccccacaccaccctgagccccagcagcagcaccacccatgaaggagagcccaccaccttccagagctggcccagcagcaaggacaccagccctgcccccagcggcaccaccagcgcctttgtgaagctgagcaccacctaccacagcagccccagcagcacccccaccacccacttcagcgccagcagcaccaccctgggccacagcgaggagagcacccctgtgcacagcagccctgtggccacagccaccaccccacctccagcccggagcgccaccagcggccacgtggaggagagcacagcctaccacaggagccctggcagcacccagaccatgcacttccctgagagcagcaccaccagcggccacagcgaggagagcgccaccttccacggcagcaccacccacaccaagagcagcacccccagcaccacagctgccctggcccacaccagctaccacagcagcctgggcagcacagagaccacccacttccgggacagcagcaccatcagcggccgctctgaggagagcaaggccagccacagcagcccagatgccatggccaccaccgtgctgcctgctggcagcacccccagcgtgctggtgggggacagcacccccagccccatcagcagcggctccatggagaccacagccctgcccggcagcaccaccaagccaggcctgtctgagaagagcaccaccttctacagcagccccaggagcccagacaccacccacctgcctgcctccatgaccagcagcggcgtgtctgaggagagcaccaccagccacagcaggcctggcagcacccacaccacagccttccctggcagcaccaccatgcctggcctgagccaggagagcacagccagccacagcagccctggccccacagacaccaccctgagccctggcagcaccacagccagcagcctgggccctgagtacaccaccttccacagcaggcctggcagcacagagaccaccctgctgcctgacaacaccacagccagcggcctgctggaggcctccatgcctgtgcacagcagcaccaggagcccccacaccaccctgagccctgctggcagcaccacccggcagggcgagagcaccaccttccacagctggcccagcagcaaggacaccaggcctgccccacccaccaccaccagcgcctttgtggagcccagcaccaccagccacggcagccccagcagcatccccaccacccacatcagcgcccggagcaccaccagcggcctggtggaggagagcaccacctaccacagcagccctggcagcacccagaccatgcacttccctgagagtgacaccaccagcggccgcggggaggagagcaccaccagccacagcagcaccacccacaccatcagcagcgcccccagcaccaccagcgccctggtggaggagcccaccagctaccacagcagccctggcagcacagccaccacccacttcccagacagcagcaccaccagcggccgctctgaggagagcacagccagccacagcagccaggatgccaccggcaccatcgtgctgcctgcccggagcaccacctctgtgctgctgggggagagcaccaccagccccatcagcagcggctccatggagaccacagccctgcccggcagcaccaccaccccaggcctgtctgagaggagcaccaccttccacagcagccccaggagccctgccaccaccctgagccctgccagcaccaccagcagcggcgtgtctgaggagagcaccaccagccgcagcaggcctggcagcacccacaccacagccttcccagacagcaccaccaccccaggcctgagccgccacagcaccaccagccacagcagccctggcagcacagacaccaccctgctgcctgccagcaccaccaccagcggccccagccaggagagcaccaccagccacagcagcagcggcagcacagacacagccctgagccctggcagcaccacagccctgagctttggccaggagagcaccaccttccacagcaaccctggcagcacccacaccaccctcttcccagacagcaccaccagcagcggcatcgtggaggccagcaccagggtgcacagcagcacaggcagccccaggaccaccctgagccctgccagcagcaccagccctggcctgcagggcgagagcacagccttccagacccacccagccagcacccacaccacccccagcccccccagcacagccacagcccctgtggaggagagcaccacctaccacaggagccctggcagcacccccaccacccacttccctgccagcagcaccaccagcggccacagcgagaagagcaccatcttccacagcagcccagatgccagcggcaccacccccagcagcgcccacagcaccaccagcggccgcggggagagcaccaccagccgcatcagccctggcagcacagagatcaccaccctgcccggcagcaccaccaccccaggcctgtctgaggccagcaccaccttctacagcagccccaggagccccaccaccaccctgagccctgcctccatgaccagcctgggcgtgggggaggagagcaccaccagccgcagccagcccggcagcacccacagcacagtgtccccagccagcaccaccaccccaggcctgtctgaggagagcaccaccgtgtacagcagcagccggggcagcacagagaccaccgtcttcccccacagcaccaccacctctgtgcatggagaggagcccaccaccttccacagcaggcctgccagcacccacaccaccctcttcacagaggacagcaccaccagcggcctgacagaggagagcacagccttccctggcagccctgccagcacccagacaggcctgcctgccaccctgaccacagctgacctgggggaggagagcaccaccttccccagcagcagcggcagcacaggcaccaagctgagccctgcccggagcaccaccagcggcctggtgggggagagcacccccagccggctgagccccagcagcacagagaccaccaccctgcccggcagccccaccacccccagcctgtctgagaagagcaccaccttctacaccagccccaggagcccagatgccaccctgagccctgccaccaccaccagcagcggcgtgtctgaggagagcagcaccagccacagccagcccggcagcacccacaccacagccttcccagacagcaccaccaccagtgacctgagccaggagcccaccaccagccacagcagccagggcagcacagaggccaccctgagccctggcagcaccacagccagcagcctgggccagcagagcaccaccttccacagcagccctggggacacagagaccaccctgctgcctgatgacaccatcaccagcggcctggtggaggccagcacccccacccacagcagcacaggcagcctgcacaccaccctgaccccagccagcagcaccagcgctggcctgcaggaggagagcaccaccttccagagctggcccagcagcagtgacaccacccccagccccccaggcaccacagctgcccctgtggaggtgtccaccacctaccacagccggcccagcagcacccccaccacccacttcagcgccagcagcaccaccctgggccgctctgaggagagcaccaccgtgcacagcagccctggggccactggaacagccctcttccccaccaggtctgccacctctgtgctggtgggggagcccaccaccagccccatcagcagcggcagcacagagaccacagccctgcccggcagcaccaccacagctggcctgtctgagaagagcaccaccttctacagcagccccaggagcccagacaccaccctgagccctgccagcaccaccagcagtggagtgtctgaggagagcaccaccagccacagccggcccggcagcacccacaccacagccttccctggcagcaccaccatgcctggggtgtcccaggagagcacagccagccacagcagccctggcagcacagacaccaccctgagccctggcagcaccacagccagcagcctgggccctgagagcaccaccttccacagcagccctggcagcacagagaccaccctgctgcctgacaacaccacagccagcggcctgctggaggccagcacccctgtgcacagcagcacaggcagcccccacaccaccctgagccctgctggcagcaccacccggcagggcgagagcaccaccttccagagctggcccagcagcaaggacaccatgcctgccccacccaccaccaccagcgcctttgtggagctgagcaccaccagccacggcagccccagcagcacccccaccacccacttcagcgccagcagcaccaccctgggccgctctgaggagagcaccaccgtgcacagcagccctgtggccacagccaccacccccagccctgcccggagcaccaccagcggcctggtggaggagagcacagcctaccacagcagccctggcagcacccagaccatgcacttccctgagagcagcacagccagcggccgctctgaggagagcaggaccagccacagcagcaccacccacaccatcagcagcccccccagcaccaccagcgccctggtggaggagcccaccagctaccacagcagccctggcagcacagccaccacccacttcccagacagcagcaccaccagcggccgctctgaggagagcacagccagccacagcagccaggatgccaccggcaccatcgtgctgcctgcccggagcaccacctctgtgctgctgggggagagcaccaccagccccatcagcagcggctccatggagaccacagccctgcccggcagcaccaccaccccaggcctgtctgagaagagcaccaccttccacagcagccccaggagccctgccaccaccctgagccctgccagcaccaccagcagtggagtgtctgaggagagcaccaccagccacagccggcccggcagcacccacaccacagccttcccagacagcaccaccaccccaggcctgagccgccacagcaccaccagccacagcagccctggcagcacagacaccaccctgctgcctgccagcaccaccaccagcggccccagccaggagagcaccaccagccacagcagccctggcagcacagacacagccctgagccctggcagcaccacagccctgagctttggccaggagagcaccaccttccacagcagccctggcagcacccacaccaccctcttcccagacagcaccaccagcagcggcatcgtggaggccagcaccagggtgcacagcagcacaggcagccccaggaccaccctgagccctgccagcagcaccagccctggcctgcagggcgagagcacagccttccagacccacccagccagcacccacaccacccccagcccccccagcacagccacagcccctgtggaggagagcaccacctaccacaggagccctggcagcacccccaccacccacttccctgccagcagcaccaccagcggccacagcgagaagagcaccatcttccacagcagcccagatgccagcggcaccacccccagcagcgcccacagcaccaccagcggccgcggggagagcaccaccagccgcatcagccctggcagcacagagatcaccaccctgcccggcagcaccaccaccccaggcctgtctgaggccagcaccaccttctacagcagccccaggagccccaccaccaccctgagccctgcctccatgaccagcctgggcgtgggggaggagagcaccaccagccgcagccagcccggcagcacccacagcacagtgtccccagccagcaccaccaccccaggcctgtctgaggagagcaccaccgtgtacagcagcagccctggcagcacagagaccaccgtcttccccaggacccccaccacctctgtgcggggggaggagcccaccaccttccacagcaggcctgccagcacccacaccaccctcttcacagaggacagcaccaccagcggcctgacagaggagagcacagccttccctggcagccctgccagcacccagacaggcctgcctgccaccctgaccacagctgacctgggggaggagagcaccaccttccccagcagcagcggcagcacaggcaccaccctgagccctgcccggagcaccaccagcggcctggtgggggagagcacccccagccggctgagccccagcagcacagagaccaccaccctgcccggcagccccaccacccccagcctgtctgagaagagcaccaccttctacaccagccccaggagcccagatgccaccctgagccctgccaccaccaccagcagtggagtgtctgaggagagcagcaccagccacagccagcccggcagcacccacaccacagccttcccagacagcaccaccaccccaggcctgagccgccacagcaccaccagccacagcagccctggcagcacagacaccaccctgctgcctgccagcaccaccaccagcggccccagccaggagagcaccaccagccacagcagccctggcagcacagacacagccctgagccctggcagcaccacagccctgagctttggccaggagagcaccaccttccacagcagccctggcagcacccacaccaccctcttcccagacagcaccaccagcagcggcatcgtggaggccagcaccagggtgcacagcagcacaggcagccccaggaccaccctgagccctgccagcagcaccagccctggcctgcagggcgagagcaccaccttccagacccacccagccagcacccacaccacccccagcccccccagcacagccacagcccctgtggaggagagcaccacctaccacaggagccctggcagcacccccaccacccacttccctgccagcagcaccaccagcggccacagcgagaagagcaccatcttccacagcagcccagatgccagcggcaccacccccagcagcgcccacagcaccaccagcggccgcggggagagcaccaccagccgcatcagccctggcagcacagagatcaccaccctgcccggcagcaccaccaccccaggcctgtctgaggccagcaccaccttctacagcagccccaggagccccaccaccaccctgagccctgcctccatgaccagcctgggcgtgggggaggagagcaccaccagccgcagccagcccggcagcacccacagcacagtgtccccagccagcaccaccaccccaggcctgtctgaggagagcaccaccgtgtacagcagcagccctggcagcacagagaccaccgtcttccccaggagcaccaccacctctgtgcggggggaggagcccaccaccttccacagcaggcctgccagcacccacaccaccctcttcacagaggacagcaccaccagcggcctgacagaggagagcacagccttccctggcagccctgccagcacccagacaggcctgcctgccaccctgaccacagctgacctgggggaggagagcaccaccttccccagcagcagcggcagcacaggcaccaccctgagccctgcccggagcaccaccagcggcctggtgggggagagcacccccagccggctgagccccagcagcacagagaccaccaccctgcccggcagccccaccacccccagcctgtctgagaagagcaccaccttctacaccagccccaggagcccagatgccaccctgagccctgccaccaccaccagcagtggagtgtctgaggagagcagcaccagccacagccagcccggcagcacccacaccacagccttcccagacagcaccaccaccagcggcctgagccaggagcccacagccagccacagcagccagggcagcacagaggccaccctgagccctggcagcaccacagccagcagcctgggccagcagagcaccaccttccacagcagccctggggacacagagaccaccctgctgcctgatgacaccatcaccagcggcctggtggaggccagcacccccacccacagcagcacaggcagcctgcacaccaccctgaccccagccagcagcaccagcgctggcctgcaggaggagagcaccaccttccagagctggcccagcagcagtgacaccacccccagccccccaggcaccacagctgcccctgtggaggtgtccaccacctaccacagccggcccagcagcacccccaccacccacttcagcgccagcagcaccaccctgggccgctctgaggagagcaccaccgtgcacagcagccctggggccaccggcacagccctcttccccaccaggtctgccacctctgtgctggtgggggagcccaccaccagccccatcagcagcggcagcacagagaccacagccctgcccggcagcaccaccacagctggcctgtctgagaagagcaccaccttctacagcagccccaggagcccagacaccaccctgagccctgccagcaccaccagcagcggcgtgtctgaggagagcaccaccagccacagcaggcctggcagcacccacaccacagccttccctggcagcaccaccatgcctggggtgtcccaggagagcacagccagccacagcagccctggcagcacagacaccaccctgagccctggcagcaccacagccagcagcctgggccctgagagcaccaccttccacagcggccctggcagcacagagaccaccctgctgcctgacaacaccacagccagcggcctgctggaggccagcacccctgtgcacagcagcacaggcagcccccacaccaccctgagccctgctggcagcaccacccggcagggcgagagcaccaccttccagagctggcccaacagcaaggacaccaccccagccccacccaccaccaccagcgcctttgtggagctgagcaccaccagccacggcagccccagcagcacccccaccacccacttcagcgccagcagcaccaccctgggccgctctgaggagagcaccaccgtgcacagcagccctgtggccacagccaccacccccagccctgcccggagcaccaccagcggcctggtggaggagagcaccacctaccacagcagccctggcagcacccagaccatgcacttccctgagagtgacaccaccagcggccgcggggaggagagcaccaccagccacagcagcaccacccacaccatcagcagcgcccccagcaccaccagcgccctggtggaggagcccaccagctaccacagcagccctggcagcacagccaccacccacttcccagacagcagcaccaccagcggccgctctgaggagagcacagccagccacagcagccaggatgccaccggcaccatcgtgctgcctgcccggagcaccacctctgtgctgctgggggagagcaccaccagccccatcagcagcggctccatggagaccacagccctgcccggcagcaccaccaccccaggcctgtctgagaagagcaccaccttccacagcagccccaggagccctgccaccaccctgagccctgccagcaccaccagcagcggcgtgtctgaggagagcaccaccagccacagcaggcctggcagcacccacaccacagccttcccagacagcaccaccaccccaggcctgagccgccacagcaccaccagccacagcagccctggcagcacagacaccaccctgctgcctgccagcaccaccaccagcggcagcagccaggagagcaccaccagccacagcagcagcggcagcacagacacagccctgagccctggcagcaccacagccctgagctttggccaggagagcaccaccttccacagcagccctggcagcacccacaccaccctcttcccagacagcaccaccagcagcggcatcgtggaggccagcaccagggtgcacagcagcacaggcagccccaggaccaccctgagccctgccagcagcaccagccctggcctgcagggcgagagcacagccttccagacccacccagccagcacccacaccacccccagcccccccagcacagccacagcccctgtggaggagagcaccacctaccacaggagccctggcagcacccccaccacccacttccctgccagcagcaccaccagcggccacagcgagaagagcaccatcttccacagcagcccagatgccagcggcaccacccccagcagcgcccacagcaccaccagcggccgcggggagagcaccaccagccgcatcagccctggcagcacagagatcaccaccctgcccggcagcaccaccaccccaggcctgtctgaggccagcaccaccttctacagcagccccaggagccccaccaccaccctgagccctgcctccatgaccagcctgggcgtgggggaggagagcaccaccagccgcagccagcccggcagcacccacagcacagtgtccccagccagcaccaccaccccaggcctgtctgaggagagcaccaccgtgtacagcagcagccctggcagcacagagaccaccgtcttccccaggagcaccaccacctctgtgagaagagaggagcccaccaccttccacagcaggcctgccagcacccacaccaccctcttcacagaggacagcaccaccagcggcctgacagaggagagcacagccttccctggcagccctgccagcacccagacaggcctgcctgccaccctgaccacagctgacctgggggaggagagcaccaccttccccagcagcagcggcagcacaggcaccaagctgagccctgcccggagcaccaccagcggcctggtgggggagagcacccccagccggctgagccccagcagcacagagaccaccaccctgcccggcagccccaccacccccagcctgtctgagaagagcaccaccttctacaccagccccaggagcccagatgccaccctgagccctgccaccaccaccagcagcggcgtgtctgaggagagcagcaccagccacagccagcccggcagcacccacaccacagccttcccagacagcaccaccaccagcggcctgagccaggagcccaccaccagccacagcagccagggcagcacagaggccaccctgagccctggcagcaccacagccagcagcctgggccagcagagcaccaccttccacagcagccctggggacacagagaccaccctgctgcctgatgacaccatcaccagcggcctggtggaggccagcacccccacccacagcagcacaggcagcctgcacaccaccctgaccccagccagcagcaccagcacaggcctgcaggaggagagcaccaccttccagagctggcccagcagcagtgacaccacccccagcccccccagcaccacagctgtgcctgtggaggtgtccaccacctaccacagccggcccagcagcacccccaccacccacttcagcgccagcagcaccaccctgggccgctctgaggagagcaccaccgtgcacagcagccctggggccactggaacagccctcttccccaccaggtctgccacctctgtgctggtgggggagcccaccaccagccccatcagcagcggcagcacagagaccacagccctgcccggcagcaccaccacagctggcctgtctgagaagagcaccaccttctacagcagccccaggagcccagacaccaccctgagccctgccagcaccaccagcagtggagtgtctgaggagagcaccaccagccacagccggcccggctccatgcacaccacagccttccccagcagcaccaccatgcctggggtgtcccaggagagcacagccagccacagcagccctggcagcacagacaccaccctgagccctggcagcaccacagccagcagcctgggccctgagagcaccaccttccacagcagccctggcagcacagagaccaccctgctgcctgacaacaccacagccagcggcctgctggaggccagcacccctgtgcacagcagcacaggcagcccccacaccaccctgagccctgctggcagcaccacccggcagggcgagagcaccaccttccagagctggcccaacagcaaggacaccaccccagccccacccaccaccaccagcgcctttgtggagctgagcaccaccagccacggcagccccagcagcacccccaccacccacttcagcgccagcagcaccaccctgggccgctctgaggagagcaccaccgtgcacagcagccctgtggccacagccaccacccccagccctgcccggagcaccaccagcggcctggtggaggagagcaccacctaccacagcagccctggcagcacccagaccatgcacttccctgagagcaacaccaccagcggccgcggggaggagagcaccaccagccacagcagcaccacccacaccatcagcagcgcccccagcaccaccagcgccctggtggaggagcccaccagctaccacagcagccctggcagcacagccaccacccacttcccagacagcagcaccaccagcggccgctctgaggagagcacagccagccacagcagccaggatgccaccggcaccatcgtgctgcctgcccggagcaccacctctgtgctgctgggggagagcaccaccagccccatcagcagcggctccatggagaccacagccctgcccggcagcaccaccaccccaggcctgtctgagaagagcaccaccttccacagcagccccagcagcacccccaccacccacttcagcgccagcagcaccaccctgggccgctctgaggagagcaccaccgtgcacagcagccctgtggccacagccaccacccccagccctgcccggagcaccaccagcggcctggtggaggagagcacagcctaccacagcagccctggcagcacccagaccatgcacttccctgagagcagcacagccagcggccgctctgaggagagcaggaccagccacagcagcaccacccacaccatcagcagcccccccagcaccaccagcgccctggtggaggagcccaccagctaccacagcagccctggcagcatcgccaccacccacttccctgagagcagcaccaccagcggccgctctgaggagagcacagccagccacagcagcccagacaccaacggcatcacccccctgcctgcccacttcaccaccagcggcagaattgctgagagcaccaccttctacatcagccctggctccatggagaccaccctggccagcacagccaccaccccaggcctgagcgccaagagcaccatcctgtacagcagcagccgcagcccagaccagaccctgagccctgcctccatgaccagcagcagcatcagcggggagcccaccagcctgtacagccaggccgagagcacccacaccacagccttccctgccagcaccaccaccagcggcctgagccaggagagcaccaccttccacagcaagccaggcagcacagagaccaccctgagccctggcagcatcaccaccagcagctttgcccaggagttcaccaccccccacagccagcccggcagcgccctgagcacagtgtccccagccagcaccaccgtgcccggcctgtctgaggagagcaccaccttctacagcagccctggcagcacagagaccacagccttcagccacagcaacaccatgagcatccacagccagcagagcacccccttcccagacagccctggcttcacccacacagtgctgcctgccaccctgaccaccacagacatcggccaggagagcacagccttccacagcagcagtgatgccaccggcaccacccccctgcctgcccggagcacagccagtgacctggtgggggagcccaccaccttctacatcagccccagccccacctacaccaccctcttccctgccagcagcagcaccagcggcctgacagaggagagcaccaccttccacaccagccccagcttcaccagcaccatcgtgtccacagagagcctggagaccctggcccctggcctgtgccaggagggccagatctggaatggcaagcagtgtgtgtgcccccagggctacgtgggctaccagtgcctgagccccctggagagcttccctgtggagaccccagagaagctgaatgccaccctgggcatgacagtgaaggtgacctacagaaacttcacagagaagatgaatgatgccagcagccaggagtaccagaacttcagcaccctcttcaagaacaggatggatgtggtgctgaagggggacaacctgccccagtaccggggcgtgaacatccggcggctgctgaatggcagcatcgtggtgaagaatgatgtgatcctggaggccgactacaccctggagtatgaggagctgtttgagaacctggccgagatcgtgaaggccaagatcatgaatgagaccaggaccaccctgctggaccctgacagctgcaggaaggccatcctgtgctacagcgaggaggacacctttgtggacagctctgtgaccccaggctttgacttccaggagcagtgcacccagaaggctgctgagggctacacccagttctactacgtggatgtgctggatggcaagctggcctgtgtgaacaagtgcaccaagggcaccaagagccagatgaactgcaacctgggcacctgccagctgcagaggagcggcccccgctgcctgtgccccaacaccaacacccactggtactggggcgagacctgtgagttcaacatcgccaagagcctggtgtatggcatcgtgggcgctgtgatggctgtgctgctgctggccctgatcatcctgatcatcctcttcagcctgagccagaggaagaggcaccgggagcagtatgatgtgccccaggagtggaggaaggagggcaccccaggcatcttccagaagacagccatctgggaggaccagaacctgcgggagagccgcttcggcctggagaatgcctacaacaacttccggcccaccctggagaccgtggacagcggcacagagctgcacatccagaggcctgagatggtggccagcacagtgtag

SEQ ID NO: 160317 - DNA, 16008 bp, Artificial Sequence
  Description of Artificial Sequence: Synthetic coding sequence
atgctggtgatctggatcctgaccctggccctgcggctgtgtgcctctgtgaccaccgtgaccccaggcagcacagtgaacaccagcatcggcggcaacaccaccagcgccagcacccccagcagcagtgaccccttcaccaccttcagtgactatggagtgtctgtgaccttcatcaccggcagcacagccaccaagcacttcctggacagcagcaccaacagcggccacagcgaggagagcacagtgagccacagcggccctggggccaccggcaccaccctcttccccagccacagcgccacctctgtgtttgtgggggagcccaagaccagccccatcaccagcgcctccatggagaccacagccctgcccggcagcaccaccacagctggcctgtctgagaagagcaccaccttctacagcagccccaggagcccagacaggaccctgagccctgcccggaccaccagcagtggagtgtctgagaagagcaccaccagccacagccggcccggccccacccacaccatcgccttcccagacagcaccaccatgcctggggtgtcccaggagagcacagccagccacagcatccctggcagcacagacaccaccctgagccctggcaccaccacccccagcagcctgggccctgagagcaccaccttccacagcagccctggctacaccaagaccacccggctgcctgacaacaccaccaccagcggcctgctggaggccagcacccctgtgcacagcagcacaggcagcccccacaccaccctgagccccagcagcagcaccacccatgaaggagagcccaccaccttccagagctggcccagcagcaaggacaccagccctgcccccagcggcaccaccagcgcctttgtgaagctgagcaccacctaccacagcagccccagcagcacccccaccacccacttcagcgccagcagcaccaccctgggccacagcgaggagagcacccctgtgcacagcagccctgtggccacagccaccaccccacctccagcccggagcgccaccagcggccacgtggaggagagcacagcctaccacaggagccctggcagcacccagaccatgcacttccctgagagcagcaccaccagcggccacagcgaggagagcgccaccttccacggcagcaccacccacaccaagagcagcacccccagcaccacagctgccctggcccacaccagctaccacagcagcctgggcagcacagagaccacccacttccgggacagcagcaccatcagcggccgctctgaggagagcaaggccagccacagcagcccagatgccatggccaccaccgtgctgcctgctggcagcaccccatctgtgctggtgggggacagcacccccagccccatcagcagcggctccatggagaccacagccctgcccggcagcaccaccaagccaggcctgtctgagaagagcaccaccttctacagcagccccaggagcccagacaccacccacctgcctgcctccatgaccagcagtggagtgtctgaggagagcaccaccagccacagccggcccggcagcacccacaccacagccttccctggcagcaccaccatgcctggcctgagccaggagagcacagccagccacagcagccctggccccacagacaccaccctgagccctggcagcaccacagccagcagcctgggccctgagtacaccaccttccacagccggcccggcagcacagagaccaccctgctgcctgacaacaccacagccagcggcctgctggaggcctccatgcctgtgcacagcagcaccaggagcccccacaccaccctgagccctgctggcagcaccacccggcagggcgagagcaccaccttccacagctggcccagcagcaaggacaccaggcctgccccacccaccaccaccagcgcctttgtggagcccagcaccaccagccacggcagccccagcagcatccccaccacccacatcagcgcccggagcaccaccagcggcctggtggaggagagcaccacctaccacagcagccctggcagcacccagaccatgcacttccctgagagtgacaccaccagcggccgcggggaggagagcaccaccagccacagcagcaccacccacaccatcagcagcgcccccagcaccaccagcgccctggtggaggagcccaccagctaccacagcagccctggcagcacagccaccacccacttcccagacagcagcaccaccagcggccgctctgaggagagcacagccagccacagcagccaggatgccaccggcaccatcgtgctgcctgcccggagcaccacctctgtgctgctgggggagagcaccaccagccccatcagcagcggctccatggagaccacagccctgcccggcagcaccaccaccccaggcctgtctgagaggagcaccaccttccacagcagccccaggagccctgccaccaccctgagccctgccagcaccaccagcagtggagtgtctgaggagagcaccaccagccgcagccggcccggcagcacccacaccacagccttcccagacagcaccaccaccccaggcctgagccgccacagcaccaccagccacagcagccctggcagcacagacaccaccctgctgcctgccagcaccaccaccagcggccccagccaggagagcaccaccagccacagcagcagcggcagcacagacacagccctgagccctggcagcaccacagccctgagctttggccaggagagcaccaccttccacagcaaccctggcagcacccacaccaccctcttcccagacagcaccaccagcagcggcatcgtggaggccagcaccagggtgcacagcagcacaggcagccccaggaccaccctgagccctgccagcagcaccagccctggcctgcagggcgagagcacagccttccagacccacccagccagcacccacaccacccccagcccccccagcacagccacagcccctgtggaggagagcaccacctaccacaggagccctggcagcacccccaccacccacttccctgccagcagcaccaccagcggccacagcgagaagagcaccatcttccacagcagcccagatgccagcggcaccacccccagcagcgcccacagcaccaccagcggccgcggggagagcaccaccagccgcatcagccctggcagcacagagatcaccaccctgcccggcagcaccaccaccccaggcctgtctgaggccagcaccaccttctacagcagccccaggagccccaccaccaccctgagccctgcctccatgaccagcctgggcgtgggggaggagagcaccaccagccgcagccagcccggcagcacccacagcacagtgtccccagccagcaccaccaccccaggcctgtctgaggagagcaccaccgtgtacagcagcagccggggcagcacagagaccaccgtcttcccccacagcaccaccacctctgtgcacggggaggagcccaccaccttccacagcaggcctgccagcacccacaccaccctcttcacagaggacagcaccaccagcggcctgacagaggagagcacagccttccctggcagccctgccagcacccagacaggcctgcctgccaccctgaccacagctgacctgggggaggagagcaccaccttccccagcagcagcggcagcacaggcaccaagctgagccctgcccggagcaccaccagcggcctggtgggggagagcacccccagccggctgagccccagcagcacagagaccaccaccctgcccggcagccccaccacccccagcctgtctgagaagagcaccaccttctacaccagccccaggagcccagatgccaccctgagccctgccaccaccaccagcagtggagtgtctgaggagagcagcaccagccacagccagcccggcagcacccacaccacagccttcccagacagcaccaccaccagtgacctgagccaggagcccaccaccagccacagcagccagggcagcacagaggccaccctgagccctggcagcaccacagccagcagcctgggccagcagagcaccaccttccacagcagccctggggacacagagaccaccctgctgcctgatgacaccatcaccagcggcctggtggaggccagcacccccacccacagcagcacaggcagcctgcacaccaccctgaccccagccagcagcaccagcgctggcctgcaggaggagagcaccaccttccagagctggcccagcagcagtgacaccacccccagccccccaggcaccacagctgcccctgtggaggtgtccaccacctaccacagccggcccagcagcacccccaccacccacttcagcgccagcagcaccaccctgggccgctctgaggagagcaccaccgtgcacagcagccctggggccaccggcacagccctcttccccaccaggtctgccacctctgtgctggtgggggagcccaccaccagccccatcagcagcggcagcacagagaccacagccctgcccggcagcaccaccacagctggcctgtctgagaagagcaccaccttctacagcagccccaggagcccagacaccaccctgagccctgccagcaccaccagcagcggcgtgtctgaggagagcaccaccagccacagcaggcctggcagcacccacaccacagccttccctggcagcaccaccatgcctggggtgtcccaggagagcacagccagccacagcagccctggcagcacagacaccaccctgagccctggcagcaccacagccagcagcctgggccctgagagcaccaccttccacagcagccctggcagcacagagaccaccctgctgcctgacaacaccacagccagcggcctgctggaggccagcacccctgtgcacagcagcacaggcagcccccacaccaccctgagccctgctggcagcaccacccggcagggcgagagcaccaccttccagagctggcccagcagcaaggacaccatgcctgccccacccaccaccaccagcgcctttgtggagctgagcaccaccagccacggcagccccagcagcacccccaccacccacttcagcgccagcagcaccaccctgggccgctctgaggagagcaccaccgtgcacagcagccctgtggccacagccaccacccccagccctgcccggagcaccaccagcggcctggtggaggagagcacagcctaccacagcagccctggcagcacccagaccatgcacttccctgagagcagcacagccagcggccgctctgaggagagcaggaccagccacagcagcaccacccacaccatcagcagcccccccagcaccaccagcgccctggtggaggagcccaccagctaccacagcagccctggcagcacagccaccacccacttcccagacagcagcaccaccagcggccgctctgaggagagcacagccagccacagcagccaggatgccaccggcaccatcgtgctgcctgcccggagcaccacctctgtgctgctgggggagagcaccaccagccccatcagcagcggctccatggagaccacagccctgcccggcagcaccaccaccccaggcctgtctgagaagagcaccaccttccacagcagccccaggagccctgccaccaccctgagccctgccagcaccaccagcagcggcgtgtctgaggagagcaccaccagccacagcaggcctggcagcacccacaccacagccttcccagacagcaccaccaccccaggcctgagccgccacagcaccaccagccacagcagccctggcagcacagacaccaccctgctgcctgccagcaccaccaccagcggccccagccaggagagcaccaccagccacagcagccctggcagcacagacacagccctgagccctggcagcaccacagccctgagctttggccaggagagcaccaccttccacagcagccctggcagcacccacaccaccctcttcccagacagcaccaccagcagcggcatcgtggaggccagcaccagggtgcacagcagcacaggcagccccaggaccaccctgagccctgccagcagcaccagccctggcctgcagggcgagagcacagccttccagacccacccagccagcacccacaccacccccagcccccccagcacagccacagcccctgtggaggagagcaccacctaccacaggagccctggcagcacccccaccacccacttccctgccagcagcaccaccagcggccacagcgagaagagcaccatcttccacagcagcccagatgccagcggcaccacccccagcagcgcccacagcaccaccagcggccgcggggagagcaccaccagccgcatcagccctggcagcacagagatcaccaccctgcccggcagcaccaccaccccaggcctgtctgaggccagcaccaccttctacagcagccccaggagccccaccaccaccctgagccctgcctccatgaccagcctgggcgtgggggaggagagcaccaccagccgcagccagcccggcagcacccacagcacagtgtccccagccagcaccaccaccccaggcctgtctgaggagagcaccaccgtgtacagcagcagccctggcagcacagagaccaccgtcttccccaggacccccaccacctctgtgcggggggaggagcccaccaccttccacagcaggcctgccagcacccacaccaccctcttcacagaggacagcaccaccagcggcctgacagaggagagcacagccttccctggcagccctgccagcacccagacaggcctgcctgccaccctgaccacagctgacctgggggaggagagcaccaccttccccagcagcagcggcagcacaggcaccaccctgagccctgcccggagcaccaccagcggcctggtgggggagagcacccccagccggctgagccccagcagcacagagaccaccaccctgcccggcagccccaccacccccagcctgtctgagaagagcaccaccttctacaccagccccaggagcccagatgccaccctgagccctgccaccaccaccagcagcggcgtgtctgaggagagcagcaccagccacagccagcccggcagcacccacaccacagccttcccagacagcaccaccaccccaggcctgagccgccacagcaccaccagccacagcagccctggcagcacagacaccaccctgctgcctgccagcaccaccaccagcggccccagccaggagagcaccaccagccacagcagccctggcagcacagacacagccctgagccctggcagcaccacagccctgagctttggccaggagagcaccaccttccacagcagccctggcagcacccacaccaccctcttcccagacagcaccaccagcagcggcatcgtggaggccagcaccagggtgcacagcagcacaggcagccccaggaccaccctgagccctgccagcagcaccagccctggcctgcagggcgagagcaccaccttccagacccacccagccagcacccacaccacccccagcccccccagcacagccacagcccctgtggaggagagcaccacctaccacaggagccctggcagcacccccaccacccacttccctgccagcagcaccaccagcggccacagcgagaagagcaccatcttccacagcagcccagatgccagcggcaccacccccagcagcgcccacagcaccaccagcggccgcggggagagcaccaccagccgcatcagccctggcagcacagagatcaccaccctgcccggcagcaccaccaccccaggcctgtctgaggccagcaccaccttctacagcagccccaggagccccaccaccaccctgagccctgcctccatgaccagcctgggcgtgggggaggagagcaccaccagccgcagccagcccggcagcacccacagcacagtgtccccagccagcaccaccaccccaggcctgtctgaggagagcaccaccgtgtacagcagcagccctggcagcacagagaccaccgtcttccccaggagcaccaccacctctgtgcggggggaggagcccaccaccttccacagcaggcctgccagcacccacaccaccctcttcacagaggacagcaccaccagcggcctgacagaggagagcacagccttccctggcagccctgccagcacccagacaggcctgcctgccaccctgaccacagctgacctgggggaggagagcaccaccttccccagcagcagcggcagcacaggcaccaccctgagccctgcccggagcaccaccagcggcctggtgggggagagcacccccagccggctgagccccagcagcacagagaccaccaccctgcccggcagccccaccacccccagcctgtctgagaagagcaccaccttctacaccagccccaggagcccagatgccaccctgagccctgccaccaccaccagcagcggcgtgtctgaggagagcagcaccagccacagccagcccggcagcacccacaccacagccttcccagacagcaccaccaccagcggcctgagccaggagcccacagccagccacagcagccagggcagcacagaggccaccctgagccctggcagcaccacagccagcagcctgggccagcagagcaccaccttccacagcagccctggggacacagagaccaccctgctgcctgatgacaccatcaccagcggcctggtggaggccagcacccccacccacagcagcacaggcagcctgcacaccaccctgaccccagccagcagcaccagcgctggcctgcaggaggagagcaccaccttccagagctggcccagcagcagtgacaccacccccagccccccaggcaccacagctgcccctgtggaggtgtccaccacctaccacagccggcccagcagcacccccaccacccacttcagcgccagcagcaccaccctgggccgctctgaggagagcaccaccgtgcacagcagccctggggccactggaacagccctcttccccaccaggtctgccacctctgtgctggtgggggagcccaccaccagccccatcagcagcggcagcacagagaccacagccctgcccggcagcaccaccacagctggcctgtctgagaagagcaccaccttctacagcagccccaggagcccagacaccaccctgagccctgccagcaccaccagcagtggagtgtctgaggagagcaccaccagccacagccggcccggcagcacccacaccacagccttccctggcagcaccaccatgcctggggtgtcccaggagagcacagccagccacagcagccctggcagcacagacaccaccctgagccctggcagcaccacagccagcagcctgggccctgagagcaccaccttccacagcggccctggcagcacagagaccaccctgctgcctgacaacaccacagccagcggcctgctggaggccagcacccctgtgcacagcagcacaggcagcccccacaccaccctgagccctgctggcagcaccacccggcagggcgagagcaccaccttccagagctggcccaacagcaaggacaccaccccagccccacccaccaccaccagcgcctttgtggagctgagcaccaccagccacggcagccccagcagcacccccaccacccacttcagcgccagcagcaccaccctgggccgctctgaggagagcaccaccgtgcacagcagccctgtggccacagccaccacccccagccctgcccggagcaccaccagcggcctggtggaggagagcaccacctaccacagcagccctggcagcacccagaccatgcacttccctgagagtgacaccaccagcggccgcggggaggagagcaccaccagccacagcagcaccacccacaccatcagcagcgcccccagcaccaccagcgccctggtggaggagcccaccagctaccacagcagccctggcagcacagccaccacccacttcccagacagcagcaccaccagcggccgctctgaggagagcacagccagccacagcagccaggatgccaccggcaccatcgtgctgcctgcccggagcaccacctctgtgctgctgggggagagcaccaccagccccatcagcagcggctccatggagaccacagccctgcccggcagcaccaccaccccaggcctgtctgagaagagcaccaccttccacagcagccccaggagccctgccaccaccctgagccctgccagcaccaccagcagtggagtgtctgaggagagcaccaccagccacagccggcccggcagcacccacaccacagccttcccagacagcaccaccaccccaggcctgagccgccacagcaccaccagccacagcagccctggcagcacagacaccaccctgctgcctgccagcaccaccaccagcggcagcagccaggagagcaccaccagccacagcagcagcggcagcacagacacagccctgagccctggcagcaccacagccctgagctttggccaggagagcaccaccttccacagcagccctggcagcacccacaccaccctcttcccagacagcaccaccagcagcggcatcgtggaggccagcaccagggtgcacagcagcacaggcagccccaggaccaccctgagccctgccagcagcaccagccctggcctgcagggcgagagcacagccttccagacccacccagccagcacccacaccacccccagcccccccagcacagccacagcccctgtggaggagagcaccacctaccacaggagccctggcagcacccccaccacccacttccctgccagcagcaccaccagcggccacagcgagaagagcaccatcttccacagcagcccagatgccagcggcaccacccccagcagcgcccacagcaccaccagcggccgcggggagagcaccaccagccgcatcagccctggcagcacagagatcaccaccctgcccggcagcaccaccaccccaggcctgtctgaggccagcaccaccttctacagcagccccaggagccccaccaccaccctgagccctgcctccatgaccagcctgggcgtgggggaggagagcaccaccagccgcagccagcccggcagcacccacagcacagtgtccccagccagcaccaccaccccaggcctgtctgaggagagcaccaccgtgtacagcagcagccctggcagcacagagaccaccgtcttccccaggagcaccaccacctctgtgcggcgggaggagcccaccaccttccacagcaggcctgccagcacccacaccaccctcttcacagaggacagcaccaccagcggcctgacagaggagagcacagccttccctggcagccctgccagcacccagacaggcctgcctgccaccctgaccacagctgacctgggggaggagagcaccaccttccccagcagcagcggcagcacaggcaccaagctgagccctgcccggagcaccaccagcggcctggtgggggagagcacccccagccggctgagccccagcagcacagagaccaccaccctgcccggcagccccaccacccccagcctgtctgagaagagcaccaccttctacaccagccccaggagcccagatgccaccctgagccctgccaccaccaccagcagtggagtgtctgaggagagcagcaccagccacagccagcccggcagcacccacaccacagccttcccagacagcaccaccaccagcggcctgagccaggagcccaccaccagccacagcagccagggcagcacagaggccaccctgagccctggcagcaccacagccagcagcctgggccagcagagcaccaccttccacagcagccctggggacacagagaccaccctgctgcctgatgacaccatcaccagcggcctggtggaggccagcacccccacccacagcagcacaggcagcctgcacaccaccctgaccccagccagcagcaccagcacaggcctgcaggaggagagcaccaccttccagagctggcccagcagcagtgacaccacccccagcccccccagcaccacagctgtgcctgtggaggtgtccaccacctaccacagccggcccagcagcacccccaccacccacttcagcgccagcagcaccaccctgggccgctctgaggagagcaccaccgtgcacagcagccctggggccaccggcacagccctcttccccaccaggtctgccacctctgtgctggtgggggagcccaccaccagccccatcagcagcggcagcacagagaccacagccctgcccggcagcaccaccacagctggcctgtctgagaagagcaccaccttctacagcagccccaggagcccagacaccaccctgagccctgccagcaccaccagcagcggcgtgtctgaggagagcaccaccagccacagcaggcctggctccatgcacaccacagccttccccagcagcaccaccatgcctggggtgtcccaggagagcacagccagccacagcagccctggcagcacagacaccaccctgagccctggcagcaccacagccagcagcctgggccctgagagcaccaccttccacagcagccctggcagcacagagaccaccctgctgcctgacaacaccacagccagcggcctgctggaggccagcacccctgtgcacagcagcacaggcagcccccacaccaccctgagccctgctggcagcaccacccggcagggcgagagcaccaccttccagagctggcccaacagcaaggacaccaccccagccccacccaccaccaccagcgcctttgtggagctgagcaccaccagccacggcagccccagcagcacccccaccacccacttcagcgccagcagcaccaccctgggccgctctgaggagagcaccaccgtgcacagcagccctgtggccacagccaccacccccagccctgcccggagcaccaccagcggcctggtggaggagagcaccacctaccacagcagccctggcagcacccagaccatgcacttccctgagagcaacaccaccagcggccgcggggaggagagcaccaccagccacagcagcaccacccacaccatcagcagcgcccccagcaccaccagcgccctggtggaggagcccaccagctaccacagcagccctggcagcacagccaccacccacttcccagacagcagcaccaccagcggccgctctgaggagagcacagccagccacagcagccaggatgccaccggcaccatcgtgctgcctgcccggagcaccacctctgtgctgctgggggagagcaccaccagccccatcagcagcggctccatggagaccacagccctgcccggcagcaccaccaccccaggcctgtctgagaagagcaccaccttccacagcagccccagcagcacccccaccacccacttcagcgccagcagcaccaccctgggccgctctgaggagagcaccaccgtgcacagcagccctgtggccacagccaccacccccagccctgcccggagcaccaccagcggcctggtggaggagagcacagcctaccacagcagccctggcagcacccagaccatgcacttccctgagagcagcacagccagcggccgctctgaggagagcaggaccagccacagcagcaccacccacaccatcagcagcccccccagcaccaccagcgccctggtggaggagcccaccagctaccacagcagccctggcagcatcgccaccacccacttccctgagagcagcaccaccagcggccgctctgaggagagcacagccagccacagcagcccagacaccaacggcatcacccccctgcctgcccacttcaccaccagcggcagaattgctgagagcaccaccttctacatcagccctggctccatggagaccaccctggccagcacagccaccaccccaggcctgagcgccaagagcaccatcctgtacagcagcagccgcagcccagaccagaccctgagccctgcctccatgaccagcagcagcatctctggagagcccaccagcctgtacagccaggccgagagcacccacaccacagccttccctgccagcaccaccaccagcggcctgagccaggagagcaccaccttccacagcaagccaggcagcacagagaccaccctgagccctggcagcatcaccaccagcagctttgcccaggagttcaccaccccccacagccagcccggcagcgccctgagcacagtgtccccagccagcaccaccgtgcccggcctgtctgaggagagcaccaccttctacagcagccctggcagcacagagaccacagccttcagccacagcaacaccatgagcatccacagccagcagagcacccccttcccagacagccctggcttcacccacacagtgctgcctgccaccctgaccaccacagacatcggccaggagagcacagccttccacagcagcagtgatgccaccggcaccacccccctgcctgcccggagcacagccagtgacctggtgggggagcccaccaccttctacatcagccccagccccacctacaccaccctcttccctgccagcagcagcaccagcggcctgacagaggagagcaccaccttccacaccagccccagcttcaccagcaccatcgtgtccacagagagcctggagaccctggcccctggcctgtgccaggagggccagatctggaatggcaagcagtgtgtgtgcccccagggctacgtgggctaccagtgcctgagccccctggagagcttccctgtggagaccccagagaagctgaatgccaccctgggcatgacagtgaaggtgacctacagaaacttcacagagaagatgaatgatgccagcagccaggagtaccagaacttcagcaccctcttcaagaacaggatggatgtggtgctgaagggggacaacctgccccagtacagaggagtgaacatccggcggctgctgaatggcagcatcgtggtgaagaatgatgtgatcctggaggccgactacaccctggagtatgaggagctgtttgagaacctggccgagatcgtgaaggccaagatcatgaatgagaccaggaccaccctgctggaccctgacagctgcaggaaggccatcctgtgctacagcgaggaggacacctttgtggacagctctgtgaccccaggctttgacttccaggagcagtgcacccagaaggctgctgagggctacacccagttctactacgtggatgtgctggatggcaagctggcctgtgtgaacaagtgcaccaagggcaccaagagccagatgaactgcaacctgggcacctgccagctgcagaggagcggcccccgctgcctgtgccccaacaccaacacccactggtactggggcgagacctgtgagttcaacatcgccaagagcctggtgtatggaattgtgggcgctgtgatggctgtgctgctgctggccctgatcatcctgatcatcctcttcagcctgagccagaggaagaggcaccgggagcagtatgatgtgccccaggagtggaggaaggagggcaccccaggcatcttccagaagacagccatctgggaggaccagaacctgcgggagagcagatttggcctggagaatgcctacaacaacttccggcccaccctggagaccgtggacagcggcacagagctgcacatccagaggcctgagatggtggccagcacagtgtag

SEQ ID NO: 160318 - DNA, 1536 bp, Artificial Sequence
  Description of Artificial Sequence: Synthetic coding sequence
atgaaggccatcatccacctgaccctgctggccctgctgtctgtgaacacagccaccaaccagggcaacagcgcagatgctgtgaccaccacagaaacagccaccagcggccccaccgtggccgctgctgacaccacagagaccaacttccctgagacagccagcaccacagccaacacccccttccccacagccaccagccctgccccacccatcatcagcacccacagcagcagcaccatccccaccccagccccacccatcatcagcacccacagcagcagcaccatccccatccccacagctgctgacagcgagagcaccaccaacgtgaacagcctggccaccagtgacatcatcacagccagcagccccaatgatggcctcatcaccatggtgcccagcgagacccagagcaacaatgagatgagccccaccacagaggacaaccagagcagcggccccccaactggaacagccctgctggagaccagcaccctgaacagcacaggccccagcaacccctgccaggatgacccctgtgccgacaacagcctgtgtgtgaagctgcacaacaccagcttctgcctgtgcctggagggctactactacaacagcagcacctgcaagaagggcaaggtgtttcctgggaagatctctgtgacagtgtctgagacctttgatcctgaggagaagcacagcatggcctaccaggacctgcacagcgagatcaccagcctcttcaaggatgtgtttggcacctctgtgtatggccagaccgtcatcctgactgtgtccaccagcctgagccccaggtctgagatgagagcagatgacaagtttgtgaatgtgaccatcgtgaccatcctggccgagaccaccagtgacaatgagaagacagtgacagagaagatcaacaaggccatccgcagcagcagcagcaacttcctgaactatgacctgaccctgcgctgtgactactacggctgcaaccagacagcagatgactgcctgaatggcctggcctgtgactgcaagagtgacctgcagaggcccaacccccagagccccttctgtgtggccagcagcctgaagtgcccagatgcctgcaatgcccagcacaagcagtgcctgatcaagaagagcggcggggccccagaatgtgcctgtgtgcccggctaccaggaggatgccaatggaaactgccagaagtgtgccttcggctacagcggcctggactgcaaggacaagttccagctgatcctgaccatcgtgggcaccatcgccggcatcgtcatcctgtccatgatcatcgccctgattgtgacagcccggagcaacaacaagaccaagcacatcgaggaggagaacctgattgatgaggacttccagaacctgaagctgcggagcacaggcttcaccaacctgggcgctgagggctctgtgttccccaaggtgcgcatcacagccagccgggacagccagatgcagaacccctacagccgccacagctccatgcccaggccagactactag

SEQ ID NO: 160319 - DNA, 13482 bp, Artificial Sequence
  Description of Artificial Sequence: Synthetic coding sequence
atgccccggcccggcaccatggccctgtgcctgctgaccctggtgctgagcctgctgcccccccaggccgctgctgagcaggacctgtctgtgaacagagctgtgtgggatggcggcggctgcatcagccagggagatgtgctgaaccggcagtgccagcagctgagccagcacgtgaggactggatctgctgccaacacagccaccggcaccaccagcaccaacgtggtggagcccaggatgtacctgagctgcagcaccaaccctgagatgaccagcattgagagctctgtgaccagtgacaccccaggagtgagcagcaccaggatgacccccacagagagcaggaccaccagcgagagcaccagtgacagcaccaccctcttccccagcagcacagaggacaccagcagccccaccaccccagagggcacagatgtgcccatgagcaccccatctgaggagagcatcagcagcaccatggcctttgtgtccacagcccccctgcccagctttgaggcctacaccagcctgacctacaaggtggacatgagcacccccctgaccaccagcacccaggccagcagcagccccaccaccccagagagcaccaccatccccaagagcaccaacagcgagggcagcacccccctgacctccatgcctgccagcaccatgaaggtggccagcagcgaggccatcaccctgctgaccacccctgtggagatcagcacccctgtgaccatcagcgcccaggccagcagcagccccaccacagctgagggccccagcctgagcaacagcgcccccagcggcggcagcacccccctgaccaggatgcccctgtctgtgatgctggtggtgagcagcgaggccagcaccctgagcaccaccccagctgccaccaacatccctgtgatcaccagcacagaggccagcagcagccccaccacagctgagggcaccagcatccccaccagcacctacacagagggcagcacccccctgaccagcaccccagccagcaccatgcctgtggccaccagcgagatgagcaccctgagcatcacccctgtggacaccagcaccctggtgaccaccagcacagagcccagcagcctgcccaccacagctgaggccacctccatgctgaccagcaccctgtctgagggcagcacccccctgaccaacatgcctgtgtccaccatcctggtggccagcagcgaggccagcaccaccagcaccatccctgtggacagcaagacctttgtgaccacagccagcgaggccagcagcagccccaccacagctgaggacaccagcatcgccaccagcacccccagcgagggcagcacccccctgacctccatgcctgtgtccaccacccctgtggccagcagcgaggccagcaacctgagcaccacccctgtggacagcaagacccaggtgaccaccagcacagaggccagcagcagccccccaacagctgaggtgaacagcatgcccaccagcaccccatctgagggcagcacccccctgacctccatgtctgtgtccaccatgcctgtggccagcagcgaggccagcaccctgagcaccacccctgtggacaccagcacccctgtgaccaccagcagcgaggccagcagcagcagcaccaccccagagggcaccagcatccccaccagcacccccagcgagggcagcacccccctgaccaacatgcctgtgtccacccggctggtggtgtcctctgaggccagcaccaccagcaccaccccagctgacagcaacacctttgtgaccaccagcagcgaggccagcagcagcagcaccacagctgagggcacctccatgcccaccagcacctacagcgagcggggcaccaccatcacctccatgtctgtgtccaccaccctggtggccagcagcgaggccagcaccctgagcaccacccctgtggacagcaacacccctgtgaccaccagcacagaggccaccagcagcagcaccacagctgagggcacctccatgcccaccagcacctacacagagggcagcacccccctgacctccatgcctgtgaacaccaccctggtggccagcagcgaggccagcaccctgagcaccacccctgtggacaccagcacccctgtgaccaccagcacagaggccagcagcagccccaccacagcagatggagcctccatgcccaccagcaccccatctgagggcagcacccccctgacctccatgcctgtgtccaagaccctgctgaccagcagcgaggccagcaccctgagcaccacccccctggacaccagcacccacatcaccaccagcacagaggccagctgcagccccaccaccacagagggcacctccatgcccatcagcacccccagcgagggcagccccctgctgaccagcatccctgtgtccatcacccctgtgaccagccctgaggccagcaccctgagcaccacccctgtggacagcaacagccctgtgaccaccagcacagaggtgagcagcagccccaccccagctgagggcacctccatgcccaccagcacctacagcgagggccgcacccccctgacctccatgcctgtgtccaccaccctggtggccaccagcgccatcagcaccctgagcaccacccctgtggacaccagcacccctgtgaccaacagcacagaggcccggagcagccccaccaccagcgagggcacctccatgcccaccagcaccccaggagagggcagcacccccctgacctccatgccagacagcaccacccctgtggtgtcctctgaggcccggaccctgagcgccacccctgtggacaccagcacccctgtgaccaccagcacagaggccaccagcagccccaccacagctgagggcaccagcatccccaccagcaccccatctgagggcaccacccccctgaccagcacccctgtgagccacaccctggtggccaacagcgaggccagcaccctgagcaccacccctgtggacagcaacacccccctgaccaccagcacagaggccagcagccccccacccacagctgagggcacctccatgcccaccagcacccccagcgagggcagcacccccctgaccaggatgcctgtgtccaccaccatggtggccagcagcgagaccagcaccctgagcaccaccccagctgacaccagcacccctgtgaccacctacagccaggccagcagcagcagcaccacagcagatggcacctccatgcccaccagcacctacagcgagggcagcacccccctgacctctgtgcctgtgtccacccggctggtggtgagcagcgaggccagcaccctgagcaccacccctgtggacaccagcatccctgtgaccaccagcacagaggccagcagcagccccaccacagctgagggcaccagcatccccaccagcccccccagcgagggcaccacccccctggcctccatgcctgtgtccaccaccctggtggtgtcctctgaggccaacaccctgagcaccacccctgtggacagcaagacccaggtggccaccagcacagaggccagcagccccccacccacagctgaggtgacctccatgcccaccagcaccccaggagagaggagcacccccctgacctccatgcctgtgcgccacacccctgtggccagcagcgaggccagcaccctgagcaccagccctgtggacaccagcacccctgtgaccaccagcgctgagaccagcagcagccccaccacagctgagggcaccagcctgcccaccagcaccaccagcgagggcagcaccctgctgaccagcatccctgtgtccaccaccctggtgaccagccctgaggccagcaccctgctgaccacccctgtggacaccaagggccctgtggtgaccagcaatgaggtgagcagcagccccaccccagctgagggcacctccatgcccaccagcacctacagcgagggccgcacccccctgaccagcatccctgtgaacaccaccctggtggccagcagcgccatcagcatcctgagcaccacccctgtggacaacagcacccctgtgaccaccagcacagaggcctgcagcagccccaccaccagcgagggcacctccatgcccaacagcaaccccagcgagggcaccacccccctgaccagcatccctgtgtccaccacccctgtggtgtcctctgaggccagcaccctgagcgccacccctgtggacaccagcaccccaggcaccaccagcgctgaggccaccagcagccccaccacagctgagggcatcagcatccccaccagcaccccatctgagggcaagacccccctgaagagcatccctgtgagcaacacccctgtggccaacagcgaggccagcaccctgagcaccacccctgtggacagcaacagccctgtggtgaccagcacagctgtgagcagcagccccaccccagctgagggcaccagcatcgccatcagcacccccagcgagggcagcacagccctgaccagcatccctgtgtccaccaccaccgtggccagcagcgagatcaacagcctgagcaccaccccagctgtgaccagcacccctgtgaccacctacagccaggccagcagcagccccaccacagcagatggcacctccatgcagaccagcacctacagcgagggcagcacccccctgaccagcctgcctgtgtccaccatgctggtggtgagcagcgaggccaacaccctgagcaccacccccatcgacagcaagacccaggtgacagccagcacagaggccagcagcagcaccacagctgagggcagctccatgaccatcagcaccccatctgagggcagccccctgctgaccagcatccctgtgtccaccacccctgtggccagccctgaggccagcaccctgagcaccacccctgtggacagcaacagccctgtgatcaccagcacagaggtgagcagcagccccaccccagctgagggcacctccatgcccaccagcacctacacagagggccgcacccccctgaccagcatcaccgtgaggaccacccctgtggccagcagcgccatcagcaccctgagcaccacccctgtggacaacagcacccctgtgaccaccagcacagaggcccggagcagccccaccaccagcgagggcacctccatgcccaacagcaccccatctgagggcaccacccccctgaccagcatccctgtgtccaccacccctgtgctgagcagcgaggccagcaccctgagcgccacccccatcgacaccagcacccctgtgaccaccagcacagaggccaccagcagccccaccacagctgagggcaccagcatccccaccagcaccctgtctgagggcatgacccccctgaccagcacccctgtgagccacaccctggtggccaacagcgaggccagcaccctgagcaccacccctgtggacagcaacagccctgtggtgaccagcacagctgtgagcagcagccccaccccagctgagggcaccagcatcgccaccagcaccccatctgagggcagcacagccctgaccagcatccctgtgtccaccaccaccgtggccagcagcgagaccaacaccctgagcaccaccccagctgtgaccagcacccctgtgaccacctacgcccaggtgagcagcagccccaccacagcagatggcagctccatgcccaccagcaccccccgggagggccggccccccctgaccagcatccctgtgtccaccaccaccgtggccagcagcgagatcaacaccctgagcaccaccctggccgacaccaggacccctgtgaccacctacagccaggccagcagcagccccaccacagcagatggcacctccatgcccaccccagcctacagcgagggcagcacccccctgacctccatgcccctgagcaccaccctggtggtgagcagcgaggccagcaccctgagcaccacccctgtggacaccagcaccccagccaccaccagcacagagggcagcagcagccccaccacagctgggggcaccagcatccagaccagcacccccagcgagaggaccacccccctggccggcatgcctgtgtccaccaccctggtggtgtcctctgagggcaacaccctgagcaccacccctgtggacagcaagacccaggtgaccaacagcacagaggccagcagcagcgccacagctgagggcagctccatgaccatcagcgcccccagcgagggcagccccctgctgaccagcatccccctgagcaccacccctgtggccagccctgaggccagcaccctgagcaccacccctgtggacagcaacagccctgtgatcaccagcacagaggtgagcagcagccccatccccacagagggcacctccatgcagaccagcacctacagcgacaggaggacccccctgacctccatgcctgtgtccaccaccgtggtggccagcagcgccatcagcaccctgagcaccacccctgtggacaccagcacccctgtgaccaacagcacagaggcccggagcagccccaccaccagcgagggcacctccatgcccaccagcacccccagcgagggcagcacccccttcacctccatgcctgtgtccaccatgcctgtggtgaccagcgaggccagcaccctgagcgccacccctgtggacaccagcacccctgtgaccaccagcacagaggccaccagcagccccaccacagctgagggcaccagcatccccaccagcaccctgtctgagggcaccacccccctgaccagcatccctgtgagccacaccctggtggccaacagcgaggtgtccaccctgagcaccacccctgtggacagcaacacccccttcaccaccagcacagaggccagcagccccccacccacagctgagggcacctccatgcccaccagcaccagcagcgagggcaacacccccctgaccaggatgcctgtgtccaccaccatggtggccagctttgagaccagcaccctgagcaccaccccagctgacaccagcacccctgtgaccacctacagccaggccggcagcagccccaccacagcagatgacacctccatgcccaccagcacctacagcgagggcagcacccccctgacctctgtgcctgtgtccaccatgcctgtggtgagcagcgaggccagcacccacagcaccacccctgtggacaccagcacccctgtgaccaccagcacagaggccagcagcagccccaccacagctgagggcaccagcatccccaccagcccccccagcgagggcaccacccccctggcctccatgcctgtgtccaccacccctgtggtgtcctctgaggccggcaccctgagcaccacccctgtggacaccagcacccccatgaccaccagcacagaggccagcagcagccccaccacagcagaagatattgtggtgcccatcagcacagccagcgagggcagcaccctgctgaccagcatccctgtgtccaccacccctgtggccagccctgaggccagcaccctgagcaccacccctgtggacagcaacagccctgtggtgaccagcacagagatcagcagcagcgccaccagcgctgagggcacctccatgcccaccagcacctacagcgagggcagcacccccctgcgctccatgcctgtgtccaccaagcccctggccagcagcgaggccagcaccctgagcaccacccctgtggacaccagcatccctgtgaccaccagcacagagaccagcagcagccccaccacagccaaggacacctccatgcccatcagcaccccatctgaggtgtccaccagcctgaccagcatcctggtgtccaccatgcctgtggccagcagcgaggccagcaccctgagcaccacccctgtggacaccaggaccctggtgaccaccagcacaggcaccagcagcagccccaccacagctgagggcagctccatgcccaccagcaccccaggagagaggagcacccccctgaccaacatcctggtgtccaccaccctgctggccaacagcgaggccagcaccctgagcaccacccctgtggacaccagcacccctgtgaccaccagcgctgaggccagcagcagccccaccacagctgagggcacctccatgaggatcagcacccccagtgatggcagcacccccctgaccagcatcctggtgtccaccctgcctgtggccagcagcgaggccagcacagtgtccaccacagctgtggacaccagcatccctgtgaccaccagcacagaggccagcagcagccccaccacagctgaggtgacctccatgcccaccagcacccccagcgagaccagcacccccctgacctccatgcctgtgaaccacacccctgtggccagcagcgaggccggcaccctgagcaccacccctgtggacaccagcacccctgtgaccaccagcaccaaggccagcagcagccccaccacagctgagggcatcgtggtgcccatcagcacagccagcgagggcagcaccctgctgaccagcatccctgtgtccaccacccctgtggccagcagcgaggccagcaccctgagcaccacccctgtggacaccagcatccctgtgaccaccagcacagagggcagcagcagccccaccacagctgagggcacctccatgcccatcagcacccccagcgaggtgtccacccccctgaccagcatcctggtgtccacagtgcctgtggccggcagcgaggccagcaccctgagcaccacccctgtggacaccaggacccctgtgaccaccagcgctgaggccagcagcagccccaccacagctgagggcacctccatgcccatcagcaccccaggagagaggaggacccccctgacctccatgtctgtgtccaccatgcctgtggccagcagcgaggccagcaccctgagcaggaccccagctgacaccagcacccctgtgaccaccagcacagaggccagcagcagccccaccacagctgagggcaccggcatccccatcagcacccccagcgagggcagcacccccctgaccagcatccctgtgtccaccacccctgtggccatccctgaggccagcaccctgagcaccacccctgtggacagcaacagccctgtggtgaccagcacagaggtgagcagcagccccaccccagctgagggcacctccatgcccatcagcacctacagcgagggcagcacccccctgactggagtgcctgtgtccaccacccctgtgaccagcagcgccatcagcaccctgagcaccacccctgtggacaccagcacccctgtgaccaccagcacagaggcccacagcagccccaccaccagcgagggcacctccatgcccaccagcacccccagcgagggcagcacccccctgacctacatgcctgtgtccaccatgctggtggtgtcctctgaggacagcaccctgagcgccacccctgtggacaccagcacccctgtgaccaccagcacagaggccaccagcagcaccacagctgagggcaccagcatccccaccagcacccccagcgagggcatgacccccctgacctctgtgcctgtgagcaacacccctgtggccagcagcgaggccagcatcctgagcaccacccctgtggacagcaacacccccctgaccaccagcacagaggccagcagcagccccccaacagctgagggcacctccatgcccaccagcaccccatctgagggcagcacccccctgacctccatgcctgtgtccaccaccaccgtggccagcagcgagaccagcaccctgagcaccaccccagctgacaccagcacccctgtgaccacctacagccaggccagcagcagcccccccatcgcagatggcacctccatgcccaccagcacctacagcgagggcagcacccccctgaccaacatgtccttcagcaccacccctgtggtgtcctctgaggccagcaccctgagcaccacccctgtggacaccagcacccctgtgaccaccagcacagaggccagcctgagccccaccacagctgagggcaccagcatccccaccagcagccccagcgagggcaccacccccctggcctccatgcctgtgtccaccacccctgtggtgagcagcgaggtgaacaccctgagcaccacccctgtggacagcaacaccctggtgaccaccagcacagaggccagcagcagccccaccatcgccgagggcaccagcctgcccaccagcaccaccagcgagggcagcacccccctgagcatcatgcccctgagcaccacccctgtggccagcagcgaggccagcaccctgagcaccacccctgtggacaccagcacccctgtgaccaccagcagccccaccaacagcagccccaccacagctgaggtgacctccatgcccaccagcacagctggggagggcagcacccccctgaccaacatgcctgtgtccaccacccctgtggccagcagcgaggccagcaccctgagcaccacccctgtggacagcaacacctttgtgaccagcagcagccaggccagcagcagccctgccaccctgcaggtgaccaccatgaggatgagcacccccagcgagggcagcagcagcctgaccaccatgctgctgagcagcacctacgtgaccagcagcgaggccagcacccccagcacccccagcgtggacaggagcacccctgtgaccaccagcacccagagcaacagcacccccaccccacctgaggtgatcaccctgcccatgagcaccccatctgaggtgtccacccccctgaccatcatgcctgtgtccaccacctctgtgaccatcagcgaggccggcacagccagcaccctgcctgtggacaccagcacccctgtgatcaccagcacccaggtgagcagcagccctgtgaccccagagggcaccaccatgcccatctggacccccagcgagggcagcacccccctgaccaccatgcctgtgtccaccaccagggtgaccagcagcgagggcagcaccctgagcacccccagcgtggtgaccagcacccctgtgaccaccagcacagaggccatcagcagcagcgccaccctggacagcaccaccatgtctgtgtccatgcccatggagatcagcaccctgggcaccaccatcctggtgtccaccacccctgtgacccgcttccctgagagcagcacccccagcatccccagcgtgtacacctccatgtccatgaccacagccagcgagggcagcagcagccccaccaccctggagggcaccaccaccatgcccatgagcaccaccagcgagaggagcaccctgctgaccaccgtgctgatcagccccatctctgtgatgagccccagcgaggccagcaccctgagcaccccacctggggacaccagcacccccctgctgaccagcaccaaggccggcagcttcagcatcccagctgaggtgaccaccatccgcatcagcatcaccagcgagaggagcacccccctgaccaccctgctggtgtccaccaccctgcccaccagcttccctggggccagcatcgccagcaccccacccctggacaccagcaccaccttcacccccagcacagacacagccagcacccccaccatccctgtggccaccaccatctctgtgtctgtcatcacagagggcagcaccccaggcaccaccatcttcatccccagcacccctgtgaccagcagcacagcagatgtgtttcctgccaccaccggggctgtgtccacccctgtgatcaccagcacagagctgaacacccccagcaccagcagcagcagcaccaccaccagcttcagcaccaccaaggagttcaccaccccagccatgaccacagctgcccccctgacctacgtgaccatgagcacagcccccagcacccccaggaccaccagccggggctgcaccaccagcgccagcaccctgagcgccaccagcaccccccacaccagcacctctgtgaccaccaggcctgtgacccccagcagcgagagcagccggcccagcaccatcaccagccacaccatcccccccaccttccccccagcccacagcagcaccccacccaccaccagcgccagcagcaccaccgtgaaccctgaggccgtgaccaccatgaccaccaggaccaagcccagcaccaggaccaccagcttccccaccgtgaccaccacagctgtgcccaccaacaccaccatcaagagcaaccccaccagcacccccaccgtgcccaggaccaccacctgctttggagatggctgccagaacacagccagccgctgcaagaatggaggcacctgggatggcctgaagtgccagtgccccaacctgtactatggagagctgtgtgaggaggtggtgagcagcattgacatcggccccccagagaccatcagcgcccagatggagctgactgtgacagtgacctctgtgaagttcacagaggagctgaagaaccacagcagccaggagttccaggagttcaagcagaccttcacagagcagatgaacatcgtgtacagcggcatcccagaatatgtgggcgtgaacatcaccaagctgcggctgggctctgtggtggtggagcatgatgtgctgctgcggaccaagtacaccccagagtacaagacagtgctggacaatgccacagaggtggtgaaggagaagatcaccaaggtgaccacccagcagatcatgatcaatgacatctgcagcgacatgatgtgcttcaacaccaccggcacccaggtgcagaacatcaccgtgacccagtatgaccctgaggaggactgcaggaagatggccaaggagtatggagactactttgtggtggagtacagagaccagaagccctactgcatcagcccctgtgagcccggcttctctgtgtccaagaactgcaacctgggcaagtgccagatgagcctgagcggcccccagtgcctgtgtgtgaccacagagacccactggtacagcggggagacctgcaaccagggcacccagaagagcctggtgtatggcctggtgggcgccggcgtggtgctgatgctgatcatcctggtggccctgctgatgctggtgttccgcagcaagcgggaggtgaagaggcagaagtaccgcctgagccagctgtacaagtggcaggaggaggacagcggccctgcccctggcaccttccagaacatcggctttgacatctgccaggatgatgacagcatccacctggagagcatctacagcaacttccagcccagcctgcggcacattgatcctgagaccaagatccgcatccagaggccccaggtgatgaccaccagcttctag

SEQ ID NO: 160320 - DNA, 843 bp, Artificial Sequence
  Description of Artificial Sequence: Synthetic coding sequence
atgaccacagccctgggcagccagctgagcagcagccagaccgtcatccctggcagcagcggcaccatcagccacaccaccgtggcccctggcagctctgtgacaggcaccaccactggagccagtgatgaccaggtgacaggcagcaagacaggcaccaccggggtggccctgagcaccaccgtggcccctggcagcagcagcacagaggccaccaccagcactggagtgcacaggaccaccgtggtgggccagaagacaggagccaccacccggggcagcgccaagcagggcaccaggagcaccatcgaggccaccaccagcttccggggcaccggcaccactggaagtggcatgaacacaggcaccaccggggtggtgtctggcaacaccatcagccccagcagcttcaacacagaggccaccagcggcaccagcgagcggcccaaccctggcagcgagatcggcaccaccggcatcgtgtctggcaccaccgtggcccctggcagcagcaacacagaggccaccaccagcctgggcaatggaggcaccacagaagctggcagcaagatcgtgaccaccggcatcaccaccggcaccaccatcgtgcccggcagcttcaacaccaaggccaccaccagcacagatgtgggcgtggccactggagtgggcatggccaccggcatcaccaacatcatcagcggccgcagccagcccaccggcagcaagacaggctacacagtgactggaagtggcaccacagccctgcccggcggcttcagaacagacagccccagcttccccctcttcctgatctgcagctaccggggccacaacttctag

SEQ ID NO: 160321 - DNA, 837 bp, Artificial Sequence
  Description of Artificial Sequence: Synthetic coding sequence
cccaccggcacccagacccccacccccacccccatcagcaccaccaccaccgtgacccccacccccacccccaccggcacccagacccccaccaccacccccatcaccaccaccaccaccgtgacccccacccccacccccaccggcacccagacccccaccaccgtgctgatcaccaccaccaccaccatgacccccacccccacccccaccagcaccaagagcaccaccgtgacccccatcaccaccaccaccaccgtgacagccacccccacccccaccggcacccagacccccaccatgatccccatcagcaccaccaccaccgtgacccccacccccacccccaccaccggcagcactggaccacccacccacaccagcacagcccccatcgccgagctgaccaccagcaaccccccacctgagagcagcaccccccagaccagccgcagcaccagcagccccctgacagagagcaccaccctgctgagcaccctgcccccagccatcgagatgaccagcacagccccacccagcacccccacagcccccaccaccaccagcggcggccacaccctgagccccccacccagcaccaccaccagccccccaggcacccccacccggggcaccaccaccggcagcagcagcgcccccacccccagcacagtgcagaccaccaccaccagcgcctggacccccacccccacccccctgagcacccccagcatcatccgcaccaccggcctgcggccctaccccagctctgtgctgatctgctgcgtgctgaatgacacctactatgcccctggagaggaggtgtacaatggatag

SEQ ID NO: 160322 - DNA, 5343 bp, Artificial Sequence
  Description of Artificial Sequence: Synthetic coding sequence
atgggcctgcccctggcccggctggccgctgtgtgcctggccctgagcctggccggcggcagcgagctgcagacagagggccgcaccaggaaccacggccacaacgtgtgcagcacctggggcaacttccactacaagacctttgatggagatgtgttccgcttccctggcctgtgtgactacaactttgccagtgactgccggggcagctacaaggagtttgctgtgcacctgaagaggggccctggccaggccgaggccccagctggggtggagagcatcctgctgaccatcaaggatgacaccatctacctgaccaggcacctggccgtgctgaatggagctgtggtgtccaccccccactacagccctggcctgctgattgagaagagtgatgcctacaccaaggtgtacagcagagctggcctgaccctgatgtggaaccgggaggatgccctgatgctggagctggacaccaagttcaggaaccacacctgtggcctgtgtggggactacaacggcctgcagagctacagcgagttcctgagtgatggagtgctcttcagccccctggagtttggaaacatgcagaagatcaaccagccagatgtggtgtgtgaagatcctgaggaggaggtggccccagccagctgcagcgagcacagagcagaatgtgagcggctgctgacagctgaggcctttgctgactgccaggacctggtgcccctggagccctacctgcgggcctgccagcaggaccgctgccgctgccctggaggagacacctgtgtgtgcagcacagtggccgagttcagccggcagtgcagccacgccggcggccggcccggcaactggaggacagccaccctgtgccccaagacctgccccggcaacctggtgtacctggagagcggcagcccctgcatggacacctgcagccacctggaggtgagcagcctgtgtgaggagcacaggatggatggctgcttctgcccagagggcaccgtgtatgatgacatcggggacagcggctgtgtgcctgtgtcccagtgccactgccgcctgcacggccacctgtacaccccaggccaggagatcaccaatgactgtgagcagtgtgtgtgcaatgccggccgctgggtgtgcaaggacctgccctgccccggcacctgtgccctggagggcggcagccacatcaccacctttgatggcaagacctacaccttccacggggactgctactacgtgctggccaagggggaccacaatgacagctatgccctgctgggggagctggccccctgtggcagcacagacaagcagacctgcctgaagacagtggtgctgctggccgacaagaagaagaatgtggtggtgttcaagagtgatggctctgtgctgctgaatgagctgcaggtgaacctgccccacgtgacagccagcttctctgtgttccggcccagcagctaccacatcatggtgtccatggccatcggcgtgcggctgcaggtgcagctggcccctgtgatgcagctgtttgtgaccctggaccaggccagccagggccaggtgcagggcctgtgtggcaacttcaacggcctggagggagatgacttcaagacagccagcggcctggtggaggccactggagctggctttgccaacacctggaaggcccagagcagctgccacgacaagctggactggctggatgacccctgcagcctgaacatcgagagcgccaactatgcagagcactggtgcagcctgctgaagaagacagagacccccttcggccgctgccacagcgctgtggaccctgctgagtactacaagcgctgcaagtatgacacctgcaactgccagaacaatgaagactgcctgtgtgccgccctgagcagctatgcccgggcctgcacagccaagggcgtgatgctgtggggctggagggagcacgtgtgcaacaaggatgtgggcagctgccccaacagccaggtgttcctgtacaacctgaccacctgccagcagacctgccgcagcctgtctgaggccgacagccactgcctggagggctttgcccctgtggatggctgcggctgcccagaccacaccttcctggatgagaagggccgctgtgtgcccctggccaagtgcagctgctaccaccggggcctgtacctggaggccggagatgtggtggtgcggcaggaggagcgctgtgtgtgcagagatggccgcctgcactgccggcagatccggctgattggccagagctgcacagcccccaagatccacatggactgcagcaacctgacagccctggccaccagcaagccccgggccctgagctgccagaccctggccgccggctactaccacacagaatgtgtgtctggctgtgtgtgcccagatggcctgatggatgatggccggggcggctgtgtggtggagaaggaatgtccctgtgtgcacaacaatgacctgtacagcagcggggccaagatcaaggtggactgcaacacctgcacctgcaagaggggccgctgggtgtgcacccaggccgtgtgccacggcacctgcagcatctacggcagcggccactacatcacctttgatggcaagtactatgactttgatggccactgcagctatgtggccgtgcaggactactgcggccagaacagcagcctgggcagcttcagcatcatcacagaaaatgtgccctgtggcaccaccggggtgacctgcagcaaggccatcaagatcttcatgggccgcacagagctgaagctggaggacaagcaccgggtggtgatccagagagatgagggccaccacgtggcctacaccacccgggaggtgggccagtacctggtggtggagagcagcacaggcatcatcgtcatctgggacaagaggaccaccgtcttcatcaagctggcccccagctacaagggcaccgtgtgtggcctgtgtggcaactttgaccacaggagcaacaatgacttcaccacccgggaccacatggtggtgtcctctgagctggactttggaaacagctggaaggaggcccccacctgcccagatgtgtccaccaaccctgagccctgcagcctgaacccccacagaagatcctgggccgagaagcagtgcagcatcctgaagagctctgtgttcagcatctgccacagcaaggtggaccccaagcccttctatgaggcctgtgtgcatgacagctgcagctgtgacaccggcggggactgtgagtgcttctgcagcgctgtggccagctatgcccaggagtgcaccaaggagggcgcctgtgtgttctggaggaccccagacctgtgccccatcttctgtgactactacaacccccctcatgaatgtgagtggcactatgagccctgtggcaacagaagctttgagacctgcaggaccatcaatggcatccacagcaacatctctgtgtcctacctggagggctgctacccccgctgccccaaggaccggcccatctatgaggaggacctgaagaagtgtgtgacagctgacaagtgtggctgctacgtggaggacacccactacccacctggggcctctgtgcccacagaggagacctgcaagtcctggtgcacctgcacccagacccacacagcctaccacgtgcacacccacggcaagatcctgaaccagacccaggatggagccttctgctactgggagatctgtggccccaatggaacagtggagaagcacttcaacatctgcagcatcaccacccggcccagcaccctgaccaccttcaccaccatcaccctgcccaccacccccaccaccttcaccaccaccaccaccaccaccacccccaccagcagcacagtgctgagcaccacccccaagctgtgctgcctgtggagcgactggatcaatgaagaccaccccagcagcggcagtgatgatggagaccgggagacctttgatggagtgtgtggggccccagaagatattgagtgccgctctgtgaaggacccccacctgagcctggagcagctgggccagaaggtgcagtgtgatgtgtctgtgggcttcatctgcaagaatgaagaccagtttggaaatggccccttcggcctgtgctatgactacaagatccgggtgaactgctgctggcccatggacaagtgcatcaccacccccagcccccccaccaccacccccagccccccacccaccagcaccaccaccctgccccccaccaccacccccagcccccccaccaccaccaccaccaccccaccacccaccaccacccccagcccccccatcaccaccaccaccaccccaccacccaccaccacccccagcccccccatcagcaccaccaccaccccaccacccaccaccacccccagcccccccaccaccacccccagcccccccaccaccacccccagcccccccaccaccaccaccaccaccccaccacccaccaccacccccagcccccccaccaccacccccatcaccccaccagccagcaccaccaccctgccccccaccaccacccccagcccccccaccaccaccaccaccaccccaccacccaccaccacccccatcaccaccaccaccaccgtgacccccacccccacccccaccggcacccagacccccaccaccacccccatcaccaccaccaccaccgtgacccccacccccacccccaccggcacccagacccccaccagcacccccatcaccaccaccaccaccacccccacccccacagccatcaccaccaccaccaccgtgacccccacccccacccccaccggcacccagacccccaccaccacccccatcaccaccaccaccaccgtgacccccacccccacccccaccggcacccagagccccacccccacagccatcaccaccaccaccaccgtgacccccacccccacccccaccggcacccagacccccaccagcacccccatcaccaccaccaccaccgtgacccccacccccacccccaccggcacccagacccccacccccacccccatcagcaccaccaccaccgtgacccccacccccacccccaccggcacccagacccccaccaccacccccatcaccaccaccaccaccgtgacccccacccccacccccaccggcacccagacccccaccaccacccccacccccaccagcaccaagagcaccaccgtgacccccatcaccaccaccaccaccgtgacagccacccccacccccaccggcacccagacccccaccatgatccccatcagcaccaccaccaccgtgaccccctag

SEQ ID NO: 160323 - DNA, 1230 bp, Artificial Sequence
  Description of Artificial Sequence: Synthetic coding sequence
gacattgaatgtagatctgtgaaggacccccacctgagcctggagcagctgggccagaaggtgcagtgtgatgtgtctgtgggcttcatctgcaagaatgaagaccagtttggaaatggccccttcggcctgtgctatgactacaagatccgggtgaactgctgctgcacccccacccggggcaccaccaccggcagcagcagcgcccccacccccagcacagtgcagaccaccaccaccagcgcctggacccccacccccacccccctgagcacccccagcatcatccgcaccaccggcctgcggccctaccccagctctgtgctgatctgctgcgtgctgaatgacacctactatgcccctggagaggaggtgtacaacggcacctacggggacacctgctactttgtgaactgcagcctgagctgcaccctggagttctacaactggagctgccccagcacccccagccccacccccacccccagcaagagcacccccacccccagcaagcccagcagcacccccagcaagcccaccccaggcaccaagcccccagaatgtcctgactttgatcctccccggcaggagaatgagacctggtggctgtgtgactgcttcatggccacctgcaagtacaacaacacagtggagatcgtgaaggtggagtgtgagcccccacccatgcccacctgcagcaatggcctgcagcctgtgcgggtggaggaccctgatggctgctgctggcactgggagtgtgactgctactgcaccggctggggagacccccactacgtgacctttgatggcctgtactacagctaccagggcaactgcacctacgtgctggtggaggagatcagccccagcgtggacaactttggagtgtacatcgacaactaccactgtgaccccaatgacaaggtgtcctgccccaggaccctcatcgtgagacatgagacccaggaggtgctgatcaagacagtgcacatgatgcccatgcaggtgcaggtgcaggtgaaccggcaggccgtggccctgccctacaagaagtatggcctggaggtgtaccagagcggcatcaactacgtggtggacatccctgagctgggcgtgctggtgtcctacaacggcctgtccttctctgtgcggctgccctaccaccgcttcggcaacaacaccaagggccagtgtggcacctgcaccaacaccaccagtgatgactgctag

SEQ ID NO: 160324 - DNA, 8454 bp, Artificial Sequence
  Description of Artificial Sequence: Synthetic coding sequence
atgggcctgcccctggcccggctggccgctgtgtgcctggccctgagcctggccggcggcagcgagctgcagacagagggccgcaccaggaaccacggccacaacgtgtgcagcacctggggcaacttccactacaagacctttgatggagatgtgttccgcttccctggcctgtgtgactacaactttgccagtgactgccggggcagctacaaggagtttgctgtgcacctgaagaggggccctggccaggccgaggccccagctggggtggagagcatcctgctgaccatcaaggatgacaccatctacctgaccaggcacctggccgtgctgaatggagctgtggtgtccaccccccactacagccctggcctgctgattgagaagagtgatgcctacaccaaggtgtacagcagagctggcctgaccctgatgtggaaccgggaggatgccctgatgctggagctggacaccaagttcaggaaccacacctgtggcctgtgtggggactacaacggcctgcagagctacagcgagttcctgagtgatggagtgctcttcagccccctggagtttggaaacatgcagaagatcaaccagccagatgtggtgtgtgaagatcctgaggaggaggtggccccagccagctgcagcgagcacagagcagaatgtgagcggctgctgacagctgaggcctttgctgactgccaggacctggtgcccctggagccctacctgcgggcctgccagcaggaccgctgccgctgccctggaggagacacctgtgtgtgcagcacagtggccgagttcagccggcagtgcagccacgccggcggccggcccggcaactggaggacagccaccctgtgccccaagacctgccccggcaacctggtgtacctggagagcggcagcccctgcatggacacctgcagccacctggaggtgagcagcctgtgtgaggagcacaggatggatggctgcttctgcccagagggcaccgtgtatgatgacatcggggacagcggctgtgtgcctgtgtcccagtgccactgccgcctgcacggccacctgtacaccccaggccaggagatcaccaatgactgtgagcagtgtgtgtgcaatgccggccgctgggtgtgcaaggacctgccctgccccggcacctgtgccctggagggcggcagccacatcaccacctttgatggcaagacctacaccttccacggggactgctactacgtgctggccaagggggaccacaatgacagctatgccctgctgggggagctggccccctgtggcagcacagacaagcagacctgcctgaagacagtggtgctgctggccgacaagaagaagaatgtggtggtgttcaagagtgatggctctgtgctgctgaatgagctgcaggtgaacctgccccacgtgacagccagcttctctgtgttccggcccagcagctaccacatcatggtgtccatggccatcggcgtgcggctgcaggtgcagctggcccctgtgatgcagctgtttgtgaccctggaccaggccagccagggccaggtgcagggcctgtgtggcaacttcaacggcctggagggagatgacttcaagacagccagcggcctggtggaggccactggagctggctttgccaacacctggaaggcccagagcagctgccacgacaagctggactggctggatgacccctgcagcctgaacatcgagagcgccaactatgcagagcactggtgcagcctgctgaagaagacagagacccccttcggccgctgccacagcgctgtggaccctgctgagtactacaagcgctgcaagtatgacacctgcaactgccagaacaatgaagactgcctgtgtgccgccctgagcagctatgcccgggcctgcacagccaagggcgtgatgctgtggggctggagggagcacgtgtgcaacaaggatgtgggcagctgccccaacagccaggtgttcctgtacaacctgaccacctgccagcagacctgccgcagcctgtctgaggccgacagccactgcctggagggctttgcccctgtggatggctgcggctgcccagaccacaccttcctggatgagaagggccgctgtgtgcccctggccaagtgcagctgctaccaccggggcctgtacctggaggccggagatgtggtggtgcggcaggaggagcgctgtgtgtgcagagatggccgcctgcactgccggcagatccggctgattggccagagctgcacagcccccaagatccacatggactgcagcaacctgacagccctggccaccagcaagccccgggccctgagctgccagaccctggccgccggctactaccacacagaatgtgtgtctggctgtgtgtgcccagatggcctgatggatgatggccggggcggctgtgtggtggagaaggaatgtccctgtgtgcacaacaatgacctgtacagcagcggggccaagatcaaggtggactgcaacacctgcacctgcaagaggggccgctgggtgtgcacccaggccgtgtgccacggcacctgcagcatctacggcagcggccactacatcacctttgatggcaagtactatgactttgatggccactgcagctatgtggccgtgcaggactactgcggccagaacagcagcctgggcagcttcagcatcatcacagaaaatgtgccctgtggcaccaccggggtgacctgcagcaaggccatcaagatcttcatgggccgcacagagctgaagctggaggacaagcaccgggtggtgatccagagagatgagggccaccacgtggcctacaccacccgggaggtgggccagtacctggtggtggagagcagcacaggcatcatcgtcatctgggacaagaggaccaccgtcttcatcaagctggcccccagctacaagggcaccgtgtgtggcctgtgtggcaactttgaccacaggagcaacaatgacttcaccacccgggaccacatggtggtgtcctctgagctggactttggaaacagctggaaggaggcccccacctgcccagatgtgtccaccaaccctgagccctgcagcctgaacccccacagaagatcctgggccgagaagcagtgcagcatcctgaagagctctgtgttcagcatctgccacagcaaggtggaccccaagcccttctatgaggcctgtgtgcatgacagctgcagctgtgacaccggcggggactgtgagtgcttctgcagcgctgtggccagctatgcccaggagtgcaccaaggagggcgcctgtgtgttctggaggaccccagacctgtgccccatcttctgtgactactacaacccccctcatgaatgtgagtggcactatgagccctgtggcaacagaagctttgagacctgcaggaccatcaatggcatccacagcaacatctctgtgtcctacctggagggctgctacccccgctgccccaaggaccggcccatctatgaggaggacctgaagaagtgtgtgacagctgacaagtgtggctgctacgtggaggacacccactacccacctggggcctctgtgcccacagaggagacctgcaagagctgtgtgtgcaccaacagcagccaggtggtgtgcaggcctgaggagggcaagatcctgaaccagacccaggatggagccttctgctactgggagatctgtggccccaacggcaccgtggagaagcacttcaacatctgcagcatcaccacccggcccagcaccctgaccaccttcaccaccatcaccctgcccaccacccccaccaccttcaccaccaccaccaccaccaccacccccaccagcagcacagtgctgagcaccacccccaagctgtgctgcctgtggagcgactggatcaatgaagaccaccccagcagcggcagtgatgatggagaccgggagacctttgatggagtgtgtggggcccctgaggacattgaatgtagatctgtgaaggacccccacctgagcctggagcagctgggccagaaggtgcagtgtgatgtgtctgtgggcttcatctgcaagaatgaagaccagtttggaaatggccccttcggcctgtgctatgactacaagatccgggtgaactgctgctggcccatggacaagtgcatcaccacccccagcccccccaccaccacccccagccccccacccaccagcaccaccaccctgccccccaccaccacccccagcccccccaccaccaccaccaccaccccaccacccaccaccacccccagcccccccatcaccaccaccaccaccccaccacccaccaccacccccagcccccccatcagcaccaccaccaccccaccacccaccaccacccccagcccccccaccaccacccccagcccccccaccaccacccccagcccccccaccaccaccaccaccaccccaccacccaccaccacccccagcccccccaccaccacccccatcaccccaccagccagcaccaccaccctgccccccaccaccacccccagcccccccaccaccaccaccaccaccccaccacccaccaccacccccatcaccaccaccaccaccgtgacccccacccccacccccaccggcacccagacccccaccaccacccccatcaccaccaccaccaccgtgacccccacccccacccccaccggcacccagacccccaccagcacccccatcaccaccaccaccaccgtgacccccacccccacccccaccggcacccagacccccaccaccacccccatcaccaccaccaccaccgtgacccccacccccacccccaccggcacccagacccccacccccacagccatcaccaccaccaccaccgtgacccccacccccacccccaccggcacccagacccccaccaccacccccatcaccaccaccaccaccgtgacccccacccccacccccaccggcacccagagccccacccccacagccatcaccaccaccaccaccgtgacccccacccccacccccaccggcacccagacccccaccagcacccccatcaccaccaccaccaccgtgacccccacccccacccccaccggcacccagacccccacccccacccccatcagcaccaccaccaccgtgacccccacccccacccccaccggcacccagacccccaccaccacccccatcaccaccaccaccaccgtgacccccacccccacccccaccggcacccagacccccaccaccgtgctgatcaccaccaccaccaccatgacccccacccccacccccaccagcaccaagagcaccaccgtgacccccatcaccaccaccaccaccgtgacagccacccccacccccaccggcacccagacccccaccatgatccccatcagcaccaccaccaccgtgacccccacccccacccccaccaccggcagcactggaccacccacccacaccagcacagcccccatcgccgagctgaccaccagcaaccccccacctgagagcagcaccccccagaccagccgcagcaccagcagccccctgacagagagcaccaccctgctgagcaccctgcccccagccatcgagatgaccagcacagccccacccagcacccccacagcccccaccaccaccagcggcggccacaccctgagccccccacccagcaccaccaccagccccccaggcacccccacccggggcaccaccaccggcagcagcagcgcccccacccccagcacagtgcagaccaccaccaccagcgcctggacccccacccccacccccctgagcacccccagcatcatccgcaccaccggcctgcggccctaccccagctctgtgctgatctgctgcgtgctgaatgacacctactatgcccctggagaggaggtgtacaacggcacctacggggacacctgctactttgtgaactgcagcctgagctgcaccctggagttctacaactggagctgccccagcacccccagccccacccccacccccagcaagagcacccccacccccagcaagcccagcagcacccccagcaagcccaccccaggcaccaagcccccagaatgtcctgactttgatcctccccggcaggagaatgagacctggtggctgtgtgactgcttcatggccacctgcaagtacaacaacacagtggagatcgtgaaggtggagtgtgagcccccacccatgcccacctgcagcaatggcctgcagcctgtgcgggtggaggaccctgatggctgctgctggcactgggagtgtgactgctactgcaccggctggggagacccccactacgtgacctttgatggcctgtactacagctaccagggcaactgcacctacgtgctggtggaggagatcagccccagcgtggacaactttggagtgtacatcgacaactaccactgtgaccccaatgacaaggtgtcctgccccaggaccctcatcgtgagacatgagacccaggaggtgctgatcaagacagtgcacatgatgcccatgcaggtgcaggtgcaggtgaaccggcaggccgtggccctgccctacaagaagtatggcctggaggtgtaccagagcggcatcaactacgtggtggacatccctgagctgggcgtgctggtgtcctacaacggcctgtccttctctgtgcggctgccctaccaccgcttcggcaacaacaccaagggccagtgtggcacctgcaccaacaccaccagtgatgactgcatcctgcccagcggggagatcgtgagcaactgtgaggccgctgctgaccagtggctggtgaatgaccccagcaagccccactgcccccacagcagcagcaccaccaagaggcctgctgtgacagtgcctgggggcggcaagaccaccccccacaaggactgcacccccagccccctgtgccagctgatcaaggacagcctgtttgcccagtgccacgccctggtgcccccccagcactactatgatgcctgtgtgtttgacagctgcttcatgcctggcagcagcctggagtgtgccagcctgcaggcctatgctgccctgtgtgcccagcagaacatctgcctggactggaggaaccacacccatggagcctgcctggtggagtgccccagccaccgggagtaccaggcctgtggccctgctgaggagcccacctgcaagagcagcagcagccagcagaacaacacagtgctggtggagggctgcttctgcccagagggcaccatgaactatgcccctggctttgatgtgtgtgtgaagacctgtggctgtgtgggccctgacaacgtgccccgggagtttggagagcactttgaatttgactgcaagaactgtgtgtgcctggagggcggcagcggcatcatctgccagcccaagcgctgcagccagaagcctgtgacccactgtgtggaggatggcacctacctggccacagaggtgaacccagctgacacctgctgcaacatcaccgtgtgcaagtgcaacaccagcctgtgcaaggagaagcccagcgtgtgccccctgggctttgaggtgaagagcaagatggtgcccggccgctgctgccccttctactggtgtgagagcaaaggagtgtgtgtgcacggcaatgctgagtaccagcccggcagccctgtgtacagcagcaagtgccaggactgtgtgtgcacagacaaggtggacaacaacaccctgctgaatgtcatcgcctgcacccacgtgccctgcaacaccagctgcagccctggctttgagctgatggaggcccctggagagtgctgcaagaagtgtgagcagacccactgcatcatcaagaggccagacaaccagcacgtgatcctgaagccaggggacttcaagagtgaccccaagaacaactgcaccttcttcagctgtgtgaagatccacaaccagctgatcagctctgtgagcaacatcacctgccccaactttgatgccagcatctgcatccctggcagcatcaccttcatgcccaacggctgctgcaagacctgcaccccaagaaatgagaccagggtgccctgcagcacagtgcctgtgaccacagaggtgtcctatgccggctgcaccaagacagtgctgatgaaccactgcagcggcagctgtggcacctttgtgatgtacagcgccaaggcccaggccctggaccacagctgcagctgctgcaaggaggagaagaccagccagcgggaggtggtgctgagctgccccaacggcggcagcctgacccacacctacacccacatcgagagctgccagtgccaggacacagtgtgtggcctgcccaccggcaccagcagaagagcccggcgcagccccaggcacctgggcagcggctag

SEQ ID NO: 160325 - DNA, 2631 bp, Artificial Sequence
  Description of Artificial Sequence: Synthetic coding sequence
atctacagcacagtgtccaccagcaccacagccatcaccagccacttcaccaccagcgagacagctgtgacccccacccctgtgacccccagcagcctgagcacagacatccccaccaccagcctgcggaccctgacccccagctctgtgggcaccagcaccagcctgaccaccaccacagacttccccagcatccccacagacatcagcaccctgcccaccaggacccacatcatcagcagcagccccagcatccagagcacagagaccagcagcctggtgggcaccaccagccccaccatgagcacagtgaggatgaccctgcgcatcacagagaacacccccatcagcagcttcagcaccagcatcgtggtgattcctgagacccccacccagaccccacctgtgctgaccagcgccaccggcacccagaccagccctgcccccaccaccgtgaccttcggcagcacagacagcagcaccagcaccctgcacaccctgacccccagcacagccctgagcaccatcgtgtccaccagccaggtgcccatccccagcacccacagcagcaccctgcagaccacccccagcacccccagcctgcagaccagcctgaccagcaccagcgagttcaccacagagagcttcacccggggcagcaccagcaccaatgccatcctgaccagcttcagcaccatcatctggagcagcacccccaccatcatcatgagcagcagccccagcagcgccagcatcacccctgtgttcagcaccaccatccacagcgtgcccagcagcccctacatcttcagcacagaaaatgtgggcagcgccagcatcaccggcttccccagcctgagcagcagcgccaccaccagcaccagcagcaccagcagcagcctgaccacagccctgacagagatcacccccttctcctacatcagcctgcccagcaccaccccctgccccggcaccatcaccatcaccatcgtgcctgccagccccacagacccctgtgtggagatggaccccagcacagaggccaccagcccccccaccacccccctgactgtgttccccttcaccacagagatggtgacctgccccaccagcatcagcatccagaccaccctgaccacctacatggacaccagctccatgatgcctgagagcgagagcagcatcagccccaatgccagcagcagcactggaactggaacagtgcccaccaacacagtgttcaccagcacccggctgcccaccagcgagacctggctgagcaacagcagcgtcatccccctgcccctgcccggggtgtccaccatccccctgaccatgaagcccagcagcagcctgcccaccatcctgcggaccagcagcaagagcacccaccccagcccccccaccaccaggaccagcgagacccctgtggccaccacccagacccccaccaccctgaccagcaggaggaccacccgcatcaccagccagatgaccacccagagcaccctgaccaccacagctggcacctgtgacaatggaggcacctgggagcagggccagtgtgcctgcctgcccggcttcagcggggaccgctgccagctgcagacccgctgccagaatggaggccagtgggatggcctgaagtgccagtgccccagcaccttctacggcagcagctgtgaatttgctgtggagcaggtggacctggatgtggtggagacagaggtgggcatggaggtgtctgtggaccagcagttctccccagacctgaatgacaacaccagccaggcctacagagacttcaacaagaccttctggaaccagatgcagaagatctttgctgacatgcagggcttcaccttcaagggcgtggagatcctgagcctgagaaatggcagcatcgtggtggactacctggtgctgctggagatgcccttcagcccccagctggagagtgaatatgagcaggtgaagaccaccctgaaggagggcctgcagaatgccagccaggatgccaacagctgccaggacagccagaccctgtgcttcaagccagacagcatcaaggtgaacaacaacagcaagacagagctgaccccagaggccatctgccggcgggccgcccccaccggctatgaggagttctacttccccctggtggaggccacccggctgcgctgtgtgaccaagtgcaccagcggcgtggacaatgccatcgactgccaccagggccagtgtgtgctggagaccagcggccctgcctgccgctgctacagcacagacacccactggttcagcggcccccgctgtgaggtggccgtgcactggagggccctggtgggcggcctgacagctggggccgccctgctggtgctgctgctgctggccctgggcgtgcgggctgtgcgcagcggctggtggggcggccagaggcggggccgctcctgggaccaggacaggaagtggtttgagacctgggatgaggaggtggtgggcaccttcagcaactggggctttgaagatgatggaacagacaaggacaccaacttccacgtggccctggagaatgtggacaccaccatgaaggtgcacatcaagaggcctgagatgaccagcagctctgtgtag

SEQ ID NO: 160326 - DNA, 927 bp, Artificial Sequence
  Description of Artificial Sequence: Synthetic coding sequence
tgtgacaatggaggcacctgggagcagggccagtgtgcctgcctgcccggcttcagcggggaccgctgccagctgcagacccgctgccagaatggaggccagtgggatggcctgaagtgccagtgccccagcaccttctacggcagcagctgtgaatttgctgtggagcaggtggacctggatgtggtggagacagaggtgggcatggaggtgtctgtggaccagcagttctccccagacctgaatgacaacaccagccaggcctacagagacttcaacaagaccttctggaaccagatgcagaagatctttgctgacatgcagggcttcaccttcaagggcgtggagatcctgagcctgagaaatggcagcatcgtggtggactacctggtgctgctggagatgcccttcagcccccagctggagagtgaatatgagcaggtgaagaccaccctgaaggagggcctgcagaatgccagccaggatgccaacagctgccaggacagccagaccctgtgcttcaagccagacagcatcaaggtgaacaacaacagcaagacagagctgaccccagaggccatctgccggcgggccgcccccaccggctatgaggagttctacttccccctggtggaggccacccggctgcgctgtgtgaccaagtgcaccagcggcgtggacaatgccatcgactgccaccagggccagtgtgtgctggagaccagcggccctgcctgccgctcctgggaccaggacaggaagtggtttgagacctgggatgaggaggtggtgggcaccttcagcaactggggctttgaagatgatggaacagacaaggacaccaacttccacgtggccctggagaatgtggacaccaccatgaaggtgcacatcaagaggcctgagatgaccagcagctctgtgtag

SEQ ID NO: 160327 - DNA, 3531 bp, Artificial Sequence
  Description of Artificial Sequence: Synthetic coding sequence
atgaagggggcccgctggaggagagtgccctgggtgtccctgagctgcctgtgcctgtgcctgctgccccacgtggtgcccggcatgaccacccccagcctgaagacagatggcggccgcaggacagccaccagccccccacccaccaccagccagaccatcatcagcaccatccccagcacagccatgcacaccaggagcacagctgcccccatccccatcctgcctgagcggggcgtgtccctcttcccctatggagctggagctggggacctggagtttgtgcggaggacagtggacttcaccagccccctcttcaagccagccaccggcttccccctgggcagcagcctgcgggacagcctgtacttcacagacaatggccagatcatcttccctgagagtgactaccagatcttctcctaccccaaccccctgcccaccggcttcaccggccgggaccctgtggccctggtggcccccttctgggatgatgctgacttcagcacaggccggggcaccaccttctaccaggagtatgagaccttctacggggagcacagcctgctggtgcagcaggccgagagctggatcaggaagatgaccaacaacggcggctacaaggcccgctgggccctgaaggtgacctgggtgaatgcccacgcctacccagcccagtggaccctgggcagcaacacctaccaggccatcctgagcacagatggcagccgctcctatgccctcttcctgtaccagagcggcggcatgcagtgggatgtggcccagaggagcggcaaccctgtgctgatgggcttcagcagtggagatggctactttgagaacagccccctgatgagccagcctgtgtgggagcgctacagaccagaccgcttcctgaacagcaacagcggcctgcagggcctgcagttctaccgcctgcaccgggaggagcggcccaactaccgcctggagtgcctgcagtggctgaagagccagccccgctggcccagctggggctggaaccaggtgtcctgcccctgctcctggcagcagggcagaagagacctgcgcttccagcctgtgtccatcggccgctggggcctgggcagccggcagctgtgcagcttcacctcctggaggggcggcgtgtgctgcagctatggcccctggggcgagttccgggagggctggcacgtgcagaggccctggcagctggcccaggagctggagccccagagctggtgctgccgctggaatgacaagccctacctgtgtgccctgtaccagcagaggcggccccacgtgggctgtgccacctaccggcccccccagcctgcctggatgtttggagacccccacatcaccaccctggatggagtgtcctacaccttcaacggcctgggggacttcctgctggtgggcgcccaggacggcaacagcagcttcctgctgcagggccgcacagcccagacaggcagcgcccaggccaccaacttcatcgcctttgctgcccagtaccgcagcagcagcctgggccctgtgacagtgcagtggctgctggagccccatgatgccatccgggtgctgctggacaaccagacagtgaccttccagcctgaccatgaagatggcggcggccaggagaccttcaatgccactggagtgctgctgagcagaaatggcagcgaggtgtctgccagctttgatggctgggccaccgtgtctgtgattgccctgagcaacatcctgcacgccagcgccagcctgcccccagagtaccagaacagaacagagggcctgctgggcgtgtggaacaacaacccagaagatgacttcaggatgcccaacggcagcaccatccccccaggcagccctgaggagatgctgttccacttcggcatgacctggcagatcaatggaacaggcctgctgggcaagagaaatgaccagctgcccagcaacttcacccctgtgttctacagccagctgcagaagaacagctcctgggccgagcacctgatcagcaactgtgatggagacagcagctgcatctatgacaccctggccctgagaaatgccagcatcggcctgcacacccgggaggtgtccaagaactatgagcaggccaatgccaccctgaaccagtacccacccagcatcaatggaggccgggtcatcgaggcctacaagggccagaccaccctcatccagtacaccagcaatgcagaagatgccaacttcaccctgcgggacagctgcacagacctggagctgtttgaaaatggcaccctgctgtggacccccaagagcctggagcccttcaccctggagatcctggcccggagcgccaagattggcctggccagcgccctgcagcccaggacagtggtgtgccactgcaatgctgagagccagtgcctgtacaaccagaccagccgggtgggcaacagcagcctggaggtggccggctgcaagtgtgatggcggcaccttcggccgctactgtgagggctctgaagatgcctgtgaggagccctgcttccccagcgtgcactgtgtgcctgggaagggctgtgaggcctgcccccccaacctgactggagatggccgccactgtgccgccctgggcagcagcttcctgtgccagaaccagagctgccctgtgaactactgctacaaccagggccactgctacatcagccagaccctgggctgccagcccatgtgcacctgccccccagccttcacagacagccgctgcttcctggccggcaacaacttcagccccaccgtgaacctggagctgcccctgcgggtcatccagctgctgctgtctgaggaggagaatgcctccatggccgaggtgaatgcctctgtggcctaccgcctgggcaccctggacatgagggccttcctgaggaacagccaggtggagagaattgacagcgctgccccagccagcggcagccccatccagcactggatggtgatcagcgagttccagtaccggccccggggccctgtgattgacttcctgaacaaccagctgctggccgctgtggtggaggccttcctgtaccacgtgccccggcgctctgaggagcccagaaatgatgtggtgttccagcccatctctggagaagatgtgagagatgtgacagccctgaatgtgtccaccctgaaggcctacttccgctgtgatggctacaagggctatgacctggtgtacagcccccagagcggcttcacctgtgtgagcccctgcagccggggctactgtgaccatggaggccagtgccagcacctgcccagcggcccccgctgcagctgtgtgtccttcagcatctacacagcctggggcgagcactgtgagcacctgtccatgaagctggatgccttcttcggcatcttcttcggggccctgggcggcctgctgctgctgggcgtgggcacctttgtggtgctgcgcttctggggctgcagcggggcccgcttctcctacttcctgaacagcgctgaggccctgccctag

SEQ ID NO: 160328 - DNA, 3378 bp, Artificial Sequence
  Description of Artificial Sequence: Synthetic coding sequence
atgaagggggcccgctggaggagagtgccctgggtgtccctgagctgcctgtgcctgtgcctgctgccccacgtggtgcctggggtgtccctcttcccctacggggccggggccggggacctggagtttgtgagaagaacagtggacttcaccagccccctcttcaagccagccaccggcttccccctgggcagcagcctgcgggacagcctgtacttcacagacaatggccagatcatcttccctgagagtgactaccagatcttctcctaccccaaccccctgcccaccggcttcaccggccgggaccctgtggccctggtggcccccttctgggatgatgctgacttcagcacaggccggggcaccaccttctaccaggagtatgagaccttctatggagagcacagcctgctggtgcagcaggccgagagctggatcaggaagatgaccaacaatggaggctacaaggcccgctgggccctgaaggtgacctgggtgaatgcccacgcctacccagcccagtggaccctgggcagcaacacctaccaggccatcctgagcacagatggcagccgctcctatgccctcttcctgtaccagagcggcggcatgcagtgggatgtggcccagaggagcggcaaccctgtgctgatgggcttcagcagtggagatggctactttgagaacagccccctgatgagccagcctgtgtgggagcgctacagaccagaccgcttcctgaacagcaacagcggcctgcagggcctgcagttctaccgcctgcaccgggaggagcggcccaactaccgcctggagtgcctgcagtggctgaagagccagccccgctggcccagctggggctggaaccaggtgtcctgcccctgctcctggcagcagggccggcgggacctgcgcttccagcctgtgtccatcggccgctggggcctgggcagccggcagctgtgcagcttcacctcctggagaggaggagtgtgctgcagctatggcccctggggcgagttccgggagggctggcacgtgcagaggccctggcagctggcccaggagctggagccccagagctggtgctgccgctggaatgacaagccctacctgtgtgccctgtaccagcagaggcggccccacgtgggctgtgccacctacagaccaccccagcctgcctggatgtttggagacccccacatcaccaccctggatggagtgtcctacaccttcaacggcctgggggacttcctgctggtgggcgcccaggacggcaacagcagcttcctgctgcagggccgcacagcccagacaggcagcgcccaggccaccaacttcatcgcctttgctgcccagtaccgcagcagcagcctgggccctgtgacagtgcagtggctgctggagccccatgatgccatccgggtgctgctggacaaccagacagtgaccttccagcctgaccatgaagatggcggcggccaggagaccttcaatgccaccggggtgctgctgagcagaaatggaagtgaggtgtctgccagctttgatggctgggccaccgtgtctgtcatcgccctgagcaacatcctgcacgccagcgccagcctgcccccagagtaccagaacagaacagagggcctgctgggcgtgtggaacaacaacccagaagatgacttcaggatgcccaacggcagcaccatccccccaggcagccctgaggagatgctgttccacttcggcatgacctggcagatcaatggcaccggcctgctgggcaagagaaatgaccagctgcccagcaacttcacccctgtgttctacagccagctgcagaagaacagctcctgggccgagcacctgatcagcaactgtgatggagacagcagctgcatctatgacaccctggccctgagaaatgccagcatcggcctgcacacccgggaggtgtccaagaactatgagcaggccaatgccaccctgaaccagtacccacccagcatcaatggaggccgggtgattgaggcctacaagggccagaccaccctcatccagtacaccagcaatgcagaagatgccaacttcaccctgcgggacagctgcacagacctggagctgtttgaaaatggcaccctgctgtggacccccaagagcctggagcccttcaccctggagatcctggcccggagcgccaagattggcctggccagcgccctgcagcccaggacagtggtgtgccactgcaatgctgagagccagtgcctgtacaaccagaccagccgggtgggcaacagcagcctggaggtggccggctgcaagtgtgatggcggcaccttcggccgctactgtgagggctctgaagatgcctgtgaggagccctgcttccccagcgtgcactgtgtgcctgggaagggctgtgaggcctgcccccccaacctgactggagatggccgccactgtgccgccctgggcagcagcttcctgtgccagaaccagagctgccctgtgaactactgctacaaccagggccactgctacatcagccagaccctgggctgccagcccatgtgcacctgccccccagccttcacagacagccgctgcttcctggccggcaacaacttcagccccaccgtgaacctggagctgcccctgcgggtcatccagctgctgctgtctgaggaggagaatgcctccatggccgaggtgaatgcctctgtggcctaccgcctgggcaccctggacatgagggccttcctgaggaacagccaggtggagagaattgattctgctgccccagccagcggcagccccatccagcactggatggtgatcagcgagttccagtaccggccccggggccctgtgattgacttcctgaacaaccagctgctggccgctgtggtggaggccttcctgtaccacgtgcccaggagaagtgaggagcccagaaatgatgtggtgttccagcccatcagcggggaggatgtgagagatgtgacagccctgaatgtgtccaccctgaaggcctacttccgctgtgatggctacaagggctatgacctggtgtacagcccccagagcggcttcacctgtgtgagcccctgcagccggggctactgtgaccacggcggccagtgccagcacctgcccagcggcccccgctgcagctgtgtgtccttcagcatctacacagcctggggcgagcactgtgagcacctgtccatgaagctggatgccttcttcggcatcttctttggagccctgggcggcctgctgctgctgggcgtgggcacctttgtggtgctgcgcttctggggctgcagcggggcccgcttctcctacttcctgaacagcgctgaggccctgccctag

SEQ ID NO: 160329 - DNA, 5739 bp, Artificial Sequence
  Description of Artificial Sequence: Synthetic coding sequence
cctggcaccacagaggacaccctcatcaccggcagcaagacagctgcccctgtgaccagcacaggcagcaccacagccaccctggagggccagagcacagctgccagcagcaggaccagcaaccaggacatcagcgccagcagccagaaccaccagaccaagagcacagagaccaccagcaaggcccagacagacaccctgacccagatgatgaccagcaccctcttcagcagccccagcgtgcacaacgtgatggagacagcccccccagatgagatgaccaccagcttccccagctctgtgaccaacaccctgatgatgaccagcaagaccatcaccatgaccaccagcacagacagcaccctgggcaacacagaggagaccagcacagctggaacagagagcagcacccctgtgaccagcgctgtgtccatcacagctggccaggagggccagagcaggaccacctcctggaggaccagcatccaggacaccagcgccagcagccagaaccactggaccaggagcacccagaccacccgggagagccagaccagcaccctgacccacaggaccaccagcacccccagcttcagccccagcgtgcacaacgtgacaggcaccgtgtcccagaagaccagccccagcggggagacagccaccagcagcctgtgcagcgtgaccaacacctccatgatgaccagcgagaagatcaccgtgaccaccagcacaggcagcaccctgggcaaccctggagagaccagctctgtgcctgtgacaggcagcctgatgcctgtgaccagcgctgccctggtgacctttgatcctgagggccagagccctgccaccttcagcaggaccagcacccaggacaccacagccttcagcaagaaccaccagacccagagcgtggagaccaccagggtgtcccagatcaacaccctgaacaccctgacccctgtgaccaccagcacagtgctgagcagccccagcggcttcaaccccagcggcaccgtgtcccaggagaccttccccagcggggagaccaccaccagcagccccagctctgtgagcaacaccttcctggtgaccagcaaggtgttcaggatgcccaccagccgggacagcaccctgggcaacacagaggagaccagcctgtctgtgtctggcaccatcagcgccatcaccagcaaggtgtccaccatctggtggagcgacaccctgagcacagccctgagccccagcagcctgccccccaagatcagcacagccttccacacccagcagagcgagggcgctgagaccaccggccggccccatgagaggagcagcttcagccctggggtgtcccaggagatcttcaccctgcacgagaccaccacctggcccagcagcttcagcagcaagggccacaccacctggagccagacagagctgcccagcaccagcactggagctgccacccggctggtgacaggcaaccccagcactggaacagctggcaccatcccccgggtgcccagcaaggtgtctgccatcggggagcccggggagcccaccacctacagcagccacagcaccaccctgcccaagaccactggagctggggcccagacccagtggacccaggagaccggcaccaccggggaggccctgctgagcagccccagctacagcgtgacccagatgatcaagacagccaccagccccagcagcagccccatgctggacagacacaccagccagcagatcaccacagcccccagcaccaaccacagcaccatccacagcaccagcaccagcccccaggagagccctgctgtgtcccagaggggccacacccaggccccccagaccacccaggagagccagaccaccaggtctgtgagccccatgacagacaccaagacagtgaccaccccaggcagcagcttcaccgccagcggccacagccccagcgagatcgtgccccaggatgcccccaccatctctgctgccaccacctttgccccagcccccactggagatggccacaccacccaggcccccaccacagccctgcaggccgcccccagcagccatgatgccaccctgggccccagcggcggcaccagcctgagcaagacaggagccctgaccctggccaacagcgtggtgtccacccctgggggccctgagggccagtggaccagcgccagcgccagcaccagcccagacacagctgctgccatgacccacacccaccaggccgagagcacagaggccagcggccagacccagaccagcgagcccgccagcagcggcagcaggaccaccagcgctggaacagccacccccagcagcagcggggccagcggcaccacccccagcggcagcgagggcatcagcaccagcggggagaccacccgcttcagcagcaaccccagccgggacagccacaccacccagagcaccacagagctgctgagcgccagcgccagccacggggccatccctgtgtccacaggcatggccagcagcatcgtgcccggcaccttccaccccaccctgtctgaggccagcacagctggccggcccaccggccagagcagccccaccagccccagcgccagcccccaggagacagctgccatcagcaggatggcccagacccagaggaccaggaccagccggggcagtgacaccatcagcctggccagccaggccacagacaccttcagcacagtgccccccaccccacccagcatcaccagcacaggcctgaccagcccccagacagagacccacaccctgagccccagcggcagcggcaagaccttcaccacagccctgatcagcaatgccacccccctgcctgtgacctacgccagcagcgccagcactggacatgccacccccctggccgtgtcctctgccaccagcgccagcacagtgtccagtgacagccccctgaagatggagaccccaggcatgaccacccccagcctgaagacagatggcggccgcaggacagccaccagccccccacccaccaccagccagaccatcatcagcaccatccccagcacagccatgcacaccaggagcacagctgcccccatccccatcctgcctgagcggggcgtgtccctcttcccctatggagctggagctggggacctggagtttgtgcggaggacagtggacttcaccagccccctcttcaagccagccaccggcttccccctgggcagcagcctgcgggacagcctgtacttcacagacaatggccagatcatcttccctgagagtgactaccagatcttctcctaccccaaccccctgcccaccggcttcaccggccgggaccctgtggccctggtggcccccttctgggatgatgctgacttcagcacaggccggggcaccaccttctaccaggagtatgagaccttctacggggagcacagcctgctggtgcagcaggccgagagctggatcaggaagatgaccaacaacggcggctacaaggcccgctgggccctgaaggtgacctgggtgaatgcccacgcctacccagcccagtggaccctgggcagcaacacctaccaggccatcctgagcacagatggcagccgctcctatgccctcttcctgtaccagagcggcggcatgcagtgggatgtggcccagaggagcggcaaccctgtgctgatgggcttcagcagtggagatggctactttgagaacagccccctgatgagccagcctgtgtgggagcgctacagaccagaccgcttcctgaacagcaacagcggcctgcagggcctgcagttctaccgcctgcaccgggaggagcggcccaactaccgcctggagtgcctgcagtggctgaagagccagccccgctggcccagctggggctggaaccaggtgtcctgcccctgctcctggcagcagggcagaagagacctgcgcttccagcctgccagcctgcccccagagtaccagaacagaacagagggcctgctgggcgtgtggaacaacaacccagaagatgacttcaggatgcccaacggcagcaccatccccccaggcagccctgaggagatgctgttccacttcggcatgacctggcagatcaatggaacaggcctgctgggcaagagaaatgaccagctgcccagcaacttcacccctgtgttctacagccagctgcagaagaacagctcctgggccgagcacctgatcagcaactgtgatggagacagcagctgcatctatgacaccctggccctgagaaatgccagcatcggcctgcacacccgggaggtgtccaagaactatgagcaggccaatgccaccctgaaccagtacccacccagcatcaatggaggccgggtcatcgaggcctacaagggccagaccaccctcatccagtacaccagcaatgcagaagatgccaacttcaccctgcgggacagctgcacagacctggagctgtttgaaaatggcaccctgctgtggacccccaagagcctggagcccttcaccctggagatcctggcccggagcgccaagattggcctggccagcgccctgcagcccaggacagtggtgtgccactgcaatgctgagagccagtgcctgtacaaccagaccagccgggtgggcaacagcagcctggaggtggccggctgcaagtgtgatggcggcaccttcggccgctactgtgagggctctgaagatgcctgtgaggagccctgcttccccagcgtgcactgtgtgcctgggaagggctgtgaggcctgcccccccaacctgactggagatggccgccactgtgccgccctgggcagcagcttcctgtgccagaaccagagctgccctgtgaactactgctacaaccagggccactgctacatcagccagaccctgggctgccagcccatgtgcacctgccccccagccttcacagacagccgctgcttcctggccggcaacaacttcagccccaccgtgaacctggagctgcccctgcgggtcatccagctgctgctgtctgaggaggagaatgcctccatggccgaggtgaatgcctctgtggcctaccgcctgggcaccctggacatgagggccttcctgaggaacagccaggtggagagaattgacagcgctgccccagccagcggcagccccatccagcactggatggtgatcagcgagttccagtaccggccccggggccctgtgattgacttcctgaacaaccagctgctggccgctgtggtggaggccttcctgtaccacgtgccccggcgctctgaggagcccagaaatgatgtggtgttccagcccatctctggagaagatgtgagagatgtgacagccctgaatgtgtccaccctgaaggcctacttccgctgtgatggctacaagggctatgacctggtgtacagcccccagagcggcttcacctgtgtgagcccctgcagccggggctactgtgaccatggaggccagtgccagcacctgcccagcggcccccgctgcagctgtgtgtccttcagcatctacacagcctggggcgagcactgtgagcacctgtccatgaagctggatgccttcttcggcatcttcttcggggccctgggcggcctgctgctgctgggcgtgggcacctttgtggtgctgcgcttctggggctgcagcggggcccgcttctcctacttcctgaacagcgctgaggccctgccctag

SEQ ID NO: 160330 - DNA, 16239 bp, Artificial Sequence
  Description of Artificial Sequence: Synthetic coding sequence
atgaagggggcccgctggaggagagtgccctgggtgtccctgagctgcctgtgcctgtgcctgctgccccacgtggtgcccggcaccacagaggacaccctcatcaccggcagcaagacagctgcccctgtgaccagcacaggcagcaccacagccaccctggagggccagagcacagctgccagcagcaggaccagcaaccaggacatcagcgccagcagccagaaccaccagaccaagagcacagagaccaccagcaaggcccagacagacaccctgacccagatgatgaccagcaccctcttcagcagccccagcgtgcacaacgtgatggagacagcccccccagatgagatgaccaccagcttccccagctctgtgaccaacaccctgatgatgaccagcaagaccatcaccatgaccaccagcacagacagcaccctgggcaacacagaggagaccagcacagctggaacagagagcagcacccctgtgaccagcgctgtgtccatcacagctggccaggagggccagagcaggaccacctcctggaggaccagcatccaggacaccagcgccagcagccagaaccactggaccaggagcacccagaccacccgggagagccagaccagcaccctgacccacaggaccaccagcacccccagcttcagccccagcgtgcacaacgtgacaggcaccgtgtcccagaagaccagccccagcggggagacagccaccagcagcctgtgcagcgtgaccaacacctccatgatgaccagcgagaagatcaccgtgaccaccagcacaggcagcaccctgggcaaccctggagagaccagctctgtgcctgtgacaggcagcctgatgcctgtgaccagcgctgccctggtgacctttgatcctgagggccagagccctgccaccttcagcaggaccagcacccaggacaccacagccttcagcaagaaccaccagacccagagcgtggagaccaccagggtgtcccagatcaacaccctgaacaccctgacccctgtgaccaccagcacagtgctgagcagccccagcggcttcaaccccagcggcaccgtgtcccaggagaccttccccagcggggagaccaccaccagcagccccagctctgtgagcaacaccttcctggtgaccagcaaggtgttcaggatgcccaccagccgggacagcaccctgggcaacacagaggagaccagcctgtctgtgtctggcaccatcagcgccatcaccagcaaggtgtccaccatctggtggagcgacaccctgagcacagccctgagccccagcagcctgccccccaagatcagcacagccttccacacccagcagagcgagggcgctgagaccaccggccggccccatgagaggagcagcttcagccctggggtgtcccaggagatcttcaccctgcacgagaccaccacctggcccagcagcttcagcagcaagggccacaccacctggagccagacagagctgcccagcaccagcactggagctgccacccggctggtgacaggcaaccccagcactggaacagctggcaccatcccccgggtgcccagcaaggtgtctgccatcggggagcccggggagcccaccacctacagcagccacagcaccaccctgcccaagaccactggagctggggcccagacccagtggacccaggagaccggcaccaccggggaggccctgctgagcagccccagctacagcgtgacccagatgatcaagacagccaccagccccagcagcagccccatgctggacagacacaccagccagcagatcaccacagcccccagcaccaaccacagcaccatccacagcaccagcaccagcccccaggagagccctgctgtgtcccagaggggccacacccaggccccccagaccacccaggagagccagaccaccaggtctgtgagccccatgacagacaccaagacagtgaccaccccaggcagcagcttcaccgccagcggccacagccccagcgagatcgtgccccaggatgcccccaccatctctgctgccaccacctttgccccagcccccactggagatggccacaccacccaggcccccaccacagccctgcaggccgcccccagcagccatgatgccaccctgggccccagcggcggcaccagcctgagcaagacaggagccctgaccctggccaacagcgtggtgtccacccctgggggccctgagggccagtggaccagcgccagcgccagcaccagcccagacacagctgctgccatgacccacacccaccaggccgagagcacagaggccagcggccagacccagaccagcgagcccgccagcagcggcagcaggaccaccagcgctggaacagccacccccagcagcagcggggccagcggcaccacccccagcggcagcgagggcatcagcaccagcggggagaccacccgcttcagcagcaaccccagccgggacagccacaccacccagagcaccacagagctgctgagcgccagcgccagccacggggccatccctgtgtccacaggcatggccagcagcatcgtgcccggcaccttccaccccaccctgtctgaggccagcacagctggccggcccaccggccagagcagccccaccagccccagcgccagcccccaggagacagctgccatcagcaggatggcccagacccagaggaccaggaccagccggggcagtgacaccatcagcctggccagccaggccacagacaccttcagcacagtgccccccaccccacccagcatcaccagcacaggcctgaccagcccccagacagagacccacaccctgagccccagcggcagcggcaagaccttcaccacagccctgatcagcaatgccacccccctgcctgtgacctacgccagcagcgccagcacaggccacaccacccccctgcacgtgacagatgccagctctgtgtccactggacatgccacccccctgcctgtgaccagccccagctctgtgtccacaggccacaccacccccctgcctgtgacagacaccagcagcgagagcactggacatgtgacccccctgcctgtgaccagcttcagcagcgccagcactggagacagcacccccctgcctgtgacagacaccagcagcgccagcactggacatgtgacccccctgcctgtgaccagcctgagcagcgccagcactggagacaccacccccctgcctgtgacagacaccagcagcgccagcactggacatgccaccagcctgcctgtgacagacaccagctctgtgtccacaggccacaccacccccctgcctgtgacagacaccagcagcgccagcactggacatgccaccagcctgcctgtgacagacaccagctctgtgtccacaggccacaccacccccctgcacgtgacagatgccagcagcgccagcacaggccaggccacccccctgcctgtgaccagcctgagctctgtgtccactggagacaccacccccctgcctgtgaccagccccagcagcgccagcactggacatgccacccccctgctggtgacagacaccagcagcgccagcactggacatgccacccccctgcctgtgacagatgccagctctgtgtccacagaccacgccaccagcctgcctgtgaccatccccagcgctgccagcacaggccacaccacccccctgcctgtgacagacaccagcagcgccagcacaggccaggccaccagcctgctggtgacagacaccagctctgtgtccactggagacaccacccccctgcctgtgaccagcaccagcagcgccagcactggacatgtgacccccctgcacgtgaccagccccagcagcgccagcactggacatgccacccccctgcctgtgaccagcctgagcagcgccagcactggagacaccatgcccctgcctgtgaccagccccagcagcgccagcactggagacaccacccccctgcctgtgacagatgccagctctgtgtccacaggccacaccacccccctgcacgtgacagatgccagcagcgccagcacaggccaggccacccccctgcctgtgaccagcctgagctctgtgtccactggagacaccacccccctgcctgtgaccagccccagcagcgccagcactggacatgccacccccctgctggtgacagacaccagcagcgccagcactggacatgccacccccctgcctgtgacagatgccagctctgtgtccacagaccacgccaccagcctgcctgtgaccatccccagcgctgccagcacaggccacaccacccccctgcctgtgacagacaccagcagcgccagcacaggccaggccaccagcctgctggtgacagacaccagctctgtgtccactggagacaccacccccctgcctgtgaccagcaccagcagcgccagcactggacatgtgacccccctgcacgtgaccagccccagcagcgccagcactggacatgccacccccctgcctgtgaccagcctgagcagcgccagcactggagacaccatgcccctgcctgtgaccagccccagcagcgccagcactggagacaccacccccctgcctgtgacagatgccagctctgtgtccacaggccacaccacccccctgcctgtgaccagccccagcagcgccagcacaggccacaccacccccctgcctgtgacagacaccagcagcgccagcaaaggagacaccacccccctgcctgtgaccagccccagcagcgccagcacaggccacaccacccccctgcctgtgacagacaccagcagcgccagcactggagacaccacccccctgcctgtgaccaatgccagcagcctgagcactggacatgccacccccctgcacgtgaccagccccagcagcgccagcactggacatgccacccccctgcctgtgaccagcaccagcagcgccagcactggacatgccacccccctgcctgtgacaggcctgagcagcgccaccacagatgacaccacccggctgcctgtgacagatgtgagcagcgccagcacaggccaggccacccccctgcctgtgaccagcctgagctctgtgtccactggagacaccacccccctgcctgtgaccagccccagcagcgccagcactggacatgccagccccctgctggtgacagatgccagcagcgccagcacaggccaggccacccccctgcctgtgacagacaccagctctgtgtccacagcccacgccacccccctgcctgtgacaggcctgagcagcgccagcacagatgacaccacccggctgcctgtgacagatgtgagcagcgccagcacaggccaggccatccccctgcctgtgaccagccccagcagcgccagcactggagacaccacccccctgcctgtgacagatgccagcagcgccagcactggagacaccaccagcctgcctgtgaccatccccagcagcgccagcagcggccacaccaccagcctgcctgtgacagatgccagctctgtgtccactggacatgccaccagcctgctggtgacagatgccagctctgtgtccactggagacaccacccccctgcctgtgacagacaccaacagcgccagcactggagacaccacccccctgcacgtgacagatgccagctctgtgtccactggacatgccaccagcctgcctgtgaccagcctgagcagcgccagcactggagacaccacccccctgcctgtgaccagccccagcagcgccagcagcggccacaccacccccctgcctgtgacagatgccagctctgtgcccactggacatgccaccagcctgcctgtgacagatgccagctctgtgtccactggacatgccacccccctgcctgtgacagatgccagctctgtgtccactggacatgccacccccctgcctgtgacagacaccagctctgtgtccacaggccaggccacccccctgcctgtgaccagcctgagcagcgccagcactggagacaccacccccctgcctgtgacagacaccagcagcgccagcacaggccaggacacccccctgcctgtgaccagcctgagctctgtgtccactggagacaccacccccctgcctgtgaccaaccccagcagcgccagcactggacatgccacccccctgctggtgacagatgccagcagcatcagcactggacatgccaccagcctgctggtgacagatgccagctctgtgtccactggacatgccacagccctgcatgacacagatgccagcagcctgagcactggagacaccacccccctgcctgtgaccagccccagcagcaccagcactggagacaccacccccctgcctgtgacagagaccagctctgtgtccactggacatgccaccagcctgcctgtgacagacaccagcagcgccagcactggacatgccaccagcctgcctgtgacagacaccagcagcgccagcactggacatgccacccccctgcctgtgacagacaccagcagcgccagcacaggccaggccacccccctgcctgtgaccagccccagcagcgccagcactggacatgccatccccctgctggtgacagacaccagcagcgccagcacaggccaggccacccccctgcctgtgaccagcctgagcagcgccagcactggagacaccacccccctgcctgtgacagatgccagctctgtgtccactggacatgccaccagcctgcctgtgaccagcctgagctctgtgtccactggagacaccacccccctgcctgtgaccagccccagcagcgccagcactggacatgccacccccctgcacgtgacagatgccagcagcgccagcactggacatgccacccccctgcctgtgaccagcctgagcagcgccagcactggagacaccacccccctgcctgtgaccagccccagcagcgccagcactggacatgccacccccctgcacgtgacagatgccagctctgtgtccactggagacaccacccccctgcctgtgaccagcagcagcagcgccagcagcggccacaccacccccctgcctgtgacagatgccagcagcgccagcactggagacaccacccccctgcctgtgacagacaccagcagcgccagcactggacatgccacccacctgcctgtgacaggcctgagcagcgccagcactggagacaccacccggctgcctgtgaccaacgtgagcagcgccagcactggacatgccacccccctgcctgtgaccagcaccagcagcgccagcactggagacaccacccccctgcccggcacagacaccagctctgtgtccacaggccacaccacccccctgctggtgacagatgccagctctgtgtccactggagacaccacccggctgcctgtgaccagccccagcagcgccagcacaggccacaccacccccctgcctgtgacagacacccccagcgccagcactggagacaccacccccctgcctgtgaccaatgccagcagcctgagcaccaggcatgccaccagcctgcacgtgaccagccccagcagcgccagcactggacatgccaccagcctgcctgtgacagacaccagcgctgccagcactggacatgccacccccctgcctgtgaccagcaccagcagcgccagcactggagacaccacccccctgcctgtgacagacacctacagcgccagcacaggccaggccacccccctgcctgtgaccagcctgagctctgtgtccactggagacaccacccccctgcctgtgaccagccccagcagcgccagcactggacatgccacccccctgctggtgacagatgccagcagcgccagcacaggccaggccacccccctgcctgtgaccagcctgagctctgtgtccactggagacaccacccccctgcctgtgaccagccccagcagcgccagcactggacatgccaccagcctgcctgtgacagacaccagcagcgccagcactggagacaccaccagcctgcctgtgacagacaccagcagcgcctacacaggagacaccaccagcctgcctgtgacagacaccagcagcagcagcactggagacaccacccccctgctggtgacagagaccagctctgtgtccactggagacaccacccccctgcctgtgacagacaccagcagcgccagcactggacatgccacccccctgcctgtgaccaacaccagctctgtgtccactggacatgccacccccctgcacgtgaccagccccagcagcgccagcacaggccacaccacccccctgcctgtgacagatgccagctctgtgtccactggacatgccaccagcctgcctgtgacagatgccagcagcgtcttcaccggccacgccaccagcctgcctgtgaccatccccagcagcgccagcagcggccacaccacccccctgcctgtgacagatgccagctctgtgtccactggacatgccaccagcctgcctgtgacagatgccagctctgtgtccactggacatgccacccccctgcctgtgacagatgccagctctgtgtccactggacatgccacccccctgcccctgaccagcctgagctctgtgtccactggagacaccacccccctgcctgtgacagacaccagcagcgccagcacaggccaggccacccccctgcctgtgaccagcctgagctctgtgtccactggagacaccacccccctgcctgtgacagacaccagcagcgccagcactggacatgccaccagcctgcctgtgacagacaccagcagcgccagcactggacatgccacccccctgcctgacacagacaccagcagcgccagcactggacatgccaccctgctgcctgtgacagacaccagcagcgccagcattggacatgccaccagcctgcctgtgacagacaccagcagcatcagcactggacatgccacccccctgcacgtgaccagccccagcagcgccagcactggacatgccacccccctgcctgtgacagacaccagcagcgccagcactggacatgccaaccccctgcacgtgaccagccccagcagcgccagcactggacatgccacccccctgcctgtgacagacaccagcagcgccagcactggacatgccacccccctgcctgtgaccagcctgagctctgtgtccactggagacaccacccccctgcctgtgaccagccccagcagcgccagcacaggccacaccacccccctgcctgtgacagacaccagcagcgccagcacaggccaggccacagccctgcctgtgaccagcaccagcagcgccagcactggagacaccacccccctgcctgtgacagacaccagcagcgccagcacaggccaggccacccccctgcctgtgaccagcctgagctctgtgtccactggagacaccacccccctgcctgtgaccagccccagcagcgccagcactggacatgccacccccctgctggtgacagatgccagcagcgccagcacaggccaggccacccccctgcctgtgaccagcctgagctctgtgtccactggagacaccacccccctgcctgtgaccagccccagcagcgccagcactggacatgccaccagcctgcctgtgacagacaccagcagcgccagcactggagacaccaccagcctgcctgtgacagacaccagcagcgcctacacaggagacaccaccagcctgcctgtgacagacaccagcagcagcagcactggagacaccacccccctgctggtgacagagaccagctctgtgtccactggacatgccacccccctgctggtgacagatgccagcagcgccagcactggacatgccacccccctgcacgtgaccagccccagcagcgccagcactggagacaccacccctgtgcctgtgacagacaccagctctgtgtccactggacatgccacccccctgcctgtgacaggcctgagcagcgccagcactggagacaccacccggctgcctgtgacagacatcagcagcgccagcacaggccaggccacccccctgcctgtgaccaacaccagctctgtgtccactggagacaccatgcccctgcctgtgaccagccccagcagcgccagcactggacatgccacccccctgcctgtgaccagcaccagcagcgccagcactggacatgccacccctgtgcctgtgaccagcaccagcagcgccagcacaggccacaccacccccctgcctgtgacagacaccagcagcgccagcactggagacaccacccccctgcctgtgaccagccccagcagcgccagcacaggccacaccacccccctgcacgtgaccatccccagcagcgccagcactggagacaccagcaccctgcctgtgactggagccagcagcgccagcactggacatgccacccccctgcctgtgacagacaccagctctgtgtccactggacatgccacccccctgcctgtgaccagcctgagctctgtgtccactggagacaccacccccctgcctgtgacagatgccagcagcgccagcacaggccaggccacccccctgcctgtgaccagcctgagctctgtgtccactggagacaccacccccctgctggtgacagatgccagctctgtgtccactggacatgccacccccctgcctgtgacagacaccagcagcgccagcactggagacaccacccggctgcctgtgacagacaccagcagcgccagcacaggccaggccacccccctgcctgtgaccagcctgagctctgtgtccactggagacaccacccccctgctggtgacagatgccagctctgtgtccactggacatgccacccccctgcctgtgacagacaccagcagcgccagcactggagacaccacccggctgcctgtgacagacaccagcagcgccagcacaggccaggccacccccctgcctgtgaccatccccagcagcagcagcagcggccacaccacccccctgcctgtgaccagcaccagctctgtgtccactggacatgtgacccccctgcacgtgaccagccccagcagcgccagcactggacatgtgacccccctgcctgtgaccagcaccagcagcgccagcactggacatgccacccccctgctggtgacagatgccagctctgtgtccactggacatgccacccccctgcctgtgacagatgccagcagcgccagcactggagacaccacccccctgcctgtgacagacaccagcagcgccagcacaggccaggccacccccctgcctgtgaccagcctgagctctgtgtccactggagacaccacccccctgcctgtgacagatgccagcagcgccagcactggacatgccacccccctgcctgtgaccatccccagctctgtgtccactggagacaccatgcccctgcctgtgaccagccccagcagcgccagcactggacatgccacccccctgcctgtgacaggcctgagcagcgccagcactggagacaccacccccctgcctgtgacagacaccagcagcgccagcaccaggcatgccacccccctgcctgtgacagacaccagcagcgccagcacagatgacaccacccggctgcctgtgacagatgtgagcagcgccagcactggacatgccacccccctgcctgtgaccagcaccagcagcgccagcactggagacaccacccccctgcctgtgacagacaccagctctgtgtccactggacatgccaccagcctgcctgtgaccagccgcagcagcgccagcactggacatgccacccccctgcctgtgacagacaccagctctgtgtccactggacatgccacccccctgcctgtgaccagcaccagctctgtgtccactggacatgccacccccctgcctgtgaccagccccagcagcgccagcactggacatgccacccctgtgcctgtgaccagcaccagcagcgccagcactggagacaccacccccctgcctgtgaccaatgccagcagcctgagcactggacatgccacccccctgcacgtgaccagccccagcagcgccagcagaggagacaccagcaccctgcctgtgacagatgccagcagcgccagcactggacatgccacccccctgcccctgaccagcctgagctctgtgtccactggagacaccacccccctgcctgtgacagacaccagcagcgccagcacaggccaggccacccccctgcctgtgaccagcctgagctctgtgtccactggagacaccacccccctgcctgtgaccatccccagcagcgccagcagcggccacaccaccagcctgcctgtgacagatgccagctctgtgtccactggacatggcacccccctgcctgtgaccagcaccagcagcgccagcactggagacaccacccccctgcctgtgacagacaccagcagcgccagcactggacatgccacccccctgcctgtgacagacaccagcagcgccagcactggacatgccacccccctgcctgtgaccagcctgagctctgtgtccactggacatgccacccccctggccgtgtcctctgccaccagcgccagcacagtgtccagtgacagccccctgaagatggagaccccaggcatgaccacccccagcctgaagacagatggcggccgcaggacagccaccagccccccacccaccaccagccagaccatcatcagcaccatccccagcacagccatgcacaccaggagcacagctgcccccatccccatcctgcctgagcggggcgtgtccctcttcccctatggagctggagctggggacctggagtttgtgcggaggacagtggacttcaccagccccctcttcaagccagccaccggcttccccctgggcagcagcctgcgggacagcctgtacttcacagacaatggccagatcatcttccctgagagtgactaccagatcttctcctaccccaaccccctgcccaccggcttcaccggccgggaccctgtggccctggtggcccccttctgggatgatgctgacttcagcacaggccggggcaccaccttctaccaggagtatgagaccttctacggggagcacagcctgctggtgcagcaggccgagagctggatcaggaagatgaccaacaacggcggctacaaggcccgctgggccctgaaggtgacctgggtgaatgcccacgcctacccagcccagtggaccctgggcagcaacacctaccaggccatcctgagcacagatggcagccgctcctatgccctcttcctgtaccagagcggcggcatgcagtgggatgtggcccagaggagcggcaaccctgtgctgatgggcttcagcagtggagatggctactttgagaacagccccctgatgagccagcctgtgtgggagcgctacagaccagaccgcttcctgaacagcaacagcggcctgcagggcctgcagttctaccgcctgcaccgggaggagcggcccaactaccgcctggagtgcctgcagtggctgaagagccagccccgctggcccagctggggctggaaccaggtgtcctgcccctgctcctggcagcagggcagaagagacctgcgcttccagcctgtgtccatcggccgctggggcctgggcagccggcagctgtgcagcttcacctcctggaggggcggcgtgtgctgcagctatggcccctggggcgagttccgggagggctggcacgtgcagaggccctggcagctggcccaggagctggagccccagagctggtgctgccgctggaatgacaagccctacctgtgtgccctgtaccagcagaggcggccccacgtgggctgtgccacctaccggcccccccagcctgcctggatgtttggagacccccacatcaccaccctggatggagtgtcctacaccttcaacggcctgggggacttcctgctggtgggcgcccaggacggcaacagcagcttcctgctgcagggccgcacagcccagacaggcagcgcccaggccaccaacttcatcgcctttgctgcccagtaccgcagcagcagcctgggccctgtgacagtgcagtggctgctggagccccatgatgccatccgggtgctgctggacaaccagacagtgaccttccagcctgaccatgaagatggcggcggccaggagaccttcaatgccactggagtgctgctgagcagaaatggcagcgaggtgtctgccagctttgatggctgggccaccgtgtctgtgattgccctgagcaacatcctgcacgccagcgccagcctgcccccagagtaccagaacagaacagagggcctgctgggcgtgtggaacaacaacccagaagatgacttcaggatgcccaacggcagcaccatccccccaggcagccctgaggagatgctgttccacttcggcatgacctggcagatcaatggaacaggcctgctgggcaagagaaatgaccagctgcccagcaacttcacccctgtgttctacagccagctgcagaagaacagctcctgggccgagcacctgatcagcaactgtgatggagacagcagctgcatctatgacaccctggccctgagaaatgccagcatcggcctgcacacccgggaggtgtccaagaactatgagcaggccaatgccaccctgaaccagtacccacccagcatcaatggaggccgggtcatcgaggcctacaagggccagaccaccctcatccagtacaccagcaatgcagaagatgccaacttcaccctgcgggacagctgcacagacctggagctgtttgaaaatggcaccctgctgtggacccccaagagcctggagcccttcaccctggagatcctggcccggagcgccaagattggcctggccagcgccctgcagcccaggacagtggtgtgccactgcaatgctgagagccagtgcctgtacaaccagaccagccgggtgggcaacagcagcctggaggtggccggctgcaagtgtgatggcggcaccttcggccgctactgtgagggctctgaagatgcctgtgaggagccctgcttccccagcgtgcactgtgtgcctgggaagggctgtgaggcctgcccccccaacctgactggagatggccgccactgtgccgccctgggcagcagcttcctgtgccagaaccagagctgccctgtgaactactgctacaaccagggccactgctacatcagccagaccctgggctgccagcccatgtgcacctgccccccagccttcacagacagccgctgcttcctggccggcaacaacttcagccccaccgtgaacctggagctgcccctgcgggtcatccagctgctgctgtctgaggaggagaatgcctccatggccgaggtgaatgcctctgtggcctaccgcctgggcaccctggacatgagggccttcctgaggaacagccaggtggagagaattgacagcgctgccccagccagcggcagccccatccagcactggatggtgatcagcgagttccagtaccggccccggggccctgtgattgacttcctgaacaaccagctgctggccgctgtggtggaggccttcctgtaccacgtgccccggcgctctgaggagcccagaaatgatgtggtgttccagcccatctctggagaagatgtgagagatgtgacagccctgaatgtgtccaccctgaaggcctacttccgctgtgatggctacaagggctatgacctggtgtacagcccccagagcggcttcacctgtgtgagcccctgcagccggggctactgtgaccatggaggccagtgccagcacctgcccagcggcccccgctgcagctgtgtgtccttcagcatctacacagcctggggcgagcactgtgagcacctgtccatgaagctggatgccttcttcggcatcttcttcggggccctgggcggcctgctgctgctgggcgtgggcacctttgtggtgctgcgcttctggggctgcagcggggcccgcttctcctacttcctgaacagcgctgaggccctgccctag

SEQ ID NO: 160331 - DNA, 16083 bp, Artificial Sequence
  Description of Artificial Sequence: Synthetic coding sequence
atgaagggggcccgctggaggagagtgccctgggtgtccctgagctgcctgtgcctgtgcctgctgccccacgtggtgcccggcaccacagaggacaccctcatcaccggcagcaagacagctgcccctgtgaccagcacaggcagcaccacagccaccctggagggccagagcacagctgccagcagcaggaccagcaaccaggacatcagcgccagcagccagaaccaccagaccaagagcacagagaccaccagcaaggcccagacagacaccctgacccagatgatgaccagcaccctcttcagcagccccagcgtgcacaacgtgatggagacagcccccccagatgagatgaccaccagcttccccagctctgtgaccaacaccctgatgatgaccagcaagaccatcaccatgaccaccagcacagacagcaccctgggcaacacagaggagaccagcacagctggaacagagagcagcacccctgtgaccagcgctgtgtccatcacagctggccaggagggccagagcaggaccacctcctggaggaccagcatccaggacaccagcgccagcagccagaaccactggaccaggagcacccagaccacccgggagagccagaccagcaccctgacccacaggaccaccagcacccccagcttcagccccagcgtgcacaacgtgacaggcaccgtgtcccagaagaccagccccagcggggagacagccaccagcagcctgtgcagcgtgaccaacacctccatgatgaccagcgagaagatcaccgtgaccaccagcacaggcagcaccctgggcaaccctggagagaccagctctgtgcctgtgacaggcagcctgatgcctgtgaccagcgctgccctggtgacctttgatcctgagggccagagccctgccaccttcagcaggaccagcacccaggacaccacagccttcagcaagaaccaccagacccagagcgtggagaccaccagggtgtcccagatcaacaccctgaacaccctgacccctgtgaccaccagcacagtgctgagcagccccagcggcttcaaccccagcggcaccgtgtcccaggagaccttccccagcggggagaccaccaccagcagccccagctctgtgagcaacaccttcctggtgaccagcaaggtgttcaggatgcccaccagccgggacagcaccctgggcaacacagaggagaccagcctgtctgtgtctggcaccatcagcgccatcaccagcaaggtgtccaccatctggtggagcgacaccctgagcacagccctgagccccagcagcctgccccccaagatcagcacagccttccacacccagcagagcgagggcgctgagaccaccggccggccccatgagaggagcagcttcagccctggggtgtcccaggagatcttcaccctgcacgagaccaccacctggcccagcagcttcagcagcaagggccacaccacctggagccagacagagctgcccagcaccagcactggagctgccacccggctggtgacaggcaaccccagcactggaacagctggcaccatcccccgggtgcccagcaaggtgtctgccatcggggagcccggggagcccaccacctacagcagccacagcaccaccctgcccaagaccactggagctggggcccagacccagtggacccaggagaccggcaccaccggggaggccctgctgagcagccccagctacagcgtgacccagatgatcaagacagccaccagccccagcagcagccccatgctggacagacacaccagccagcagatcaccacagcccccagcaccaaccacagcaccatccacagcaccagcaccagcccccaggagagccctgctgtgtcccagaggggccacacccaggccccccagaccacccaggagagccagaccaccaggtctgtgagccccatgacagacaccaagacagtgaccaccccaggcagcagcttcaccgccagcggccacagccccagcgagatcgtgccccaggatgcccccaccatctctgctgccaccacctttgccccagcccccactggagatggccacaccacccaggcccccaccacagccctgcaggccgcccccagcagccatgatgccaccctgggccccagcggcggcaccagcctgagcaagacaggagccctgaccctggccaacagcgtggtgtccacccctgggggccctgagggccagtggaccagcgccagcgccagcaccagcccagacacagctgctgccatgacccacacccaccaggccgagagcacagaggccagcggccagacccagaccagcgagcccgccagcagcggcagcaggaccaccagcgctggaacagccacccccagcagcagcggggccagcggcaccacccccagcggcagcgagggcatcagcaccagcggggagaccacccgcttcagcagcaaccccagccgggacagccacaccacccagagcaccacagagctgctgagcgccagcgccagccacggggccatccctgtgtccacaggcatggccagcagcatcgtgcccggcaccttccaccccaccctgtctgaggccagcacagctggccggcccaccggccagagcagccccaccagccccagcgccagcccccaggagacagctgccatcagcaggatggcccagacccagaggaccaggaccagccggggcagtgacaccatcagcctggccagccaggccacagacaccttcagcacagtgccccccaccccacccagcatcaccagcacaggcctgaccagcccccagacagagacccacaccctgagccccagcggcagcggcaagaccttcaccacagccctgatcagcaatgccacccccctgcctgtgacctacgccagcagcgccagcacaggccacaccacccccctgcacgtgacagatgccagctctgtgtccactggacatgccacccccctgcctgtgaccagccccagctctgtgtccacaggccacaccacccccctgcctgtgacagacaccagcagcgagagcactggacatgtgacccccctgcctgtgaccagcttcagcagcgccagcactggagacagcacccccctgcctgtgacagacaccagcagcgccagcactggacatgtgacccccctgcctgtgaccagcctgagcagcgccagcactggagacaccacccccctgcctgtgacagacaccagcagcgccagcactggacatgccaccagcctgcctgtgacagacaccagctctgtgtccacaggccacaccacccccctgcctgtgacagacaccagcagcgccagcactggacatgccaccagcctgcctgtgacagacaccagctctgtgtccacaggccacaccacccccctgcacgtgacagatgccagcagcgccagcacaggccaggccacccccctgcctgtgaccagcctgagctctgtgtccactggagacaccacccccctgcctgtgaccagccccagcagcgccagcactggacatgccacccccctgctggtgacagacaccagcagcgccagcactggacatgccacccccctgcctgtgacagatgccagctctgtgtccacagaccacgccaccagcctgcctgtgaccatccccagcgctgccagcacaggccacaccacccccctgcctgtgacagacaccagcagcgccagcacaggccaggccaccagcctgctggtgacagacaccagctctgtgtccactggagacaccacccccctgcctgtgaccagcaccagcagcgccagcactggacatgtgacccccctgcacgtgaccagccccagcagcgccagcactggacatgccacccccctgcctgtgaccagcctgagcagcgccagcactggagacaccatgcccctgcctgtgaccagccccagcagcgccagcactggagacaccacccccctgcctgtgacagatgccagctctgtgtccacaggccacaccacccccctgcacgtgacagatgccagcagcgccagcacaggccaggccacccccctgcctgtgaccagcctgagctctgtgtccactggagacaccacccccctgcctgtgaccagccccagcagcgccagcactggacatgccacccccctgctggtgacagacaccagcagcgccagcactggacatgccacccccctgcctgtgacagatgccagctctgtgtccacagaccacgccaccagcctgcctgtgaccatccccagcgctgccagcacaggccacaccacccccctgcctgtgacagacaccagcagcgccagcacaggccaggccaccagcctgctggtgacagacaccagctctgtgtccactggagacaccacccccctgcctgtgaccagcaccagcagcgccagcactggacatgtgacccccctgcacgtgaccagccccagcagcgccagcactggacatgccacccccctgcctgtgaccagcctgagcagcgccagcactggagacaccatgcccctgcctgtgaccagccccagcagcgccagcactggagacaccacccccctgcctgtgacagatgccagctctgtgtccacaggccacaccacccccctgcctgtgaccagccccagcagcgccagcacaggccacaccacccccctgcctgtgacagacaccagcagcgccagcaaaggagacaccacccccctgcctgtgaccagccccagcagcgccagcacaggccacaccacccccctgcctgtgacagacaccagcagcgccagcactggagacaccacccccctgcctgtgaccaatgccagcagcctgagcactggacatgccacccccctgcacgtgaccagccccagcagcgccagcactggacatgccacccccctgcctgtgaccagcaccagcagcgccagcactggacatgccacccccctgcctgtgacaggcctgagcagcgccaccacagatgacaccacccggctgcctgtgacagatgtgagcagcgccagcacaggccaggccacccccctgcctgtgaccagcctgagctctgtgtccactggagacaccacccccctgcctgtgaccagccccagcagcgccagcactggacatgccagccccctgctggtgacagatgccagcagcgccagcacaggccaggccacccccctgcctgtgacagacaccagctctgtgtccacagcccacgccacccccctgcctgtgacaggcctgagcagcgccagcacagatgacaccacccggctgcctgtgacagatgtgagcagcgccagcacaggccaggccatccccctgcctgtgaccagccccagcagcgccagcactggagacaccacccccctgcctgtgacagatgccagcagcgccagcactggagacaccaccagcctgcctgtgaccatccccagcagcgccagcagcggccacaccaccagcctgcctgtgacagatgccagctctgtgtccactggacatgccaccagcctgctggtgacagatgccagctctgtgtccactggagacaccacccccctgcctgtgacagacaccaacagcgccagcactggagacaccacccccctgcacgtgacagatgccagctctgtgtccactggacatgccaccagcctgcctgtgaccagcctgagcagcgccagcactggagacaccacccccctgcctgtgaccagccccagcagcgccagcagcggccacaccacccccctgcctgtgacagatgccagctctgtgcccactggacatgccaccagcctgcctgtgacagatgccagctctgtgtccactggacatgccacccccctgcctgtgacagatgccagctctgtgtccactggacatgccacccccctgcctgtgacagacaccagctctgtgtccacaggccaggccacccccctgcctgtgaccagcctgagcagcgccagcactggagacaccacccccctgcctgtgacagacaccagcagcgccagcacaggccaggacacccccctgcctgtgaccagcctgagctctgtgtccactggagacaccacccccctgcctgtgaccaaccccagcagcgccagcactggacatgccacccccctgctggtgacagatgccagcagcatcagcactggacatgccaccagcctgctggtgacagatgccagctctgtgtccactggacatgccacagccctgcatgacacagatgccagcagcctgagcactggagacaccacccccctgcctgtgaccagccccagcagcaccagcactggagacaccacccccctgcctgtgacagagaccagctctgtgtccactggacatgccaccagcctgcctgtgacagacaccagcagcgccagcactggacatgccaccagcctgcctgtgacagacaccagcagcgccagcactggacatgccacccccctgcctgtgacagacaccagcagcgccagcacaggccaggccacccccctgcctgtgaccagccccagcagcgccagcactggacatgccatccccctgctggtgacagacaccagcagcgccagcacaggccaggccacccccctgcctgtgaccagcctgagcagcgccagcactggagacaccacccccctgcctgtgacagatgccagctctgtgtccactggacatgccaccagcctgcctgtgaccagcctgagctctgtgtccactggagacaccacccccctgcctgtgaccagccccagcagcgccagcactggacatgccacccccctgcacgtgacagatgccagcagcgccagcactggacatgccacccccctgcctgtgaccagcctgagcagcgccagcactggagacaccacccccctgcctgtgaccagccccagcagcgccagcactggacatgccacccccctgcacgtgacagatgccagctctgtgtccactggagacaccacccccctgcctgtgaccagcagcagcagcgccagcagcggccacaccacccccctgcctgtgacagatgccagcagcgccagcactggagacaccacccccctgcctgtgacagacaccagcagcgccagcactggacatgccacccacctgcctgtgacaggcctgagcagcgccagcactggagacaccacccggctgcctgtgaccaacgtgagcagcgccagcactggacatgccacccccctgcctgtgaccagcaccagcagcgccagcactggagacaccacccccctgcccggcacagacaccagctctgtgtccacaggccacaccacccccctgctggtgacagatgccagctctgtgtccactggagacaccacccggctgcctgtgaccagccccagcagcgccagcacaggccacaccacccccctgcctgtgacagacacccccagcgccagcactggagacaccacccccctgcctgtgaccaatgccagcagcctgagcaccaggcatgccaccagcctgcacgtgaccagccccagcagcgccagcactggacatgccaccagcctgcctgtgacagacaccagcgctgccagcactggacatgccacccccctgcctgtgaccagcaccagcagcgccagcactggagacaccacccccctgcctgtgacagacacctacagcgccagcacaggccaggccacccccctgcctgtgaccagcctgagctctgtgtccactggagacaccacccccctgcctgtgaccagccccagcagcgccagcactggacatgccacccccctgctggtgacagatgccagcagcgccagcacaggccaggccacccccctgcctgtgaccagcctgagctctgtgtccactggagacaccacccccctgcctgtgaccagccccagcagcgccagcactggacatgccaccagcctgcctgtgacagacaccagcagcgccagcactggagacaccaccagcctgcctgtgacagacaccagcagcgcctacacaggagacaccaccagcctgcctgtgacagacaccagcagcagcagcactggagacaccacccccctgctggtgacagagaccagctctgtgtccactggagacaccacccccctgcctgtgacagacaccagcagcgccagcactggacatgccacccccctgcctgtgaccaacaccagctctgtgtccactggacatgccacccccctgcacgtgaccagccccagcagcgccagcacaggccacaccacccccctgcctgtgacagatgccagctctgtgtccactggacatgccaccagcctgcctgtgacagatgccagcagcgtcttcaccggccacgccaccagcctgcctgtgaccatccccagcagcgccagcagcggccacaccacccccctgcctgtgacagatgccagctctgtgtccactggacatgccaccagcctgcctgtgacagatgccagctctgtgtccactggacatgccacccccctgcctgtgacagatgccagctctgtgtccactggacatgccacccccctgcccctgaccagcctgagctctgtgtccactggagacaccacccccctgcctgtgacagacaccagcagcgccagcacaggccaggccacccccctgcctgtgaccagcctgagctctgtgtccactggagacaccacccccctgcctgtgacagacaccagcagcgccagcactggacatgccaccagcctgcctgtgacagacaccagcagcgccagcactggacatgccacccccctgcctgacacagacaccagcagcgccagcactggacatgccaccctgctgcctgtgacagacaccagcagcgccagcattggacatgccaccagcctgcctgtgacagacaccagcagcatcagcactggacatgccacccccctgcacgtgaccagccccagcagcgccagcactggacatgccacccccctgcctgtgacagacaccagcagcgccagcactggacatgccaaccccctgcacgtgaccagccccagcagcgccagcactggacatgccacccccctgcctgtgacagacaccagcagcgccagcactggacatgccacccccctgcctgtgaccagcctgagctctgtgtccactggagacaccacccccctgcctgtgaccagccccagcagcgccagcacaggccacaccacccccctgcctgtgacagacaccagcagcgccagcacaggccaggccacagccctgcctgtgaccagcaccagcagcgccagcactggagacaccacccccctgcctgtgacagacaccagcagcgccagcacaggccaggccacccccctgcctgtgaccagcctgagctctgtgtccactggagacaccacccccctgcctgtgaccagccccagcagcgccagcactggacatgccacccccctgctggtgacagatgccagcagcgccagcacaggccaggccacccccctgcctgtgaccagcctgagctctgtgtccactggagacaccacccccctgcctgtgaccagccccagcagcgccagcactggacatgccaccagcctgcctgtgacagacaccagcagcgccagcactggagacaccaccagcctgcctgtgacagacaccagcagcgcctacacaggagacaccaccagcctgcctgtgacagacaccagcagcagcagcactggagacaccacccccctgctggtgacagagaccagctctgtgtccactggacatgccacccccctgctggtgacagatgccagcagcgccagcactggacatgccacccccctgcacgtgaccagccccagcagcgccagcactggagacaccacccctgtgcctgtgacagacaccagctctgtgtccactggacatgccacccccctgcctgtgacaggcctgagcagcgccagcactggagacaccacccggctgcctgtgacagacatcagcagcgccagcacaggccaggccacccccctgcctgtgaccaacaccagctctgtgtccactggagacaccatgcccctgcctgtgaccagccccagcagcgccagcactggacatgccacccccctgcctgtgaccagcaccagcagcgccagcactggacatgccacccctgtgcctgtgaccagcaccagcagcgccagcacaggccacaccacccccctgcctgtgacagacaccagcagcgccagcactggagacaccacccccctgcctgtgaccagccccagcagcgccagcacaggccacaccacccccctgcacgtgaccatccccagcagcgccagcactggagacaccagcaccctgcctgtgactggagccagcagcgccagcactggacatgccacccccctgcctgtgacagacaccagctctgtgtccactggacatgccacccccctgcctgtgaccagcctgagctctgtgtccactggagacaccacccccctgcctgtgacagatgccagcagcgccagcacaggccaggccacccccctgcctgtgaccagcctgagctctgtgtccactggagacaccacccccctgctggtgacagatgccagctctgtgtccactggacatgccacccccctgcctgtgacagacaccagcagcgccagcactggagacaccacccggctgcctgtgacagacaccagcagcgccagcacaggccaggccacccccctgcctgtgaccagcctgagctctgtgtccactggagacaccacccccctgctggtgacagatgccagctctgtgtccactggacatgccacccccctgcctgtgacagacaccagcagcgccagcactggagacaccacccggctgcctgtgacagacaccagcagcgccagcacaggccaggccacccccctgcctgtgaccatccccagcagcagcagcagcggccacaccacccccctgcctgtgaccagcaccagctctgtgtccactggacatgtgacccccctgcacgtgaccagccccagcagcgccagcactggacatgtgacccccctgcctgtgaccagcaccagcagcgccagcactggacatgccacccccctgctggtgacagatgccagctctgtgtccactggacatgccacccccctgcctgtgacagatgccagcagcgccagcactggagacaccacccccctgcctgtgacagacaccagcagcgccagcacaggccaggccacccccctgcctgtgaccagcctgagctctgtgtccactggagacaccacccccctgcctgtgacagatgccagcagcgccagcactggacatgccacccccctgcctgtgaccatccccagctctgtgtccactggagacaccatgcccctgcctgtgaccagccccagcagcgccagcactggacatgccacccccctgcctgtgacaggcctgagcagcgccagcactggagacaccacccccctgcctgtgacagacaccagcagcgccagcaccaggcatgccacccccctgcctgtgacagacaccagcagcgccagcacagatgacaccacccggctgcctgtgacagatgtgagcagcgccagcactggacatgccacccccctgcctgtgaccagcaccagcagcgccagcactggagacaccacccccctgcctgtgacagacaccagctctgtgtccactggacatgccaccagcctgcctgtgaccagccgcagcagcgccagcactggacatgccacccccctgcctgtgacagacaccagctctgtgtccactggacatgccacccccctgcctgtgaccagcaccagctctgtgtccactggacatgccacccccctgcctgtgaccagccccagcagcgccagcactggacatgccacccctgtgcctgtgaccagcaccagcagcgccagcactggagacaccacccccctgcctgtgaccaatgccagcagcctgagcactggacatgccacccccctgcacgtgaccagccccagcagcgccagcagaggagacaccagcaccctgcctgtgacagatgccagcagcgccagcactggacatgccacccccctgcccctgaccagcctgagctctgtgtccactggagacaccacccccctgcctgtgacagacaccagcagcgccagcacaggccaggccacccccctgcctgtgaccagcctgagctctgtgtccactggagacaccacccccctgcctgtgaccatccccagcagcgccagcagcggccacaccaccagcctgcctgtgacagatgccagctctgtgtccactggacatggcacccccctgcctgtgaccagcaccagcagcgccagcactggagacaccacccccctgcctgtgacagacaccagcagcgccagcactggacatgccacccccctgcctgtgacagacaccagcagcgccagcactggacatgccacccccctgcctgtgaccagcctgagctctgtgtccactggacatgccacccccctggccgtgtcctctgccaccagcgccagcacagtgtccagtgacagccccctgaagatggagaccccaggcatgaccacccccagcctgaagacagatggcggccgcaggacagccaccagccccccacccaccaccagccagaccatcatcagcaccatccccagcacagccatgcacaccaggagcacagctgcccccatccccatcctgcctgagcggggcgtgtccctcttcccctatggagctggagctggggacctggagtttgtgcggaggacagtggacttcaccagccccctcttcaagccagccaccggcttccccctgggcagcagcctgcgggacagcctgtacttcacagacaatggccagatcatcttccctgagagtgactaccagatcttctcctaccccaaccccctgcccaccggcttcaccggccgggaccctgtggccctggtggcccccttctgggatgatgctgacttcagcacaggccggggcaccaccttctaccagagcaacacctaccaggccatcctgagcacagatggcagccgctcctatgccctcttcctgtaccagagcggcggcatgcagtgggatgtggcccagaggagcggcaaccctgtgctgatgggcttcagcagtggagatggctactttgagaacagccccctgatgagccagcctgtgtgggagcgctacagaccagaccgcttcctgaacagcaacagcggcctgcagggcctgcagttctaccgcctgcaccgggaggagcggcccaactaccgcctggagtgcctgcagtggctgaagagccagccccgctggcccagctggggctggaaccaggtgtcctgcccctgctcctggcagcagggcagaagagacctgcgcttccagcctgtgtccatcggccgctggggcctgggcagccggcagctgtgcagcttcacctcctggaggggcggcgtgtgctgcagctatggcccctggggcgagttccgggagggctggcacgtgcagaggccctggcagctggcccaggagctggagccccagagctggtgctgccgctggaatgacaagccctacctgtgtgccctgtaccagcagaggcggccccacgtgggctgtgccacctaccggcccccccagcctgcctggatgtttggagacccccacatcaccaccctggatggagtgtcctacaccttcaacggcctgggggacttcctgctggtgggcgcccaggacggcaacagcagcttcctgctgcagggccgcacagcccagacaggcagcgcccaggccaccaacttcatcgcctttgctgcccagtaccgcagcagcagcctgggccctgtgacagtgcagtggctgctggagccccatgatgccatccgggtgctgctggacaaccagacagtgaccttccagcctgaccatgaagatggcggcggccaggagaccttcaatgccactggagtgctgctgagcagaaatggcagcgaggtgtctgccagctttgatggctgggccaccgtgtctgtgattgccctgagcaacatcctgcacgccagcgccagcctgcccccagagtaccagaacagaacagagggcctgctgggcgtgtggaacaacaacccagaagatgacttcaggatgcccaacggcagcaccatccccccaggcagccctgaggagatgctgttccacttcggcatgacctggcagatcaatggaacaggcctgctgggcaagagaaatgaccagctgcccagcaacttcacccctgtgttctacagccagctgcagaagaacagctcctgggccgagcacctgatcagcaactgtgatggagacagcagctgcatctatgacaccctggccctgagaaatgccagcatcggcctgcacacccgggaggtgtccaagaactatgagcaggccaatgccaccctgaaccagtacccacccagcatcaatggaggccgggtcatcgaggcctacaagggccagaccaccctcatccagtacaccagcaatgcagaagatgccaacttcaccctgcgggacagctgcacagacctggagctgtttgaaaatggcaccctgctgtggacccccaagagcctggagcccttcaccctggagatcctggcccggagcgccaagattggcctggccagcgccctgcagcccaggacagtggtgtgccactgcaatgctgagagccagtgcctgtacaaccagaccagccgggtgggcaacagcagcctggaggtggccggctgcaagtgtgatggcggcaccttcggccgctactgtgagggctctgaagatgcctgtgaggagccctgcttccccagcgtgcactgtgtgcctgggaagggctgtgaggcctgcccccccaacctgactggagatggccgccactgtgccgccctgggcagcagcttcctgtgccagaaccagagctgccctgtgaactactgctacaaccagggccactgctacatcagccagaccctgggctgccagcccatgtgcacctgccccccagccttcacagacagccgctgcttcctggccggcaacaacttcagccccaccgtgaacctggagctgcccctgcgggtcatccagctgctgctgtctgaggaggagaatgcctccatggccgaggtgaatgcctctgtggcctaccgcctgggcaccctggacatgagggccttcctgaggaacagccaggtggagagaattgacagcgctgccccagccagcggcagccccatccagcactggatggtgatcagcgagttccagtaccggccccggggccctgtgattgacttcctgaacaaccagctgctggccgctgtggtggaggccttcctgtaccacgtgccccggcgctctgaggagcccagaaatgatgtggtgttccagcccatctctggagaagatgtgagagatgtgacagccctgaatgtgtccaccctgaaggcctacttccgctgtgatggctacaagggctatgacctggtgtacagcccccagagcggcttcacctgtgtgagcccctgcagccggggctactgtgaccatggaggccagtgccagcacctgcccagcggcccccgctgcagctgtgtgtccttcagcatctacacagcctggggcgagcactgtgagcacctgtccatgaagctggatgccttcttcggcatcttcttcggggccctgggcggcctgctgctgctgggcgtgggcacctttgtggtgctgcgcttctggggctgcagcggggcccgcttctcctacttcctgaacagcgctgaggccctgccctag

SEQ ID NO: 160332 - DNA, 1863 bp, Artificial Sequence
  Description of Artificial Sequence: Synthetic coding sequence
atgtctgtgggccgcaggaagctggccctgctgtgggccctggccctggccctggcctgcaccaggcacacaggccacgcccaggacggcagcagcgagagcagctacaagcaccacccagccctgagccccatcgcccggggccccagcggcgtgcccctgcggggggccaccgtcttccccagcctgcggaccatccctgtggtgcgggccagcaacccagcccacaacggccgggtgtgcagcacctggggcagcttccactacaagacctttgatggagatgtgttccgcttccctggcctgtgcaactacgtgttcagcgagcactgtggggccgcctatgaggacttcaacccagccaccccccagcccggggtgtctggcccccacgccgagcagggcccccatgaaggaggctggaggggccaccctgctgaccagggcctgcggcccggccagaggcctcctggccctgctgccctgcagcctgtgtggggcccccacagcagagctgctgccaccccccgctggaggcctggctgggccctgagcagctgtggcaccaccatgacagcctgctgctggctggacaccaagtatgccaacaagctgtgggccctgtggggcctgcagagagatgcccggggccagagggcccccctgccccagcaccaggccgacacccacggcatccgggagcccgcccgctggaccacccccaggagctctgtgaggaccctgagcctgaacccccggggcacagcccccctggccctgggcatctgtgaggagctgctgcacggccagctgttcagcggctgtgtggccctggtggatgtgggcagctacctggaggcctgccggcaggacctgtgcttctgtgaggacacagacctgctgagctgtgtgtgccacaccctggccgagtacagccggcagtgcacccacgccggcggcctgccccaggactggaggggccctgacttctgcccccagaagtgccccaacaacatgcagtaccatgaatgtcgcagcccctgtgccgacacctgcagcaaccaggagcacagccgggcctgtgaggaccactgtgtggccggctgcttctgcccagagggcaccgtgctggatgacatcggccagacaggctgtgtgcctgtgtccaaatgtgcctgtgtgtacaacggggccgcctatgcccctggggccacctacagcacagactgcaccaactgcacctgcagcggcggccgctggagctgccaggaggtgccctgccccggcacctgcagcgtgctgggcggggcccacttcagcacctttgatggcaagcagtacacagtgcacggggactgcagctatgtgctgaccaagccctgtgacagcagcgccttcaccgtgctggccgagctgcggcgctgtggcctgacagacagcgagacctgcctgaagtctgtgaccctgagcctggatggagtgcagacagtggtggtgatcaaggccagcggggaggtgttcctgaaccagatctacacccagctgcccatctctgctgccaacgtgaccatcttccggcccagcaccttcttcatcatcgcccagaccagcctgggcctgcagctgaacctgcagctggtgcccaccatgcagctgttcatgcagctggcccccaagctgcggggccagacctgtggcctgtgtggcaacttcaacagcatccaggctgatgacttccgcaccctgtctggagtggtggaggccacagctgctgccttcttcaacaccttcaagacccaggccgcctgccccaacatcagaaattcctttgaggacccctgcagcctgtctgtggagaactag

SEQ ID NO: 160333 - DNA, 1872 bp, Artificial Sequence
  Description of Artificial Sequence: Synthetic coding sequence
atgtctgtgggccgcaggaagctggccctgctgtgggccctggccctggccctggcctgcaccaggcacacaggccacgcccaggacggcagcagcgagagcagctacaagcaccacccagccctgagccccatcgcccggggccccagcggcgtgcccctgcggggggccaccgtcttccccagcctgcggaccatccctgtggtgcgggccagcaacccagcccacaacggccgggtgtgcagcacctggggcagcttccactacaagacctttgatggagatgtgttccgcttccctggcctgtgcaactacgtgttcagcgagcactgtggggccgcctatgaggacttcaacatccagctgcggcgcagccaggagagcgctgcccccaccctgagccgggtgctgatgaaggtggatggagtggtgatccagctgaccaagggctctgtgctggtgaatggccaccctgtgctgctgcccttcagccagagcggcgtgctgatccagcagagcagcagctacaccaaggtggaggcccggctgggcctggtgctgatgtggaaccatgatgacagcctgctgctggagctggacaccaagtatgccaacaagacctgtggcctgtgtggggacttcaacggcatgcctgtggtgtctgagctgctgagccacaacaccaagctgacccccatggagtttggaaacctgcagaagatggatgaccccacagagcagtgccaggaccctgtgcctgagcccccaagaaactgcagcactggatttggcatctgtgaggagctgctgcacggccagctgttcagcggctgtgtggccctggtggatgtgggcagctacctggaggcctgccggcaggacctgtgcttctgtgaggacacagacctgctgagctgtgtgtgccacaccctggccgagtacagccggcagtgcacccatgctgggggcctgccccaggactggaggggccctgacttctgcccccagaagtgccccaacaacatgcagtaccacgagtgccgcagcccctgtgccgacacctgcagcaaccaggagcacagccgggcctgtgaggaccactgtgtggccggctgcttctgcccagagggcaccgtgctggatgacatcggccagacaggctgtgtgcctgtgtccaaatgtgcctgtgtgtacaatggagctgcctatgcccctggggccacctacagcacagactgcaccaactgcacctgcagcggcggccgctggagctgccaggaggtgccctgccccggcacctgcagcgtgctgggcggggcccacttcagcacctttgatggcaagcagtacacagtgcatggagactgcagctatgtgctgaccaagccctgtgacagcagcgccttcaccgtgctggccgagctgcggcgctgtggcctgacagattctgagacctgcctgaagtctgtgaccctgagcctggatggagtgcagacagtggtggtgatcaaggccagcggggaggtgttcctgaaccagatctacacccagctgcccatctctgctgccaacgtgaccatcttccggcccagcaccttcttcatcatcgcccagaccagcctgggcctgcagctgaacctgcagctggtgcccaccatgcagctgttcatgcagctggcccccaagctgcggggccagacctgtggcctgtgtggcaacttcaacagcatccaggctgatgacttccgcaccctgagcggcgtggtggaggccacagctgctgccttcttcaacaccttcaagacccaggccgcctgccccaacatccggaacagctttgaggacccctgcagcctgtctgtggagaactag

SEQ ID NO: 160334 - DNA, 17121 bp, Artificial Sequence
  Description of Artificial Sequence: Synthetic coding sequence
atgggcgcccccagcgcctgcaggaccctggtgctggccctggccgccatgctggtggtgccccaggccgagacccagggccctgtggagcccagctgggagaatgccggccacaccatggatggaggagcccccaccagcagccccaccaggagagtgtcctttgtgccccctgtgaccgtcttccccagcctgagccccctgaacccagcccacaacggccgggtgtgcagcacctggggagacttccactacaagacctttgatggagatgtgttccgcttccctggcctgtgcaactacgtgttcagcgagcactgcagagctgcctatgaggacttcaacgtgcagctgcggcggggcctggtgggcagcaggcctgtggtgaccagggtggtgatcaaggcccagggcctggtgctggaggccagcaatggatctgtgctgatcaatggccagcgggaggagctgccctacagcaggacaggcctgctggtggagcagagcggggactacatcaaggtgtccatccggctggtgctgaccttcctgtggaatggagaggacagcgccctgctggagctggaccccaagtatgccaaccagacctgtggcctgtgtggggacttcaacggcctgcctgccttcaatgagttctacgcccacaatgcccggctgacccccctgcagtttggaaacctgcagaagctggatggccccacagagcagtgcccagaccccctgcccctgcctgctggcaactgcacagatgaggagggcatctgccacaggaccctgctgggccctgcctttgctgaatgtcatgccctggtggacagcacagcctacctggccgcctgtgcccaggacctgtgccgctgccccacctgcccctgtgccacctttgtggagtacagccggcagtgtgcccacgccggcggccagcccaggaactggcgctgcccagagctgtgccccaggacctgccccctgaacatgcagcaccaggagtgtggcagcccctgcacagacacctgcagcaacccccagagggcccagctgtgtgaggaccactgtgtggatggctgcttctgccccccaggcagcacagtgctggatgacatcacccacagcggctgcctgcccctgggccagtgcccctgcacccacggcggccgcacctacagccctggcaccagcttcaacaccacctgcagcagctgcacctgcagcggcggcctgtggcagtgccaggacctgccctgccccggcacctgcagcgtgcagggcggggcccacatcagcacctatgatgagaagctgtatgacctgcatggagactgcagctatgtgctgagcaagaagtgtgccgacagcagcttcaccgtgctggccgagctgaggaaatgtggcctgacagacaatgaaaactgcctgaaggctgtgaccctgagcctggatggaggagacacagccatccgggtgcaggctgatggcggcgtcttcctgaacagcatctacacccagctgcccctgtctgctgccaacatcaccctcttcacccccagcagcttcttcatcgtggtgcagacaggcctgggcctgcagctgctggtgcagctggtgcccctgatgcaggtgtttgtgcggctggaccctgcccaccagggccagatgtgtggcctgtgtggcaacttcaaccagaaccaggctgatgacttcaccgccctgagcggcgtggtggaggccaccggggccgcctttgccaacacctggaaggcccaggccgcctgtgccaatgccaggaacagctttgaggacccctgcagcctgtctgtggagaatgaaaattatgcccggcactggtgcagccggctgacagaccccaacagcgccttcagccgctgccacagcatcatcaaccccaagcccttccacagcaactgcatgtttgacacctgcaactgtgagaggtctgaggactgcctgtgtgccgccctgagcagctatgtgcacgcctgtgccgccaagggcgtgcagctgagtgactggagagatggagtgtgcaccaagtacatgcagaactgccccaagagccagagatatgcctacgtggtggatgcctgccagcccacctgccggggcctgtctgaggctgatgtgacctgcagcgtgtcctttgtgcctgtggatggctgcacctgcccagctggcaccttcctgaatgatgctggggcctgtgtgcctgcccaggagtgcccctgctacgcccacggcaccgtgctggcccctggagaggtggtgcatgatgagggcgctgtgtgcagctgcaccggcggcaagctgagctgcctgggcgccagcctgcagaagagcacaggctgtgccgcccccatggtgtacctggactgcagcaacagcagcgctggcaccccaggagcagaatgtctgcggagctgccacaccctggatgtgggctgcttcagcacccactgtgtgtctggctgtgtgtgccccccaggcctggtgtctgatggcagcggcggctgcatcgccgaggaggactgcccctgtgtgcacaatgaggccacctacaagccaggagagaccatccgggtggactgcaacacctgcacctgcaggaacagacgctgggagtgcagccaccggctgtgcctgggcacctgtgtggcctatggagatggccacttcatcacctttgatggagaccgctacagctttgagggcagctgtgagtacatcctggcccaggactactgtggggacaacaccacccacggcaccttccgcatcgtgacagagaacatcccctgtggcaccaccggcaccacctgcagcaaggccatcaagctgtttgtggagagctatgagctgatcctgcaggagggcaccttcaaggctgtggcccggggccctggaggagaccccccctacaagatccgctacatgggcatcttcctggtgattgagacccacggcatggctgtgtcctgggacaggaagaccagcgtcttcatccggctgcaccaggactacaagggccgggtgtgtggcctgtgtggcaactttgatgacaatgccatcaatgactttgccaccaggagccgctctgtggtgggagatgccctggagtttggaaacagctggaagctgagccccagctgcccagatgccctggcccccaaggacccctgcacagccaaccccttcaggaagtcctgggcccagaagcagtgcagcatcctgcacggccccacctttgctgcctgccgcagccaggtggacagcaccaagtactatgaggcctgtgtgaatgatgcctgtgcctgtgacagcggcggggactgtgagtgcttctgcacagctgtggccgcctatgcccaggcctgccatgatgctggcctgtgtgtgtcctggaggaccccagacacctgccccctcttctgtgacttctacaacccccacggcggctgtgagtggcactaccagccctgtggggccccctgcctgaagacctgcaggaaccccagcggccactgcctggtggacctgcccggcctggagggctgctaccccaagtgcccccccagccagcccttcttcaatgaagaccagatgaagtgtgtggcccagtgtggctgctatgacaaggatggcaactactatgatgtgggcgcccgggtgcccacagctgagaactgccagagctgcaactgcaccccatctggcatccagtgtgcccacagcctggaggcctgcacctgcacctatgaggacaggacctacagctaccaggatgtgatctacaacaccacagatggcctgggcgcctgcctgattgccatctgtggcagcaatggcaccatcatcaggaaggctgtggcctgccccggcaccccagccaccacccccttcaccttcaccacagcctgggtgccccacagcaccaccagccctgccctgcctgtgtccacagtgtgtgtgcgggaggtgtgccgctggagctcctggtacaacggccacaggcctgagcccggcctgggcggcggggactttgagacctttgagaacctgcggcagaggggctaccaggtgtgccctgtgctggccgacatcgagtgcagagctgcccagctgcctgacatgcccctggaggagctgggccagcaggtggactgtgacaggatgaggggcctgatgtgtgccaacagccagcagagcccccccctgtgccacgactatgagctgcgggtgctgtgctgtgaatatgtgccctgtggccccagccctgcccctggcaccagcccccagcccagcctgagcgccagcacagagcctgctgtgcccacccccacccagaccacagccacagagaagaccaccctgtgggtgacccccagcatccgcagcacagctgccctgaccagccagacaggcagcagcagcggccctgtgacagtgaccccatctgcccctggcaccaccacctgccagccccgctgccagtggacagagtggtttgatgaggactaccccaagtctgagcagctgggcggagatgtggagagctatgacaagatccgggctgctgggggccacctgtgccagcagcccaaggacatcgagtgccaggccgagagcttccccaactggaccctggcccaggtgggccagaaggtgcactgtgatgtgcacttcggcctggtgtgcaggaactgggagcaggagggcgtcttcaagatgtgctacaactaccgcatccgggtgctgtgctgcagtgatgaccactgccggggccgggccaccaccccaccacccaccacagagctggagacagccaccaccaccaccacccaggccctcttcagcaccccccagcccaccagcagccctggcctgacccgggcccccccagccagcaccacagctgtgcccaccctgtctgagggcctgaccagcccccgctacaccagcaccctgggcacagccaccaccggcggccccaccaccccagctggcagcacagagcccaccgtgcctggggtggccaccagcaccctgcccaccaggtctgccctgcccggcaccaccggcagcctgggcacctggaggcccagccagccccccaccctggcccccaccaccatggccaccagccgggcccggcccactggaacagccagcacagccagcaaggagcccctgaccaccagcctggcccccaccctgaccagcgagctgagcaccagccaggccgagaccagcacccccaggacagagaccaccatgagccccctgaccaacaccaccaccagccagggcaccacccgctgccagcccaagtgtgagtggacagagtggtttgatgtggacttccccaccagcggcgtggccggcggggacatggagacctttgagaacatccgggccgccggcggcaagatgtgctgggcccccaagagcattgagtgcagagctgagaactacccagaggtgtccattgaccaggtgggccaggtgctgacctgcagcctggagaccggcctgacctgcaagaatgaagaccagacaggccgcttcaacatgtgcttcaactacaacgtgcgggtgctgtgctgtgatgactacagccactgccccagcaccccagccaccagcagcacagccacccccagcagcaccccaggcaccacctggatcctgaccaagcccaccaccacagccaccaccacagccagcacaggcagcacagccacccccaccagcaccctgaggacagcccccccacccaaggtgctgaccaccacagccaccacccccaccgtgaccagcagcaaggccacccccagcagcagccctggaacagccacagccctgcctgccctgcggagcacagccaccacccccacagccacctctgtgacccccatccccagcagcagcctgggcaccacctggacccggctgagccagaccaccacccccacagccaccatgagcacagccacccccagcagcaccccagagacagcccacaccagcacagtgctgacagccacagccaccaccactggagccaccggctctgtggccacccccagcagcaccccaggcacagcccacaccaccaaggtgcccaccaccaccaccaccggcttcaccgccacccccagcagcagccctggaacagccctgaccccacctgtgtggatcagcaccaccaccacccccaccacccggggcagcacagtgacccccagcagcatccctggcaccacccacacagccaccgtgctgaccaccaccaccaccaccgtggccaccggctccatggccacccccagcagcagcacccagaccagcggcaccccacccagcctgaccaccacagccaccaccatcacagccaccggcagcaccaccaaccccagcagcaccccaggcaccacccccatcccccctgtgctgaccaccacagccaccaccccagctgccaccagcaacacagtgacccccagcagcgccctgggcaccacccacaccccacctgtgcccaacaccatggccaccacccacggccgcagcctgccccccagcagcccccacacagtgaggacagcctggaccagcgccaccagcggcatcctgggcaccacccacatcacagagcccagcacagtgaccagccacaccctggccgccaccaccggcaccacccagcacagcaccccagccctgagcagcccccaccccagcagcaggaccacagagagcccccccagccctggcaccaccaccccaggccacaccacagccaccagcaggaccacagccacagccacccccagcaagaccaggaccagcaccctgctgcccagcagccccaccagcgcccccatcaccaccgtggtgaccatgggctgtgagccccagtgtgcctggagcgagtggctggactacagctaccccatgcctggccccagcggcggggactttgacacctacagcaacatccgggccgccggcggcgctgtgtgtgagcagcccctgggcctggagtgccgggcccaggcccagcccggggtgcccctgcgggagctgggccaggtggtggagtgcagcctggactttggcctggtgtgcaggaaccgggagcaggtgggcaagttcaagatgtgcttcaactatgagatccgggtcttctgctgcaactacggccactgccccagcaccccagccaccagcagcacagccatgcccagcagcaccccaggcaccacctggatcctgacagagctgaccaccacagccaccaccacagagagcacaggcagcacagccacccccagcagcaccccagccacagctggcacccctcatgtgtccaccacagccaccacccccaccgtgaccagcagcaaggccacccccttcagcagccctggaacagccacagccctgcctgccctgcggagcacagccaccacccccacagccaccagcttcaccgccatccccagcagcagcctgggcaccacctggacccggctgagccagaccaccacccccacagccaccatgagcacagccacccccagcagcaccccagagaccgtgcacaccagcacagtgctgaccaccacagccaccaccactggagccaccggctctgtggccacccccagcagcaccccaggcacagcccacaccaccaaggtgctgaccaccaccaccaccggcttcaccgccacccccagcagcagccctggaacagcccggaccctgcctgtgtggatcagcaccaccaccacccccaccacccggggcagcacagtgacccccagcagcatccctggcaccacccacacccccaccgtgctgaccaccaccaccaccaccgtggccaccggctccatggccacccccagcagcagcacccagaccagcggcaccccacccagcctgaccaccacagccaccaccatcacagccaccggcagcaccaccaaccccagcagcaccccaggcaccacccccatcccccctgtgctgaccaccacagccaccaccccagctgccaccagcagcacagtgacccccagcagcgccctgggcaccacccacaccccacctgtgcccaacaccacagccaccacccacggccgcagcctgagccccagcagcccccacacagtgaggacagcctggaccagcgccaccagcggcaccctgggcaccacccacatcacagagcccagcacaggcaccagccacaccccagctgccaccaccggcaccacccagcacagcaccccagccctgagcagcccccaccccagcagcaggaccacagagagcccccccagccctggcaccaccaccccaggccacacccgggccaccagcaggaccacagccacagccacccccagcaagaccaggaccagcaccctgctgcccagcagccccaccagcgcccccatcaccaccgtggtgaccatgggctgtgagccccagtgtgcctggagcgagtggctggactacagctaccccatgcctggccccagcggcggggactttgacacctacagcaacatccgggccgccggcggcgctgtgtgtgagcagcccctgggcctggagtgccgggcccaggcccagcccggggtgcccctgcgggagctgggccaggtggtggagtgcagcctggactttggcctggtgtgcaggaaccgggagcaggtgggcaagttcaagatgtgcttcaactatgagatccgggtcttctgctgcaactacggccactgccccagcaccccagccaccagcagcacagccacccccagcagcaccccaggcaccacctggatcctgacagagcagaccacagctgccaccaccacagccaccaccggcagcacagccatccccagcagcaccccaggcacagcccccccacccaaggtgctgaccagcacagccaccacccccacagccaccagcagcaaggccaccagcagcagcagccccaggacagccaccaccctgcctgtgctgaccagcacagccaccaagagcacagccaccagcttcacccccatccccagcttcaccctgggcaccaccggcaccctgcctgagcagaccaccacccccatggccaccatgagcaccatccaccccagcagcaccccagagaccacccacaccagcacagtgctgaccaccaaggccaccaccacccgggccaccagctccatgagcacccccagcagcaccccaggcaccacctggatcctgacagagctgaccacagctgccaccaccacagctgccaccggccccacagccacccccagcagcaccccaggcaccacctggatcctgacagagcccagcaccacagccaccgtgacagtgcccaccggcagcacagccacagccagcagcacccgggccacagctggcaccctgaaggtgctgaccagcacagccaccacccccaccgtcatcagcagccgggccacccccagcagcagccctggaacagccacagccctgcctgccctgcggagcacagccaccacccccacagccacctctgtgacagccatccccagcagcagcctgggcacagcctggacccggctgagccagaccaccacccccacagccaccatgagcacagccacccccagcagcaccccagagaccgtgcacaccagcacagtgctgaccaccaccaccaccaccacccgggccaccggctctgtggccacccccagcagcaccccaggcacagcccacaccaccaaggtgcccaccaccaccaccaccggcttcaccgccacccccagcagcagccctggaacagccctgaccccacctgtgtggatcagcaccaccaccacccccaccacccggggcagcacagtgacccccagcagcatccctggcaccacccacacagccaccgtgctgaccaccaccaccaccaccgtggccaccggctccatggccacccccagcagcagcacccagaccagcggcaccccacccagcctgaccaccacagccaccaccatcacagccaccggcagcaccaccaaccccagcagcaccccaggcaccacccccatcccccctgtgctgaccaccacagccaccaccccagctgccaccagcagcacagtgacccccagcagcgccctgggcaccacccacaccccacctgtgcccaacaccacagccaccacccacggccgcagcctgccccccagcagcccccacacagtgaggacagcctggaccagcgccaccagcggcatcctgggcaccacccacatcacagagcccagcacagtgaccagccacaccccagctgccaccaccagcaccacccagcacagcaccccagccctgagcagcccccaccccagcagcaggaccacagagagcccccccagccctggcaccaccaccccaggccacacccggggcaccagcaggaccacagccacagccacccccagcaagaccaggaccagcaccctgctgcccagcagccccaccagcgcccccatcaccaccgtggtgaccaccggctgtgagccccagtgtgcctggagcgagtggctggactacagctaccccatgcctggccccagcggcggggactttgacacctacagcaacatccgggccgccggcggcgctgtgtgtgagcagcccctgggcctggagtgccgggcccaggcccagcccggggtgcccctgcgggagctgggccaggtggtggagtgcagcctggactttggcctggtgtgcaggaaccgggagcaggtgggcaagttcaagatgtgcttcaactatgagatccgggtcttctgctgcaactacggccactgccccagcaccccagccaccagcagcacagccacccccagcagcaccccaggcaccacctggatcctgaccaagctgaccaccacagccaccaccacagagagcacaggcagcacagccacccccagcagcacccctggggccacagctggcaccccccacgtgtccaccacagccaccacccccaccgtgaccagcagcaaggccacccccttcagcagccctggaacagccacagccctgcctgccctgcggagcacagccaccacccccacagccaccagcttcaccgccatccccagcagcagcctgggcaccacctggacccggctgagccagaccaccacccccacagccaccatgagcacagccacccccagcagcaccccagagacagcccacaccagcacagtgctgaccaccacagccaccaccacccgggccactggatctgtggccacccccagcagcaccccaggcacagcccacaccaccaaggtgcccaccaccaccaccaccggcttcaccgtgacccccagcagcagccctggaacagcccggaccccacctgtgtggatcagcaccaccaccacccccaccaccagcggcagcacagtgacccccagctctgtgcccggcaccacccacacccccaccgtgctgaccaccaccaccaccaccgtggccaccggctccatggccacccccagcagcagcacccagaccagcggcaccccacccagcctcatcaccacagccaccaccatcacagccaccggcagcaccaccaaccccagcagcaccccaggcaccacccccatcccccctgtgctgaccaccacagccaccaccccagctgccaccagcagcacagtgacccccagcagcgccctgggcaccacccacaccccacctgtgcccaacaccacagccaccacccacggccgcagcctgagccccagcagcccccacacagtgaggacagcctggaccagcgccaccagcggcaccctgggcaccacccacatcacagagcccagcacaggcaccagccacaccccagctgccaccaccggcaccacccagcacagcaccccagccctgagcagcccccaccccagcagcaggaccacagagagcccccccagccctggcaccaccaccccaggccacaccacagccaccagcaggaccacagccacagccacccccagcaagaccaggaccagcaccctgctgcccagcagccccaccagcgcccccatcaccaccgtggtgaccaccggctgtgagccccagtgtgcctggagcgagtggctggactacagctaccccatgcctggccccagcggcggggactttgacacctacagcaacatccgggctgctggaggagctgtgtgtgagcagcccctgggcctggagtgccgggcccaggcccagcccggggtgcccctgggggagctgggccaggtggtggagtgcagcctggactttggcctggtgtgcaggaaccgggagcaggtgggcaagttcaagatgtgcttcaactatgagatccgggtcttctgctgcaactacggccactgccccagcaccccagccaccagcagcacagccatgcccagcagcaccccaggcaccacctggatcctgacagagctgaccaccacagccaccaccacagccagcacaggcagcacagccacccccagcagcaccccaggcacagcccccccacccaaggtgctgaccagccctgccaccacccccacagccaccagcagcaaggccaccagcagcagcagccccaggacagccaccaccctgcctgtgctgaccagcacagccaccaagagcacagccacctctgtgacccccatccccagcagcaccctgggcaccaccggcaccctgcctgagcagaccaccacccctgtggccaccatgagcaccatccaccccagcagcaccccagagaccacccacaccagcacagtgctgaccaccaaggccaccaccacccgggccaccagcagcaccagcacccccagcagcaccccaggcaccacctggatcctgacagagctgaccacagctgccaccaccacagctgccaccggccccacagccacccccagcagcaccccaggcaccacctggatcctgacagagctgaccaccacagccaccaccacagccagcacaggcagcacagccacccccagcagcaccccaggcaccacctggatcctgacagagcccagcaccacagccaccgtgacagtgcccaccggcagcacagccacagccagcagcacccaggccacagctggcaccccccacgtgtccaccacagccaccacccccaccgtgaccagcagcaaggccacccccagcagcagccctggaacagccacagccctgcctgccctgcggagcacagccaccacccccacagccaccagcttcaccgccatccccagcagcagcctgggcaccacctggacccggctgagccagaccaccacccccacagccaccatgagcacagccacccccagcagcaccccagagaccgtgcacaccagcacagtgctgacagccacagccaccaccaccggggccactggatctgtggccacccccagcagcaccccaggcacagcccacaccaccaaggtgcccaccaccaccaccaccggcttcaccgccacccccagcagcagccctggaacagccctgaccccacctgtgtggatcagcaccaccaccacccccaccaccaccacccccaccaccagcggcagcacagtgacccccagcagcatccctggcaccacccacacagcccgggtgctgaccaccaccaccaccaccgtggccaccggctccatggccacccccagcagcagcacccagaccagcggcaccccacccagcctgaccaccacagccaccaccatcacagccaccggcagcaccaccaaccccagcagcaccccaggcaccacccccatcacccctgtgctgaccagcacagccaccaccccagctgccaccagcagcaaggccaccagcagcagcagccccaggacagccaccaccctgcctgtgctgaccagcacagccaccaagagcacagccaccagcttcacccccatccccagcagcaccctgtggaccacctggacagtgcctgcccagaccaccacccccatgagcaccatgagcaccatccacaccagcagcaccccagagaccacccacaccagcacagtgctgaccaccacagccaccatgacccgggccaccaacagcacagccacccccagcagcaccctgggcaccacccgcatcctgacagagctgaccaccacagccaccaccacagctgccaccggcagcacagccaccctgagcagcaccccaggcaccacctggatcctgacagagcccagcaccatcgccaccgtgatggtgcccaccggcagcacagccacagccagcagcaccctgggcacagcccacacccccaaggtggtgaccaccatggccaccatgcccacagccacagccagcacagtgcccagcagcagcacagtgggcaccaccaggaccccagctgtgctgcccagcagcctgcccaccttctctgtgtccacagtgagcagctctgtgctgaccaccctgcggcccaccggcttccccagcagccacttcagcaccccctgcttctgccgggccttcggccagttcttcagccctggagaggtgatctacaacaagacagacagagctggctgccacttctatgctgtgtgcaaccagcactgtgacatcgaccgcttccagggcgcctgccccaccagccccccacctgtgtcctctgcccccctgagcagccccagccctgcccctggctgtgacaatgccatccccctgcggcaggtgaatgagacctggaccctggagaactgcaccgtggcccgctgtgtgggggacaacagagtggtgctgctggaccccaagcctgtggccaacgtgacctgtgtgaacaagcacctgcccatcaaggtgtctgaccccagccagccctgtgacttccactatgaatgtgagtgcatctgcagcatgtggggcggcagccactacagcacctttgatggcaccagctacaccttccggggcaactgcacctacgtgctgatgagggagatccacgccaggtttggaaacctgagcctgtacctggacaaccactactgcacagccagcgccacagctgctgctgcccgctgcccccgggccctgagcatccactacaagtccatggacatcgtgctgactgtgaccatggtgcacggcaaggaggagggcctcatcctgtttgaccagatccctgtgagcagcggcttcagcaagaatggagtgctggtgtctgtgctgggcaccaccaccatgagggtggacatcccagccctgggcgtgtctgtgaccttcaacggccaggtgttccaggcccggctgccctacagcctcttccacaacaacacagagggccagtgtggcacctgcaccaacaaccagagagatgactgcctgcagagagatggcaccacagctgccagctgcaaggacatggccaagacctggctggtgcctgacagcaggaaggatggctgctgggcccccaccggcaccccacccacagccagccctgctgcccctgtgagcagcacccccacccccaccccctgccccccccagcccctgtgtgacctgatgctgagccaggtgtttgctgagtgccacaacctggtgcccccaggccccttcttcaatgcctgcatcagtgaccactgccggggccgcctggaggtgccctgccagagcctggaggcctatgcagagctgtgccgggcccggggcgtgtgcagcgactggaggggggccactggaggcctgtgtgacctgacctgcccccccaccaaggtgtacaagccctgtggccccatccagcctgccacctgcaacagcaggaaccagagcccccagctggagggcatggccgagggctgcttctgcccagaggaccagatcctcttcaatgcccacatgggcatctgtgtgcaggcctgcccctgtgtgggcccagatggcttccccaagtttcctggagagcgctgggtgagcaactgccagagctgtgtgtgtgatgagggctctgtgtctgtgcagtgcaagcccctgccctgtgatgcccagggccagcccccaccctgcaacagacctggctttgtgacagtgacccggcccagggctgagaacccctgctgcccagagaccgtgtgtgtgtgcaacaccaccacctgcccccagagcctgcctgtgtgccccccaggccaggagagcatctgcacccaggaggagggggactgctgccccaccttccgctgccggccccagctgtgcagctacaacggcaccttctacggcgtgggcgccaccttccctggggccctgccctgccacatgtgcacctgcctgagcggggacacccaggaccccaccgtgcagtgccaggaggatgcctgcaacaacaccacctgcccccagggctttgagtacaagagggtggccggccagtgctgcggagaatgtgtgcagacagcctgcctgaccccagatggccagcctgtgcagctgaatgagacctgggtgaacagccacgtggacaactgcaccgtgtacctgtgtgaggccgagggcggcgtgcacctgctgaccccccagcctgccagctgcccagatgtgagcagctgccggggcagcctgaggaagacaggctgctgctacagctgtgaggaggacagctgccaggtgcgcatcaacaccaccatcctgtggcaccagggctgtgaaacagaggtgaacatcaccttctgtgagggcagctgccctggggccagcaagtacagcgctgaggcccaggccatgcagcaccagtgcacctgctgccaggagcggcgggtgcatgaggagaccgtgcccctgcactgccccaatggaagtgccatcctgcacacctacacccacgtggatgaatgtggctgcacccccttctgtgtgcctgcccccatggccccaccccacacccggggcttccctgcccaggaggccacagctgtgtag

SEQ ID NO: 160335 - DNA, 16587 bp, Artificial Sequence
  Description of Artificial Sequence: Synthetic coding sequence
gcccccaggatgggcgcccccagcgcctgcaggaccctggtgctggccctggccgccatgctggtggtgccccaggccggcaagagcccccccctgcggcccctgagcagaaattctggagctggcctggatggaggagcccccaccagcagccccacccggcgggtgtcctttgtgccccctgtgacagtgttccccagcctgagcaggaagcagatgctgcccctgcctgctgggaagggcgtgtttgccagccccaagggcggcggccctgacctgggcgtgcagctgcccccagccctgaacccagcccacaacggccgggtgtgcagcacctggggagacttccactacaagacctttgatggagatgtgttccgcttccctggcctgtgcaactacgtgttttctgagcactgccgggccgcctatgaggacttcaacgtgcagctgcggcggggcctggtgggcagcaggcctgtggtgaccagggtggtgatcaaggcccagggcctggtgctggaggccagcaatggatctgtgctgatcaatggccagcgggaggagctgccctacagcaggacaggcctgctggtggagcagagcggggactacatcaaggtgtccatccggctggtgctgaccttcctgtggaatggagaagattctgccctgctggagctggaccccaagtatgccaaccagacctgtggcctgtgtggggacttcaacggcctgcctgccttcaatgagttctacgcccacaatgcccggctgacccccctgcagtttggaaacctgcagaagctggatggccccacagagcagtgcccagaccccctgcccctgcctgctggcaactgcacagatgaggagggcatctgccacaggaccctgctgggccctgcctttgctgagtgccacgccctggtggacagcacagcctacctggccgcctgtgcccaggacctgtgccgctgccccacctgcccctgtgccacctttgtggagtacagccggcagtgtgcccatgctgggggccagcccaggaactggcgctgcccagagctgtgccccaggacctgccccctgaacatgcagcaccaggagtgtggcagcccctgcacagacacctgcagcaacccccagagggcccagctgtgtgaggaccactgtgtggatggctgcttctgccccccaggccgcagctgcaccgtgctggatgacatcacccacagcggctgcctgcccctgggccagtgcccctgcacccatggaggccgcacctacagccctggcaccagcttcaacaccacctgcagcagctgcacctgcagcggcggcctgtggcagtgccaggacctgccctgccccggcacctgcagcgtgcagggcggggcccacatcagcacctatgatgagaagctgtatgacctgcacggggactgcagctatgtgctgagcaagaagtgtgccgacagcagcttcaccgtgctggccgagctgaggaaatgtggcctgacagacaatgaaaactgcctgaaggctgtgaccctgagcctggatggaggagacacagccatccgggtgcaggctgatggaggagtcttcctgaacagcatctacacccagctgcccctgtctgctgccaacatcaccctcttcacccccagcagcttcttcatcgtggtgcagacaggcctgggcctgcagctgctggtgcagctggtgcccctgatgcaggtgtttgtgcggctggaccctgcccaccagggccagatgtgtggcctgtgtggcaacttcaaccagaaccaggctgatgacttcaccgccctgtctggagtggtggaggccactggagctgcctttgccaacacctggaaggcccaggccgcctgtgccaatgccagaaattcctttgaggacccctgcagcctgtctgtggagaatgaaaattatgcccggcactggtgcagccggctgacagaccccaacagcgccttcagccgctgccacagcatcatcaaccccaagcccttccacagcaactgcatgtttgacacctgcaactgtgagaggtctgaggactgcctgtgtgccgccctgagcagctatgtgcacgcctgtgccgccaagggcgtgcagctgagtgactggagagatggagtgtgcaccaagtacatgcagaactgccccaagagccagagatatgcctacgtggtggatgcctgccagcccacctgccggggcctgtctgaggctgatgtgacctgcagcgtgtcctttgtgcctgtggatggctgcacctgcccagctggcaccttcctgaatgatgctggggcctgtgtgcctgcccaggagtgcccctgctacgcccatggaacagtgctggcccctggagaggtggtgcatgatgaaggagctgtgtgcagctgcacaggaggcaagctgagctgcctgggcgccagcctgcagaagagcacaggctgtgccgcccccatggtgtacctggactgcagcaacagcagcgctggcaccccaggagctgagtgcctgcggagctgccacaccctggatgtgggctgcttcagcacccactgtgtgtctggctgtgtgtgccccccaggcctggtgtctgatggcagcggcggctgcatcgccgaggaggactgcccctgtgtgcacaatgaggccacctacaagccaggagagaccatccgggtggactgcaacacctgcacctgcaggaacagacgctgggagtgcagccaccggctgtgcctgggcacctgtgtggcctatggagatggccacttcatcacctttgatggagaccgctacagctttgagggcagctgtgagtacatcctggcccaggactactgtggggacaacaccacccacggcaccttcagaattgtgacagagaacatcccctgtggcaccaccggcaccacctgcagcaaggccatcaagctgtttgtggaggtgaggacagccccagctgtgtccaccccagaccctgctgccaatgaaccagccccccgggaggcctctgtgggcttccggcagaggctgccccccctgcagagctatgagctgatcctgcaggagggcaccttcaaggctgtggcccggggccctggaggagaccccccctacaagatccgctacatgggcatcttcctggtgattgagacccacggcatggctgtgtcctgggacaggaagacctctgtgttcatccggctgcaccaggactacaagggccgggtgtgtggcctgtgtggcaactttgatgacaatgccatcaatgactttgccaccaggagccgctctgtggtgggagatgccctggagtttggaaacagctggaagctgagccccagctgcccagatgccctggcccccaaggacccctgcacagccaaccccttcaggaagtcctgggcccagaagcagtgcagcatcctgcacggccccacctttgctgcctgccgcagccaggtggacagcaccaagtactatgaggcctgtgtgaatgatgcctgtgcctgtgacagcggcggggactgtgagtgcttctgcacagctgtggccgcctatgcccaggcctgccatgatgctggcctgtgtgtgtcctggaggaccccagacacctgccccctcttctgtgacttctacaacccccatggaggctgtgagtggcactaccagccctgtggggccccctgcctgaagacctgcaggaaccccagcggccactgcctggtggacctgcccggcctggagggctgctaccccaagtgcccccccagccagcccttcttcaatgaagaccagatgaagtgtgtggcccagtgtggctgctatgacaaggatggcaactactatgatgtgggcgcccgggtgcccacagctgagaactgccagagctgcaactgcacccccagcggcatccagtgtgcccacagcctggaggcctgcacctgcacctatgaggacaggacctacagctaccaggacgtcatctacaacaccacagatggcctgggcgcctgcctgattgccatctgtggcagcaatggcaccatcatcaggaaggctgtggcctgccccggcaccccagccaccacccccttcaccttcaccacagcctgggtgccccacagcaccaccagccctgccctgcctgtgtccacagtgtgtgtgcgggaggtgtgccgctggagctcctggtacaacggccacaggcctgagcccggcctgggcggcggggactttgagacctttgagaacctgcggcagaggggctaccaggtgtgccctgtgctggccgacattgaatgtcgggccgcccagctgcctgacatgcccctggaggagctgggccagcaggtggactgtgacaggatgaggggcctgatgtgtgccaacagccagcagagcccccccctgtgccacgactatgagctgcgggtgctgtgctgtgaatatgtgccctgtggccccagccctgcccctggcaccagcccccagcccagcctgagcgccagcacagagcctgctgtgcccacccccacccagaccacagccacagagaagaccaccctgtgggtgacccccagcatccgcagcacagctgccctgaccagccagacaggcagcagcagcggccctgtgacagtgacccccagcgcccctggcaccaccacctgccagccccgctgccagtggacagagtggtttgatgaggactaccccaagtctgagcagctgggcggagatgtggagagctatgacaagatccgggccgccggcggccacctgtgccagcagcccaaggacatcgagtgccaggccgagagcttccccaactggaccctggcccaggtgggccagaaggtgcactgtgatgtgcacttcggcctggtgtgcaggaactgggagcaggagggcgtcttcaagatgtgctacaactaccgcatccgggtgctgtgctgcagtgatgaccactgccggggccgggccaccaccccaccacccaccacagagctggagacagccaccaccaccaccacccaggccctcttcagcaccccccagcccaccagcagccctggcctgacccgggcccccccagccagcaccacagctgtgcccaccctgtctgagggcctgaccagcccccgctacaccagcaccctgggcacagccaccactggaggccccaccaccccagctggcagcacagagcccaccgtgcctggggtggccaccagcaccctgcccaccaggtctgccctgcccggcaccaccggcagcctgggcacctggaggcccagccagccccccaccctggcccccaccaccatggccaccagccgggcccggcccaccggcacagccagcacagccagcaaggagcccctgaccaccagcctggcccccaccctgaccagcgagctgagcaccagccaggccgagaccagcacccccaggacagagaccaccatgagccccctgaccaacaccaccaccagccagggcaccacccgctgccagcccaagtgtgagtggacagagtggtttgatgtggacttccccaccagcggcgtggccggcggggacatggagacctttgagaacatccgggctgctgggggcaagatgtgctgggcccccaagagcattgaatgtagagctgagaactacccagaggtgtccattgaccaggtgggccaggtgctgacctgcagcctggagaccggcctgacctgcaagaatgaagaccagacaggccgcttcaacatgtgcttcaactacaacgtgcgggtgctgtgctgtgatgactacagccactgccccagcaccccagccaccagcagcacagccacccccagcagcaccccaggcaccacctggatcctgaccaagcccaccaccacagccaccaccacagccagcacaggcagcacagccacccccaccagcaccctgaggacagcccccccacccaaggtgctgaccaccacagccaccacccccaccgtgaccagcagcaaggccacccccagcagcagccctggaacagccacagccctgcctgccctgcggagcacagccaccacccccacagccacctctgtgacccccatccccagcagcagcctgggcaccacctggacccggctgagccagaccaccacccccacagccaccatgagcacagccacccccagcagcaccccagagacagcccacaccagcacagtgctgacagccacagccaccaccaccggggccactggatctgtggccacccccagcagcaccccaggcacagcccacaccaccaaggtgcccaccaccaccaccaccggcttcaccgccacccccagcagcagccctggaacagccctgaccccacctgtgtggatcagcaccaccaccacccccaccacccggggcagcacagtgacccccagcagcatccctggcaccacccacacagccaccgtgctgaccaccaccaccaccaccgtggccaccggctccatggccacccccagcagcagcacccagaccagcggcaccacccacaccccacctgtgcccaacaccatggccaccacccacggccgcagcctgccccccagcagcccccacacagtgaggacagcctggaccagcgccaccagcggcatcctgggcaccacccacatcacagagcccagcacagtgaccagccacaccctggccgccaccaccggcaccacccagcacagcaccccagccctgagcagcccccaccccagcagcaggaccacagagagcccccccagccctggcaccaccaccccaggccacaccacagccaccagcaggaccacagccacagccacccccagcaagaccaggaccagcaccctgctgcccagcagccccaccagcgcccccatcaccaccgtggtgaccatgggctgtgagccccagtgtgcctggagcgagtggctggactacagctaccccatgcctggccccagcggcggggactttgacacctacagcaacatccgggccgccggcggcgctgtgtgtgagcagcccctgggcctggagtgccgggcccaggcccagcccggggtgcccctgcgggagctgggccaggtggtggagtgcagcctggactttggcctggtgtgcaggaaccgggagcaggtgggcaagttcaagatgtgcttcaactatgagatccgggtcttctgctgcaactacggccactgccccagcaccccagccaccagcagcacagccatgcccagcagcaccccaggcaccacctggatcctgacagagctgaccaccacagccaccaccacagagagcacaggcagcacagccacccccagcagcaccccaggcaccacctggatcctgacagagcccagcaccacagccaccgtgacagtgcccaccggcagcacagccacagccagcagcacccaggccacagctggcaccccccacgtgtccaccacagccaccacccccaccgtgaccagcagcaaggccacccccttcagcagccctggaacagccacagccctgcctgccctgcggagcacagccaccacccccacagccaccagcttcaccgccatccccagcagcagcctgggcaccacctggacccggctgagccagaccaccacccccacagccaccatgagcacagccacccccagcagcaccccagagaccgtgcacaccagcacagtgctgaccaccacagccaccaccaccggggccactggatctgtggccacccccagcagcaccccaggcacagcccacaccaccaaggtgctgaccaccaccaccaccggcttcaccgccacccccagcagcagccctggaacagcccggaccctgcctgtgtggatcagcaccaccaccacccccaccacccggggcagcacagtgacccccagcagcatccctggcaccacccacacccccaccgtgctgaccaccaccaccaccaccgtggccaccggctccatggccacccccagcagcagcacccagaccagcggcaccacccacaccccacctgtgcccaacaccacagccaccacccacggccgcagcctgagccccagcagcccccacacagtgaggacagcctggaccagcgccaccagcggcaccctgggcaccacccacatcacagagcccagcacaggcaccagccacaccccagctgccaccaccggcaccacccagcacagcaccccagccctgagcagcccccaccccagcagcaggaccacagagagcccccccagccctggcaccaccaccccaggccacacccgggccaccagcaggaccacagccacagccacccccagcaagaccaggaccagcaccctgctgcccagcagccccaccagcgcccccatcaccaccgtggtgaccatgggctgtgagccccagtgtgcctggagcgagtggctggactacagctaccccatgcctggccccagcggcggggactttgacacctacagcaacatccgggccgccggcggcgctgtgtgtgagcagcccctgggcctggagtgccgggcccaggcccagcccggggtgcccctgcgggagctgggccaggtggtggagtgcagcctggactttggcctggtgtgcaggaaccgggagcaggtgggcaagttcaagatgtgcttcaactatgagatccgggtcttctgctgcaactacggccactgccccagcaccccagccaccagcagcacagccacccccagcagcaccccaggcaccacctggatcctgacagagcagaccacagctgccaccaccacagccaccaccggcagcacagccatccccagcagcaccccaggcacagcccccccacccaaggtgctgaccagcacagccaccacccccacagccaccagcagcaaggccaccagcagcagcagccccaggacagccaccaccctgcctgtgctgaccagcacagccaccaagagcacagccaccagcttcacccccatccccagcttcaccctgggcaccaccggcaccctgcctgagcagaccaccacccccatggccaccatgagcaccatccaccccagcagcaccccagagaccacccacaccagcacagtgctgaccaccaaggccaccaccacccgggccaccagctccatgagcacccccagcagcaccccaggcaccacctggatcctgacagagctgaccacagctgccaccaccacagctgccaccggccccacagccacccccagcagcaccccaggcaccacctggatcctgacagagcccagcaccacagccaccgtgacagtgcccaccggcagcacagccacagccagcagcacccgggccacagctggcaccctgaaggtgctgaccagcacagccaccacccccaccgtcatcagcagccgggccacccccagcagcagccctggaacagccacagccctgcctgccctgcggagcacagccaccacccccacagccacctctgtgacagccatccccagcagcagcctgggcacagcctggacccggctgagccagaccaccacccccacagccaccatgagcacagccacccccagcagcaccccagagaccgtgcacaccagcacagtgctgaccaccaccaccaccaccacccgggccaccggctctgtggccacccccagcagcaccccaggcacagcccacaccaccaaggtgcccaccaccaccaccaccggcttcaccgccacccccagcagcagccctggaacagccctgaccccacctgtgtggatcagcaccaccaccacccccaccacccggggcagcacagtgacccccagcagcatccctggcaccacccacacagccaccgtgctgaccaccaccaccaccaccgtggccaccggctccatggccacccccagcagcagcacccagaccagcggcaccacccacaccccacctgtgcccaacaccacagccaccacccacggccgcagcctgccccccagcagcccccacacagtgaggacagcctggaccagcgccaccagcggcatcctgggcaccacccacatcacagagcccagcacagtgaccagccacaccccagctgccaccaccagcaccacccagcacagcaccccagccctgagcagcccccaccccagcagcaggaccacagagagcccccccagccctggcaccaccaccccaggccacacccggggcaccagcaggaccacagccacagccacccccagcaagaccaggaccagcaccctgctgcccagcagccccaccagcgcccccatcaccaccgtggtgaccaccggctgtgagccccagtgtgcctggagcgagtggctggactacagctaccccatgcctggccccagcggcggggactttgacacctacagcaacatccgggctgctggaggagctgtgtgtgagcagcccctgggcctggagtgccgggcccaggcccagcccggggtgcccctgcgggagctgggccaggtggtggagtgcagcctggactttggcctggtgtgcaggaaccgggagcaggtgggcaagttcaagatgtgcttcaactatgagatccgggtcttctgctgcaactacggccactgccccagcaccccagccaccagcagcacagccacccccagcagcaccccaggcaccacctggatcctgaccaagctgaccaccacagccaccaccacagagagcacaggcagcacagccacccccagcagcaccccaggcaccacctggatcctgacagagcccagcaccacagccaccgtgacagtgcccaccggcagcacagccacagccagcagcacccaggccacagctggcacccctcatgtgtccaccacagccaccacccccaccgtgaccagcagcaaggccacccccttcagcagccctggaacagccacagccctgcctgccctgcggagcacagccaccacccccacagccaccagcttcaccgccatccccagcagcagcctgggcaccacctggacccggctgagccagaccaccacccccacagccaccatgagcacagccacccccagcagcaccccagagacagcccacaccagcacagtgctgaccaccacagccaccaccacccgggccaccggctctgtggccacccccagcagcaccccaggcacagcccacaccaccaaggtgcccaccaccaccaccaccggcttcaccgtgacccccagcagcagccctggaacagcccggaccccacctgtgtggatcagcaccaccaccacccccaccaccagcggcagcacagtgacccccagctctgtgcccggcaccacccacacccccaccgtgctgaccaccaccaccaccaccgtggccaccggctccatggccacccccagcagcagcacccagaccagcggcaccacccacaccccacctgtgcccaacaccacagccaccacccacggccgcagcctgagccccagcagcccccacacagtgaggacagcctggaccagcgccaccagcggcaccctgggcaccacccacatcacagagcccagcacaggcaccagccacaccccagctgccaccaccggcaccacccagcacagcaccccagccctgagcagcccccaccccagcagcaggaccacagagagcccccccagccctggcaccaccaccccaggccacaccacagccaccagcaggaccacagccacagccacccccagcaagaccaggaccagcaccctgctgcccagcagccccaccagcgcccccatcaccaccgtggtgaccaccggctgtgagccccagtgtgcctggagcgagtggctggactacagctaccccatgcctggccccagcggcggggactttgacacctacagcaacatccgggctgctggaggagctgtgtgtgagcagcccctgggcctggagtgccgggcccaggcccagcccggggtgcccctgggggagctgggccaggtggtggagtgcagcctggactttggcctggtgtgcaggaaccgggagcaggtgggcaagttcaagatgtgcttcaactatgagatccgggtcttctgctgcaactacggccactgccccagcaccccagccaccagcagcacagccatgcccagcagcaccccaggcaccacctggatcctgacagagctgaccaccacagccaccaccacagccagcacaggcagcacagccacccccagcagcaccccaggcacagcccccccacccaaggtgctgaccagccctgccaccacccccacagccaccagcagcaaggccaccagcagcagcagccccaggacagccaccaccctgcctgtgctgaccagcacagccaccaagagcacagccacctctgtgacccccatccccagcagcaccctgggcaccaccggcaccctgcctgagcagaccaccacccctgtggccaccatgagcaccatccaccccagcagcaccccagagaccacccacaccagcacagtgctgaccaccaaggccaccaccacccgggccaccagcagcaccagcacccccagcagcaccccaggcaccacctggatcctgacagagctgaccacagctgccaccaccacagctgccaccggccccacagccacccccagcagcaccccaggcaccacctggatcctgacagagctgaccaccacagccaccaccacagccagcacaggcagcacagccacccccagcagcaccccaggcaccacctggatcctgacagagcccagcaccacagccaccgtgacagtgcccaccggcagcacagccacagccagcagcacccaggccacagctggcaccccccacgtgtccaccacagccaccacccccaccgtgaccagcagcaaggccacccccagcagcagccctggaacagccacagccctgcctgccctgcggagcacagccaccacccccacagccaccagcttcaccgccatccccagcagcagcctgggcaccacctggacccggctgagccagaccaccacccccacagccaccatgagcacagccacccccagcagcaccccagagaccgtgcacaccagcacagtgctgacagccacagccaccaccaccggggccactggatctgtggccacccccagcagcaccccaggcacagcccacaccaccaaggtgcccaccaccaccaccaccggcttcaccgccacccccagcagcagccctggaacagccctgaccccacccaccaccacccccatgagcaccatgagcaccatccacaccagcagcaccccagagaccacccacaccagcacagtgctgaccaccacagccaccatgacccgggccaccaacagcacagccacccccagcagcaccctgggcaccacccgcatcctgacagagctgaccaccacagccaccaccacagctgccaccggcagcacagccaccctgagcagcaccccaggcaccacctggatcctgacagagcccagcaccatcgccaccgtgatggtgcccaccggcagcacagccacagccagcagcaccctgggcacagcccacacccccaaggtggtgaccaccatggccaccatgcccacagccacagccagcacagtgcccagcagcagcacagtgggcaccaccaggaccccagctgtgctgcccagcagcctgcccaccttctctgtgtccacagtgagcagctctgtgctgaccaccctgcggcccaccggcttccccagcagccacttcagcaccccctgcttctgccgggccttcggccagttcttcagccctggagaggtgatctacaacaagacagaccgggccggctgccacttctatgctgtgtgcaaccagcactgtgacatcgaccgcttccagggcgcctgccccaccagccccccacctgtgagcagcgcccccctgagcagccccagccctgcccctggctgtgacaatgccatccccctgcggcaggtgaatgagacctggaccctggagaactgcaccgtggcccgctgtgtgggggacaacagagtggtgctgctggaccccaagcctgtggccaacgtgacctgtgtgaacaagcacctgcccatcaaggtgtctgaccccagccagccctgtgacttccactatgaatgtgaatgtgaatgtgtgggcggccggggcatcacccctggggccggcatctgcagcatgtggggcggcagccactacagcacctttgatggcaccagctacaccttccggggcaactgcacctacgtgctgatgagggagatccacgccaggtttggaaacctgagcctgtacctggacaaccactactgcacagccagcgccacagctgctgctgcccgctgcccccgggccctgagcatccactacaagtccatggacatcgtgctgactgtgaccatggtgcacggcaaggaggagggcctcatcctgtttgaccagatccctgtgagcagcggcttcagcaagaatggagtgctggtgtctgtgctgggcaccaccaccatgagggtggacatcccagccctgggcgtgtctgtgaccttcaacggccaggtgttccaggcccggctgccctacagcctcttccacaacaacacagagggccagtgtggcacctgcaccaacaaccagagagatgactgcctgcagagagatggcaccacagctgccagctgcaaggacatggccaagacctggctggtgcctgacagcaggaaggatggctgctgggcccccaccggcaccccacccacagccagccctgctgcccctgtgagcagcacccccacccccaccccctgccccccccagcccctgtgtgacctgatgctgagccaggtgtttgctgagtgccacaacctggtgcccccaggccccttcttcaatgcctgcatcagtgaccactgccggggccgcctggaggtgccctgccagagcctggaggcctatgcagagctgtgccgggcccggggcgtgtgcagcgactggaggggggccactggaggcctgtgtgacctgacctgcccccccaccaaggtgtacaagccctgtggccccatccagcctgccacctgcaacagcaggaaccagagcccccagctggagggcatggccgagggctgcttctgcccagaggaccagatcctcttcaatgcccacatgggcatctgtgtgcaggcctgcccctgtgtgggcccagatggcttccccaagtttcctggagagcgctgggtgagcaactgccagagctgtgtgtgtgatgagggctctgtgtctgtgcagtgcaagcccctgccctgtgatgcccagggccagcccccaccctgcaacagacctggctttgtgacagtgacccggcccagggctgagaacccctgctgcccagagaccgtgtgtgtgtgcaacaccaccacctgcccccagagcctgcctgtgtgccccccaggccaggagagcatctgcacccaggaggagggggactgctgccccaccttccgctgccggccccagctgtgcagctacaacggcaccttctacggcgtgggcgccaccttccctggggccctgccctgccacatgtgcacctgcctgagcggggacacccaggaccccaccgtgcagtgccaggaggatgcctgcaacaacaccacctgcccccagggctttgagtacaagagggtggccggccagtgctgcggagaatgtgtgcagacagcctgcctgaccccagatggccagcctgtgcagctgaatgagacctgggtgaacagccacgtggacaactgcaccgtgtacctgtgtgaggccgagggcggcgtgcacctgctgaccccccagcctgccagctgcccagatgtgagcagctgccggggcagcctgaggaagacaggctgctgctacagctgtgaggaggacagctgccaggtgcgcatcaacaccaccatcctgtggcaccagggctgtgaaacagaggtgaacatcaccttctgtgagggcagctgccctggggccagcaagtacagcgctgaggcccaggccatgcagcaccagtgcacctgctgccaggagcggcgggtgcatgaggagaccgtgcccctgcactgccccaatggaagtgccatcctgcacacctacacccatgctgtgcaggtgctgtgtggcctgctggcctggggcctgcaggccggcggccacatcagaggagctgtgcaggacccccagcagcccctgaaggaccaggaggccagcggcaaggcccggcagggcggcggctaccggcagacagtggcctggggagacaagagcaatgcccgggcctggctgcagaagcctgtggtgtgggtgcagagcggggccttccccaccccaggccctgccagcgccctgtgcccctggtag

SEQ ID NO: 160336 - DNA, 17298 bp, Artificial Sequence
  Description of Artificial Sequence: Synthetic coding sequence
atgggcgcccccagcgcctgcaggaccctggtgctggccctggccgccatgctggtggtgccccaggccgagacccagggccctgtggagcccagctgggagaatgccggccacaccatggatggaggagcccccaccagcagccccaccaggagagtgtcctttgtgccccctgtgaccgtcttccccagcctgagccccctgaacccagcccacaacggccgggtgtgcagcacctggggagacttccactacaagacctttgatggagatgtgttccgcttccctggcctgtgcaactacgtgttcagcgagcactgcagagctgcctatgaggacttcaacgtgcagctgcggcggggcctggtgggcagcaggcctgtggtgaccagggtggtgatcaaggcccagggcctggtgctggaggccagcaatggatctgtgctgatcaatggccagcgggaggagctgccctacagcaggacaggcctgctggtggagcagagcggggactacatcaaggtgtccatccggctggtgctgaccttcctgtggaatggagaggacagcgccctgctggagctggaccccaagtatgccaaccagacctgtggcctgtgtggggacttcaacggcctgcctgccttcaatgagttctacgcccacaatgcccggctgacccccctgcagtttggaaacctgcagaagctggatggccccacagagcagtgcccagaccccctgcccctgcctgctggcaactgcacagatgaggagggcatctgccacaggaccctgctgggccctgcctttgctgaatgtcatgccctggtggacagcacagcctacctggccgcctgtgcccaggacctgtgccgctgccccacctgcccctgtgccacctttgtggagtacagccggcagtgtgcccacgccggcggccagcccaggaactggcgctgcccagagctgtgccccaggacctgccccctgaacatgcagcaccaggagtgtggcagcccctgcacagacacctgcagcaacccccagagggcccagctgtgtgaggaccactgtgtggatggctgcttctgccccccaggccgcagctgcaccgtgctggatgacatcacccacagcggctgcctgcccctgggccagtgcccctgcacccacggcggccgcacctacagccctggcaccagcttcaacaccacctgcagcagctgcacctgcagcggcggcctgtggcagtgccaggacctgccctgccccggcacctgcagcgtgcagggcggggcccacatcagcacctatgatgagaagctgtatgacctgcatggagactgcagctatgtgctgagcaagaagtgtgccgacagcagcttcaccgtgctggccgagctgaggaaatgtggcctgacagacaatgaaaactgcctgaaggctgtgaccctgagcctggatggaggagacacagccatccgggtgcaggctgatggcggcgtcttcctgaacagcatctacacccagctgcccctgtctgctgccaacatcaccctcttcacccccagcagcttcttcatcgtggtgcagacaggcctgggcctgcagctgctggtgcagctggtgcccctgatgcaggtgtttgtgcggctggaccctgcccaccagggccagatgtgtggcctgtgtggcaacttcaaccagaaccaggctgatgacttcaccgccctgagcggcgtggtggaggccaccggggccgcctttgccaacacctggaaggcccaggccgcctgtgccaatgccaggaacagctttgaggacccctgcagcctgtctgtggagaatgaaaattatgcccggcactggtgcagccggctgacagaccccaacagcgccttcagccgctgccacagcatcatcaaccccaagcccttccacagcaactgcatgtttgacacctgcaactgtgagaggtctgaggactgcctgtgtgccgccctgagcagctatgtgcacgcctgtgccgccaagggcgtgcagctgagtgactggagagatggagtgtgcaccaagtacatgcagaactgccccaagagccagagatatgcctacgtggtggatgcctgccagcccacctgccggggcctgtctgaggctgatgtgacctgcagcgtgtcctttgtgcctgtggatggctgcacctgcccagctggcaccttcctgaatgatgctggggcctgtgtgcctgcccaggagtgcccctgctacgcccacggcaccgtgctggcccctggagaggtggtgcatgatgagggcgctgtgtgcagctgcaccggcggcaagctgagctgcctgggcgccagcctgcagaagagcacaggctgtgccgcccccatggtgtacctggactgcagcaacagcagcgctggcaccccaggagcagaatgtctgcggagctgccacaccctggatgtgggctgcttcagcacccactgtgtgtctggctgtgtgtgccccccaggcctggtgtctgatggcagcggcggctgcatcgccgaggaggactgcccctgtgtgcacaatgaggccacctacaagccaggagagaccatccgggtggactgcaacacctgcacctgcaggaacagacgctgggagtgcagccaccggctgtgcctgggcacctgtgtggcctatggagatggccacttcatcacctttgatggagaccgctacagctttgagggcagctgtgagtacatcctggcccaggactactgtggggacaacaccacccacggcaccttccgcatcgtgacagagaacatcccctgtggcaccaccggcaccacctgcagcaaggccatcaagctgtttgtggagagctatgagctgatcctgcaggagggcaccttcaaggctgtggcccggggccctggaggagaccccccctacaagatccgctacatgggcatcttcctggtgattgagacccacggcatggctgtgtcctgggacaggaagaccagcgtcttcatccggctgcaccaggactacaagggccgggtgtgtggcctgtgtggcaactttgatgacaatgccatcaatgactttgccaccaggagccgctctgtggtgggagatgccctggagtttggaaacagctggaagctgagccccagctgcccagatgccctggcccccaaggacccctgcacagccaaccccttcaggaagtcctgggcccagaagcagtgcagcatcctgcacggccccacctttgctgcctgccgcagccaggtggacagcaccaagtactatgaggcctgtgtgaatgatgcctgtgcctgtgacagcggcggggactgtgagtgcttctgcacagctgtggccgcctatgcccaggcctgccatgatgctggcctgtgtgtgtcctggaggaccccagacacctgccccctcttctgtgacttctacaacccccacggcggctgtgagtggcactaccagccctgtggggccccctgcctgaagacctgcaggaaccccagcggccactgcctggtggacctgcccggcctggagggctgctaccccaagtgcccccccagccagcccttcttcaatgaagaccagatgaagtgtgtggcccagtgtggctgctatgacaaggatggcaactactatgatgtgggcgcccgggtgcccacagctgagaactgccagagctgcaactgcaccccatctggcatccagtgtgcccacagcctggaggcctgcacctgcacctatgaggacaggacctacagctaccaggatgtgatctacaacaccacagatggcctgggcgcctgcctgattgccatctgtggcagcaatggcaccatcatcaggaaggctgtggcctgccccggcaccccagccaccacccccttcaccttcaccacagcctgggtgccccacagcaccaccagccctgccctgcctgtgtccacagtgtgtgtgcgggaggtgtgccgctggagctcctggtacaacggccacaggcctgagcccggcctgggcggcggggactttgagacctttgagaacctgcggcagaggggctaccaggtgtgccctgtgctggccgacatcgagtgcagagctgcccagctgcctgacatgcccctggaggagctgggccagcaggtggactgtgacaggatgaggggcctgatgtgtgccaacagccagcagagcccccccctgtgccacgactatgagctgcgggtgctgtgctgtgaatatgtgccctgtggccccagccctgcccctggcaccagcccccagcccagcctgagcgccagcacagagcctgctgtgcccacccccacccagaccacagccacagagaagaccaccctgtgggtgacccccagcatccgcagcacagctgccctgaccagccagacaggcagcagcagcggccctgtgacagtgaccccatctgcccctggcaccaccacctgccagccccgctgccagtggacagagtggtttgatgaggactaccccaagtctgagcagctgggcggagatgtggagagctatgacaagatccgggctgctgggggccacctgtgccagcagcccaaggacatcgagtgccaggccgagagcttccccaactggaccctggcccaggtgggccagaaggtgcactgtgatgtgcacttcggcctggtgtgcaggaactgggagcaggagggcgtcttcaagatgtgctacaactaccgcatccgggtgctgtgctgcagtgatgaccactgccggggccgggccaccaccccaccacccaccacagagctggagacagccaccaccaccaccacccaggccctcttcagcaccccccagcccaccagcagccctggcctgacccgggcccccccagccagcaccacagctgtgcccaccctgtctgagggcctgaccagcccccgctacaccagcaccctgggcacagccaccaccggcggccccaccaccccagctggcagcacagagcccaccgtgcctggggtggccaccagcaccctgcccaccaggtctgccctgcccggcaccaccggcagcctgggcacctggaggcccagccagccccccaccctggcccccaccaccatggccaccagccgggcccggcccactggaacagccagcacagccagcaaggagcccctgaccaccagcctggcccccaccctgaccagcgagctgagcaccagccaggccgagaccagcacccccaggacagagaccaccatgagccccctgaccaacaccaccaccagccagggcaccacccgctgccagcccaagtgtgagtggacagagtggtttgatgtggacttccccaccagcggcgtggccggcggggacatggagacctttgagaacatccgggccgccggcggcaagatgtgctgggcccccaagagcattgagtgcagagctgagaactacccagaggtgtccattgaccaggtgggccaggtgctgacctgcagcctggagaccggcctgacctgcaagaatgaagaccagacaggccgcttcaacatgtgcttcaactacaacgtgcgggtgctgtgctgtgatgactacagccactgccccagcaccccagccaccagcagcacagccacccccagcagcaccccaggcaccacctggatcctgaccaagcccaccaccacagccaccaccacagccagcacaggcagcacagccacccccaccagcaccctgaggacagcccccccacccaaggtgctgaccaccacagccaccacccccaccgtgaccagcagcaaggccacccccagcagcagccctggaacagccacagccctgcctgccctgcggagcacagccaccacccccacagccacctctgtgacccccatccccagcagcagcctgggcaccacctggacccggctgagccagaccaccacccccacagccaccatgagcacagccacccccagcagcaccccagagacagcccacaccagcacagtgctgacagccacagccaccaccactggagccaccggctctgtggccacccccagcagcaccccaggcacagcccacaccaccaaggtgcccaccaccaccaccaccggcttcaccgccacccccagcagcagccctggaacagccctgaccccacctgtgtggatcagcaccaccaccacccccaccacccggggcagcacagtgacccccagcagcatccctggcaccacccacacagccaccgtgctgaccaccaccaccaccaccgtggccaccggctccatggccacccccagcagcagcacccagaccagcggcaccccacccagcctgaccaccacagccaccaccatcacagccaccggcagcaccaccaaccccagcagcaccccaggcaccacccccatcccccctgtgctgaccaccacagccaccaccccagctgccaccagcaacacagtgacccccagcagcgccctgggcaccacccacaccccacctgtgcccaacaccatggccaccacccacggccgcagcctgccccccagcagcccccacacagtgaggacagcctggaccagcgccaccagcggcatcctgggcaccacccacatcacagagcccagcacagtgaccagccacaccctggccgccaccaccggcaccacccagcacagcaccccagccctgagcagcccccaccccagcagcaggaccacagagagcccccccagccctggcaccaccaccccaggccacaccacagccaccagcaggaccacagccacagccacccccagcaagaccaggaccagcaccctgctgcccagcagccccaccagcgcccccatcaccaccgtggtgaccatgggctgtgagccccagtgtgcctggagcgagtggctggactacagctaccccatgcctggccccagcggcggggactttgacacctacagcaacatccgggccgccggcggcgctgtgtgtgagcagcccctgggcctggagtgccgggcccaggcccagcccggggtgcccctgcgggagctgggccaggtggtggagtgcagcctggactttggcctggtgtgcaggaaccgggagcaggtgggcaagttcaagatgtgcttcaactatgagatccgggtcttctgctgcaactacggccactgccccagcaccccagccaccagcagcacagccatgcccagcagcaccccaggcaccacctggatcctgacagagctgaccaccacagccaccaccacagagagcacaggcagcacagccacccccagcagcaccccaggcaccacctggatcctgacagagcccagcaccacagccaccgtgacagtgcccaccggcagcacagccacagccagcagcacccaggccacagctggcaccccccacgtgtccaccacagccaccacccccaccgtgaccagcagcaaggccacccccttcagcagccctggaacagccacagccctgcctgccctgcggagcacagccaccacccccacagccaccagcttcaccgccatccccagcagcagcctgggcaccacctggacccggctgagccagaccaccacccccacagccaccatgagcacagccacccccagcagcaccccagagaccgtgcacaccagcacagtgctgaccaccacagccaccaccaccggggccactggatctgtggccacccccagcagcaccccaggcacagcccacaccaccaaggtgctgaccaccaccaccaccggcttcaccgccacccccagcagcagccctggaacagcccggaccctgcctgtgtggatcagcaccaccaccacccccaccacccggggcagcacagtgacccccagcagcatccctggcaccacccacacccccaccgtgctgaccaccaccaccaccaccgtggccaccggctccatggccacccccagcagcagcacccagaccagcggcaccccacccagcctgaccaccacagccaccaccatcacagccaccggcagcaccaccaaccccagcagcaccccaggcaccacccccatcccccctgtgctgaccaccacagccaccaccccagctgccaccagcagcacagtgacccccagcagcgccctgggcaccacccacaccccacctgtgcccaacaccacagccaccacccacggccgcagcctgagccccagcagcccccacacagtgaggacagcctggaccagcgccaccagcggcaccctgggcaccacccacatcacagagcccagcacaggcaccagccacaccccagctgccaccaccggcaccacccagcacagcaccccagccctgagcagcccccaccccagcagcaggaccacagagagcccccccagccctggcaccaccaccccaggccacacccgggccaccagcaggaccacagccacagccacccccagcaagaccaggaccagcaccctgctgcccagcagccccaccagcgcccccatcaccaccgtggtgaccatgggctgtgagccccagtgtgcctggagcgagtggctggactacagctaccccatgcctggccccagcggcggggactttgacacctacagcaacatccgggctgctggaggagctgtgtgtgagcagcccctgggcctggagtgccgggcccaggcccagcccggggtgcccctgcgggagctgggccaggtggtggagtgcagcctggactttggcctggtgtgcaggaaccgggagcaggtgggcaagttcaagatgtgcttcaactatgagatccgggtcttctgctgcaactacggccactgccccagcaccccagccaccagcagcacagccacccccagcagcaccccaggcaccacctggatcctgacagagcagaccacagctgccaccaccacagccaccaccggcagcacagccatccccagcagcaccccaggcacagcccccccacccaaggtgctgaccagcacagccaccacccccacagccaccagcagcaaggccaccagcagcagcagccccaggacagccaccaccctgcctgtgctgaccagcacagccaccaagagcacagccaccagcttcacccccatccccagcttcaccctgggcaccaccggcaccctgcctgagcagaccaccacccccatggccaccatgagcaccatccaccccagcagcaccccagagaccacccacaccagcacagtgctgaccaccaaggccaccaccacccgggccaccagctccatgagcacccccagcagcaccccaggcaccacctggatcctgacagagctgaccacagctgccaccaccacagctgccaccggccccacagccacccccagcagcaccccaggcaccacctggatcctgacagagcccagcaccacagccaccgtgacagtgcccaccggcagcacagccacagccagcagcacccgggccacagctggcaccctgaaggtgctgaccagcacagccaccacccccaccgtcatcagcagccgggccacccccagcagcagccctggaacagccacagccctgcctgccctgcggagcacagccaccacccccacagccacctctgtgacagccatccccagcagcagcctgggcacagcctggacccggctgagccagaccaccacccccacagccaccatgagcacagccacccccagcagcaccccagagaccgtgcacaccagcacagtgctgaccaccaccaccaccaccacccgggccactggatctgtggccacccccagcagcaccccaggcacagcccacaccaccaaggtgcccaccaccaccaccaccggcttcaccgccacccccagcagcagccctggaacagccctgaccccacctgtgtggatcagcaccaccaccacccccaccacccggggcagcacagtgacccccagcagcatccctggcaccacccacacagccaccgtgctgaccaccaccaccaccaccgtggccaccggctccatggccacccccagcagcagcacccagaccagcggcaccccacccagcctgaccaccacagccaccaccatcacagccaccggcagcaccaccaaccccagcagcaccccaggcaccacccccatcccccctgtgctgaccaccacagccaccaccccagctgccaccagcagcacagtgacccccagcagcgccctgggcaccacccacaccccacctgtgcccaacaccacagccaccacccacggccgcagcctgccccccagcagcccccacacagtgaggacagcctggaccagcgccaccagcggcatcctgggcaccacccacatcacagagcccagcacagtgaccagccacaccccagctgccaccaccagcaccacccagcacagcaccccagccctgagcagcccccaccccagcagcaggaccacagagagcccccccagccctggcaccaccaccccaggccacacccggggcaccagcaggaccacagccacagccacccccagcaagaccaggaccagcaccctgctgcccagcagccccaccagcgcccccatcaccaccgtggtgaccaccggctgtgagccccagtgtgcctggagcgagtggctggactacagctaccccatgcctggccccagcggcggggactttgacacctacagcaacatccgggctgctggaggagctgtgtgtgagcagcccctgggcctggagtgccgggcccaggcccagcccggggtgcccctgcgggagctgggccaggtggtggagtgcagcctggactttggcctggtgtgcaggaaccgggagcaggtgggcaagttcaagatgtgcttcaactatgagatccgggtcttctgctgcaactacggccactgccccagcaccccagccaccagcagcacagccacccccagcagcaccccaggcaccacctggatcctgaccaagctgaccaccacagccaccaccacagagagcacaggcagcacagccacccccagcagcaccccaggcaccacctggatcctgacagagcccagcaccacagccaccgtgacagtgcccaccggcagcacagccacagccagcagcacccaggccacagctggcacccctcatgtgtccaccacagccaccacccccaccgtgaccagcagcaaggccacccccttcagcagccctggaacagccacagccctgcctgccctgcggagcacagccaccacccccacagccaccagcttcaccgccatccccagcagcagcctgggcaccacctggacccggctgagccagaccaccacccccacagccaccatgagcacagccacccccagcagcaccccagagacagcccacaccagcacagtgctgaccaccacagccaccaccacccgggccaccggctctgtggccacccccagcagcaccccaggcacagcccacaccaccaaggtgcccaccaccaccaccaccggcttcaccgtgacccccagcagcagccctggaacagcccggaccccacctgtgtggatcagcaccaccaccacccccaccaccagcggcagcacagtgacccccagctctgtgcccggcaccacccacacccccaccgtgctgaccaccaccaccaccaccgtggccaccggctccatggccacccccagcagcagcacccagaccagcggcaccccacccagcctcatcaccacagccaccaccatcacagccaccggcagcaccaccaaccccagcagcaccccaggcaccacccccatcccccctgtgctgaccaccacagccaccaccccagctgccaccagcagcacagtgacccccagcagcgccctgggcaccacccacaccccacctgtgcccaacaccacagccaccacccacggccgcagcctgagccccagcagcccccacacagtgaggacagcctggaccagcgccaccagcggcaccctgggcaccacccacatcacagagcccagcacaggcaccagccacaccccagctgccaccaccggcaccacccagcacagcaccccagccctgagcagcccccaccccagcagcaggaccacagagagcccccccagccctggcaccaccaccccaggccacaccacagccaccagcaggaccacagccacagccacccccagcaagaccaggaccagcaccctgctgcccagcagccccaccagcgcccccatcaccaccgtggtgaccaccggctgtgagccccagtgtgcctggagcgagtggctggactacagctaccccatgcctggccccagcggcggggactttgacacctacagcaacatccgggccgccggcggcgctgtgtgtgagcagcccctgggcctggagtgccgggcccaggcccagcccggggtgcccctgggggagctgggccaggtggtggagtgcagcctggactttggcctggtgtgcaggaaccgggagcaggtgggcaagttcaagatgtgcttcaactatgagatccgggtcttctgctgcaactacggccactgccccagcaccccagccaccagcagcacagccatgcccagcagcaccccaggcaccacctggatcctgacagagctgaccaccacagccaccaccacagccagcacaggcagcacagccacccccagcagcaccccaggcacagcccccccacccaaggtgctgaccagccctgccaccacccccacagccaccagcagcaaggccaccagcagcagcagccccaggacagccaccaccctgcctgtgctgaccagcacagccaccaagagcacagccacctctgtgacccccatccccagcagcaccctgggcaccaccggcaccctgcctgagcagaccaccacccctgtggccaccatgagcaccatccaccccagcagcaccccagagaccacccacaccagcacagtgctgaccaccaaggccaccaccacccgggccaccagcagcaccagcacccccagcagcaccccaggcaccacctggatcctgacagagctgaccacagctgccaccaccacagctgccaccggccccacagccacccccagcagcaccccaggcaccacctggatcctgacagagctgaccaccacagccaccaccacagccagcacaggcagcacagccacccccagcagcaccccaggcaccacctggatcctgacagagcccagcaccacagccaccgtgacagtgcccaccggcagcacagccacagccagcagcacccaggccacagctggcacccctcatgtgtccaccacagccaccacccccaccgtgaccagcagcaaggccacccccagcagcagccctggaacagccacagccctgcctgccctgcggagcacagccaccacccccacagccaccagcttcaccgccatccccagcagcagcctgggcaccacctggacccggctgagccagaccaccacccccacagccaccatgagcacagccacccccagcagcaccccagagaccgtgcacaccagcacagtgctgacagccacagccaccaccactggagccaccggctctgtggccacccccagcagcaccccaggcacagcccacaccaccaaggtgcccaccaccaccaccaccggcttcaccgccacccccagcagcagccctggaacagccctgaccccacctgtgtggatcagcaccaccaccacccccaccaccaccacccccaccaccagcggcagcacagtgacccccagcagcatccctggcaccacccacacagcccgggtgctgaccaccaccaccaccaccgtggccaccggctccatggccacccccagcagcagcacccagaccagcggcaccccacccagcctgaccaccacagccaccaccatcacagccaccggcagcaccaccaaccccagcagcaccccaggcaccacccccatcacccctgtgctgaccagcacagccaccaccccagctgccaccagcagcaaggccaccagcagcagcagccccaggacagccaccaccctgcctgtgctgaccagcacagccaccaagagcacagccaccagcttcacccccatccccagcagcaccctgtggaccacctggacagtgcctgcccagaccaccacccccatgagcaccatgagcaccatccacaccagcagcaccccagagaccacccacaccagcacagtgctgaccaccacagccaccatgacccgggccaccaacagcacagccacccccagcagcaccctgggcaccacccgcatcctgacagagctgaccaccacagccaccaccacagctgccaccggcagcacagccaccctgagcagcaccccaggcaccacctggatcctgacagagcccagcaccatcgccaccgtgatggtgcccaccggcagcacagccacagccagcagcaccctgggcacagcccacacccccaaggtggtgaccaccatggccaccatgcccacagccacagccagcacagtgcccagcagcagcacagtgggcaccaccaggaccccagctgtgctgcccagcagcctgcccaccttctctgtgtccacagtgagcagctctgtgctgaccaccctgcggcccaccggcttccccagcagccacttcagcaccccctgcttctgccgggccttcggccagttcttcagccctggagaggtgatctacaacaagacagaccgggccggctgccacttctatgctgtgtgcaaccagcactgtgacatcgaccgcttccagggcgcctgccccaccagccccccacctgtgagcagcgcccccctgagcagccccagccctgcccctggctgtgacaatgccatccccctgcggcaggtgaatgagacctggaccctggagaactgcaccgtggcccgctgtgtgggggacaacagagtggtgctgctggaccccaagcctgtggccaacgtgacctgtgtgaacaagcacctgcccatcaaggtgtctgaccccagccagccctgtgacttccactatgaatgtgagtgcatctgcagcatgtggggcggcagccactacagcacctttgatggcaccagctacaccttccggggcaactgcacctacgtgctgatgagggagatccacgcccgcttcggcaacctgagcctgtacctggacaaccactactgcacagccagcgccacagctgctgctgcccgctgcccccgggccctgagcatccactacaagtccatggacatcgtgctgactgtgaccatggtgcacggcaaggaggagggcctcatcctgtttgaccagatccctgtgagcagcggcttcagcaagaatggagtgctggtgtctgtgctgggcaccaccaccatgagggtggacatcccagccctgggcgtgtctgtgaccttcaacggccaggtgttccaggcccggctgccctacagcctcttccacaacaacacagagggccagtgtggcacctgcaccaacaaccagagagatgactgcctgcagagagatggcaccacagctgccagctgcaaggacatggccaagacctggctggtgcctgacagcaggaaggatggctgctgggcccccaccggcaccccacccacagccagccctgctgcccctgtgagcagcacccccacccccaccccctgccccccccagcccctgtgtgacctgatgctgagccaggtgtttgctgagtgccacaacctggtgcccccaggccccttcttcaatgcctgcatcagtgaccactgccggggccgcctggaggtgccctgccagagcctggaggcctatgcagagctgtgccgggcccggggcgtgtgcagcgactggaggggggccaccggcggcctgtgtgacctgacctgcccccccaccaaggtgtacaagccctgtggccccatccagcctgccacctgcaacagcaggaaccagagcccccagctggagggcatggccgagggctgcttctgcccagaggaccagatcctcttcaatgcccacatgggcatctgtgtgcaggcctgcccctgtgtgggcccagatggcttccccaagtttcctggagagcgctgggtgagcaactgccagagctgtgtgtgtgatgagggctctgtgtctgtgcagtgcaagcccctgccctgtgatgcccagggccagcccccaccctgcaaccggcccggctttgtgacagtgacccggcccagggctgagaacccctgctgcccagagaccgtgtgtgtgtgcaacaccaccacctgcccccagagcctgcctgtgtgccccccaggccaggagagcatctgcacccaggaggagggggactgctgccccaccttccgctgccggccccagctgtgcagctacaacggcaccttctatggagtgggcgccaccttccctggggccctgccctgccacatgtgcacctgcctgagcggggacacccaggaccccaccgtgcagtgccaggaggatgcctgcaacaacaccacctgcccccagggctttgagtacaagagggtggccggccagtgctgcggggagtgtgtgcagacagcctgcctgaccccagatggccagcctgtgcagctgaatgagacctgggtgaacagccacgtggacaactgcaccgtgtacctgtgtgaggccgagggcggcgtgcacctgctgaccccccagcctgccagctgcccagatgtgagcagctgccggggcagcctgaggaagacaggctgctgctacagctgtgaggaggacagctgccaggtgcgcatcaacaccaccatcctgtggcaccagggctgtgaaacagaggtgaacatcaccttctgtgagggcagctgccctggggccagcaagtacagcgctgaggcccaggccatgcagcaccagtgcacctgctgccaggagaggagagtgcatgaggagaccgtgcccctgcactgccccaacggcagcgccatcctgcacacctacacccacgtggatgaatgtggctgcacccccttctgtgtgcctgcccccatggccccaccccacacccggggcttccctgcccaggaggccacagctgtgtag

SEQ ID NO: 160337 - DNA, 17289 bp, Artificial Sequence
  Description of Artificial Sequence: Synthetic coding sequence
atgggcgcccccagcgcctgcaggaccctggtgctggccctggccgccatgctggtggtgccccaggccgagacccagggccctgtggagcccagctgggagaatgccggccacaccatggatggaggagcccccaccagcagccccaccaggagagtgtcctttgtgccccctgtgaccgtcttccccagcctgagccccctgaacccagcccacaacggccgggtgtgcagcacctggggagacttccactacaagacctttgatggagatgtgttccgcttccctggcctgtgcaactacgtgttcagcgagcactgcagagctgcctatgaggacttcaacgtgcagctgcggcggggcctggtgggcagcaggcctgtggtgaccagggtggtgatcaaggcccagggcctggtgctggaggccagcaatggatctgtgctgatcaatggccagcgggaggagctgccctacagcaggacaggcctgctggtggagcagagcggggactacatcaaggtgtccatccggctggtgctgaccttcctgtggaatggagaggacagcgccctgctggagctggaccccaagtatgccaaccagacctgtggcctgtgtggggacttcaacggcctgcctgccttcaatgagttctacgcccacaatgcccggctgacccccctgcagtttggaaacctgcagaagctggatggccccacagagcagtgcccagaccccctgcccctgcctgctggcaactgcacagatgaggagggcatctgccacaggaccctgctgggccctgcctttgctgaatgtcatgccctggtggacagcacagcctacctggccgcctgtgcccaggacctgtgccgctgccccacctgcccctgtgccacctttgtggagtacagccggcagtgtgcccacgccggcggccagcccaggaactggcgctgcccagagctgtgccccaggacctgccccctgaacatgcagcaccaggagtgtggcagcccctgcacagacacctgcagcaacccccagagggcccagctgtgtgaggaccactgtgtggatggctgcttctgccccccaggcaccgtgctggatgacatcacccacagcggctgcctgcccctgggccagtgcccctgcacccatggaggccgcacctacagccctggcaccagcttcaacaccacctgcagcagctgcacctgcagcggcggcctgtggcagtgccaggacctgccctgccccggcacctgcagcgtgcagggcggggcccacatcagcacctatgatgagaagctgtatgacctgcacggggactgcagctatgtgctgagcaagaagtgtgccgacagcagcttcaccgtgctggccgagctgaggaaatgtggcctgacagacaatgaaaactgcctgaaggctgtgaccctgagcctggatggaggagacacagccatccgggtgcaggctgatggaggagtcttcctgaacagcatctacacccagctgcccctgtctgctgccaacatcaccctcttcacccccagcagcttcttcatcgtggtgcagacaggcctgggcctgcagctgctggtgcagctggtgcccctgatgcaggtgtttgtgcggctggaccctgcccaccagggccagatgtgtggcctgtgtggcaacttcaaccagaaccaggctgatgacttcaccgccctgtctggagtggtggaggccactggagctgcctttgccaacacctggaaggcccaggccgcctgtgccaatgccagaaattcctttgaggacccctgcagcctgtctgtggagaatgaaaattatgcccggcactggtgcagccggctgacagaccccaacagcgccttcagccgctgccacagcatcatcaaccccaagcccttccacagcaactgcatgtttgacacctgcaactgtgagaggtctgaggactgcctgtgtgccgccctgagcagctatgtgcacgcctgtgccgccaagggcgtgcagctgagtgactggagagatggagtgtgcaccaagtacatgcagaactgccccaagagccagagatatgcctacgtggtggatgcctgccagcccacctgccggggcctgtctgaggctgatgtgacctgcagcgtgtcctttgtgcctgtggatggctgcacctgcccagctggcaccttcctgaatgatgctggggcctgtgtgcctgcccaggagtgcccctgctacgcccatggaacagtgctggcccctggagaggtggtgcatgatgaaggagctgtgtgcagctgcacaggaggcaagctgagctgcctgggcgccagcctgcagaagagcacaggctgtgccgcccccatggtgtacctggactgcagcaacagcagcgctggcaccccaggagctgagtgcctgcggagctgccacaccctggatgtgggctgcttcagcacccactgtgtgtctggctgtgtgtgccccccaggcctggtgtctgatggcagcggcggctgcatcgccgaggaggactgcccctgtgtgcacaatgaggccacctacaagccaggagagaccatccgggtggactgcaacacctgcacctgcaggaacagacgctgggagtgcagccaccggctgtgcctgggcacctgtgtggcctatggagatggccacttcatcacctttgatggagaccgctacagctttgagggcagctgtgagtacatcctggcccaggactactgtggggacaacaccacccacggcaccttcagaattgtgacagagaacatcccctgtggcaccaccggcaccacctgcagcaaggccatcaagctgtttgtggagagctatgagctgatcctgcaggagggcaccttcaaggctgtggcccggggccctggaggagaccccccctacaagatccgctacatgggcatcttcctggtgattgagacccacggcatggctgtgtcctgggacaggaagacctctgtgttcatccggctgcaccaggactacaagggccgggtgtgtggcctgtgtggcaactttgatgacaatgccatcaatgactttgccaccaggagccgctctgtggtgggagatgccctggagtttggaaacagctggaagctgagccccagctgcccagatgccctggcccccaaggacccctgcacagccaaccccttcaggaagtcctgggcccagaagcagtgcagcatcctgcacggccccacctttgctgcctgccgcagccaggtggacagcaccaagtactatgaggcctgtgtgaatgatgcctgtgcctgtgacagcggcggggactgtgagtgcttctgcacagctgtggccgcctatgcccaggcctgccatgatgctggcctgtgtgtgtcctggaggaccccagacacctgccccctcttctgtgacttctacaacccccatggaggctgtgagtggcactaccagccctgtggggccccctgcctgaagacctgcaggaaccccagcggccactgcctggtggacctgcccggcctggagggctgctaccccaagtgcccccccagccagcccttcttcaatgaagaccagatgaagtgtgtggcccagtgtggctgctatgacaaggatggcaactactatgatgtgggcgcccgggtgcccacagctgagaactgccagagctgcaactgcacccccagcggcatccagtgtgcccacagcctggaggcctgcacctgcacctatgaggacaggacctacagctaccaggacgtcatctacaacaccacagatggcctgggcgcctgcctgattgccatctgtggcagcaatggcaccatcatcaggaaggctgtggcctgccccggcaccccagccaccacccccttcaccttcaccacagcctgggtgccccacagcaccaccagccctgccctgcctgtgtccacagtgtgtgtgcgggaggtgtgccgctggagctcctggtacaacggccacaggcctgagcccggcctgggcggcggggactttgagacctttgagaacctgcggcagaggggctaccaggtgtgccctgtgctggccgacattgaatgtcgggccgcccagctgcctgacatgcccctggaggagctgggccagcaggtggactgtgacaggatgaggggcctgatgtgtgccaacagccagcagagcccccccctgtgccacgactatgagctgcgggtgctgtgctgtgaatatgtgccctgtggccccagccctgcccctggcaccagcccccagcccagcctgagcgccagcacagagcctgctgtgcccacccccacccagaccacagccacagagaagaccaccctgtgggtgacccccagcatccgcagcacagctgccctgaccagccagacaggcagcagcagcggccctgtgacagtgacccccagcgcccctggcaccaccacctgccagccccgctgccagtggacagagtggtttgatgaggactaccccaagtctgagcagctgggcggagatgtggagagctatgacaagatccgggccgccggcggccacctgtgccagcagcccaaggacatcgagtgccaggccgagagcttccccaactggaccctggcccaggtgggccagaaggtgcactgtgatgtgcacttcggcctggtgtgcaggaactgggagcaggagggcgtcttcaagatgtgctacaactaccgcatccgggtgctgtgctgcagtgatgaccactgccggggccgggccaccaccccaccacccaccacagagctggagacagccaccaccaccaccacccaggccctcttcagcaccccccagcccaccagcagccctggcctgacccgggcccccccagccagcaccacagctgtgcccaccctgtctgagggcctgaccagcccccgctacaccagcaccctgggcacagccaccactggaggccccaccaccccagctggcagcacagagcccaccgtgcctggggtggccaccagcaccctgcccaccaggtctgccctgcccggcaccaccggcagcctgggcacctggaggcccagccagccccccaccctggcccccaccaccatggccaccagccgggcccggcccaccggcacagccagcacagccagcaaggagcccctgaccaccagcctggcccccaccctgaccagcgagctgagcaccagccaggccgagaccagcacccccaggacagagaccaccatgagccccctgaccaacaccaccaccagccagggcaccacccgctgccagcccaagtgtgagtggacagagtggtttgatgtggacttccccaccagcggcgtggccggcggggacatggagacctttgagaacatccgggctgctgggggcaagatgtgctgggcccccaagagcattgaatgtagagctgagaactacccagaggtgtccattgaccaggtgggccaggtgctgacctgcagcctggagaccggcctgacctgcaagaatgaagaccagacaggccgcttcaacatgtgcttcaactacaacgtgcgggtgctgtgctgtgatgactacagccactgccccagcaccccagccaccagcagcacagccacccccagcagcaccccaggcaccacctggatcctgaccaagcccaccaccacagccaccaccacagccagcacaggcagcacagccacccccaccagcaccctgaggacagcccccccacccaaggtgctgaccaccacagccaccacccccaccgtgaccagcagcaaggccacccccagcagcagccctggaacagccacagccctgcctgccctgcggagcacagccaccacccccacagccacctctgtgacccccatccccagcagcagcctgggcaccacctggacccggctgagccagaccaccacccccacagccaccatgagcacagccacccccagcagcaccccagagacagcccacaccagcacagtgctgacagccacagccaccaccaccggggccactggatctgtggccacccccagcagcaccccaggcacagcccacaccaccaaggtgcccaccaccaccaccaccggcttcaccgccacccccagcagcagccctggaacagccctgaccccacctgtgtggatcagcaccaccaccacccccaccacccggggcagcacagtgacccccagcagcatccctggcaccacccacacagccaccgtgctgaccaccaccaccaccaccgtggccaccggctccatggccacccccagcagcagcacccagaccagcggcaccccacccagcctgaccaccacagccaccaccatcacagccaccggcagcaccaccaaccccagcagcaccccaggcaccacccccatcccccctgtgctgaccaccacagccaccaccccagctgccaccagcaacacagtgacccccagcagcgccctgggcaccacccacaccccacctgtgcccaacaccatggccaccacccacggccgcagcctgccccccagcagcccccacacagtgaggacagcctggaccagcgccaccagcggcatcctgggcaccacccacatcacagagcccagcacagtgaccagccacaccctggccgccaccaccggcaccacccagcacagcaccccagccctgagcagcccccaccccagcagcaggaccacagagagcccccccagccctggcaccaccaccccaggccacaccacagccaccagcaggaccacagccacagccacccccagcaagaccaggaccagcaccctgctgcccagcagccccaccagcgcccccatcaccaccgtggtgaccatgggctgtgagccccagtgtgcctggagcgagtggctggactacagctaccccatgcctggccccagcggcggggactttgacacctacagcaacatccgggctgctggaggagctgtgtgtgagcagcccctgggcctggagtgccgggcccaggcccagcccggggtgcccctgcgggagctgggccaggtggtggagtgcagcctggactttggcctggtgtgcaggaaccgggagcaggtgggcaagttcaagatgtgcttcaactatgagatccgggtcttctgctgcaactacggccactgccccagcaccccagccaccagcagcacagccatgcccagcagcaccccaggcaccacctggatcctgacagagctgaccaccacagccaccaccacagagagcacaggcagcacagccacccccagcagcaccccaggcaccacctggatcctgacagagcccagcaccacagccaccgtgacagtgcccaccggcagcacagccacagccagcagcacccaggccacagctggcacccctcatgtgtccaccacagccaccacccccaccgtgaccagcagcaaggccacccccttcagcagccctggaacagccacagccctgcctgccctgcggagcacagccaccacccccacagccaccagcttcaccgccatccccagcagcagcctgggcaccacctggacccggctgagccagaccaccacccccacagccaccatgagcacagccacccccagcagcaccccagagaccgtgcacaccagcacagtgctgaccaccacagccaccaccactggagccaccggctctgtggccacccccagcagcaccccaggcacagcccacaccaccaaggtgctgaccaccaccaccaccggcttcaccgccacccccagcagcagccctggaacagcccggaccctgcctgtgtggatcagcaccaccaccacccccaccacccggggcagcacagtgacccccagcagcatccctggcaccacccacacccccaccgtgctgaccaccaccaccaccaccgtggccaccggctccatggccacccccagcagcagcacccagaccagcggcaccccacccagcctgaccaccacagccaccaccatcacagccaccggcagcaccaccaaccccagcagcaccccaggcaccacccccatcccccctgtgctgaccaccacagccaccaccccagctgccaccagcagcacagtgacccccagcagcgccctgggcaccacccacaccccacctgtgcccaacaccacagccaccacccacggccgcagcctgagccccagcagcccccacacagtgaggacagcctggaccagcgccaccagcggcaccctgggcaccacccacatcacagagcccagcacaggcaccagccacaccccagctgccaccaccggcaccacccagcacagcaccccagccctgagcagcccccaccccagcagcaggaccacagagagcccccccagccctggcaccaccaccccaggccacacccgggccaccagcaggaccacagccacagccacccccagcaagaccaggaccagcaccctgctgcccagcagccccaccagcgcccccatcaccaccgtggtgaccatgggctgtgagccccagtgtgcctggagcgagtggctggactacagctaccccatgcctggccccagcggcggggactttgacacctacagcaacatccgggccgccggcggcgctgtgtgtgagcagcccctgggcctggagtgccgggcccaggcccagcccggggtgcccctgcgggagctgggccaggtggtggagtgcagcctggactttggcctggtgtgcaggaaccgggagcaggtgggcaagttcaagatgtgcttcaactatgagatccgggtcttctgctgcaactacggccactgccccagcaccccagccaccagcagcacagccacccccagcagcaccccaggcaccacctggatcctgacagagcagaccacagctgccaccaccacagccaccaccggcagcacagccatccccagcagcaccccaggcacagcccccccacccaaggtgctgaccagcacagccaccacccccacagccaccagcagcaaggccaccagcagcagcagccccaggacagccaccaccctgcctgtgctgaccagcacagccaccaagagcacagccaccagcttcacccccatccccagcttcaccctgggcaccaccggcaccctgcctgagcagaccaccacccccatggccaccatgagcaccatccaccccagcagcaccccagagaccacccacaccagcacagtgctgaccaccaaggccaccaccacccgggccaccagctccatgagcacccccagcagcaccccaggcaccacctggatcctgacagagctgaccacagctgccaccaccacagctgccaccggccccacagccacccccagcagcaccccaggcaccacctggatcctgacagagcccagcaccacagccaccgtgacagtgcccaccggcagcacagccacagccagcagcacccgggccacagctggcaccctgaaggtgctgaccagcacagccaccacccccaccgtcatcagcagccgggccacccccagcagcagccctggaacagccacagccctgcctgccctgcggagcacagccaccacccccacagccacctctgtgacagccatccccagcagcagcctgggcacagcctggacccggctgagccagaccaccacccccacagccaccatgagcacagccacccccagcagcaccccagagaccgtgcacaccagcacagtgctgaccaccaccaccaccaccacccgggccaccggctctgtggccacccccagcagcaccccaggcacagcccacaccaccaaggtgcccaccaccaccaccaccggcttcaccgccacccccagcagcagccctggaacagccctgaccccacctgtgtggatcagcaccaccaccacccccaccacccggggcagcacagtgacccccagcagcatccctggcaccacccacacagccaccgtgctgaccaccaccaccaccaccgtggccaccggctccatggccacccccagcagcagcacccagaccagcggcaccccacccagcctgaccaccacagccaccaccatcacagccaccggcagcaccaccaaccccagcagcaccccaggcaccacccccatcccccctgtgctgaccaccacagccaccaccccagctgccaccagcagcacagtgacccccagcagcgccctgggcaccacccacaccccacctgtgcccaacaccacagccaccacccacggccgcagcctgccccccagcagcccccacacagtgaggacagcctggaccagcgccaccagcggcatcctgggcaccacccacatcacagagcccagcacagtgaccagccacaccccagctgccaccaccagcaccacccagcacagcaccccagccctgagcagcccccaccccagcagcaggaccacagagagcccccccagccctggcaccaccaccccaggccacacccggggcaccagcaggaccacagccacagccacccccagcaagaccaggaccagcaccctgctgcccagcagccccaccagcgcccccatcaccaccgtggtgaccaccggctgtgagccccagtgtgcctggagcgagtggctggactacagctaccccatgcctggccccagcggcggggactttgacacctacagcaacatccgggccgccggcggcgctgtgtgtgagcagcccctgggcctggagtgccgggcccaggcccagcccggggtgcccctgcgggagctgggccaggtggtggagtgcagcctggactttggcctggtgtgcaggaaccgggagcaggtgggcaagttcaagatgtgcttcaactatgagatccgggtcttctgctgcaactacggccactgccccagcaccccagccaccagcagcacagccacccccagcagcaccccaggcaccacctggatcctgaccaagctgaccaccacagccaccaccacagagagcacaggcagcacagccacccccagcagcaccccaggcaccacctggatcctgacagagcccagcaccacagccaccgtgacagtgcccaccggcagcacagccacagccagcagcacccaggccacagctggcaccccccacgtgtccaccacagccaccacccccaccgtgaccagcagcaaggccacccccttcagcagccctggaacagccacagccctgcctgccctgcggagcacagccaccacccccacagccaccagcttcaccgccatccccagcagcagcctgggcaccacctggacccggctgagccagaccaccacccccacagccaccatgagcacagccacccccagcagcaccccagagacagcccacaccagcacagtgctgaccaccacagccaccaccacccgggccactggatctgtggccacccccagcagcaccccaggcacagcccacaccaccaaggtgcccaccaccaccaccaccggcttcaccgtgacccccagcagcagccctggaacagcccggaccccacctgtgtggatcagcaccaccaccacccccaccaccagcggcagcacagtgacccccagctctgtgcccggcaccacccacacccccaccgtgctgaccaccaccaccaccaccgtggccaccggctccatggccacccccagcagcagcacccagaccagcggcaccccacccagcctcatcaccacagccaccaccatcacagccaccggcagcaccaccaaccccagcagcaccccaggcaccacccccatcccccctgtgctgaccaccacagccaccaccccagctgccaccagcagcacagtgacccccagcagcgccctgggcaccacccacaccccacctgtgcccaacaccacagccaccacccacggccgcagcctgagccccagcagcccccacacagtgaggacagcctggaccagcgccaccagcggcaccctgggcaccacccacatcacagagcccagcacaggcaccagccacaccccagctgccaccaccggcaccacccagcacagcaccccagccctgagcagcccccaccccagcagcaggaccacagagagcccccccagccctggcaccaccaccccaggccacaccacagccaccagcaggaccacagccacagccacccccagcaagaccaggaccagcaccctgctgcccagcagccccaccagcgcccccatcaccaccgtggtgaccaccggctgtgagccccagtgtgcctggagcgagtggctggactacagctaccccatgcctggccccagcggcggggactttgacacctacagcaacatccgggctgctggaggagctgtgtgtgagcagcccctgggcctggagtgccgggcccaggcccagcccggggtgcccctgggggagctgggccaggtggtggagtgcagcctggactttggcctggtgtgcaggaaccgggagcaggtgggcaagttcaagatgtgcttcaactatgagatccgggtcttctgctgcaactacggccactgccccagcaccccagccaccagcagcacagccatgcccagcagcaccccaggcaccacctggatcctgacagagctgaccaccacagccaccaccacagccagcacaggcagcacagccacccccagcagcaccccaggcacagcccccccacccaaggtgctgaccagccctgccaccacccccacagccaccagcagcaaggccaccagcagcagcagccccaggacagccaccaccctgcctgtgctgaccagcacagccaccaagagcacagccacctctgtgacccccatccccagcagcaccctgggcaccaccggcaccctgcctgagcagaccaccacccctgtggccaccatgagcaccatccaccccagcagcaccccagagaccacccacaccagcacagtgctgaccaccaaggccaccaccacccgggccaccagcagcaccagcacccccagcagcaccccaggcaccacctggatcctgacagagctgaccacagctgccaccaccacagctgccaccggccccacagccacccccagcagcaccccaggcaccacctggatcctgacagagctgaccaccacagccaccaccacagccagcacaggcagcacagccacccccagcagcaccccaggcaccacctggatcctgacagagcccagcaccacagccaccgtgacagtgcccaccggcagcacagccacagccagcagcacccaggccacagctggcaccccccacgtgtccaccacagccaccacccccaccgtgaccagcagcaaggccacccccagcagcagccctggaacagccacagccctgcctgccctgcggagcacagccaccacccccacagccaccagcttcaccgccatccccagcagcagcctgggcaccacctggacccggctgagccagaccaccacccccacagccaccatgagcacagccacccccagcagcaccccagagaccgtgcacaccagcacagtgctgacagccacagccaccaccaccggggccactggatctgtggccacccccagcagcaccccaggcacagcccacaccaccaaggtgcccaccaccaccaccaccggcttcaccgccacccccagcagcagccctggaacagccctgaccccacctgtgtggatcagcaccaccaccacccccaccaccaccacccccaccaccagcggcagcacagtgacccccagcagcatccctggcaccacccacacagcccgggtgctgaccaccaccaccaccaccgtggccaccggctccatggccacccccagcagcagcacccagaccagcggcaccccacccagcctgaccaccacagccaccaccatcacagccaccggcagcaccaccaaccccagcagcaccccaggcaccacccccatcacccctgtgctgaccagcacagccaccaccccagctgccaccagcagcaaggccaccagcagcagcagccccaggacagccaccaccctgcctgtgctgaccagcacagccaccaagagcacagccaccagcttcacccccatccccagcagcaccctgtggaccacctggacagtgcctgcccagaccaccacccccatgagcaccatgagcaccatccacaccagcagcaccccagagaccacccacaccagcacagtgctgaccaccacagccaccatgacccgggccaccaacagcacagccacccccagcagcaccctgggcaccacccgcatcctgacagagctgaccaccacagccaccaccacagctgccaccggcagcacagccaccctgagcagcaccccaggcaccacctggatcctgacagagcccagcaccatcgccaccgtgatggtgcccaccggcagcacagccacagccagcagcaccctgggcacagcccacacccccaaggtggtgaccaccatggccaccatgcccacagccacagccagcacagtgcccagcagcagcacagtgggcaccaccaggaccccagctgtgctgcccagcagcctgcccaccttctctgtgtccacagtgagcagctctgtgctgaccaccctgcggcccaccggcttccccagcagccacttcagcaccccctgcttctgccgggccttcggccagttcttcagccctggagaggtgatctacaacaagacagacagagctggctgccacttctatgctgtgtgcaaccagcactgtgacatcgaccgcttccagggcgcctgccccaccagccccccacctgtgtcctctgcccccctgagcagccccagccctgcccctggctgtgacaatgccatccccctgcggcaggtgaatgagacctggaccctggagaactgcaccgtggcccgctgtgtgggggacaacagagtggtgctgctggaccccaagcctgtggccaacgtgacctgtgtgaacaagcacctgcccatcaaggtgtctgaccccagccagccctgtgacttccactatgaatgtgagtgcatctgcagcatgtggggcggcagccactacagcacctttgatggcaccagctacaccttccggggcaactgcacctacgtgctgatgagggagatccacgccaggtttggaaacctgagcctgtacctggacaaccactactgcacagccagcgccacagctgctgctgcccgctgcccccgggccctgagcatccactacaagtccatggacatcgtgctgactgtgaccatggtgcacggcaaggaggagggcctcatcctgtttgaccagatccctgtgagcagcggcttcagcaagaatggagtgctggtgtctgtgctgggcaccaccaccatgagggtggacatcccagccctgggcgtgtctgtgaccttcaacggccaggtgttccaggcccggctgccctacagcctcttccacaacaacacagagggccagtgtggcacctgcaccaacaaccagagagatgactgcctgcagagagatggcaccacagctgccagctgcaaggacatggccaagacctggctggtgcctgacagcaggaaggatggctgctgggcccccaccggcaccccacccacagccagccctgctgcccctgtgagcagcacccccacccccaccccctgccccccccagcccctgtgtgacctgatgctgagccaggtgtttgctgagtgccacaacctggtgcccccaggccccttcttcaatgcctgcatcagtgaccactgccggggccgcctggaggtgccctgccagagcctggaggcctatgcagagctgtgccgggcccggggcgtgtgcagcgactggaggggggccactggaggcctgtgtgacctgacctgcccccccaccaaggtgtacaagccctgtggccccatccagcctgccacctgcaacagcaggaaccagagcccccagctggagggcatggccgagggctgcttctgcccagaggaccagatcctcttcaatgcccacatgggcatctgtgtgcaggcctgcccctgtgtgggcccagatggcttccccaagtttcctggagagcgctgggtgagcaactgccagagctgtgtgtgtgatgagggctctgtgtctgtgcagtgcaagcccctgccctgtgatgcccagggccagcccccaccctgcaacagacctggctttgtgacagtgacccggcccagggctgagaacccctgctgcccagagaccgtgtgtgtgtgcaacaccaccacctgcccccagagcctgcctgtgtgccccccaggccaggagagcatctgcacccaggaggagggggactgctgccccaccttccgctgccggccccagctgtgcagctacaacggcaccttctacggcgtgggcgccaccttccctggggccctgccctgccacatgtgcacctgcctgagcggggacacccaggaccccaccgtgcagtgccaggaggatgcctgcaacaacaccacctgcccccagggctttgagtacaagagggtggccggccagtgctgcggagaatgtgtgcagacagcctgcctgaccccagatggccagcctgtgcagctgaatgagacctgggtgaacagccacgtggacaactgcaccgtgtacctgtgtgaggccgagggcggcgtgcacctgctgaccccccagcctgccagctgcccagatgtgagcagctgccggggcagcctgaggaagacaggctgctgctacagctgtgaggaggacagctgccaggtgcgcatcaacaccaccatcctgtggcaccagggctgtgaaacagaggtgaacatcaccttctgtgagggcagctgccctggggccagcaagtacagcgctgaggcccaggccatgcagcaccagtgcacctgctgccaggagcggcgggtgcatgaggagaccgtgcccctgcactgccccaatggaagtgccatcctgcacacctacacccacgtggatgaatgtggctgcacccccttctgtgtgcctgcccccatggccccaccccacacccggggcttccctgcccaggaggccacagctgtgtag

SEQ ID NO: 160338 - DNA, 1611 bp, Artificial Sequence
  Description of Artificial Sequence: Synthetic coding sequence
gtcttctgctgcaactacggccactgccccccccggcccccagccctgcggccctgccccccacccctgcggggccggcccggcagcacagagctgaccaccacagccaccaccacagccagcacaggcagcacagccacccccagcagcaccccaggcacagcccccccacccaaggtgctgaccagccctgccaccacccccacagccaccagcagcaaggccaccagcagcagcagccccaggacagccaccaccctgcctgtgctgaccagcacagccaccaagagcacagccacctctgtgacccccatccccagcagcaccctgggcaccaccggcaccctgcctgagcagaccaccacccctgtggccaccatgagcaccatccaccccagcagcaccccagagaccacccacaccagcacagtgctgaccaccaaggccaccaccacccgggccaccagcagcaccagcacccccagcagcaccccaggcaccacctggatcctgacagagctgaccacagctgccaccaccacagctgccaccggccccacagccacccccagcagcaccccaggcaccacctggatcctgacagagctgaccaccacagccaccaccacagccagcacaggcagcacagccacccccagcagcaccccaggcaccacctggatcctgacagagcccagcaccacagccaccgtgacagtgcccaccggcagcacagccacagccagcagcacccaggccacagctggcacccctcatgtgtccaccacagccaccacccccaccgtgaccagcagcaaggccacccccagcagcagccctggaacagccacagccctgcctgccctgcggagcacagccaccacccacagctaccagctgtacagccaccccctgctgctgcccaccacctggacccggctgagccagaccaccacccccacagccaccatgagcacagccacccccagcagcaccccagagaccgtgcacaccagcacagtgctgacagccacagccaccaccactggacctgccctgtggcccccacctcctccaccccaggagcagctgaccctgcccaagtgccgcctgccccagcccaggcacagccaccccctgctgcagcccagagatggcacccacgccagctctgtggaccagcacaaccaccacacccacaaccaccacacccacaaccagtggctgcacggggaccccctgctgcaccctggggaccacccccaccggcagagcgctgaccaccaccaccacaactgcaccggctccatggccacccccagcagcagcacccagaccagcggcaccccacccagcctgaccaccacagccaccaccatcacagccaccggcagcaccaccaaccccagcagcaccccaggcaccacccccatcacccctgtgctgaccagcacagccaccaccccagctgccaccagcagcaaggccaccagcagcagcagccccaggacagccaccaccctgcctgtgctgaccagcacagccaccaagagcacagccaccagcttcacccccatccccagcccctgtggcccccggggccccagctag

SEQ ID NO: 160339 - DNA, 561 bp, Artificial Sequence
  Description of Artificial Sequence: Synthetic coding sequence
agcagcaccccaggcaccacctggatcctgacagagcccagcaccacagccaccgtgacagtgcccaccggcagcacagccacagccagcagcacccaggccacagctggcaccccccacgtgtccaccacagccaccacccccaccgtgaccagcagcaaggccacccccttcagcagccctggaacagccacagccctgcctgccctgcggagcacagccaccacccccacagccaccagcttcaccgccatccccagctcctgggcccctcctggccctgcctaccacaggcctccccacccccggcccccctgcccccagccccaccccccacccctgcagaggctgagcaccccaccccagtgcctgcccccccggcccccccggggccaccggctgtgtggccaccccctgctgcaccccaggaacagcagccactaccagagcgctgactaccacaaccacttcaccgccacccccagcagcagccctggaacagcccggaccctgcctgtgtggatcagcaccaccaccacccccaccacccggggcagctag

SEQ ID NO: 160340 - DNA, 960 bp, Artificial Sequence
  Description of Artificial Sequence: Synthetic coding sequence
accaaggccaccaccacccgggccaccagctccatgagcacccccagcagcaccccaggcaccacctggatcctgacagagctgaccacagctgccaccaccacagctgccaccccccacggccaccctgtgctgcacccccgggaccacctggacccccaccgggcccagcactacacagtgacagtgcccaccggcagcacagccacagccagcagcacccgggccacagctggcaccctgaaggtgctgaccagccaccacacccacagccaccagctgcagagccacagcctgctgcagagccgggactgcaaccggcccagcagcacagagaagcacagccaccacacccacagctaccagcgctacagccaccccctcttcctgcccacagcctggacccggctgagccagaccaccacccccacagccaccatgagcacagccacccccagcagcaccccagagaccgtgcacaccagcacagtgctgaccaccaccaccaccaccacccgggccaccctgtggcccccacctcctccaccccaggagcagctgaccctgcccaagtgccgcctgccccagcccaggcacagccaccccctgctgcagcccagagatggcacccacgccagctctgtggaccagcacaaccaccacacccacaaccagaggctgcacggggaccccctgctgcaccccaccacccacacagccaccgtgctgaccaccaccaccaccacccccctggtgctgtggcagcacccccccctggcccacaggcctgtggtgccccccagcctgaccaccacagccaccaccatcacagccaccggcagcaccaccaaccccagcagcaccccaggcaccacccccatcccccctgtgctgaccaccacagcccacacctgcagccaccagcagcacagcgacagcctgctgtgcccccgggactag

SEQ ID NO: 160341 - DNA, 2007 bp, Artificial Sequence
  Description of Artificial Sequence: Synthetic coding sequence
atgagggagatccacgcccgcttcggcaacctgagcctgtacctggacaaccactactgcacagccagcgccacagctgctgctgcccgctgcccccgggccctgagcatccactacaagtccatggacatcgtgctgactgtgaccatggtgcacggcaaggaggagggcctcatcctgtttgaccagatccctgtgagcagcggcttcagcaagaatggagtgctggtgtctgtgctgggcaccaccaccatgagggtggacatcccagccctgggcgtgtctgtgaccttcaacggccaggtgttccaggcccggctgccctacagcctcttccacaacaacacagagggccagtgtggcacctgcaccaacaaccagagagatgactgcctgcagagagatggcaccacagctgccagctgcaaggacatggccaagacctggctggtgcctgacagcaggaaggatggctgctgggcccccaccggcaccccacccacagccagccctgctgcccctgtgagcagcacccccacccccaccccctgccccccccagcccctgtgtgacctgatgctgagccaggtgtttgctgagtgccacaacctggtgcccccaggccccttcttcaatgcctgcatcagtgaccactgccggggccgcctggaggtgccctgccagagcctggaggcctatgcagagctgtgccgggcccggggcgtgtgcagcgactggaggggggccaccggcggcctgtgtgacctgacctgcccccccaccaaggtgtacaagccctgtggccccatccagcctgccacctgcaacagcaggaaccagagcccccagctggagggcatggccgagggctgcttctgcccagaggaccagatcctcttcaatgcccacatgggcatctgtgtgcaggcctgcccctgtgtgggcccagatggcttccccaagtttcctggagagcgctgggtgagcaactgccagagctgtgtgtgtgatgagggctctgtgtctgtgcagtgcaagcccctgccctgtgatgcccagggccagcccccaccctgcaaccggcccggctttgtgacagtgacccggcccagggctgagaacccctgctgcccagagaccgtgtgtgtgtgcaacaccaccacctgcccccagagcctgcctgtgtgccccccaggccaggagagcatctgcacccaggaggagggggactgctgccccaccttccgctgccggccccagctgtgcagctacaacggcaccttctatggagtgggcgccaccttccctggggccctgccctgccacatgtgcacctgcctgagcggggacacccaggaccccaccgtgcagtgccaggaggatgcctgcaacaacaccacctgcccccagggctttgagtacaagagggtggccggccagtgctgcggggagtgtgtgcagacagcctgcctgaccccagatggccagcctgtgcagctgaatgagacctgggtgaacagccacgtggacaactgcaccgtgtacctgtgtgaggccgagggcggcgtgcacctgctgaccccccagcctgccagctgcccagatgtgagcagctgccggggcagcctgaggaagacaggctgctgctacagctgtgaggaggacagctgccaggtgcgcatcaacaccaccatcctgtggcaccagggctgtgaaacagaggtgaacatcaccttctgtgagggcagctgccctggggccagcaagtacagcgctgaggcccaggccatgcagcaccagtgcacctgctgccaggagaggagagtgcatgaggagaccgtgcccctgcactgccccaacggcagcgccatcctgcacacctacacccacgtggatgaatgtggctgcacccccttctgtgtgcctgcccccatgagccccccagcctgtgtgtggcacccagccctgcgggccccagctgcccacctgggcctggcccctccttag

SEQ ID NO: 160342 - DNA, 7320 bp, Artificial Sequence
  Description of Artificial Sequence: Synthetic coding sequence
atggtgcagcgctggctgctgctgagctgctgcggggccctgctgtctgctggcctggccaacaccagctacaccagccctggcctgcagaggctgaaggacagcccccagacagccccagacaagggccagtgcagcacctggggcgccggccacttcagcacctttgaccaccacgtgtatgacttcagcggcacctgcaactacatctttgctgccacctgcaaggatgccttccccaccttctctgtgcagctgcggcggggcccagatggcagcatcagccgcatcatcgtggagctgggcgcctctgtggtgacagtgtctgaggccatcatctctgtgaaggacatcggggtcatcagcctgccctacaccagcaatggcctgcagatcaccccatttggccagagcgtgcggctggtggccaagcagctggagctggagctggaggtggtgtggggccctgacagccacctgatggtgctggtggagaggaagtacatgggccagatgtgtggcctgtgtggcaactttgatggcaaggtgaccaatgaatttgtgtctgaggagggcaagttcctggagccccacaagtttgctgccctgcagaagctggatgatcctggagagatctgcaccttccaggacatccccagcacccacgtgcggcaggcccagcacgcccgcatctgcacccagctgctgaccctggtggcccctgagtgcagcgtgtccaaggagccctttgtgctgagctgccaggctgatgtggccgccgccccccagcccggcccccagaacagcagctgtgccaccctgtctgagtacagccggcagtgcagcatggtgggccagcctgtgcggcgctggaggagccctggcctgtgcagcgtgggccagtgcccagccaaccaggtgtaccaggagtgtggcagcgcctgtgtgaagacctgcagcaacccccagcacagctgcagcagcagctgcaccttcggctgcttctgcccagagggcaccgtgctgaatgacctgagcaacaaccacacctgtgtgcctgtgacccagtgcccctgtgtgctgcacggggccatgtatgcccctggagaggtgaccatcgccgcctgccagacctgccgctgcaccctgggccgctgggtgtgcacagagcggccctgccccggccactgcagcctggagggcggcagctttgtgaccacctttgatgcccggccctaccgcttccacggcacctgcacctacatcctgctgcagagcccccagctgcctgaagatggagccctgatggctgtgtatgacaagagcggcgtgagccacagcgagaccagcctggtggccgtggtgtacctgagccggcaggacaagatcgtcatcagccaggatgaggtggtgaccaacaacggggaggccaagtggctgccctacaagaccaggaacatcaccgtcttccggcagaccagcacccacctgcagatggccaccagctttggcctggagctggtggtgcagctgcggcccatcttccaggcctacgtgacagtgggcccccagttccggggccagacccggggcctgtgtggcaacttcaatggagacaccacagatgacttcaccacctccatgggcattgctgagggcacagccagcctgtttgtggacagctggagggctggcaactgcccagctgccctggagcgggagacagacccctgcagcatgagccagctgaacaaggtgtgtgccgagacccactgcagcatgctgctgaggacaggcaccgtgtttgagcgctgccacgccaccgtgaacccagcccccttctacaagagatgtgtgtaccaggcctgcaactatgaggagaccttcccccacatctgtgccgccctgggggactatgtgcacgcctgcagcctgcggggcgtgctgctgtggggctggaggagctctgtggacaactgcaccatcccctgcaccggcaacaccaccttctcctacaacagccaggcctgtgagaggacctgcctgagcctgagtgaccgggccacagagtgccaccacagcgctgtgcctgtggatggctgcaactgcccagatggcacctacctgaaccagaagggggagtgtgtgaggaaggcccagtgcccctgcatcctggagggctacaagttcatcctggccgagcagagcaccgtcatcaatggcatcacctgccactgcatcaatggccgcctgagctgcccccagaggccccagatgttcctggccagctgccaggcccccaagaccttcaagagctgcagccagagcagcgagaacaagtttggagctgcctgtgcccccacctgccagatgctggccaccggggtggcctgtgtgcccaccaagtgtgagcccggctgtgtgtgtgccgagggcctgtatgaaaatgctgatggccagtgtgtgcccccagaggagtgcccctgtgagttcagcggcgtgtcctacccaggaggagctgagctgcacacagactgcaggacctgcagctgcagccggggccgctgggcctgccagcagggcacccactgccccagcacctgcaccctgtatggagagggccacgtgatcacctttgatggccagagatttgtgtttgatggcaactgtgagtacatcctggccacagatgtgtgtggggtgaatgacagccagcccaccttcaagatcctgacagaaaatgtcatctgtggcaacagcggcgtgacctgcagccgggccatcaagatcttcctgggcggcctgtctgtggtgctggccgacaggaactacacagtgactggagaggagccccacgtgcagctgggcgtgacccctggggccctgagcctggtggtggacatcagcatccctggccgctacaacctgaccctcatctggaacagacacatgaccatcctgatccgcatcgcccgggccagccaggaccccctgtgtggcctgtgtggcaacttcaacggcaacatgaaggatgactttgagaccaggagccgctacgtggccagcagcgagctggagctggtgaacagctggaaggagagccccctgtgtggagatgtgtcctttgtgacagacccctgcagcctgaatgccttcagaagatcctgggccgagaggaagtgcagcgtcatcaacagccagacctttgccacctgccacagcaaggtgtaccacctgccctactatgaggcctgtgtgagagatgcctgtggctgtgacagcggcggggactgtgaatgtctgtgtgatgctgtggccgcctatgcccaggcctgcctggacaagggcgtgtgtgtggactggaggaccccagccttctgccccatctactgcggcttctacaacacccacacccaggacggccacggggagtaccagtacacccaggaggccaactgcacctggcactaccagccctgcctgtgccccagccagccccagagcgtgcccggcagcaacatcgagggctgctacaactgcagccaggatgagtactttgaccacgaggagggcgtgtgtgtgccctgcatgccacccaccaccccccagccccccaccaccccccagctgcccaccaccggcagccggcccacccaggtgtggcccatgacaggcaccagcaccaccatcggcctgctgagcagcacaggccccagccccagcagcaaccacaccccagccagccccacccagacccccctgctgcctgccaccctgaccagcagcaagcccacagccagcagcggggagcccccccggcccaccacagctgtgaccccccaggccaccagcggcctgcccccaacagccaccctgcggagcacagccaccaagcccaccgtgacccaggccaccacccgggccacagccagcacagccagccctgccaccaccagcacagcccagagcaccaccaggaccaccatgaccctgcccaccccagccaccagcggcaccagccccaccctgcccaagagcaccaaccaggagctgcccggcaccacagccacccagaccaccggcccccggcccaccccagccagcaccaccggccccaccaccccccagcccggccagcccacccggcccacagccacagagaccacccagaccaggaccaccacagagtacaccaccccccagaccccccacaccacccacagccccccaacagctggcagccctgtgcccagcactggacctgtgacagccaccagcttccacgccaccaccacctaccccacccccagccaccctgagaccaccctgcccacccacgtgccccccttcagcaccagcctggtgacccccagcacccacacagtcatcacccccacccacgcccagatggccaccagcgccagcaaccacagcgcccccaccggcaccatccccccacccaccaccctgaaggccaccggcagcacccacacagccccacccatcacccccaccaccagcggcaccagccaggcccacagcagcttcagcaccaacaagacccccaccagcctgcacagccacaccagcagcacccaccaccctgaggtgacccccaccagcaccaccaccatcacccccaaccccaccagcaccaggaccaggacccctgtggcccacaccaacagcgccaccagcagcaggcctcctccacccttcaccacccacagcccccccaccggcagcagccccttcagcagcacaggccccatgacagccaccagcttcaagaccaccaccacctaccccacccccagccacccccagaccaccctgcccacccacgtgccccccttcagcaccagcctggtgacccccagcacccacacagtcatcacccccacccacgcccagatggccaccagcgccagcatccacagcatgcccaccggcaccatccccccacccaccaccctgaaggccaccggcagcacccacacagcccccaccatgaccctgaccaccagcggcaccagccaggccctgagcagcctgaacacagccaagaccagcaccagcctgcacagccacaccagcagcacccaccacgccgaggccaccagcaccagcaccaccaacatcacccccaaccccaccagcacaggcaccccacccatgacagtgaccaccagcggcaccagccagagccgcagcagcttcagcacagccaagaccagcaccagcctgcacagccacaccagcagcacccaccaccctgaggtgaccagcaccagcaccaccagcatcacccccaaccacaccagcacaggcaccaggacccctgtggcccacaccaccagcgccaccagcagccggctgcccacccccttcaccacccacagcccccccaccggcaccacccccatcagcagcacaggccctgtgacagccaccagcttccagaccaccaccacctaccccacccccagccacccccacaccaccctgcccacccacgtgcccagcttcagcaccagcctggtgacccccagcacccacacagtcatcatccccacccacacccagatggccaccagcgccagcatccacagcatgcccaccggcaccatccccccacccaccaccatcaaggccaccggcagcacccacacagccccacccatgacccccaccaccagcggcaccagccagagccccagcagcttcagcacagccaagaccagcaccagcctgccctaccacaccagcagcacccaccaccctgaggtgacccccaccagcaccaccaacatcacccccaagcacaccagcacaggcaccaggacccctgtggcccacaccaccagcgccagcagcagccggctgcccacccccttcaccacccacagccccccaacaggcagcagccccttcagcagcacaggccccatgacagccaccagcttccagaccaccaccacctaccccacccccagccacccccagaccaccctgcccacccacgtgccccccttcagcaccagcctggtgacccccagcacccacacagtcatcatcaccacccacacccagatggccaccagcgccagcatccacagcacccccactggaacagtgcccccacccaccaccctgaaggccaccggcagcacccacacagccccacccatgacagtgaccaccagcggcaccagccagacccacagcagcttcagcacagccacagccagcagcagcttcatcagcagcagctcctggctgccccagaacagcagcagccggccccccagcagccccatcaccacccagctgccccacctgagcagcgccaccacccctgtgtccaccaccaaccagctgagcagcagcttcagccccagccccagcgcccccagcacagtgtcctcctatgtgcccagcagccacagcagcccccagaccagcagccccagcgtgggcaccagcagcagctttgtgtctgcccctgtgcacagcaccaccctgagcagcggcagccacagcagcctgagcacccaccccaccacagcctctgtgtctgccagccccctcttccccagcagccctgctgccagcaccaccatccgggccaccctgccccacaccatcagcagccccttcaccctgagcgccctgctgcccatcagcacagtgacagtgagccccacccccagcagccacctggccagcagcaccatcgccttccccagcacccccaggaccacagccagcacccacacagccccagccttcagcagccagagcaccaccagccgcagcaccagcctgaccaccagggtgcccaccagcggctttgtgtccctgaccagcggcgtgacaggcatccccaccagccctgtgaccaacctgaccaccaggcaccctggccccaccctgagccccaccacccgcttcctgaccagcagcctgacagcccacggcagcaccccagccagcgcccctgtgagcagcctgggcacccccacccccaccagccctggggtgtgcagcgtgcgggagcagcaggaggagatcaccttcaagggctgcatggccaacgtgacagtgacccgctgtgagggcgcctgcatctctgctgccagcttcaacatcatcacccagcaggtggatgcccgctgcagctgctgccggcccctgcacagctatgagcagcagctggagctgccctgcccagaccccagcaccccaggccggcggctggtgctgaccctgcaggtgttcagccactgtgtgtgcagctctgtggcctgtggggactag

SEQ ID NO: 160343 - DNA, 1134 bp, Artificial Sequence
  Description of Artificial Sequence: Synthetic coding sequence
atgaagaccctgcccctgtttgtgtgcatctgtgccctgagcgcctgcttctccttcagcgagggccgggagcgggaccacgagctgcggcaccggcggcaccaccaccagagccccaagagccactttgagctgccccactacccaggcctgctggcccaccagaagcccttcatcaggaagagctacaagtgcctgcacaagcgctgccggcccaagctgccccccagccccaacaacccccccaagttccccaacccccaccagccccccaagcacccagacaagaacagctctgtggtgaaccccaccctggtggccaccacccagatccccagcgtgaccttccccagcgccagcaccaagatcaccaccctgcccaacgtgaccttcctgccccagaatgccaccaccatcagcagcagagaaaatgtgaacaccagcagctctgtggccaccctggcccctgtgaacagccctgccccccaggacaccacagctgccccacccaccccatctgccaccaccccagccccacccagcagcagcgcccctcctgagaccacagctgccccacccacccccagcgccaccacccaggccccacccagcagcagcgcccctcctgagaccacagctgccccacccaccccaccagccaccaccccagccccacccagcagcagcgcccctcctgagaccacagctgccccacccacccccagcgccaccaccccagcccccctgagcagcagcgcccctcctgagaccacagctgtgccccccaccccatctgccaccaccctggaccccagcagcgccagcgcccctcctgagaccacagctgccccacccacccccagcgccaccaccccagccccacccagcagccctgccccccaggagaccacagctgcccccatcaccacccccaacagcagccccaccaccctggccccagacaccagcgagaccagcgctgcccccacccaccagaccaccacctctgtgaccacccagaccaccaccaccaagcagcccaccagcgcccctggccagaacaagatcagccgcttcctgctgtacatgaagaacctgctgaaccgcatcattgatgacatggtggagcagtag

SEQ ID NO: 160344 - DNA, 1134 bp, Artificial Sequence; identical to SEQ ID NO: 160343
  Description of Artificial Sequence: Synthetic coding sequence

SEQ ID NO: 160345 - DNA, 1134 bp, Artificial Sequence; identical to SEQ ID NO: 160343
  Description of Artificial Sequence: Synthetic coding sequence

SEQ ID NO: 160346 - DNA, 411 bp, Artificial Sequence
  Description of Artificial Sequence: Synthetic coding sequence
atgaagaccctgcccctgtttgtgtgcatctgtgccctgagcgcctgcttctccttcagcgagggccgggagcgggaccacgagctgcggcaccggcggcaccaccaccagagccccaagagccactttgagctgccccactacccaggcctgctggcccaccagaagcccttcatcaggaagagctacaagtgcctgcacaagcgctgccggcccaagctgccccccagccccaacaacccccccaagttccccaacccccaccagccccccaagcacccagacaagaacagctctgtggtgaaccccaccctggtggccaccacccagatccccagcgtgaccttccccagcgccagcaccaagatcaccaccctgcccaacgtgaccttcctgccccagaatgcctag

SEQ ID NO: 160347 - DNA, 1743 bp, Artificial Sequence
  Description of Artificial Sequence: Synthetic coding sequence
atgacagccccagctggcccccggggcagcgagacagagcggctgctgacccccaaccctggctacggcacccaggccggccccagccctgccccacccaccccacctgaggaggaggacctgcggcggcggctgaagtacttcttcatgagcccctgtgacaagttccgggccaagggcaggaagccctgcaagctgatgctgcaggtggtgaagatcctggtggtgacagtgcagctgatcctgtttggcctgagcaaccagctggccgtgaccttccgggaggagaacaccatcgccttccgccacctgttcctgctgggctacagtgatggagcagatgacacctttgctgcctacacccgggagcagctgtaccaggccatcttccacgctgtggaccagtacctggccctgcctgatgtgtccctgggccgctatgcctacgtgcggggcggcggggacccctggaccaatggaagtggcctggccctgtgccagcgctactaccaccggggccacgtggaccctgccaatgacacctttgacatcgaccccatggtggtgacagactgcatccaggtggaccccccagagaggcctcctcctccacccagtgatgacctgaccctgctggagagcagcagcagctacaagaacctgaccctgaagttccacaagctggtgaatgtgaccatccacttccggctgaagaccatcaacctgcagagcctcatcaacaatgagatcccagactgctacaccttctctgtgctgatcacctttgacaacaaggcccacagcggccgcatccccatcagcctggagacccaggcccacatccaggagtgcaagcaccccagcgtcttccagcacggggacaacagcttccggctgctgtttgatgtggtggtgatcctgacctgcagcctgtccttcctgctgtgtgcccggagcctgctgcggggcttcctgctgcagaatgaatttgtgggcttcatgtggaggcagaggggccgggtcatcagcctgtgggagcggctggagtttgtgaatggctggtacatcctgctggtgaccagtgatgtgctgaccatcagcggcaccatcatgaagattggaattgaggccaagaacctggccagctatgatgtgtgcagcatcctgctgggcaccagcaccctgctggtgtgggtgggcgtcatccgctacctgaccttcttccacaactacaacatcctgattgccaccctgcgggtggccctgcccagcgtgatgaggttctgctgctgcgtggccgtcatctacctgggctactgcttctgtggctggatcgtgctgggcccctaccacgtgaagttccgcagcctgtccatggtgtctgagtgcctcttcagcctcatcaatggagatgacatgtttgtgacctttgctgccatgcaggcccagcagggccgcagcagcctggtgtggctgttcagccagctgtacctgtacagcttcatcagcctcttcatctacatggtgctgagcctcttcatcgccctgatcaccggggcctatgacaccatcaagcaccctggaggagctggagctgaggagagcgagctgcaggcctacatcgcccagtgccaggacagccccaccagcggcaagttccggcggggcagcggcagcgcctgcagcctgctgtgctgctgcggccgggaccccagcgaggagcacagcctgctggtgaactag

SEQ ID NO: 160348 - DNA, 1638 bp, Artificial Sequence
  Description of Artificial Sequence: Synthetic coding sequence
atgacccccagccagcccacccggggcagcagctgcacccggcccagctccatgctgtggaccagcacctggcgctgcctgacctgccactgggccggcatgaggatgtctgtggtgggcgtgaccctgggccccatggcccagggcctgctgagcgccagcggcaccaccacagaggccacctggacccggcccaccacccacctgaccctcatccgctggtggctgctgacagccagccgctggatcccccccagcggccccctgcggcccccagccaccatcagccccagctggaaggccgcccctgtgaccaggaccagccgcagcaacagcaccagcacagcctgcagcctggagggcggccctggctggggccggcagcacaccaggcacagccaccccagcaactacttccccaaggtgggcaccggccccccccggccccgctggtgcctgctgggggagcacttcccctgccagctgcagagccagcacgtggccggagatgctggcacctggggcaggaaaggaccagaagatgccccagacccccaccccagcctgctgccccggctggtgaatgtgaccatccacttccggctgaagaccatcaacctgcagagcctcatcaacaatgagatcccagactgctacaccttctctgtgctgatcacctttgacaacaaggcccacagcggccgcatccccatcagcctggagacccaggcccacatccaggagtgcaagcaccccagcgtcttccagcacggggacaacagcttccggctgctgtttgatgtggtggtgatcctgacctgcagcctgtccttcctgctgtgtgcccggagcctgctgcggggcttcctgctgcagaatgaatttgtgggcttcatgtggaggcagaggggccgggtcatcagcctgtgggagcggctggagtttgtgaatggctggtacatcctgctggtgaccagtgatgtgctgaccatcagcggcaccatcatgaagattggcatcgaggccaagaacctggccagctatgatgtgtgcagcatcctgctgggcaccagcaccctgctggtgtgggtgggcgtcatccgctacctgaccttcttccacaactacaacatcctgattgccaccctgcgggtggccctgcccagcgtgatgaggttctgctgctgcgtggccgtcatctacctgggctactgcttctgtggctggatcgtgctgggcccctaccacgtgaagttccgcagcctgtccatggtgtctgaatgtctcttcagcctcatcaatggagatgacatgtttgtgacctttgctgccatgcaggcccagcagggccgcagcagcctggtgtggctgttcagccagctgtacctgtacagcttcatcagcctcttcatctacatggtgctgagcctcttcatcgccctgatcactggagcctatgacaccatcaagcaccctgggggcgctggagctgaggagagcgagctgcaggcctacatcgcccagtgccaggacagccccaccagcggcaagttcagaagaggcagcggcagcgcctgcagcctgctgtgctgctgcggccgggaccccagcgaggagcacagcctgctggtgaactag

SEQ ID NO: 160349 - DNA, 1701 bp, Artificial Sequence
  Description of Artificial Sequence: Synthetic coding sequence
atggcccggcagccctaccgcttcccccaggcccgcatccctgagcggggcagcggggtcttccggctgactgtgagaaatgccatggcccaccgggacagcgagatgaaggaggagtgcctgcgggaggacctgaagttctacttcatgagcccctgtgagaagtaccgggcccggcggcagatcccctggaagctgggcctgcagatcctgaagatcgtgatggtgaccacccagctggtgcgcttcggcctgagcaaccagctggtggtggccttcaaggaggacaacacagtggccttcaagcacctgttcctgaagggctacagcggcacagatgaagatgactacagctgcagcgtgtacacccaggaggatgcctatgagagcatcttctttgccatcaaccagtaccaccagctgaaggacatcaccctgggcaccctgggctatggagaaaatgaagacaacagaattggcctgaaggtgtgcaagcagcactacaagaagggcaccatgttccccagcaatgagaccctgaacatcgacaatgatgtggagctggactgtgtgcagctggacctgcaggacctgagcaagaagcccccagactggaagaacagcagcttcttccggctggagttctaccgcctgctgcaggtggagatctccttccacctgaagggcatcgacctgcagaccatccacagccgggagctgcctgactgctacgtgttccagaacaccatcatctttgacaacaaggcccacagcggcaagatcaagatctactttgacagtgatgccaagattgaggagtgcaaggacctgaacatcttcggcagcacccagaagaatgcccagtatgtgctggtgtttgatgccttcgtcatcgtcatctgcctggccagcctcatcctgtgcaccaggagcatcgtgctggccctgcggctgaggaagcgcttcctgaacttcttcctggagaagtacaagaggcctgtgtgtgacacagaccagtgggagttcatcaatggctggtacgtgctggtgatcatcagtgacctgatgaccatcatcggcagcatcctgaagatggagatcaaggccaagaacctgaccaactatgacctgtgcagcatcttcctgggcaccagcaccctgctggtgtgggtgggcgtcatccgctacctgggctacttccaggcctacaacgtgctgatcctgaccatgcaggccagcctgcccaaggtgctgcgcttctgtgcctgtgccggcatgatctacctgggctacaccttctgtggctggatcgtgctgggcccctaccatgacaagtttgagaacctgaacacagtggccgagtgcctcttcagcctggtgaatggagatgacatgtttgccacctttgcccagatccagcagaagagcatcctggtgtggctgttcagccggctgtacctgtacagcttcatcagcctcttcatctacatgatcctgagcctcttcatcgccctgatcacagacagctatgacaccatcaagaagttccagcagaatggcttccctgagacagacctgcaggagttcctgaaggagtgcagcagcaaggaggagtaccagaaggagagcagcgccttcctgagctgcatctgctgcagaagaaggaagagaagtgatgaccacctgatccccatctcctag

SEQ ID NO: 160350 - DNA, 1662 bp, Artificial Sequence
  Description of Artificial Sequence: Synthetic coding sequence
atggctgaccctgaggtggtggtgagcagctgcagcagccatgaggaggagaaccgctgcaacttcaaccagcagaccagccccagcgaggagctgctgctggaggaccagatgaggaggaagctgaagttcttcttcatgaacccctgtgagaagttctgggcccggggcaggaagccctggaagctggccatccagatcctgaagatcgccatggtgaccatccagctggtgctgtttggcctgagcaaccagatggtggtggccttcaaggaggagaacaccatcgccttcaagcacctgttcctgaagggctacatggacaggatggatgacacctatgctgtgtacacccagagtgatgtgtatgaccagctgatctttgctgtgaaccagtacctgcagctgtacaacgtgtctgtgggcaaccacgcctatgaaaataaaggcaccaagcagagcgccatggccatctgccagcacttctacaagaggggcaacatctacccaggaaatgacacctttgatattgatcctgagattgaaacagagtgcttctttgtggagccagatgagcccttccacatcggcaccccagctgagaacaagctgaacctgaccctggacttccaccggctgctgactgtggagctgcagttcaagctgaaggccatcaacctgcagacagtgcgccaccaggagctgcctgactgctatgacttcaccctgaccatcacctttgacaacaaggcccacagcggccgcatcaagatcagcctggacaatgacatcagcatccgggagtgcaaggactggcacgtgtctggcagcatccagaagaacacccactacatgatgatctttgatgcctttgtgatcctgacctgcctggtgtccctcatcctgtgcatccgcagcgtcatccggggcctgcagctgcagcaggagtttgtgaacttcttcctgctgcactacaagaaggaggtgtctgtgtctgaccagatggagtttgtgaatggctggtacatcatgatcatcatcagtgacatcctgaccatcatcggcagcatcctgaagatggagatccaggccaagagcctgaccagctatgatgtgtgcagcatcctgctgggcaccagcaccatgctggtgtggctgggcgtcatccgctacctgggcttctttgccaagtacaacctgctgatcctgaccctgcaggccgccctgcccaacgtcatccgcttctgctgctgtgccgccatgatctacctgggctactgcttctgtggctggatcgtgctgggcccctaccatgacaagttccgcagcctgaacatggtgtctgaatgtctcttcagcctcatcaatggagatgacatgtttgccacctttgccaagatgcagcagaagagctacctggtgtggctgttcagccgcatctacctgtacagcttcatcagcctcttcatctacatgatcctgagcctcttcatcgccctgatcacagacacctatgagaccatcaagcagtaccagcaggacggcttccctgagacagagctgcggaccttcatcagcgagtgcaaggacctgcccaacagcggcaagtaccgcctggaggatgatcctcctgtgtccctcttctgctgctgcaagaagtag

SEQ ID NO: 160351 - DNA, 1494 bp, Artificial Sequence
  Description of Artificial Sequence: Synthetic coding sequence
atggctgaccctgaggtggtggtgagcagctgcagcagccatgaggaggagaaccgctgcaacttcaaccagcagaccagccccagcgaggagctgctgctggaggaccagatgaggaggaagctgaagttcttcttcatgaacccctgtgagaagttctgggcccggggcaggaagccctggaagctggccatccagatcctgaagatcgccatggtgaccatccagtacctgcagctgtacaacgtgtctgtgggcaaccacgcctatgaaaataaaggcaccaagcagagcgccatggccatctgccagcacttctacaagaggggcaacatctacccaggaaatgacacctttgatattgatcctgagattgaaacagagtgcttctttgtggagccagatgagcccttccacatcggcaccccagctgagaacaagctgaacctgaccctggacttccaccggctgctgactgtggagctgcagttcaagctgaaggccatcaacctgcagacagtgcgccaccaggagctgcctgactgctatgacttcaccctgaccatcacctttgacaacaaggcccacagcggccgcatcaagatcagcctggacaatgacatcagcatccgggagtgcaaggactggcacgtgtctggcagcatccagaagaacacccactacatgatgatctttgatgcctttgtgatcctgacctgcctggtgtccctcatcctgtgcatccgcagcgtcatccggggcctgcagctgcagcaggagtttgtgaacttcttcctgctgcactacaagaaggaggtgtctgtgtctgaccagatggagtttgtgaatggctggtacatcatgatcatcatcagtgacatcctgaccatcatcggcagcatcctgaagatggagatccaggccaagagcctgaccagctatgatgtgtgcagcatcctgctgggcaccagcaccatgctggtgtggctgggcgtcatccgctacctgggcttctttgccaagtacaacctgctgatcctgaccctgcaggccgccctgcccaacgtcatccgcttctgctgctgtgccgccatgatctacctgggctactgcttctgtggctggatcgtgctgggcccctaccatgacaagttccgcagcctgaacatggtgtctgaatgtctcttcagcctcatcaatggagatgacatgtttgccacctttgccaagatgcagcagaagagctacctggtgtggctgttcagccgcatctacctgtacagcttcatcagcctcttcatctacatgatcctgagcctcttcatcgccctgatcacagacacctatgagaccatcaagcagtaccagcaggacggcttccctgagacagagctgcggaccttcatcagcgagtgcaaggacctgcccaacagcggcaagtaccgcctggaggatgatcctcctgtgtccctcttctgctgctgcaagaagtag

SEQ ID NO: 160352 - DNA, 966 bp, Artificial Sequence
  Description of Artificial Sequence: Synthetic coding sequence
atggctgaccctgaggtggtggtgagcagctgcagcagccatgaggaggagaaccgctgcaacttcaaccagcagaccagccccagcgaggagctgctgctggaggaccagatgaggaggaagctgaagttcttcttcatgaacccctgtgagaagttctgggcccggggcaggaagccctggaagctggccatccagatcctgaagatcgccatggtgaccatccagctggtgctgtttggcctgagcaaccagatggtggtggccttcaaggaggagaacaccatcgccttcaagcacctgttcctgaagggctacatggacaggatggatgacacctatgctgtgtacacccagagtgatgtgtatgaccagctgatctttgctgtgaaccagtacctgcagctgtacaacgtgtctgtgggcaaccacgcctatgaaaataaaggcaccaagcagagcgccatggccatctgccagcacttctacaagaggggcaacatctacccaggaaatgacacctttgatattgatcctgagattgaaacagagtgcttctttgtggagccagatgagcccttccacatcggcaccccagctgagaacaagctgaacctgaccctggacttccaccggctgctgactgtggagctgcagttcaagctgaaggccatcaacctgcagacagtgcgccaccaggagctgcctgactgctatgacttcaccctgaccatcacctttgacaacaaggcccacagcggccgcatcaagatcagcctggacaatgacatcagcatccgggagtgcaaggactggcacgtgtctggcagcatccagaagaacacccactacatgatgatctttgatgcctttgtgatcctgacctgcctggtgtccctcatcctgtgcatccgcagcgtcatccggggcctgcagctgcagcaggtgggcaatgtggccttctag

SEQ ID NO: 160353 - DNA, 1494 bp, Artificial Sequence; identical to SEQ ID NO: 160351
  Description of Artificial Sequence: Synthetic coding sequence

SEQ ID NO: 160354 - DNA, 1662 bp, Artificial Sequence; identical to SEQ ID NO: 160350
  Description of Artificial Sequence: Synthetic coding sequence

SEQ ID NO: 160355 - DNA, 2442 bp, Artificial Sequence
  Description of Artificial Sequence: Synthetic coding sequence
atgagcctgctgggggaccccctgcaggccctgccccccagcgctgcccccaccggccccctgctggcccccccagctggggccaccctgaaccggctgcgggagcccctgctgcggcggctgtctgagctgctggaccaggcccctgagggccggggctggaggcggctggccgagctggccggcagccggggccgcctgcggctgagctgcctggacctggagcagtgcagcctgaaggtgctggagcctgagggcagccccagcctgtgcctgctgaagctgatgggagagaagggctgcaccgtgacagagctgagtgacttcctgcaggccatggagcacacagaggtgctgcagctgctgagccccccaggcatcaagatcaccgtgaaccctgagagcaaggctgtgctggccggccagtttgtgaagctgtgctgccgggccaccggccacccctttgtgcagtaccagtggttcaagatgaacaaggagatccccaatggaaacaccagcgagctgatcttcaatgctgtgcacgtgaaggatgctggcttctacgtgtgccgggtgaacaacaacttcacctttgagttcagccagtggagccagctggatgtgtgtgacatccctgagagcttccagaggtctgtggatggagtgtctgagagcaagctgcagatctgtgtggagcccaccagccagaagctgatgcctggcagcaccctggtgctgcagtgtgtggccgtgggcagccccatcccccactaccagtggttcaagaatgagctgcccctgacccatgagaccaagaagctgtacatggtgccctacgtggacctggagcaccagggcacctactggtgccacgtgtacaatgaccgggacagccaggacagcaagaaggtggagatcatcattgatgagctgaacaacctgggccacccagacaacaaggagcagaccacagaccagcccctggccaaggacaaggtggccctgctgattggcaacatgaactaccgggagcaccccaagctgaaggcccccctggtggatgtgtatgagctgaccaacctgctgcggcagctggacttcaaggtggtgtccctgctggacctgacagaatatgagatgagaaatgctgtggatgagttcctgctgctgctggacaagggcgtgtatggcctgctgtactatgccggccacggctatgaaaattttggaaacagcttcatggtgcctgtggatgcccccaacccctacagaagtgagaactgcctgtgtgtgcagaacatcctgaagctgatgcaggagaaggagaccggcctgaatgtgttcctgctggacatgtgcaggaagagaaatgactatgatgacaccatccccatcctggatgccctgaaggtgacagccaacatcgtgtttggctacgccacctgccagggcgctgaggcctttgagatccagcacagcggcctggccaacggcatcttcatgaagttcctgaaggaccggctgctggaggacaagaagatcaccgtgctgctggatgaggtggccgaggacatgggcaagtgccacctgaccaagggcaagcaggccctggagatccgcagcagcctgtctgagaagagggccctgacagaccccatccagggcacagagtacagcgctgagagcctggtgaggaacctgcagtgggccaaggcccacgagctgcctgagagcatgtgcctgaagtttgactgtggggtgcagatccagctgggctttgctgctgagttcagcaatgtgatgatcatctacaccagcatcgtgtacaagcccccagagatcatcatgtgtgatgcctacgtgacagacttccccctggacctggacatcgaccccaaggatgccaacaagggcaccccagaggagaccggcagctacctggtgtccaaggacctgcccaagcactgcctgtacacccggctgagcagcctgcagaagctgaaggagcacctggtgttcaccgtgtgcctgagctaccagtacagcggcctggaggacacagtggaggacaagcaggaggtgaatgtgggcaagcccctgattgccaagctggacatgcaccggggcctgggcaggaagacctgcttccagacctgcctgatgagcaatggcccctaccagagcagcgctgccaccagcggcggggccggccactaccacagcctgcaggaccccttccatggagtgtaccacagccaccctggcaaccccagcaatgtgaccccagctgacagctgccactgcagcaggaccccagatgccttcatcagcagctttgcccaccacgccagctgccacttcagccgcagcaatgtgcctgtggagaccacagatgagatccccttctccttcagtgaccggctgcgcatcagcgagaagtag

SEQ ID NO: 160356 - DNA, 2475 bp, Artificial Sequence
  Description of Artificial Sequence: Synthetic coding sequence
atgagcctgctgggggaccccctgcaggccctgccccccagcgctgcccccaccggccccctgctggcccccccagctggggccaccctgaaccggctgcgggagcccctgctgcggcggctgtctgagctgctggaccaggcccctgagggccggggctggaggcggctggccgagctggccggcagccggggccgcctgcggctgagctgcctggacctggagcagtgcagcctgaaggtgctggagcctgagggcagccccagcctgtgcctgctgaagctgatgggagagaagggctgcaccgtgacagagctgagtgacttcctgcaggccatggagcacacagaggtgctgcagctgctgagccccccaggcatcaagatcaccgtgaaccctgagagcaaggctgtgctggccggccagtttgtgaagctgtgctgccgggccaccggccacccctttgtgcagtaccagtggttcaagatgaacaaggagatccccaatggaaacaccagcgagctgatcttcaatgctgtgcacgtgaaggatgctggcttctacgtgtgccgggtgaacaacaacttcacctttgagttcagccagtggagccagctggatgtgtgtgacatccctgagagcttccagaggtctgtggatggagtgtctgagagcaagctgcagatctgtgtggagcccaccagccagaagctgatgcctggcagcaccctggtgctgcagtgtgtggccgtgggcagccccatcccccactaccagtggttcaagaatgagctgcccctgacccatgagaccaagaagctgtacatggtgccctacgtggacctggagcaccagggcacctactggtgccacgtgtacaatgaccgggacagccaggacagcaagaaggtggagatcatcatcggccgcacagatgaggccgtggagtgcacagaagatgagctgaacaacctgggccacccagacaacaaggagcagaccacagaccagcccctggccaaggacaaggtggccctgctgattggcaacatgaactaccgggagcaccccaagctgaaggcccccctggtggatgtgtatgagctgaccaacctgctgcggcagctggacttcaaggtggtgtccctgctggacctgacagaatatgagatgagaaatgctgtggatgagttcctgctgctgctggacaagggcgtgtatggcctgctgtactatgccggccacggctatgagaactttggaaacagcttcatggtgcctgtggatgcccccaacccctacagaagtgagaactgcctgtgtgtgcagaacatcctgaagctgatgcaggagaaggagaccggcctgaatgtgttcctgctggacatgtgcaggaagagaaatgactatgatgacaccatccccatcctggatgccctgaaggtgacagccaacatcgtgtttggctacgccacctgccagggcgctgaggcctttgagatccagcacagcggcctggccaacggcatcttcatgaagttcctgaaggaccggctgctggaggacaagaagatcaccgtgctgctggatgaggtggccgaggacatgggcaagtgccacctgaccaagggcaagcaggccctggagatccgcagcagcctgtctgagaagagggccctgacagaccccatccagggcacagagtacagcgctgagagcctggtgaggaacctgcagtgggccaaggcccacgagctgcctgagagcatgtgcctgaagtttgactgtggggtgcagatccagctgggctttgctgctgagttcagcaatgtgatgatcatctacaccagcatcgtgtacaagcccccagagatcatcatgtgtgatgcctacgtgacagacttccccctggacctggacatcgaccccaaggatgccaacaagggcaccccagaggagaccggcagctacctggtgtccaaggacctgcccaagcactgcctgtacacccggctgagcagcctgcagaagctgaaggagcacctggtgttcaccgtgtgcctgagctaccagtacagcggcctggaggacacagtggaggacaagcaggaggtgaatgtgggcaagcccctcatcgccaagctggacatgcaccggggcctgggcaggaagacctgcttccagacctgcctgatgagcaatggcccctaccagagcagcgctgccaccagcggcggggccggccactaccacagcctgcaggaccccttccacggcgtgtaccacagccaccctggcaaccccagcaatgtgaccccagctgacagctgccactgcagcaggaccccagatgccttcatcagcagctttgcccaccacgccagctgccacttcagccgcagcaatgtgcctgtggagaccacagatgagatccccttctccttcagtgaccggctgcgcatcagcgagaagtag

SEQ ID NO: 160357 - DNA, 441 bp, Artificial Sequence
  Description of Artificial Sequence: Synthetic coding sequence
atgaccatgaggagcctgctgcggacccccttcctgtgtggcctgctgtgggccttctgtgcccctggggcccgggcagaggagcctgctgccagcttcagccagcccggctccatgggcctggacaagaacacagtgcatgaccaggagcacatcatggagcacctggagggcgtcatcaacaagccagaggccgagatgagcccccaggagctgcagctgcactacttcaagatgcatgactatgatggcaacaacctgctggatggcctggagctgagcacagccatcacccacgtgcacaaggaggagggcagcgagcaggcccccctgatgtctgaagatgagctgatcaacatcattgatggagtgctgagagatgatgacaagaacaatgatggctacatcgactatgcagagtttgccaagagcctgcagtag

SEQ ID NO: 160358 - DNA, 441 bp, Artificial Sequence; identical to SEQ ID NO: 160357
  Description of Artificial Sequence: Synthetic coding sequence

SEQ ID NO: 160359 - DNA, 285 bp, Artificial Sequence
  Description of Artificial Sequence: Synthetic coding sequence
atggagcacctggagggcgtcatcaacaagccagaggccgagatgagcccccaggagctgcagctgcactacttcaagatgcatgactatgatggcaacaacctgctggatggcctggagctgagcacagccatcacccacgtgcacaaggaggagggcagcgagcaggcccccctgatgtctgaagatgagctgatcaacatcattgatggagtgctgagagatgatgacaagaacaatgatggctacatcgactatgcagagtttgccaagagcctgcagtag

SEQ ID NO: 160360 - DNA, 441 bp, Artificial Sequence; identical to SEQ ID NO: 160357
  Description of Artificial Sequence: Synthetic coding sequence

SEQ ID NO: 160361 - DNA, 441 bp, Artificial Sequence; identical to SEQ ID NO: 160357
  Description of Artificial Sequence: Synthetic coding sequence

SEQ ID NO: 160362 - DNA, 285 bp, Artificial Sequence; identical to SEQ ID NO: 160359
  Description of Artificial Sequence: Synthetic coding sequence

SEQ ID NO: 160363 - DNA, 285 bp, Artificial Sequence; identical to SEQ ID NO: 160359
  Description of Artificial Sequence: Synthetic coding sequence

SEQ ID NO: 160364 - DNA, 441 bp, Artificial Sequence; identical to SEQ ID NO: 160357
  Description of Artificial Sequence: Synthetic coding sequence

SEQ ID NO: 160365 - DNA, 441 bp, Artificial Sequence; identical to SEQ ID NO: 160357
  Description of Artificial Sequence: Synthetic coding sequence

SEQ ID NO: 160366 - DNA, 186 bp, Artificial Sequence
  Description of Artificial Sequence: Synthetic coding sequence
atgaccatgaggagcctgctgcggacccccttcctgtgtggcctgctgtgggccttctgtgcccctggggcccgggcagaggagcctgctgccagcttcagccagcccggctccatgggcctggacaagaacacagtgcatgaccaggagcacatcatggagcacctggagggcgtcatcaactag

SEQ ID NO: 160367 - DNA, 384 bp, Artificial Sequence
  Description of Artificial Sequence: Synthetic coding sequence
atgctgtctgtgtgcagctgcaggaccagcagcggcatgaggagccagtggcccagcgcccggcagaggagcagcagcctgagcaccttccgccacatcatggagcacctggagggcgtcatcaacaagccagaggccgagatgagcccccaggagctgcagctgcactacttcaagatgcatgactatgatggcaacaacctgctggatggcctggagctgagcacagccatcacccacgtgcacaaggaggagggcagcgagcaggcccccctgatgtctgaagatgagctgatcaacatcattgatggagtgctgagagatgatgacaagaacaatgatggctacattgattatgcagagtttgccaagagcctgcagtag

SEQ ID NO: 160368 - DNA, 3423 bp, Artificial Sequence
  Description of Artificial Sequence: Synthetic coding sequence
atggtgatcagcctgaacagctgcctgtccttcatctgcctgctgctgtgccactggattggaacagccagccccctgaacctggaggaccccaacgtgtgcagccactgggagagctacagcgtgacagtgcaggagagctacccccacccctttgaccagatctactacaccagctgcacagacatcctgaactggttcaagtgcaccaggcaccgggtgtcctacagaacagcctaccgccacggggagaagaccatgtacagaaggaagagccagtgctgccccggcttctatgaaagtggagagatgtgtgtgccccactgtgccgacaagtgtgtgcacggccgctgcatcgcccccaacacctgccagtgtgagcccggctggggcggcaccaactgcagcagcgcctgtgatggagaccactggggcccccactgcaccagccgctgccagtgcaagaatggagccctgtgcaaccccatcaccggggcctgccactgtgccgccggcttccggggctggaggtgtgaagatcgctgtgagcagggcacctatggaaatgactgccaccagcgctgccagtgccagaatggagccacctgtgaccacgtgactggagaatgtcgctgccccccaggctacacaggagccttctgtgaggacctgtgccccccaggcaagcacggcccccagtgtgagcagcgctgcccctgccagaatggaggagtgtgccaccacgtgactggagagtgcagctgccccagcggctggatgggcaccgtgtgtggccagccctgcccagagggccgctttgggaagaactgcagccaggagtgccagtgccacaatggaggcacctgtgatgctgccaccggccagtgccactgcagccctggctacacaggagagcgctgccaggatgagtgccctgtgggcacctacggcgtgctgtgtgccgagacctgccagtgtgtgaatggaggcaagtgctaccacgtgtctggggcctgcctgtgtgaggccggctttgctggggagcgctgtgaggcccggctgtgcccagagggcctgtatggcatcaagtgtgacaagcgctgcccctgccacctggagaacacccacagctgccaccccatgtctggagaatgtgcctgcaagccaggctggagcggcctgtactgcaatgagacctgcagccctggcttctatggagaggcctgccagcagatctgcagctgccagaatggagctgactgtgacagcgtgacaggcaagtgcacctgtgcccctggcttcaagggcatcgactgcagcaccccctgccccctgggcacctacggcatcaactgcagcagccgctgtggctgcaagaatgatgctgtgtgcagccctgtggatggcagctgcacctgcaaggccggctggcacggcgtggactgcagcatccgctgccccagcggcacctggggcttcggctgcaacctgacctgccagtgcctgaatggaggagcctgcaacaccctggatggcacctgcacctgtgcccctggctggagaggagagaagtgtgagctgccctgccaggacggcacctacggcctgaactgtgccgagcgctgtgactgcagccatgctgatggctgccaccccaccaccggccactgccgctgcctgcccggctggagcggcgtgcactgtgacagcgtgtgtgccgagggccgctggggccccaactgcagcctgccctgctactgcaagaatggagccagctgcagcccagatgatggcatctgtgaatgtgcccctggcttccggggcaccacctgccagaggatctgcagccctggcttctacggccaccgctgcagccagacctgcccccagtgtgtgcacagcagcggcccctgccaccacatcaccggcctgtgtgactgcctgcccggcttcaccggggccctgtgcaatgaggtgtgccccagcggccgctttgggaagaactgtgccggcatctgcacctgcaccaacaacggcacctgcaaccccatcgacaggagctgccagtgctacccaggctggattggaagtgactgcagccagccctgccccccagcccactggggccccaactgcatccacacctgcaactgccacaacggggccttctgcagcgcctatgatggagagtgcaagtgcaccccaggctggacaggcctgtactgcacccagcgctgccccctgggcttctacggcaaggactgtgccctgatctgccagtgccagaatggagctgactgtgaccacatcagcggccagtgcacctgcaggacaggcttcatgggccgccactgtgagcagaagtgccccagcggcacctacggctacggctgccggcagatctgtgactgcctgaacaacagcacctgtgaccacatcaccggcacctgctactgcagccctggctggaagggggcccgctgtgaccaggccggggtcatcatcgtgggcaacctgaacagcctgagcaggaccagcacagccctgcctgctgacagctaccagatcggggccatcgccggcatcatcatcctggtgctggtggtgctcttcctgctggccctcttcatcatctaccgccacaagcagaagggcaaggagagctccatgcctgctgtgacctacaccccagccatgagggtggtgaatgctgactacaccatcagcggcaccctgccccacagcaatggaggaaatgccaacagccactacttcaccaaccccagctaccacaccctgacccagtgtgccaccagcccccacgtgaacaacagagacaggatgacagtgaccaagagcaagaacaaccagctgtttgtgaacctgaagaatgtgaaccctgggaagaggggccctgtgggggactgcaccggcaccctgcctgctgactggaagcacggcggctacctgaatgagctgggcgccttcggcctggacaggagctacatgggcaagagcctgaaggacctgggcaagaacagcgagtacaacagcagcaactgcagcctgagcagcagcgagaacccctatgccaccatcaaggacccccctgtgctgatccccaagagcagtgaatgtggctacgtggagatgaagagccctgcccggcgggacagcccctatgcagagatcaacaacagcaccagcgccaacagaaatgtgtatgaggtggagcccaccgtgtctgtggtgcagggcgtcttcagcaacaacggccgcctgagccaggacccctatgacctgcccaagaacagccacatcccctgccactatgacctgctgcctgtgcgggacagcagcagcagccccaagcaggaggacagcggcggcagcagcagcaacagcagcagcagcagcgagtag

SEQ ID NO: 160369 - DNA, 1704 bp, Artificial Sequence
  Description of Artificial Sequence: Synthetic coding sequence
atggtgatcagcctgaacagctgcctgtccttcatctgcctgctgctgtgccactggattggaacagccagccccctgaacctggaggaccccaacgtgtgcagccactgggagagctacagcgtgacagtgcaggagagctacccccacccctttgaccagatctactacaccagctgcacagacatcctgaactggttcaagtgcaccaggcaccgggtgtcctacagaacagcctaccgccacggggagaagaccatgtacagaaggaagagccagtgctgccccggcttctatgaaagtggagagatgtgtgtgccccactgtgccgacaagtgtgtgcacggccgctgcatcgcccccaacacctgccagtgtgagcccggctggggcggcaccaactgcagcagcgcctgtgatggagaccactggggcccccactgcaccagccgctgccagtgcaagaatggagccctgtgcaaccccatcaccggggcctgccactgtgccgccggcttccggggctggaggtgtgaagatcgctgtgagcagggcacctatggaaatgactgccaccagcgctgccagtgccagaatggagccacctgtgaccacgtgactggagaatgtcgctgccccccaggctacacaggagccttctgtgaggacctgtgccccccaggcaagcacggcccccagtgtgagcagcgctgcccctgccagaatggaggagtgtgccaccacgtgactggagagtgcagctgccccagcggctggatgggcaccgtgtgtggccagccctgcccagagggccgctttgggaagaactgcagccaggagtgccagtgccacaatggaggcacctgtgatgctgccaccggccagtgccactgcagccctggctacacaggagagcgctgccaggatgagtgccctgtgggcacctacggcgtgctgtgtgccgagacctgccagtgtgtgaatggaggcaagtgctaccacgtgtctggggcctgcctgtgtgaggccggctttgctggggagcgctgtgaggcccggctgtgcccagagggcctgtatggcatcaagtgtgacaagcgctgcccctgccacctggagaacacccacagctgccaccccatgtctggagaatgtgcctgcaagccaggctggagcggcctgtactgcaatgagacctgcagccctggcttctatggagaggcctgccagcagatctgcagctgccagaatggagctgactgtgacagcgtgacaggcaagtgcacctgtgcccctggcttcaagggcatcgactgcagcaccccctgccccctgggcacctacggcatcaactgcagcagccgctgtggctgcaagaatgatgctgtgtgcagccctgtggatggcagctgcacctgcaaggccggctggcacggcgtggactgcagcatccgctgccccagcggcacctggggcttcggctgcaacctgacctgccagtgcctgaatggaggagcctgcaacaccctggatggcacctgcacctgtgcccctggctggagaggagagaagtgtgagctgccctgccaggacggcacctacggcctgaactgtgccgagcgctgtgactgcagccatgctgatggctgccaccccaccaccggccactgccgctgcctgcccggctggagcggcctcttctag

SEQ ID NO: 160370 - DNA, 3423 bp, Artificial Sequence; identical to SEQ ID NO: 160368
  Description of Artificial Sequence: Synthetic coding sequence

SEQ ID NO: 160371 - DNA, 2910 bp, Artificial Sequence
  Description of Artificial Sequence: Synthetic coding sequence
atgcacacccccagcatccgcagcatcacccatgatgcccagaccagcagcacaggcagcagcgcccctggaacagccctgtgcacagaagaatgtgtgcacggccgctgtgtgtccccagacacctgccactgtgagcccggctggggcggccctgactgcagcagcggctgtgacagcgaccactggggcccccactgcagcaaccgctgccagtgccagaatggagccctgtgcaaccccatcactggagcctgtgtgtgtgccgccggcttccggggctggaggtgtgaggagctgtgtgcccctggcacccacggcaagggctgccagctgccctgccagtgccgccacggggccagctgtgacccccgggccggggagtgcctgtgtgcccctggctacacaggagtgtactgtgaggagctgtgccccccaggcagccatggagcccactgtgagctgcgctgcccctgccagaatggaggcacctgccaccacatcactggagaatgtgcctgccccccaggctggacaggagctgtgtgtgcccagccctgccccccaggcaccttcggccagaactgcagccaggactgcccctgccaccacggcggccagtgtgaccacgtgacaggccagtgccactgcacagctggctacatgggagaccgctgccaggaggagtgccccttcggcagctttggcttccagtgcagccagcactgtgactgccacaatggaggccagtgcagccccaccactggagcctgtgaatgtgagcccggctacaagggcccccgctgccaggagcggctgtgcccagagggcctgcacggccctggctgcaccctgccctgcccctgtgatgctgacaacaccatcagctgccaccctgtgactggagcctgcacctgccagcccggctggagcggccaccactgcaatgaaagctgccctgtgggctactatggagatggctgccagctgccctgcacctgccagaatggagctgactgccacagcatcaccggcggctgcacctgtgcccctggcttcatgggagaggtgtgtgctgtgtcctgtgccgccggcacctacggccccaactgcagcagcatctgcagctgcaacaatggaggcacctgcagccctgtggatggcagctgcacctgcaaggagggctggcagggcctggactgcaccctgccctgccccagcggcacctggggcctgaactgcaatgaaagctgcacctgtgccaacggggccgcctgcagccccattgatggcagctgcagctgcaccccaggctggctgggggacacctgtgagctgccctgcccagatggcaccttcggcctgaactgcagcgagcactgtgactgcagccatgctgatggctgtgaccctgtgacaggccactgctgctgcctggccggctggacaggcatccgctgtgacagcacctgccccccaggccgctggggccccaactgcagcgtgtcctgcagctgtgaaaatggaggcagctgcagcccagaagatggcagctgtgaatgtgcccctggcttccggggccccctgtgccagaggatctgccccccaggcttctacggccacggctgtgcccagccctgccccctgtgtgtgcacagcagccggccctgccaccacatcagcggcatctgtgaatgtctgcccggcttcagcggggccctgtgcaaccaggtgtgtgccggcggctacttcggccaggactgtgcccagctgtgcagctgtgccaacaacggcacctgcagccccattgatggcagctgccagtgcttccctggctggattggcaaggactgcagccaggcctgccccccaggcttctggggccctgcctgcttccacgcctgcagctgccacaatggagccagctgcagcgcagaagatggagcctgccactgcaccccaggctggacaggcctcttctgcacccagcgctgcccagctgccttcttcggcaaggactgtggccgggtgtgccagtgccagaatggagccagctgtgaccacatcagcggcaagtgcacctgcaggacaggcttcaccggccagcactgtgagcagagatgtgcccctggcaccttcggctacggctgccagcagctgtgtgagtgcatgaacaacagcacctgtgaccacgtgacaggcacctgctactgcagccctggcttcaagggcatccgctgtgaccaggccgccctgatgatggaggagctgaacccctacaccaagatcagccctgccctgggcgctgagcggcacagcgtgggcgctgtgacaggcatcatgctgctgctcttcctgattgtggtgctgctgggcctgtttgcctggcacagaagacggcagaaggagaagggccgggacctggccccccgggtgtcctacaccccagccatgaggatgaccagcacagactacagcctgagcggggcctgtggcatggaccggcggcagaacacctacatcatggacaagggcttcaaggactacatgaaggagagcgtgtgcagcagcagcacctgcagcctgaacagcagcgagaacccctatgccaccatcaaggacccccccatcctgacctgcaagctgcctgagagcagctatgtggagatgaagagccctgtgcacatgggcagcccctacacagatgtgcccagcctgagcaccagcaacaagaacatctatgaggtggagcccaccgtgtctgtggtgcaggagggctgcggccacaacagcagctacatccagaatgcctatgacctgcccaggaacagccacatccctggccactatgacctgctgcctgtgcggcagagccctgccaacggccccagccaggacaagcagagctag

SEQ ID NO: 160372 - DNA, 2628 bp, Artificial Sequence
  Description of Artificial Sequence: Synthetic coding sequence
atggtgctgagcctgaccggcctgattgccttctccttcctgcaggccaccctggccctgaaccctgaggaccccaacgtgtgcagccactgggagagctatgctgtgacagtgcaggagagctatgcccacccctttgaccagatctactacacccgctgcacagacatcctgaactggttcaagtgcaccaggcaccgcatctcctacaagacagcctacagaagaggcctgcggaccatgtacagaagaagaagccagtgctgccccggctactatgaaagtggggacttctgcatccccctgtgcacagaggagtgtgtgcacggccgctgtgtgtccccagacacctgccactgtgagcccggctggggcggccctgactgcagcagcggctgtgacagcgaccactggggcccccactgcagcaaccgctgccagtgccagaatggagccctgtgcaaccccatcaccggggcctgtgtgtgtgccgccggcttccggggctggaggtgtgaggagctgtgtgcccctggcacccacggcaagggctgccagctgccctgccagtgcagacatggagccagctgtgaccccagggctggagaatgtctgtgtgcccctggctacacaggagtgtactgtgaggagctgtgccccccaggcagccacggggcccactgtgagctgcgctgcccctgccagaatggaggcacctgccaccacatcaccggggagtgtgcctgccccccaggctggacaggagctgtgtgtgcccagccctgccccccaggcaccttcggccagaactgcagccaggactgcccctgccaccacggcggccagtgtgaccacgtgacaggccagtgccactgcacagctggctacatgggagaccgctgccaggaggagtgccccttcggcagctttggcttccagtgcagccagcactgtgactgccacaacggcggccagtgcagccccaccaccggggcctgtgaatgtgagcccggctacaagggcccccgctgccaggagcggctgtgcccagagggcctgcacggccctggctgcaccctgccctgcccctgtgatgctgacaacaccatcagctgccaccctgtgactggagcctgcacctgccagcccggctggagcggccaccactgcaatgaaagctgccctgtgggctactatggagatggctgccagctgccctgcacctgccagaatggagctgactgccacagcatcactggaggctgcacctgtgcccctggcttcatgggagaggtgtgtgctgtgtcctgtgccgccggcacctacggccccaactgcagcagcatctgcagctgcaacaacggcggcacctgcagccctgtggatggcagctgcacctgcaaggagggctggcagggcctggactgcaccctgccctgccccagcggcacctggggcctgaactgcaatgaaagctgcacctgtgccaatggagctgcctgcagccccattgatggcagctgcagctgcaccccaggctggctgggggacacctgtgagctgccctgcccagatggcaccttcggcctgaactgcagcgagcactgtgactgcagccatgctgatggctgtgaccctgtgacaggccactgctgctgcctggccggctggacaggcatccgctgtgacagcacctgccccccaggccgctggggccccaactgcagcgtgtcctgcagctgtgaaaatggaggcagctgcagcccagaagatggcagctgtgaatgtgcccctggcttccggggccccctgtgccagaggatctgccccccaggcttctacggccacggctgtgcccagccctgccccctgtgtgtgcacagcagccggccctgccaccacatcagcggcatctgtgagtgcctgcccggcttcagcggggccctgtgcaaccaggtgtgtgccggcggctacttcggccaggactgtgcccagctgtgcagctgtgccaacaacggcacctgcagccccattgatggcagctgccagtgcttccctggctggattggcaaggactgcagccaggcctgccccccaggcttctggggccctgcctgcttccacgcctgcagctgccacaacggggccagctgcagcgcagaagatggagcctgccactgcaccccaggctggacaggcctcttctgcacccagaggaagccccacctgctggccagccagcccctgcgcatcccctgctgcggcctgctggccaccgtgggcatcgtgcagaccagccgggagggcggcatgcaggccgcccctggcctggtggtgcctgacagctgccccaccaggacagaggagctgtgccggggcagcagcaggccagactggatccagggcatcgacaagcccaaggtgctggagggccagggctgcaaggccgcccagcagcacttcctgggccgcacagtgggcgcctatgcctctgtgaggatggccccagctgtgaccacctctgtggccagcgccccagctgcccaggccagccctggcaacacagtgtccagagatgtgccccaggagcccctggccatgggcgtgtcctcctatgtgtctgcctag

SEQ ID NO: 160373 - DNA, 414 bp, Artificial Sequence
  Description of Artificial Sequence: Synthetic coding sequence
atgatggaggagctgaacccctacaccaagatcagccctgccctgggcgctgagcggcacagcgtgggcgctgtgacaggcatcatgctgctgctcttcctgattgtggtgctgctgggcctgtttgcctggcacagaagacggcagaaggagaagggccgggacctggccccccgggtgtcctacaccccagccatgaggatgaccagcacagactacagcctgagcgccagcaccaccccctggtggcctgtgatggagcacctggcccggcccttcagccagaggcccaggacccagctgagcaacaagagcctggaccgggacacagctggctggaccccctacagctatgtgaatgtgctggaccagtgccctgggggccaggtgcctgcccggggcctgctgcactag

SEQ ID NO: 160374 - DNA, 2910 bp, Artificial Sequence; identical to SEQ ID NO: 160371
  Description of Artificial Sequence: Synthetic coding sequence

SEQ ID NO: 160375 - DNA, 3135 bp, Artificial Sequence
  Description of Artificial Sequence: Synthetic coding sequence
atggtgctgagcctgaccggcctgattgccttctccttcctgcaggccaccctggccctgaaccctgaggaccccaacgtgtgcagccactgggagagctatgctgtgacagtgcaggagagctatgcccacccctttgaccagatctactacacccgctgcacagacatcctgaactggttcaagtgcaccaggcaccgcatctcctacaagacagcctacagaagaggcctgcggaccatgtacagaagaagaagccagtgctgccccggctactatgaaagtggggacttctgcatccccctgtgcacagaggagtgtgtgcacggccgctgtgtgtccccagacacctgccactgtgagcccggctggggcggccctgactgcagcagcggctgtgacagcgaccactggggcccccactgcagcaaccgctgccagtgccagaatggagccctgtgcaaccccatcaccggggcctgtgtgtgtgccgccggcttccggggctggaggtgtgaggagctgtgtgcccctggcacccacggcaagggctgccagctgccctgccagtgcagacatggagccagctgtgaccccagggctggagaatgtctgtgtgcccctggctacacaggagtgtactgtgaggagctgtgccccccaggcagccacggggcccactgtgagctgcgctgcccctgccagaatggaggcacctgccaccacatcaccggggagtgtgcctgccccccaggctggacaggagctgtgtgtgcccagccctgccccccaggcaccttcggccagaactgcagccaggactgcccctgccaccacggcggccagtgtgaccacgtgacaggccagtgccactgcacagctggctacatgggagaccgctgccaggaggagtgccccttcggcagctttggcttccagtgcagccagcactgtgactgccacaacggcggccagtgcagccccaccaccggggcctgtgaatgtgagcccggctacaagggcccccgctgccaggagcggctgtgcccagagggcctgcacggccctggctgcaccctgccctgcccctgtgatgctgacaacaccatcagctgccaccctgtgactggagcctgcacctgccagcccggctggagcggccaccactgcaatgaaagctgccctgtgggctactatggagatggctgccagctgccctgcacctgccagaatggagctgactgccacagcatcactggaggctgcacctgtgcccctggcttcatgggagaggtgtgtgctgtgtcctgtgccgccggcacctacggccccaactgcagcagcatctgcagctgcaacaacggcggcacctgcagccctgtggatggcagctgcacctgcaaggagggctggcagggcctggactgcaccctgccctgccccagcggcacctggggcctgaactgcaatgaaagctgcacctgtgccaatggagctgcctgcagccccattgatggcagctgcagctgcaccccaggctggctgggggacacctgtgagctgccctgcccagatggcaccttcggcctgaactgcagcgagcactgtgactgcagccatgctgatggctgtgaccctgtgacaggccactgctgctgcctggccggctggacaggcatccgctgtgacagcacctgccccccaggccgctggggccccaactgcagcgtgtcctgcagctgtgaaaatggaggcagctgcagcccagaagatggcagctgtgaatgtgcccctggcttccggggccccctgtgccagaggatctgccccccaggcttctacggccacggctgtgcccagccctgccccctgtgtgtgcacagcagccggccctgccaccacatcagcggcatctgtgagtgcctgcccggcttcagcggggccctgtgcaaccaggtgtgtgccggcggctacttcggccaggactgtgcccagctgtgcagctgtgccaacaacggcacctgcagccccattgatggcagctgccagtgcttccctggctggattggcaaggactgcagccaggcctgccccccaggcttctggggccctgcctgcttccacgcctgcagctgccacaacggggccagctgcagcgcagaagatggagcctgccactgcaccccaggctggacaggcctcttctgcacccagcgctgcccagctgccttcttcggcaaggactgtggccgggtgtgccagtgccagaatggagccagctgtgaccacatcagcggcaagtgcacctgcaggacaggcttcaccggccagcactgtgagcagagatgtgcccctggcaccttcggctacggctgccagcagctgtgtgagtgcatgaacaacagcacctgtgaccacgtgacaggcacctgctactgcagccctggcttcaagggcatccgctgtgaccaggccgccctgatgatggaggagctgaacccctacaccaagatcagccctgccctgggcgctgagcggcacagcgtgggcgctgtgacaggcatcatgctgctgctcttcctgattgtggtgctgctgggcctgtttgcctggcacagaagacggcagaaggagaagggccgggacctggccccccgggtgtcctacaccccagccatgaggatgaccagcacagactacagcctgagcggggcctgtggcatggaccggcggcagaacacctacatcatggacaagggcttcaaggactacatgaaggagagcgtgtgcagcagcagcacctgcagcctgaacagcagcgagaacccctatgccaccatcaaggacccccccatcctgacctgcaagctgcctgagagcagctatgtggagatgaagagccctgtgcacatgggcagcccctacacagatgtgcccagcctgagcaccagcaacaagaacatctatgaggtggagcccaccgtgtctgtggtgcaggagggctgcggccacaacagcagctacatccagaatgcctatgacctgcccaggaacagccacatccctggccactatgacctgctgcctgtgcggcagagccctgccaacggccccagccaggacaagcagagctag

SEQ ID NO: 160376 - DNA, 3135 bp, Artificial Sequence; identical to SEQ ID NO: 160375
  Description of Artificial Sequence: Synthetic coding sequence

SEQ ID NO: 160377 - DNA, 3690 bp, Artificial Sequence
  Description of Artificial Sequence: Synthetic coding sequence
atgggcgccagccgggaccggggcctggccgccctgtggtgcctgggcctgctgggcggcctggcccgggtggccggcacccactaccgctacctgtggaggggctgctacccctgccacctgggccaggccggctaccctgtgtctgctggggaccagaggccagatgtggatgaatgtaggacccacaacggcggctgccagcaccgctgtgtgaacaccccaggcagctacctgtgtgagtgcaagccaggcttccggctgcacacagacagcaggacctgcctggccatcaacagctgtgccctgggcaatggaggctgccagcaccactgtgtgcagctgaccatcaccaggcaccgctgccagtgccggcccggcttccagctgcaggaggatggccgccactgtgtgagaagaagcccctgtgccaacagaaatggcagctgcatgcaccgctgccaggtggtgcggggcctggcccgctgtgagtgccacgtgggctaccagctggccgcagatggcaaggcctgtgaagatgtggatgaatgtgccgccggcctggcccagtgtgcccacggctgcctgaacacccagggcagcttcaagtgtgtgtgccacgccggctatgagctgggcgcagatggccggcagtgctaccgcatcgagatggagatcgtgaacagctgtgaggccaacaacggcggctgcagccacggctgcagccacaccagcgctggccccctgtgcacctgcccccggggctatgagctggacacagaccagaggacctgcattgatgtggatgactgtgccgacagcccctgctgccagcaggtgtgcaccaacaaccctgggggctatgaatgtggctgctacgccggctaccgcctgtctgcagatggctgcggctgtgaagatgtggatgaatgtgccagcagccggggcggctgtgagcaccactgcaccaacctggccggcagcttccagtgcagctgtgaggccggctaccgcctgcatgaagatagaagaggctgcagccccctggaggagcccatggtggacctggatggagagctgccctttgtgcggcccctgccccacatcgctgtgctgcaggatgagctgccccagctgttccaggatgatgatgtgggcgcagatgaggaggaggccgagctgcggggggagcacaccctgacagagaagtttgtgtgcctggatgacagctttggacatgactgcagcctgacctgtgatgactgcagaaatggaggcacctgcctgctgggcctggatggctgtgactgcccagagggctggacaggcctcatctgcaatgagacctgccccccagacaccttcggcaagaactgcagcttcagctgcagctgccagaatggaggcacctgtgacagcgtgactggagcctgccgctgccccccaggagtgtctggcaccaactgtgaagatggctgccccaagggctactacggcaagcactgcaggaagaagtgcaactgtgccaacagaggccgctgccaccggctgtatggagcctgcctgtgtgaccccggcctgtatggccgcttctgccacctgacctgccccccctgggcctttggacctggctgcagcgaggagtgccagtgtgtgcagccccacacccagagctgtgacaagagagatggcagctgcagctgcaaggccggcttccggggggagcgctgccaggccgagtgtgagctgggctacttcggccctggctgctggcaggcctgcacctgccctgtgggcgtggcctgtgacagcgtgtctggagaatgtgggaagcgctgcccagctggcttccagggcgaggactgtggccaggagtgccctgtgggcacctttggagtgaactgcagcagcagctgcagctgtggcggggccccctgccacggcgtgacaggccagtgccgctgccccccaggccgcactggagaggactgtgaggccgactgcccagagggccgctggggcctgggctgccaggagatctgcccagcctgccagcacgccgcccgctgtgaccctgagaccggggcctgcctgtgcctgcccggctttgtgggcagccgctgccaggatgtgtgcccagctggctggtacggccccagctgccagacccgctgcagctgtgccaatgatggccactgccacccagccaccggccactgcagctgtgcccctggctggacaggcttcagctgccagagggcctgtgacaccggccactggggccctgactgcagccacccctgcaactgcagcgctggccacggcagctgtgatgccatcagcggcctgtgcctgtgtgaggccggctacgtgggcccccgctgtgagcagcagtgcccccagggccacttcggccctggctgtgagcagcgctgccagtgccagcacggggccgcctgtgaccacgtgtctggggcctgcacctgcccagctggctggaggggcaccttctgtgagcacgcctgcccagctggcttcttcggcctggactgccgcagcgcctgcaactgcacagctggagctgcctgtgatgctgtgaatggcagctgcctgtgcccagctggccggcggggcccccgctgtgccgagaagtgcctgcccagagatgtgcgggccggctgccgccacagcggcggctgcctgaatggaggcctgtgtgacccccacacaggccgctgcctgtgcccagctggctggacaggagacaagtgccagagcccctgcctgcggggctggtttggagaggcctgtgcccagcgctgcagctgccccccaggagctgcctgccaccacgtgactggagcctgccgctgccccccaggcttcaccggcagcggctgtgagcagggctgccccccaggccgctatggccctggctgtgagcagctgtgtggctgcctgaatggaggcagctgtgatgctgccaccggggcctgccgctgccccaccggcttcctgggcacagactgcaacctgacctgcccccagggccgcttcggccccaactgcacccacgtgtgtggctgcggccagggcgccgcctgtgaccctgtgacaggcacctgcctgtgccccccaggccgggccggcgtgcgctgtgagcggggctgcccccagaaccgcttcggcgtgggctgtgagcacacctgcagctgcagaaatggaggcctgtgccacgccagcaatggcagctgcagctgtggcctgggctggacaggccgccactgtgagctggcctgccccccaggccgctatggagctgcctgccacctggagtgcagctgccacaacaacagcacctgtgagcccgccaccggcacctgccgctgtggccctggcttctacggccaggcctgtgagcaccggcgcagcggggccacctgcaacctggactgcagaagaggccagtttggccccagctgcaccctgcactgtgactgtggcggcggcgctgactgtgaccctgtgtctggccagtgccactgtgtggatggctacatgggccccacctgccgggagggcggccccctgcggctgcctgagaaccccagcctggcccagggcagcgctggcaccctgcctgccagcagccggcccaccagccgcagcggcggccctgcccggcactag

SEQ ID NO: 160378 - DNA, 4626 bp, Artificial Sequence
  Description of Artificial Sequence: Synthetic coding sequence
atgtccttcctggaggaggcccgggccgccggccgggctgtggtgctggccctggtgctgctgctgctgcctgctgtgcctgtgggcgcctctgtgcccccccggcccctgctgcccctgcagcccggcatgccccacgtgtgtgccgagcaggagctgaccctggtgggccggcggcagccctgtgtgcaggccctgagccacacagtgcctgtgtggaaggccggctgcggctggcaggcctggtgtgtgggccacgagaggagaacagtgtactacatgggctaccggcaggtgtacaccacagaggccaggacagtgctgcgctgctgccggggctggatgcagcagccagatgaggagggctgcctgtctgcagaatgttctgccagcctgtgcttccatggaggccgctgtgtgcccggcagcgcccagccctgccactgccccccaggcttccagggcccccgctgccagtatgatgtggatgagtgcaggacccacaatggaggctgccagcaccgctgtgtgaacaccccaggcagctacctgtgtgagtgcaagccaggcttccggctgcacacagacagcaggacctgcctggccatcaacagctgtgccctgggcaatggaggctgccagcaccactgtgtgcagctgaccatcaccaggcaccgctgccagtgcaggcctggcttccagctgcaggaggatggccgccactgtgtgcggcgcagcccctgtgccaacagaaatggcagctgcatgcaccgctgccaggtggtgcggggcctggcccgctgtgaatgtcatgtgggctaccagctggccgcagatggcaaggcctgtgaagatgtggatgaatgtgccgccggcctggcccagtgtgcccacggctgcctgaacacccagggcagcttcaagtgtgtgtgccacgccggctatgagctgggcgcagatggccggcagtgctacagaattgagatggagatcgtgaacagctgtgaggccaacaatggaggctgcagccacggctgcagccacaccagcgctggccccctgtgcacctgcccccggggctatgagctggacacagaccagaggacctgcattgatgtggatgactgtgccgacagcccctgctgccagcaggtgtgcaccaacaaccctgggggctatgaatgtggctgctacgccggctaccgcctgtctgcagatggctgcggctgtgaagatgtggatgaatgtgccagcagcagaggaggctgtgagcaccactgcaccaacctggccggcagcttccagtgcagctgtgaggccggctaccgcctgcacgaggaccggcggggctgcagccccctggaggagcccatggtggacctggatggagagctgccctttgtgcggcccctgccccacatcgctgtgctgcaggatgagctgccccagctgttccaggatgatgatgtgggcgcagatgaggaggaggccgagctgcggggggagcacaccctgacagagaagtttgtgtgcctggatgacagctttggacatgactgcagcctgacctgtgatgactgcagaaatggaggcacctgcctgctgggcctggatggctgtgactgcccagagggctggacaggcctcatctgcaatgagacctgccccccagacaccttcggcaagaactgcagcttcagctgcagctgccagaatggaggcacctgtgacagcgtgactggagcctgccgctgccccccaggagtgtctggcaccaactgtgaagatggctgccccaagggctactacggcaagcactgcaggaagaagtgcaactgtgccaacagaggccgctgccaccggctgtatggagcctgcctgtgtgaccccggcctgtatggccgcttctgccacctgacctgccccccctgggccttcggccctggctgcagcgaggagtgccagtgtgtgcagccccacacccagagctgtgacaagagagatggcagctgcagctgcaaggccggcttccggggggagcgctgccaggctgaatgtgagctgggctactttggacctggctgctggcaggcctgcacctgccctgtgggcgtggcctgtgacagcgtgtctggagaatgtgggaagcgctgcccagctggcttccagggcgaggactgtggccaggagtgccctgtgggcaccttcggcgtgaactgcagcagcagctgcagctgtggcggggccccctgccacggcgtgacaggccagtgccgctgccccccaggccgcactggagaggactgtgaggccgactgcccagagggccgctggggcctgggctgccaggagatctgcccagcctgccagcacgccgcccgctgtgaccctgagactggagcctgcctgtgcctgcccggctttgtgggcagccgctgccaggatgtgtgcccagctggctggtacggccccagctgccagacccgctgcagctgtgccaatgatggccactgccacccagccaccggccactgcagctgtgcccctggctggacaggcttcagctgccagagggcctgtgacaccggccactggggccctgactgcagccacccctgcaactgcagcgctggccacggcagctgtgatgccatcagcggcctgtgcctgtgtgaggccggctacgtgggcccccgctgtgagcagcagtgcccccagggccactttggacctggctgtgagcagcgctgccagtgccagcacggggccgcctgtgaccacgtgtctggggcctgcacctgcccagctggctggaggggcaccttctgtgaacatgcctgcccagctggcttcttcggcctggactgccgcagcgcctgcaactgcacagctggggccgcctgtgatgctgtgaatggcagctgcctgtgcccagctggaagaagaggcccccgctgtgccgagacctgcccagcccacacctacggccacaactgcagccaggcctgtgcctgcttcaatggagccagctgtgaccctgtgcacggccagtgccactgtgcccctggctggatgggccccagctgcctgcaggcctgcccagctggcctgtatggagacaactgccgccacagctgcctgtgccagaatggaggcacctgtgaccctgtgtctggccactgtgcctgcccagagggctgggccggcctggcctgtgagaaggaatgtctgcccagagatgtgcgggccggctgccgccacagcggcggctgcctgaatggaggcctgtgtgacccccacacaggccgctgcctgtgcccagctggctggacaggagacaagtgccagagcccctgcctgcggggctggtttggagaggcctgtgcccagcgctgcagctgccccccaggggccgcctgccaccacgtgactggagcctgccgctgccccccaggcttcaccggcagcggctgtgagcaggcctgccccccaggcagctttggagaggactgtgcccagatgtgccagtgccctggagagaacccagcctgccacccagccaccggcacctgcagctgtgccgccggctaccacggccccagctgccagcagcgctgccccccaggccgctatggccctggctgtgagcagctgtgtggctgcctgaatggaggcagctgtgatgctgccactggagcctgccgctgccccaccggcttcctgggcacagactgcaacctgacctgcccccagggccgcttcggccccaactgcacccacgtgtgtggctgcggccagggcgccgcctgtgaccctgtgacaggcacctgcctgtgccccccaggccgggccggcgtgcgctgtgagcggggctgcccccagaacagatttggagtgggctgtgagcacacctgcagctgcagaaatggaggcctgtgccacgccagcaatggcagctgcagctgtggcctgggctggacaggccgccactgtgagctggcctgccccccaggccgctacggggccgcctgccacctggagtgcagctgccacaacaacagcacctgtgagcccgccaccggcacctgccgctgtggccctggcttctacggccaggcctgtgagcacccctgccccccaggcttccatggagctggctgccagggcctgtgctggtgccagcacggggccccctgtgaccccatcagcggccgctgcctgtgcccagctggcttccacggccacttctgtgagcggggctgtgagcccggcagctttggagagggctgccaccagagatgtgactgtgatggaggagccccctgtgaccctgtgacaggcctgtgcctgtgccccccaggccgcagcggggccacctgcaacctggactgcagaagaggccagtttggccccagctgcaccctgcactgtgactgtggcggcggcgctgactgtgaccctgtgtctggccagtgccactgtgtggatggctacatgggccccacctgccgggagggcggccccctgcggctgcctgagaaccccagcctggcccagggcagcgctggcaccctgcctgccagcagccggcccaccagccgcagcggcggccctgcccggcactag

SEQ ID NO: 160379 - DNA, 8538 bp, Artificial Sequence
  Description of Artificial Sequence: Synthetic coding sequence
atggccctgggcaaggtgctggccatggccctggtgctggccctggccgtgctgggcagcctgagccctggggcccgggccggggactgcaagggccagaggcaggtgctgcgggaggcccctggctttgtgacagatggagctggcaactacagcgtgaatggaaactgtgagtggctgattgaggcccccagcccccagcaccgcatcctgctggacttcctgttcctggacacagagtgcacctatgactacctgtttgtgtatgatggagacagcccccggggccccctgctggccagcctgagcggcagcacccggcccccacccatcgaggccagcagcggcaagatgctgctgcacctgttcagtgatgccaactacaacctgctgggcttcaatgccagcttccgcttcagcctgtgccctgggggctgccagagccacggccagtgccagcccccaggagtgtgtgcctgtgagcccggctggggcggccctgactgtggcctgcaggagtgcagcgcctactgcggcagccacggcacctgtgccagccccctgggcccctgccgctgtgagcccggcttcctgggccgggcctgtgacctgcacctgtgggagaaccagggcgccggctggtggcacaacgtgtctgcccgggaccctgccttcagcgccagaattggagctgctggggccttcctgagccccccaggcctgctggccgtgtttggaggccaggacctgaacaatgccctgggggacctggtgctgtacaacttcagcgccaacacctgggagagctgggacctgagccctgccccagctgcccggcacagccacgtggccgtggcctgggccggcagcctggtgctgatgggcggggagctggctgatggcagcctgaccaatgatgtgtgggccttcagccccctgggccggggccactgggagctgctggcccccccagccagcagcagcagcggccccccaggcctggccggccacgccgccgccctggtggatgatgtgtggctgtatgtgtctgggggccgcacccctcatgacctcttcagcagcggcctcttccgcttccggctggacagcaccagcggcggctactgggagcaggtgatcccagctgggggccggcccccagctgccaccggccacagcatggtgttccacgcccccagccgggccctgctggtgcacggcggccaccggcccagcacagcccgcttctctgtgcgggtgaacagcacagagctgttccacgtggacagacatgtgtggaccaccctgaagggcagagatggcctgcagggcccccgggagcgggccttccacacagcctctgtgctgggcaactacatggtggtgtatggaggaaatgtgcacacccactaccaggaggagaagtgctatgaagatggcatcttcttctaccacctgggctgccaccagtgggtgtctggagctgagctggcccctcctggcaccccagagggccgggccgcccctccttctggccgctacagccacgtggccgctgtgctgggcggctctgtgctgctggtggccggcggctacagcggccggcccaggggggacctgatggcctacaaggtgcccccatttgtgttccaggccccagccccagactaccacctggactactgcagcatgtacacagaccacagcgtgtgcagccgggaccctgagtgctcctggtgccagggcgcctgccaggccgcccctcctcctggcacccccctgggcgcctgcccagctgccagctgcctgggcctgggccgcctgctgggggactgccaggcctgcctggccttcagcagccccacagccccaccccggggccctggcaccctgggctggtgtgtgcacaatgaaagctgcctgcccaggcctgagcaggcccgctgccgcggggagcagatctctggaacagtgggctggtggggccctgcccctgtgtttgtgaccagcctggaggcctgtgtgacccagagcttcctgcccggcctgcacctgctgaccttccagcagccccccaacaccagccagcctgacaaggtgtccatcgtgcgcagcaccaccatcaccctgaccccatctgctgagacagatgtgtccctggtgtaccggggcttcatctaccccatgctgcccggcggccctgggggccctggagcagaagatgtggccgtgtggacccgggcccagaggctgcacgtgctggccaggatggcccggggccctgacacagagaacatggaggaggtgggccgctgggtggcccaccaggagaaggagacccggcggctgcagaggcctggcagcgcccggctcttccccctgcccggccgggaccacaagtatgctgtggagatccagggccagctgaatggcagcgctggccctggccacagcgagctgaccctgctgtgggacagaactggagtgcctgggggcagcgagatctccttcttcttcctggagccctaccgcagcagcagctgcaccagctacagcagctgcctgggctgcctggccgaccagggctgcggctggtgcctgaccagcgccacctgccacctgcggcagggcggggcccactgtggagatgatggagctgggggcagcctgctggtgctggtgcccaccctgtgccccctgtgtgaggagcaccgggactgccacgcctgcacccaggaccccttctgtgagtggcaccagagcaccagcaggaaaggagatgctgcctgcagccggcggggccggggccgcggggccctgaagagcccagaagaatgtcctcccctgtgcagccagaggctgacctgtgaggactgcctggccaacagcagccagtgtgcctggtgccagagcacccacacctgcttcctgtttgctgcctacctggcccgctacccccatggaggctgccggggctgggatgacagcgtgcacagcgagccccgctgccgcagctgtgatggcttcctgacctgccacgagtgcctgcagagccatgaatgtggctggtgtggaaatgaagacaaccccaccctgggccgctgcctgcagggcgacttcagcggccccctgggcggcggcaactgcagcctgtgggtgggggagggcctgggcctgcctgtggccctgcctgcccgctgggcctatgcccgctgcccagatgtggatgaatgtcggctgggcctggcccgctgccacccccgggccacctgcctgaacacccccctgtcctatgagtgccactgccagaggggctaccagggagatggcatcagccactgcaacagaacctgcctggaggactgtggccacggcgtgtgcagcggccccccagacttcacctgtgtgtgtgacctgggctggaccagtgacctgcccccacccaccccagcccctggccccccagccccccgctgcagccgggactgtggctgcagcttccacagccactgcaggaagaggggccctggcttctgtgatgagtgccaggactggacctggggcgagcactgtgagcgctgccggcccggcagctttggaaatgccaccggcagccggggctgccggccctgccagtgcaatggccacggggacccccggcggggccactgtgacaacctgagcggcctgtgcttctgccaggaccacacagaaggagcccactgccagctgtgcagccctggctactacggggaccccagggctgggggcagctgcttccgggagtgtggcggccgggccctgctgaccaacgtgtcctctgtggccctgggcagccggcgggtgggcggcctgctgcccccaggcggcggggccgcccgggccggccctggcctgagctactgtgtgtgggtggtgtctgccacagaggagctgcagccctgtgcccctggcaccctgtgcccccccctgaccctgaccttctccccagacagcagcaccccctgcaccctgtcctatgtgctggcctttgatggcttcccccgcttcctggacacaggagtggtgcagagcgacaggagcctgattgctgccttctgtggccagaggcgggaccggcccctgactgtgcaggccctgagcggcctgctggtgctgcactgggaggccaacggcagcagctcctggggcttcaatgcctctgtgggcagcgcccgctgtggcagcggcggccctggcagctgccctgtgccccaggagtgtgtgccccaggatggagctgctggggccggcctgtgccgctgcccccagggctgggccggcccccactgcaggatggccctgtgcccagagaactgcaatgcccacactggagctggcacctgcaaccagagcctgggcgtgtgcatctgtgccgagggctttggaggccctgactgtgccaccaagctggatggcggccagctggtgtgggagaccctgatggacagccggctgtctgctgacacagccagccgcttcctgcaccggctgggccacaccatggtggatggcccagatgccaccctgtggatgtttggaggcctgggcctgccccagggcctgctgggcaacctgtaccgctacagcgtgtctgaaagacgctggacccagatgctggccggggctgaagatggcggccctggccccagccccaggagcttccacgccgccgcctacgtgcctgctggccgcggggccatgtacctgctgggcggcctgacagctggaggagtgacccgggacttctgggtgctgaacctgaccaccctgcagtggaggcaggagaaggccccccagacagtggagctgcctgctgtggccggccacaccctgacagcccggcggggcctgagcctgctgctggtgggcggctacagcccagaaaatggcttcaaccagcagctgctggagtaccagctggccaccggcacctgggtgtctggggcccagagcggcaccccacccaccggcctgtatggccacagcgctgtgtaccacgaggccacagacagcctgtatgtgtttggaggcttccgcttccacgtggagctggccgcccccagccctgagctgtacagcctgcactgcccagacaggacctggagcctgctggcccccagccagggcgccaagagggacaggatgagaaatgtgcggggcagcagccggggcctgggccaggtgcctggagagcagcccggctcctggggcttccgggaggtgaggaagaagatggccctgtgggccgccctggccggcaccggcggcttcctggaggagatcagcccccacctgaaggagccccggcccaggctcttccacgccagcgccctgctgggggacaccatggtggtgctgggcggccgcagtgaccctgatgagttcagcagtgatgtgctgctgtaccaggtgaactgcaatgcctggctgctgcctgacctgaccaggtctgcctctgtgggcccccccatggaggagagcgtggcccatgctgtggccgctgtgggcagccggctgtacatcagcggcggctttggaggagtggccctgggccgcctgctggccctgaccctgcccccagacccctgccgcctgctgagcagccctgaggcctgcaaccagagcggggcctgcacctggtgccacggggcctgcctgagcggggaccaggcccaccggctgggctgcggcggcagcccctgcagccccatgcccaggagccctgaggagtgccggcggctgcggacctgcagtgaatgtctggcccggcaccccaggaccctgcagcctggagatggagaggccagcaccccccgctgcaagtggtgcaccaactgcccagagggcgcctgcatcggcagaaatggcagctgcaccagtgaaaatgactgccgcatcaaccagcgggaggtgttctgggccggcaactgcagcgaggccgcctgtggggctgctgactgtgagcagtgcacccgggagggcaagtgcatgtggacccggcagttcaagaggactggagagacccggcgcatcctgtctgtgcagcccacctatgactggacctgcttcagccacagcctgctgaatgtgagccccatgcctgtggagagcagcccccccctgccctgccccaccccctgccacctgctgcccaactgcaccagctgcctggacagcaaaggagcagatggcggctggcagcactgtgtgtggagcagcagcctgcagcagtgcctgagccccagctacctgcccctgcgctgcatggccggcggctgcggccgcctgctgcggggccctgagagctgcagcctgggctgtgcccaggccacccagtgtgccctgtgcctgcggcggccccactgcggctggtgtgcctggggcggccaggacggcggcggccgctgcatggagggcggcctgagcggccccagagatggcctgacctgtggccggcctggggcctcctgggccttcctgagctgccccccagaagatgaatgtgccaacggccaccacgactgcaatgagacccagaactgccacgaccagccccacggctatgaatgtagctgcaagacaggctacaccatggacaacatgacaggcctgtgcaggcctgtgtgtgcccagggctgtgtgaatggcagctgtgtggagccagaccactgccgctgccacttcggctttgtgggcaggaactgcagcacagagtgccgctgcaacagacattctgaatgtgccggcgtgggcgcccgggaccactgcctgctgtgcaggaaccacaccaagggcagccactgtgagcagtgcctgcccctgtttgtgggcagcgctgtgggcggcggcacctgccggccctgccacgccttctgccggggcaacagccacatctgcatcagcaggaaggagctgcagatgagcaaaggagagcccaagaagtacagcctggaccctgaggagattgagaactgggtgacagagggccccagtgaagatgaagctgtgtgtgtgaactgccagaacaacagctatggagagaagtgtgagagctgcctgcagggctacttcctgctggatggcaagtgcaccaagtgccagtgcaatggacatgctgacacctgcaatgagcaggacggcaccggctgcccctgccagaacaacacagaaacaggcacctgccagggcagcagccccagcgaccggcgggactgctacaagtaccagtgtgccaagtgccgggagagcttccacggcagccccctgggcggccagcagtgctaccgcctcatctctgtggagcaggagtgctgcctggaccccaccagccagaccaactgcttccacgagcccaagagaagagccctgggccctggccgcacagtgctgtttggagtgcagcccaagttcaccaacgtggacatccggctgaccctggatgtgacctttggagctgtggacctgtatgtgtccaccagctatgacacctttgtggtgcgggtggccccagacacaggagtgcacacagtgcacatccagcccccaccagcccctcctcctcctcctcctccagcagatggcggccccaggggggccggggaccctggaggagctggggccagcagcggccctggggccccagctgagccccgggtgcgggaggtgtggccccggggcctcatcacctacgtgacagtgacagagcccagcgctgtgctggtggtgcggggcgtgcgggaccggctggtgatcacctacccccatgagcaccacgccctgaagagcagccgcttctacctgctgctgctgggcgtgggggaccccagcggccctggggccaacggcagcgctgacagccagggcctgctcttcttccggcaggaccaggcccacatcgacctgtttgtgttcttctctgtgttcttcagctgcttcttcctgttcctgagcctgtgtgtgctgctgtggaaggccaagcaggccctggaccagaggcaggagcagaggaggcacctgcaggagatgaccaagatggccagccggccctttgccaaggtgacagtgtgcttccccccagaccccacagccccagccagcgcctggaagccagctggcctgcccccaccagccttccgccgctctgagcccttcctggcccccctgctgctgaccggggccggcggcccctggggccccatgggcggcggctgctgccccccagccatcccagccaccacagctggcctgcgggccggccccatcaccctggagcccacagaagatggcatggccggcgtggccaccctgctgctgcagctgcccggcggcccccacgccccaaatggagcctgcctgggcagcgccctggtgaccctgcggcaccggctgcacgagtactgcggcggcggcggcggggccggcggcagcggccatggaactggagctggcaggaagggcctgctgagccaggacaacctgacctccatgagcctgtag

SEQ ID NO: 160380 - DNA, 8337 bp, Artificial Sequence
  Description of Artificial Sequence: Synthetic coding sequence
atggccctgggcaaggtgctggccatggccctggtgctggccctggccgtgctgggcagcctgagccctggggcccgggccggggactgcaagggccagaggcaggtgctgcgggaggcccctggctttgtgacagatggagctggcaactacagcgtgaatggaaactgtgagtggctgattgaggcccccagcccccagcaccgcatcctgctggacttcctgttcctggacacagagtgcacctatgactacctgtttgtgtatgatggagacagcccccggggccccctgctggccagcctgagcggcagcacccggcccccacccatcgaggccagcagcggcaagatgctgctgcacctgttcagtgatgccaactacaacctgctgggcttcaatgccagcttccgcttcagcctgtgccctgggggctgccagagccacggccagtgccagcccccaggagtgtgtgcctgtgagcccggctggggcggccctgactgtggcctgcaggagtgcagcgcctactgcggcagccacggcacctgtgccagccccctgggcccctgccgctgtgagcccggcttcctgggccgggcctgtgacctgcacctgtgggagaaccagggcgccggctggtggcacaacgtgtctgcccgggaccctgccttcagcgccagaattggagctgctggggccttcctgagccccccaggcctgctggccgtgtttggaggccaggacctgaacaatgccctgggggacctggtgctgtacaacttcagcgccaacacctgggagagctgggacctgagccctgccccagctgcccggcacagccacgtggccgtggcctgggccggcagcctggtgctgatgggcggggagctggctgatggcagcctgaccaatgatgtgtgggccttcagccccctgggccggggccactgggagctgctggcccccccagccagcagcagcagcggccccccaggcctggccggccacgccgccgccctggtggatgatgtgtggctgtatgtgtctgggggccgcacccctcatgacctcttcagcagcggcctcttccgcttccggctggacagcaccagcggcggctactgggagcaggtgatcccagctgggggccggcccccagctgccaccggccacagcatggtgttccacgcccccagccgggccctgctggtgcacggcggccaccggcccagcacagcccgcttctctgtgcgggtgaacagcacagagctgttccacgtggacagacatgtgtggaccaccctgaagggcagagatggcctgcagggcccccgggagcgggccttccacacagcctctgtgctgggcaactacatggtggtgtatggaggaaatgtgcacacccactaccaggaggagaagtgctatgaagatggcatcttcttctaccacctgggctgccaccagtgggtgtctggagctgagctggcccctcctggcaccccagagggccgggccgcccctccttctggccgctacagccacgtggccgctgtgctgggcggctctgtgctgctggtggccggcggctacagcggccggcccaggggggacctgatggcctacaaggtgcccccatttgtgttccaggccccagccccagactaccacctggactactgcagcatgtacacagaccacagcgtgtgcagccgggaccctgagtgctcctggtgccagggcgcctgccaggccgcccctcctcctggcacccccctgggcgcctgcccagctgccagctgcctgggcctgggccgcctgctgggggactgccaggcctgcctggccttcagcagccccacagccccaccccggggccctggcaccctgggctggtgtgtgcacaatgaaagctgcctgcccaggcctgagcaggcccgctgccgcggggagcagatctctggaacagtgggctggtggggccctgcccctgtgtttgtgaccagcctggaggcctgtgtgacccagagcttcctgcccggcctgcacctgctgaccttccagcagccccccaacaccagccagcctgacaaggaggaggtgggccgctgggtggcccaccaggagaaggagacccggcggctgcagaggcctggcagcgcccggctcttccccctgcccggccgggaccacaagtatgctgtggagatccagggccagctgaatggatctgctggccctggccacagcgagctgaccctgctgtgggacagaactggagtgcctgggggcagcgagatctccttcttcttcctggagccctaccgcagcagcagctgcaccagctacagcagctgcctgggctgcctggccgaccagggctgcggctggtgcctgaccagcgccacctgccacctgcggcagggcggggcccactgtggagatgatggagctgggggcagcctgctggtgctggtgcccaccctgtgccccctgtgtgaggagcaccgggactgccacgcctgcacccaggaccccttctgtgagtggcaccagagcaccagcaggaaaggagatgctgcctgcagcagaagaggccggggccgcggggccctgaagagccctgaggagtgcccccccctgtgcagccagaggctgacctgtgaggactgcctggccaacagcagccagtgtgcctggtgccagagcacccacacctgcttcctgtttgctgcctacctggcccgctacccccacggcggctgccggggctgggatgattctgtgcacagcgagccccgctgccgcagctgtgatggcttcctgacctgccatgaatgtctgcagagccatgaatgtggctggtgtggaaatgaagacaaccccaccctgggccgctgcctgcagggcgacttcagcggccccctgggcggcggcaactgcagcctgtgggtgggggagggcctgggcctgcctgtggccctgcctgcccgctgggcctatgcccgctgcccagatgtggatgagtgccgcctgggcctggcccgctgccacccccgggccacctgcctgaacacccccctgtcctatgagtgccactgccagaggggctaccagggagatggcatcagccactgcaacagaacctgcctggaggactgtggccatggagtgtgcagcggccccccagacttcacctgtgtgtgtgacctgggctggaccagtgacctgcccccacccaccccagcccctggccccccagccccccgctgcagccgggactgtggctgcagcttccacagccactgcaggaagaggggccctggcttctgtgatgagtgccaggactggacctggggcgagcactgtgagcgctgcaggcctggcagctttggaaatgccaccggcagccggggctgccggccctgccagtgcaatggacatggagacccccggcggggccactgtgacaacctgagcggcctgtgcttctgccaggaccacacagagggcgcccactgccagctgtgcagccctggctactatggagacccccgggccggcggcagctgcttcagagaatgtggcggccgggccctgctgaccaacgtgtcctctgtggccctgggcagcagaagagtgggcggcctgctgcccccaggcggcggggccgcccgggccggccctggcctgagctactgtgtgtgggtggtgtctgccacagaggagctgcagccctgtgcccctggcaccctgtgcccccccctgaccctgaccttctccccagacagcagcaccccctgcaccctgtcctatgtgctggcctttgatggcttcccccgcttcctggacaccggggtggtgcagagcgacaggagcctgattgctgccttctgtggccagaggcgggaccggcccctgactgtgcaggccctgagcggcctgctggtgctgcactgggaggccaacggcagcagctcctggggcttcaatgcctctgtgggcagcgcccgctgtggcagcggcggccctggcagctgccctgtgccccaggagtgtgtgccccaggatggagctgctggagctggcctgtgccgctgcccccagggctgggccggcccccactgcaggatggccctgtgcccagagaactgcaatgcccacactggagctggcacctgcaaccagagcctgggcgtgtgcatctgtgccgagggctttggaggccctgactgtgccaccaagctggatggcggccagctggtgtgggagaccctgatggacagccggctgtctgctgacacagccagccgcttcctgcaccggctgggccacaccatggtggatggcccagatgccaccctgtggatgtttggaggcctgggcctgccccagggcctgctgggcaacctgtaccgctacagcgtgtctgagcggcgctggacccagatgctggccggggctgaagatggcggccctggccccagccccaggagcttccacgccgccgcctacgtgcctgctggccgcggggccatgtacctgctgggcggcctgacagctgggggcgtgacccgggacttctgggtgctgaacctgaccaccctgcagtggaggcaggagaaggccccccagacagtggagctgcctgctgtggccggccacaccctgacagcccggcggggcctgagcctgctgctggtgggcggctacagcccagaaaatggcttcaaccagcagctgctggagtaccagctggccaccggcacctgggtgtctggggcccagagcggcaccccacccaccggcctgtatggccacagcgctgtgtaccacgaggccacagacagcctgtatgtgtttggaggcttccgcttccacgtggagctggccgcccccagccctgagctgtacagcctgcactgcccagacaggacctggagcctgctggcccccagccagggcgccaagagggacaggatgagaaatgtgcggggcagcagccggggcctgggccaggtgcctggagagcagcccggctcctggggcttccgggaggtgaggaagaagatggccctgtgggccgccctggccggcactggaggcttcctggaggagatcagcccccacctgaaggagccccggcccaggctcttccacgccagcgccctgctgggggacaccatggtggtgctgggcggccgcagtgaccctgatgagttcagcagtgatgtgctgctgtaccaggtgaactgcaatgcctggctgctgcctgacctgaccaggtctgcctctgtgggcccccccatggaggagagcgtggcccatgctgtggccgctgtgggcagccggctgtacatcagcggcggctttggaggagtggccctgggccgcctgctggccctgaccctgcccccagacccctgccgcctgctgagcagccctgaggcctgcaaccagagcggggcctgcacctggtgccacggggcctgcctgagcggggaccaggcccaccggctgggctgcggcggcagcccctgcagccccatgcccaggagcccagaagaatgtagaaggctgcggacctgcagcgagtgcctggcccggcaccccaggaccctgcagcctggagatggagaggccagcaccccccgctgcaagtggtgcaccaactgcccagagggcgcctgcattggaagaaatggcagctgcaccagtgaaaatgactgccgcatcaaccagcgggaggtgttctgggccggcaactgcagcgaggccgcctgtggggctgctgactgtgagcagtgcacccgggagggcaagtgcatgtggacccggcagttcaagaggactggagagacccggcgcatcctgtctgtgcagcccacctatgactggacctgcttcagccacagcctgctgaatgtgagccccatgcctgtggagagcagcccccccctgccctgccccaccccctgccacctgctgcccaactgcaccagctgcctggacagcaaaggagcagatggcggctggcagcactgtgtgtggagcagcagcctgcagcagtgcctgagccccagctacctgcccctgcgctgcatggccggcggctgcggccgcctgctgcggggccctgagagctgcagcctgggctgtgcccaggccacccagtgtgccctgtgcctgcggcggccccactgcggctggtgtgcctggggcggccaggacggcggcggccgctgcatggagggcggcctgagcggccccagagatggcctgacctgtggccggcctggggcctcctgggccttcctgagctgccccccagaagatgaatgtgccaacggccaccacgactgcaatgagacccagaactgccacgaccagccccacggctatgagtgcagctgcaagacaggctacaccatggacaacatgacaggcctgtgcaggcctgtgtgtgcccagggctgtgtgaatggcagctgtgtggagccagaccactgccgctgccactttggatttgtgggcaggaactgcagcacagaatgtcgctgcaacagacacagtgaatgtgccggcgtgggcgcccgggaccactgcctgctgtgcaggaaccacaccaagggcagccactgtgagcagtgcctgcccctgtttgtgggcagcgctgtgggcggcggcacctgccggccctgccacgccttctgccggggcaacagccacatctgcatcagcaggaaggagctgcagatgagcaagggggagcccaagaagtacagcctggaccctgaggagattgagaactgggtgacagagggccccagtgaagatgaggccgtgtgtgtgaactgccagaacaacagctatggagagaagtgtgagagctgcctgcagggctacttcctgctggatggcaagtgcaccaagtgccagtgcaatggacatgctgacacctgcaatgagcaggacggcaccggctgcccctgccagaacaacacagagaccggcacctgccagggcagcagccccagcgacagaagagactgctacaagtaccagtgtgccaagtgccgggagagcttccacggcagccccctgggcggccagcagtgctaccgcctcatctctgtggagcaggagtgctgcctggaccccaccagccagaccaactgcttccacgagcccaagaggcgggccctgggccctggccgcacagtgctgtttggagtgcagcccaagttcaccaacgtggacatccggctgaccctggatgtgaccttcggggctgtggacctgtatgtgtccaccagctatgacacctttgtggtgcgggtggccccagacaccggggtgcacacagtgcacatccagcccccaccagcccctcctcctcctcctcctccagcagatggcggccccagaggagctggggaccccggcggggccggggccagcagcggccctggggccccagctgagccccgggtgcgggaggtgtggccccggggcctcatcacctacgtgacagtgacagagcccagcgctgtgctggtggtgcggggcgtgcgggaccggctggtgatcacctacccccatgagcaccacgccctgaagagcagccgcttctacctgctgctgctgggcgtgggggaccccagcggccctggggccaatggatctgctgacagccagggcctgctcttcttccggcaggaccaggcccacatcgacctgtttgtgttcttcagcgtcttcttcagctgcttcttcctgttcctgagcctgtgtgtgctgctgtggaaggccaagcaggccctggaccagaggcaggagcagaggaggcacctgcaggagatgaccaagatggccagccggccctttgccaaggtgacagtgtgcttccccccagaccccacagccccagccagcgcctggaagccagctggcctgcccccaccagccttcagaagaagtgagcccttcctggcccccctgctgctgactggagctgggggcccctggggccccatgggcggcggctgctgccccccagccatcccagccaccacagctggcctgcgggccggccccatcaccctggagcccacagaagatggcatggccggcgtggccaccctgctgctgcagctgcccggcggcccccacgcccccaacggggcctgcctgggcagcgccctggtgaccctgcggcaccggctgcacgagtactgcggcggcggcggcggggccggcggcagcggccacggcaccggggccggcaggaagggcctgctgagccaggacaacctgacctccatgagcctgtag

SEQ ID NO: 160381 - DNA, 1320 bp, Artificial Sequence
  Description of Artificial Sequence: Synthetic coding sequence
atgagggagctgcctgctggcctgctgcccccaggccgggaggtgcaccagtgtgccaagtgccgggagagcttccacggcagccccctgggcggccagcagtgctaccgcctcatctctgtggagcaggagtgctgcctggaccccaccagccagaccaactgcttccacgagcccaagagaagagccctgggccctggccgcacagtgctgtttggagtgcagcccaagttcaccaacgtggacatccggctgaccctggatgtgacctttggagctgtggacctgtatgtgtccaccagctatgacacctttgtggtgcgggtggccccagacacaggagtgcacacagtgcacatccagcccccaccagcccctcctcctcctcctcctccagcagatggcggccccaggggggccggggaccctggaggagctggggccagcagcggccctggggccccagctgagccccgggtgcgggaggtgtggccccggggcctcatcacctacgtgacagtgacagagcccagcgctgtgctggtggtgcggggcgtgcgggaccggctggtgatcacctacccccatgagcaccacgccctgaagagcagccgcttctacctgctgctgctgggcgtgggggaccccagcggccctggggccaacggcagcgctgacagccagggcctgctcttcttccggcaggaccaggcccacatcgacctgtttgtgttcttctctgtgttcttcagctgcttcttcctgttcctgagcctgtgtgtgctgctgtggaaggccaagcaggccctggaccagaggcaggagcagaggaggcacctgcaggagatgaccaagatggccagccggccctttgccaaggtgacagtgtgcttccccccagaccccacagccccagccagcgcctggaagccagctggcctgcccccaccagccttccgccgctctgagcccttcctggcccccctgctgctgaccggggccggcggcccctggggccccatgggcggcggctgctgccccccagccatcccagccaccacagctggcctgcgggccggccccatcaccctggagcccacagaagatggcatggccggcgtggccaccctgctgctgcagctgcccggcggcccccacgccccaaatggagcctgcctgggcagcgccctggtgaccctgcggcaccggctgcacgagtactgcggcggcggcggcggggccggcggcagcggccatggaactggagctggcaggaagggcctgctgagccaggacaacctgacctccatgagcctgtag

SEQ ID NO: 160382 - DNA, 1809 bp, Artificial Sequence
  Description of Artificial Sequence: Synthetic coding sequence
atgaatggaggagctgagcgggccatgaggagcctgcccagcctgggcggcctggccctgctgtgctgtgccgctgctgctgctgctgctgctgtggccagcgctgccagcgctggaaatgtgactggaggcggcggggccgccggccaggtggatgccagccctggccctggcctgcggggggagcccagccaccccttcccccgggccacagcccccacagcccaggcccccaggacaggccccccccgggccaccgtgcaccggcccctggccgccaccagccctgcccagagccctgagaccacccccctgtgggccacagctggccccagcagcaccaccttccaggcccccctgggccccagccccaccaccccacctgctgctgagaggaccagcaccaccagccaggcccccaccaggcctgcccccaccaccctgagcaccaccaccggccctgcccccaccacccctgtggccaccaccgtgcctgcccccaccacccccaggacccccaccccagacctgcccagcagcagcaacagctctgtgctgcccaccccaccagccacagaggcccccagcagccccccaccagaatatgtgtgcaactgcagcgtggtgggcagcctgaatgtgaaccgctgcaaccagaccaccggccagtgtgaatgtcggcccggctaccagggcctgcactgtgagacctgcaaggagggcttctacctgaactacaccagcggcctgtgccagccctgtgactgcagcccccatggagccctgagcatcccctgcaacagcagcggcaagtgccagtgcaaggtgggcgtgattggcagcatctgtgaccgctgccaggacggctactacggcttcagcaagaatggctgcctgccctgccagtgcaacaacagaagtgccagctgtgatgccctgaccggggcctgcctgaactgccaggagaacagcaaaggaaaccactgtgaggagtgcaaggagggcttctaccagagcccagatgccaccaaggaatgtctgcgctgcccctgcagcgctgtgaccagcacaggcagctgcagcatcaagagcagcgagctggagccagaatgtgaccagtgcaaggatggctacatcggccccaactgcaacaagtgtgaaaatggctactacaactttgacagcatctgcaggaagtgccagtgccacggccacgtggaccctgtgaagacccccaagatctgcaagccagagagcggggagtgcatcaactgcctgcacaacaccaccggcttctggtgtgagaactgcctggagggctacgtgcatgacctggagggcaactgcatcaagaaggaggtgatcctgcccaccccagagggcagcaccatcctggtgtccaatgccagcctgaccacctctgtgcccacccctgtgatcaacagcaccttcacccccaccaccctgcagaccatcttctctgtgtccaccagcgagaacagcaccagcgccctggctgatgtgtcctggacccagttcaacatcatcatcctgaccgtcatcatcatcgtggtggtgctgctgatgggctttgtgggcgctgtgtacatgtaccgggagtaccagaacaggaagctgaatgcccccttctggaccatcgagctgaaggaggacaacatctccttcagcagctaccatgacagcatccccaatgctgatgtgtctggcctgctggaggatgatggaaatgaggtggcccccaacggccagctgaccctgaccacccccatccacaactacaaggcctag

SEQ ID NO: 160383 - DNA, 1920 bp, Artificial Sequence
  Description of Artificial Sequence: Synthetic coding sequence
atgaggagcctgcccagcctgggcggcctggccctgctgtgctgtgccgctgctgctgctgctgctgctgtggccagcgctgccagcgctggaaatgtgactggaggcggcggggccgccggccaggtggatgccagccctggccctggcctgcggggggagcccagccaccccttcccccgggccacagcccccacagcccaggcccccaggacaggccccccccgggccaccgtgcaccggcccctggccgccaccagccctgcccagagccctgagaccacccccctgtgggccacagctggccccagcagcaccaccttccaggcccccctgggccccagccccaccaccccacctgctgctgagaggaccagcaccaccagccaggcccccaccaggcctgcccccaccaccctgagcaccaccaccggccctgcccccaccacccctgtggccaccaccgtgcctgcccccaccacccccaggacccccaccccagacctgcccagcagcagcaacagctctgtgctgcccaccccaccagccacagaggcccccagcagccccccacctggccaccagtggcctgtggccaagatgccccagaagtacctgggcaagtatgcctgtgagagcaacctgaagagcaagtacctgcccctgacccagcctgtgatgaacctgcgggtgtctgaggccgtgaagacagaatatgtgtgcaactgcagcgtggtgggcagcctgaatgtgaaccgctgcaaccagaccaccggccagtgtgagtgcaggcctggctaccagggcctgcactgtgagacctgcaaggagggcttctacctgaactacaccagcggcctgtgccagccctgtgactgcagcccccacggggccctgagcatcccctgcaacagcagcggcaagtgccagtgcaaggtgggcgtcatcggcagcatctgtgaccgctgccaggacggctactacggcttcagcaagaatggctgcctgccctgccagtgcaacaacagaagtgccagctgtgatgccctgactggagcctgcctgaactgccaggagaacagcaagggcaaccactgtgaggagtgcaaggagggcttctaccagagcccagatgccaccaaggagtgcctgcgctgcccctgcagcgctgtgaccagcacaggcagctgcagcatcaagagcagcgagctggagccagaatgtgaccagtgcaaggatggctacatcggccccaactgcaacaagtgtgaaaatggctactacaactttgacagcatctgcaggaagtgccagtgccacggccacgtggaccctgtgaagacccccaagatctgcaagccagagagcggggagtgcatcaactgcctgcacaacaccaccggcttctggtgtgagaactgcctggagggctacgtgcatgacctggagggcaactgcatcaagaaggaggtgatcctgcccaccccagagggcagcaccatcctggtgtccaatgccagcctgaccacctctgtgcccacccctgtgatcaacagcaccttcacccccaccaccctgcagaccatcttctctgtgtccaccagcgagaacagcaccagcgccctggctgatgtgtcctggacccagttcaacatcatcatcctgaccgtcatcatcatcgtggtggtgctgctgatgggctttgtgggcgctgtgtacatgtaccgggagtaccagaacaggaagctgaatgcccccttctggaccatcgagctgaaggaggacaacatctccttcagcagctaccatgacagcatccccaatgctgatgtgtctggcctgctggaggatgatggaaatgaggtggccccaaatggccagctgaccctgaccacccccatccacaactacaaggcctag

SEQ ID NO: 160384 - DNA, 939 bp, Artificial Sequence
  Description of Artificial Sequence: Synthetic coding sequence
atgctgcgggcccctggctgcctgctgcggacctctgtggccccagctgctgccctggccgccgccctgctgagcagcctggcccgctgcagcctgctggagccccgggaccctgtggccagcagcctgagcccctacttcggcaccaagaccaggtatgaagatgtgaaccctgtgctgctgagcggccctgaggccccctggagggaccctgagctgctggagggcacctgcacccctgtgcagctggtggccctgatcagacatggcacccgctaccccaccgtgaagcagatcaggaagctgcggcagctgcacggcctgctgcaggcccggggcagcagagatggaggagccagcagcacaggcagccgggacctgggcgccgccctggccgactggcccctgtggtatgctgactggatggatggccagctggtggagaagggccggcaggacatgaggcagctggccctgcggctggccagcctcttccctgccctcttcagccgggagaactacggccgcctgcggctcatcaccagcagcaagcaccgctgcatggacagcagcgctgccttcctgcagggcctgtggcagcactaccaccctggcctgcccccaccagatgtggccgacatggagtttggcccccccaccgtgaatgacaagctgatgaggttctttgaccactgtgagaagttcctgacagaggtggagaagaatgccacagccctgtaccacgtggaggccttcaagacaggccctgagatgcagaacatcctgaagaaggtggccgccaccctgcaggtgcctgtgaatgacctgaatgccggcctgagccagttcctgctgcagagcagcagcagcctggtgatgcagaggctcttcttccactgcttcctgtcctgggccaccagcaagaccaggaacccctag

SEQ ID NO: 160385 - DNA, 1464 bp, Artificial Sequence
  Description of Artificial Sequence: Synthetic coding sequence
atgctgcgggcccctggctgcctgctgcggacctctgtggccccagctgctgccctggccgccgccctgctgagcagcctggcccgctgcagcctgctggagccccgggaccctgtggccagcagcctgagcccctacttcggcaccaagaccaggtatgaagatgtgaaccctgtgctgctgagcggccctgaggccccctggagggaccctgagctgctggagggcacctgcacccctgtgcagctggtggccctgatcagacatggcacccgctaccccaccgtgaagcagatcaggaagctgcggcagctgcacggcctgctgcaggcccggggcagcagagatggaggagccagcagcacaggcagccgggacctgggcgccgccctggccgactggcccctgtggtatgctgactggatggatggccagctggtggagaagggccggcaggacatgaggcagctggccctgcggctggccagcctcttccctgccctcttcagccgggagaactacggccgcctgcggctcatcaccagcagcaagcaccgctgcatggacagcagcgctgccttcctgcagggcctgtggcagcactaccaccctggcctgcccccaccagatgtggccgacatggagtttggcccccccaccgtgaatgacaagctgatgaggttctttgaccactgtgagaagttcctgacagaggtggagaagaatgccacagccctgtaccacgtggaggccttcaagacaggccctgagatgcagaacatcctgaagaaggtggccgccaccctgcaggtgcctgtgaatgacctgaatgctgacctgatccaggtggccttcttcacctgcagctttgacctggccatcaagggcgtgaagagcccctggtgtgatgtgtttgatattgatgatgccaaggtgctggagtacctgaatgacctgaagcagtactggaagaggggctacggctacaccatcaacagccgcagcagctgcaccctcttccaggacatcttccagcacctggacaaggctgtggagcagaagcagaggagccagcccatcagcagccctgtgatcctgcagtttggacatgctgagaccctgctgcccctgctgagcctgatgggctacttcaaggacaaggagcccctgacagcctacaactacaagaagcagatgcacaggaagttccgcagcggcctcatcgtgccctatgccagcaacctgatctttgtgctgtaccactgtgaaaatgccaagacccccaaggagcagttccgggtgcagatgctgctgaatgagaaggtgctgcccctggcctacagccaggagaccgtgtccttctatgaggacctgaagaaccactacaaggacatcctgcagagctgccagaccagcgaggagtgtgagctggcccgggccaacagcaccagtgatgagctgtag

SEQ ID NO: 160386 - DNA, 861 bp, Artificial Sequence
  Description of Artificial Sequence: Synthetic coding sequence
atgtgcctcttccagctgtgtggcctggtgcgctacatggagtttggaccacccaccgtgaatgacaagctgatgaggttctttgaccactgtgagaagttcctgacagaggtggagaagaatgccacagccctgtaccacgtggaggccttcaagacaggccctgagatgcagaacatcctgaagaaggtggccgccaccctgcaggtgcctgtgaatgacctgaatgctgacctgatccaggtggccttcttcacctgcagctttgacctggccatcaagggcgtgaagagcccctggtgtgatgtgtttgatattgatgatgccaaggtgctggagtacctgaatgacctgaagcagtactggaagaggggctacggctacaccatcaacagccgcagcagctgcaccctcttccaggacatcttccagcacctggacaaggctgtggagcagaagcagaggagccagcccatcagcagccctgtgatcctgcagtttggacatgctgagaccctgctgcccctgctgagcctgatgggctacttcaaggacaaggagcccctgacagcctacaactacaagaagcagatgcacaggaagttccgcagcggcctgattgtgccctatgccagcaacctgatctttgtgctgtaccactgtgaaaatgccaagacccccaaggagcagttccgggtgcagatgctgctgaatgagaaggtgctgcccctggcctacagccaggagaccgtgtccttctatgaggacctgaagaaccactacaaggacatcctgcagagctgccagaccagtgaagaatgtgagctggcccgggccaacagcaccagtgatgagctgtag

SEQ ID NO: 160387 - DNA, 1041 bp, Artificial Sequence
  Description of Artificial Sequence: Synthetic coding sequence
atggatggccagctggtggagaagggccggcaggacatgaggcagctggccctgcggctggccagcctcttccctgccctcttcagcagagaaaattatggccgcctgcggctcatcaccagcagcaagcaccgctgcatggacagcagcgctgccttcctgcagggcctgtggcagcactaccaccctggcctgcccccaccagatgtggccgacatggagtttggaccacccaccgtgaatgacaagctgatgaggttctttgaccactgtgagaagttcctgacagaggtggagaagaatgccacagccctgtaccacgtggaggccttcaagacaggccctgagatgcagaacatcctgaagaaggtggccgccaccctgcaggtgcctgtgaatgacctgaatgctgacctgatccaggtggccttcttcacctgcagctttgacctggccatcaagggcgtgaagagcccctggtgtgatgtgtttgatattgatgatgccaaggtgctggagtacctgaatgacctgaagcagtactggaagaggggctacggctacaccatcaacagccgcagcagctgcaccctcttccaggacatcttccagcacctggacaaggctgtggagcagaagcagaggagccagcccatcagcagccctgtgatcctgcagtttggacatgctgagaccctgctgcccctgctgagcctgatgggctacttcaaggacaaggagcccctgacagcctacaactacaagaagcagatgcacaggaagttccgcagcggcctgattgtgccctatgccagcaacctgatctttgtgctgtaccactgtgaaaatgccaagacccccaaggagcagttccgggtgcagatgctgctgaatgagaaggtgctgcccctggcctacagccaggagaccgtgtccttctatgaggacctgaagaaccactacaaggacatcctgcagagctgccagaccagtgaagaatgtgagctggcccgggccaacagcaccagtgatgagctgtag

SEQ ID NO: 160388 - DNA, 6213 bp, Artificial Sequence
  Description of Artificial Sequence: Synthetic coding sequence
atgctggaggccatcgacaagaacagagccctgcatgctgctgagcggctgcagaccaagctgcgggagagaggagatgtggccaatgaagacaagctgagcctgctgaagtctgtgctgcagagccccctcttcagccagatcctgagcctgcagacctctgtgcagcagctgaaggaccaggtgaacatcgccaccagcgccaccagcaacatcgagtatgcccacgtgccccacctgagccctgctgtgatccccaccctgcagaatgaaagcttcctgctgagccccaacaatggaaacctggaggccctgaccggccctggcatcccccacatcaacgggaagccagcctgtgatgaatttgaccagctgatcaagaacatggcccagggccgccacgtggaggtgtttgagctgctgaagcccccatctgggggcctgggcttctctgtggtgggcctgcggtctgagaacagaggagagctgggcatctttgtgcaggagatccaggagggctctgtggcccacagagatggccgcctgaaggagacagaccagatcctggccatcaatggccaggccctggaccagaccatcacccaccagcaggccatcagcatcctgcagaaggccaaggacacagtgcagctggtgattgcccggggcagcctgccccagctggtgagccccatcgtgagccgcagccccagcgctgccagcaccatcagcgcccacagcaaccctgtgcactggcagcacatggagaccatcgagctggtgaatgatggcagcggcctgggcttcggcatcatcggcggcaaggccactggagtcatcgtgaagaccatcctgcccggcggcgtggccgaccagcacggccgcctgtgcagcggggaccacatcctgaagattggagacacagacctggccggcatgagcagcgagcaggtggcccaggtgctgcggcagtgtggcaacagagtgaagctgatgattgcccggggggccatcgaggagaggacagcccccacagccctgggcatcaccctgagcagcagccccaccagcaccccagagctgcgggtggatgccagcacccagaagggggaggagagcgagacctttgatgtggagctgaccaagaatgtgcagggcctgggcatcaccatcgccggctacatcggggacaagaagctggagcccagcggcatctttgtgaagagcatcaccaagagcagcgctgtggagcatgatggccgcatccagatcggggaccagatcatcgctgtggatggcaccaacctgcagggcttcaccaaccagcaggccgtggaggtgctgcggcacacaggccagacagtgctgctgaccctgatgagaagaggcatgaagcaggaggccgagctgatgagccgggaggatgtgaccaaggatgctgacctgagccctgtgaatgccagcatcatcaaggagaactatgagaaggatgaggacttcctgagcagcaccaggaacaccaacatcctgcccacagaggaggagggctaccccctgctgtctgctgagattgaggagattgaagatgcccagaagcaggaggccgccctgctgaccaagtggcagaggatcatgggcatcaactatgaaattgtggtggcccacgtgtccaagttctctgaaaattctggcctgggcatcagcctggaggccaccgtgggccaccacttcatccgctctgtgctgcctgagggccctgtgggccacagcggcaagctgttctctggagatgagctgctggaggtgaatggcatcaccctgctgggggagaaccaccaggatgtggtgaacatcctgaaggagctgcccatcgaggtgaccatggtgtgctgcagaagaacagtgccccccaccacccagagcgagctggacagcctggacctgtgtgacatcgagctgacagagaagccccacgtggacctgggggagttcatcggcagcagcgagacagaagatcctgtgctggccatgacagatgctggccagagcacagaggaggtgcaggcccccctggccatgtgggaggccggcatccagcacatcgagctggagaagggcagcaagggcctgggcttcagcatcctggactaccaggaccccattgatcctgccagcaccgtcatcatcatccgcagcctggtgcctgggggcattgctgagaaggatggccgcctgctgcccggggaccggctgatgtttgtgaatgatgtgaacctggagaacagcagcctggaggaggccgtggaggccctgaagggggcccccagcggcaccgtgagaattggagtggccaagcccctgcccctgagccctgaggagggctacgtgtctgccaaggaggacagcttcctgtacccaccccacagctgtgaggaggccggcctggccgacaagcccctcttccgggctgacctggccctggtgggcaccaatgatgctgacctggtggatgagagcacctttgagagcccctacagcccagaaaatgacagcatctacagcacccaggccagcatcctgagcctgcacggcagcagctgtggagatggcctgaactacggcagcagcctgcccagcagcccccccaaggatgtgattgagaacagctgtgaccctgtgctggacctgcacatgagcctggaggagctgtacacccagaacctgctgcagaggcaggatgagaacacccccagcgtggacatctccatgggccctgccagcggcttcaccatcaatgactacaccccagccaatgccatcgagcagcagtatgaatgtgagaacaccatcgtgtggacagagagccacctgcccagcgaggtgatcagcagcgctgagctgcccagcgtgctgcctgacagcgctggaaaaggaagtgagtacctgctggagcagagcagcctggcctgcaatgcagaatgtgtgatgctgcagaatgtgtccaaggagagctttgagaggaccatcaacatcgccaagggcaacagcagcctgggcatgacagtgtctgccaacaaggatggcctgggcatgattgtgcgcagcatcatccacggcggggccatcagcagagatggccgcatcgccatcggggactgcatcctgagcatcaatgaggagagcaccatctctgtgaccaatgcccaggcccgggccatgctgcggcggcacagcctcatcggccctgacatcaagatcacctacgtgcctgctgagcacctggaggagttcaagatcagcctgggccagcagagcggccgggtgatggccctggacatcttcagcagctacacaggccgggacatccctgagctgcctgagcgggaggagggggagggggaggagagcgagctgcagaacacagcctacagcaactggaaccagccccggcgggtggagctgtggagggagcccagcaagagcctgggcatcagcatcgtgggcggccggggcatgggcagccggctgagcaatggagaggtgatgaggggcatcttcatcaagcacgtgctggaggacagccctgctgggaagaatggcaccctgaagccaggggaccgcatcgtggaggtggatggcatggacctgagagatgccagccatgagcaggccgtggaggccatcaggaaggccggcaaccctgtggtgttcatggtgcagagcatcatcaaccggcccaggaagagccccctgcccagcctgctgcacaacctgtaccccaagtacaacttcagcagcaccaacccctttgctgacagcctgcagatcaatgctgacaaggcccccagccagagcgagagcgagcctgagaaggcccccctgtgcagcgtgcccccacctcctccttctgcctttgctgagatgggcagtgaccacacccagagcagcgccagcaagatcagccaggatgtggacaaggaggatgaatttggctacagctggaagaacatccgggagagatatggcaccctgactggagagctgcacatgattgagctggagaagggccacagcggcctgggcctgagcctggccggcaacaaggacaggagcaggatgtctgtgttcatcgtgggcatcgaccccaatggagctgctgggaaggatggccgcctgcagattgctgatgagctgctggagatcaatggccagatcctgtatggccgcagccaccagaatgccagcagcatcatcaagtgtgcccccagcaaggtgaagatcatcttcatccggaacaaggatgctgtgaaccagatggctgtgtgccctggaaatgctgtggagcccctgcccagcaacagcgagaacctgcagaacaaggagacagagcccaccgtgaccaccagtgatgctgctgtggacctgagcagcttcaagaatgtgcagcacctggagctgcccaaggaccagggcggcctgggcatcgccatcagcgaggaggacaccctgagcggggtcatcatcaagagcctgacagagcacggcgtggccgccacagatggccgcctgaaggtgggggaccagatcctggccgtggatgatgagatcgtggtgggctaccccatcgagaagttcatcagcctgctgaagacagccaagatgacagtgaagctgaccatccacgcagaaaatccagacagccaggccgtgcccagcgctgctggggccgccagcggggagaagaagaacagcagccagagcctgatggtgccccagagcggcagccctgagcctgagagcatccggaacaccagccgcagcagcaccccagccatctttgccagtgaccctgccacctgccccatcatccctggctgtgagaccaccatcgagatcagcaagggccgcacaggcctgggcctgagcatcgtgggcggcagtgacaccctgctgggcgccatcatcatccacgaggtgtatgaggagggcgccgcctgcaaggatggccgcctgtgggccggggaccagatcctggaggtgaatggaattgacctgaggaaggccacccatgatgaggccatcaacgtgctgcggcagaccccccagagggtgcggctgaccctgtacagagatgaggccccctacaaggaggaggaggtgtgtgacaccctgaccatcgagctgcagaagaagccaggcaagggcctgggcctgagcatcgtgggcaagagaaatgacacaggagtgtttgtgtctgacatcgtgaagggcggcattgctgatgctgatggccgcctgatgcagggcgaccagatcctgatggtgaatggagaagatgtgagaaatgccacccaggaggccgtggccgccctgctgaagtgcagcctgggcaccgtgaccctggaggtgggccgcatcaaggccggccccttccacagcgagcggcggcccagccagagcagccaggtgtctgagggcagcctgagcagcttcaccttccccctgagcggcagcagcaccagcgagagcctggagagcagcagcaagaagaatgccctggccagcgagatccagggcctgaggacagtggagatgaagaagggccccacagacagcctgggcatcagcattgctgggggcgtgggcagccccctgggagatgtgcccatcttcatcgccatgatgcaccccaccggggtggccgcccagacccagaagctgcgggtgggggacagaattgtgaccatctgtggcaccagcacagagggcatgacccacacccaggccgtgaacctgctgaagaatgccagcggcagcattgagatgcaggtggtggccggaggagatgtgtctgtggtgacaggccaccagcaggagcccgccagcagcagcctgtccttcaccggcctgaccagcagcagcatcttccaggatgacctgggccccccccagtgcaagagcatcaccctggagcggggcccagatggcctgggcttcagcatcgtgggcggctacggcagcccccatggagacctgcccatctacgtgaagacagtgtttgccaagggggccgcctctgaagatggccgcctgaagagaggagaccagatcatcgctgtgaatggccagagcctggagggcgtgacccatgaggaggccgtggccatcctgaagaggaccaagggcaccgtgaccctgatggtgctgtcctag

SEQ ID NO: 160389 - DNA, 6213 bp, Artificial Sequence; identical to SEQ ID NO: 160388
  Description of Artificial Sequence: Synthetic coding sequence

SEQ ID NO: 160390 - DNA, 6126 bp, Artificial Sequence
  Description of Artificial Sequence: Synthetic coding sequence
atgctggaggccatcgacaagaacagagccctgcatgctgctgagcggctgcagaccaagctgcgggagagaggagatgtggccaatgaagacaagctgagcctgctgaagtctgtgctgcagagccccctcttcagccagatcctgagcctgcagacctctgtgcagcagctgaaggaccaggtgaacatcgccaccagcgccaccagcaacatcgagtatgcccacgtgccccacctgagccctgctgtgatccccaccctgcagaatgaaagcttcctgctgagccccaacaatggaaacctggaggccctgaccggccctggcatcccccacatcaacgggaagccagcctgtgatgaatttgaccagctgatcaagaacatggcccagggccgccacgtggaggtgtttgagctgctgaagcccccatctgggggcctgggcttctctgtggtgggcctgcggtctgagaacagaggagagctgggcatctttgtgcaggagatccaggagggctctgtggcccacagagatggccgcctgaaggagacagaccagatcctggccatcaatggccaggccctggaccagaccatcacccaccagcaggccatcagcatcctgcagaaggccaaggacacagtgcagctggtgattgcccggggcagcctgccccagctggtgagccccatcgtgagccgcagccccagcgctgccagcaccatcagcgcccacagcaaccctgtgcactggcagcacatggagaccatcgagctggtgaatgatggcagcggcctgggcttcggcatcatcggcggcaaggccactggagtcatcgtgaagaccatcctgcccggcggcgtggccgaccagcacggccgcctgtgcagcggggaccacatcctgaagattggagacacagacctggccggcatgagcagcgagcaggtggcccaggtgctgcggcagtgtggcaacagagtgaagctgatgattgcccggggggccatcgaggagaggacagcccccacagccctgggcatcaccctgagcagcagccccaccagcaccccagagctgcgggtggatgccagcacccagaagggggaggagagcgagacctttgatgtggagctgaccaagaatgtgcagggcctgggcatcaccatcgccggctacatcggggacaagaagctggagcccagcggcatctttgtgaagagcatcaccaagagcagcgctgtggagcatgatggccgcatccagatcggggaccagatcatcgctgtggatggcaccaacctgcagggcttcaccaaccagcaggccgtggaggtgctgcggcacacaggccagacagtgctgctgaccctgatgagaagaggcatgaagcaggaggccgagctgatgagccgggaggatgtgaccaaggatgctgacctgagccctgtgaatgccagcatcatcaaggagaactatgagaaggatgaggacttcctgagcagcaccaggaacaccaacatcctgcccacagaggaggagggctaccccctgctgtctgctgagattgaggagattgaagatgcccagaagcaggaggccgccctgctgaccaagtggcagaggatcatgggcatcaactatgaaattgtggtggcccacgtgtccaagttctctgaaaattctggcctgggcatcagcctggaggccaccgtgggccaccacttcatccgctctgtgctgcctgagggccctgtgggccacagcggcaagctgttctctggagatgagctgctggaggtgaatggcatcaccctgctgggggagaaccaccaggatgtggtgaacatcctgaaggagctgcccatcgaggtgaccatggtgtgctgcagaagaacagtgccccccaccacccagagcgagctggacagcctggacctgtgtgacatcgagctgacagagaagccccacgtggacctgggggagttcatcggcagcagcgagacagaagatcctgtgctggccatgacagatgctggccagagcacagaggaggtgcaggcccccctggccatgtgggaggccggcatccagcacatcgagctggagaagggcagcaagggcctgggcttcagcatcctggactaccaggaccccattgatcctgccagcaccgtcatcatcatccgcagcctggtgcctgggggcattgctgagaaggatggccgcctgctgcccggggaccggctgatgtttgtgaatgatgtgaacctggagaacagcagcctggaggaggccgtggaggccctgaagggggcccccagcggcaccgtgagaattggagtggccaagcccctgcccctgagccctgaggagggctacgtgtctgccaaggaggacagcttcctgtacccaccccacagctgtgaggaggccggcctggccgacaagcccctcttccgggctgacctggccctggtgggcaccaatgatgctgacctggtggatgagagcacctttgagagcccctacagcccagaaaatgacagcatctacagcacccaggccagcatcctgagcctgcacggcagcagctgtggagatggcctgaactacggcagcagcctgcccagcagcccccccaaggatgtgattgagaacagctgtgaccctgtgctggacctgcacatgagcctggaggagctgtacacccagaacctgctgcagaggcaggatgagaacacccccagcgtggacatctccatgggccctgccagcggcttcaccatcaatgactacaccccagccaatgccatcgagcagcagtatgaatgtgagaacaccatcgtgtggacagagagccacctgcccagcgaggtgatcagcagcgctgagctgcccagcgtgctgcctgacagcgctggaaaaggaagtgagtacctgctggagcagagcagcctggcctgcaatgcagaatgtgtgatgctgcagaatgtgtccaaggagagctttgagaggaccatcaacatcgccaagggcaacagcagcctgggcatgacagtgtctgccaacaaggatggcctgggcatgattgtgcgcagcatcatccacggcggggccatcagcagagatggccgcatcgccatcggggactgcatcctgagcatcaatgaggagagcaccatctctgtgaccaatgcccaggcccgggccatgctgcggcggcacagcctcatcggccctgacatcaagatcacctacgtgcctgctgagcacctggaggagttcaagatcagcctgggccagcagagcggccgggtgatggccctggacatcttcagcagctacacaggccgggacatccctgagctgcctgagcgggaggagggggagggggaggagagcgagctgcagaacacagcctacagcaactggaaccagccccggcgggtggagctgtggagggagcccagcaagagcctgggcatcagcatcgtgggcggccggggcatgggcagccggctgagcaatggagaggtgatgaggggcatcttcatcaagcacgtgctggaggacagccctgctgggaagaatggcaccctgaagccaggggaccgcatcgtggaggtggatggcatggacctgagagatgccagccatgagcaggccgtggaggccatcaggaaggccggcaaccctgtggtgttcatggtgcagagcatcatcaaccggcccaggaagagccccctgcccagcctgctgcacaacctgtaccccaagtacaacttcagcagcaccaacccctttgctgacagcctgcagatcaatgctgacaaggcccccagccagagcgagagcgagcctgagaaggcccccctgtgcagcgtgcccccacctcctccttctgcctttgctgagatgggcagtgaccacacccagagcagcgccagcaagatcagccaggatgtggacaaggaggatgaatttggctacagctggaagaacatccgggagagatatggcaccctgactggagagctgcacatgattgagctggagaagggccacagcggcctgggcctgagcctggccggcaacaaggacaggagcaggatgtctgtgttcatcgtgggcatcgaccccaatggagctgctgggaaggatggccgcctgcagattgctgatgagctgctggagatcaatggccagatcctgtatggccgcagccaccagaatgccagcagcatcatcaagtgtgcccccagcaaggtgaagatcatcttcatccggaacaaggatgctgtgaaccagatggctgtgtgccctggaaatgctgtggagcccctgcccagcaacagcgagaacctgcagaacaaggagacagagcccaccgtgaccaccagtgatgctgctgtggacctgagcagcttcaagaatgtgcagcacctggagctgcccaaggaccagggcggcctgggcatcgccatcagcgaggaggacaccctgagcggggtcatcatcaagagcctgacagagcacggcgtggccgccacagatggccgcctgaaggtgggggaccagatcctggccgtggatgatgagatcgtggtgggctaccccatcgagaagttcatcagcctgctgaagacagccaagatgacagtgaagctgaccatccacgcagaaaatccagacagccaggccgtgcccagcgctgctggggccgccagcggggagaagaagaacagcagccagagcctgatggtgccccagagcggcagccctgagcctgagagcatccggaacaccagccgcagcagcaccccagccatctttgccagtgaccctgccacctgccccatcatccctggctgtgagaccaccatcgagatcagcaagggccgcacaggcctgggcctgagcatcgtgggcggcagtgacaccctgctgggcgccatcatcatccacgaggtgtatgaggagggcgccgcctgcaaggatggccgcctgtgggccggggaccagatcctggaggtgaatggaattgacctgaggaaggccacccatgatgaggccatcaacgtgctgcggcagaccccccagagggtgcggctgaccctgtacagagatgaggccccctacaaggaggaggaggtgtgtgacaccctgaccatcgagctgcagaagaagccaggcaagggcctgggcctgagcatcgtgggcaagagaaatgacacaggagtgtttgtgtctgacatcgtgaagggcggcattgctgatgctgatggccgcctgatgcagggcgaccagatcctgatggtgaatggagaagatgtgagaaatgccacccaggaggccgtggccgccctgctgaaggtgtctgagggcagcctgagcagcttcaccttccccctgagcggcagcagcaccagcgagagcctggagagcagcagcaagaagaatgccctggccagcgagatccagggcctgaggacagtggagatgaagaagggccccacagacagcctgggcatcagcattgctggaggagtgggcagccccctgggagatgtgcccatcttcatcgccatgatgcaccccactggagtggccgcccagacccagaagctgcgggtgggggaccgcatcgtgaccatctgtggcaccagcacagagggcatgacccacacccaggccgtgaacctgctgaagaatgccagcggcagcattgagatgcaggtggtggccggaggagatgtgtctgtggtgacaggccaccagcaggagcccgccagcagcagcctgtccttcaccggcctgaccagcagcagcatcttccaggatgacctgggccccccccagtgcaagagcatcaccctggagcggggcccagatggcctgggcttcagcatcgtgggcggctacggcagcccccacggggacctgcccatctacgtgaagacagtgtttgccaagggagctgcctctgaagatggccgcctgaagagaggagaccagatcatcgctgtgaatggccagagcctggagggcgtgacccatgaggaggccgtggccatcctgaagaggaccaagggcaccgtgaccctgatggtgctgtcctag

SEQ ID NO: 160391 - DNA, 5853 bp, Artificial Sequence
  Description of Artificial Sequence: Synthetic coding sequence
atgctggaggccatcgacaagaacagagccctgcatgctgctgagcggctgcagaccaagctgcgggagagaggagatgtggccaatgaagacaagctgagcctgctgaagtctgtgctgcagagccccctcttcagccagatcctgagcctgcagacctctgtgcagcagctgaaggaccaggtgaacatcgccaccagcgccaccagcaacatcgagtatgcccacgtgccccacctgagccctgctgtgatccccaccctgcagaatgaaagcttcctgctgagccccaacaatggaaacctggaggccctgaccggccctggcatcccccacatcaacgggaagccagcctgtgatgaatttgaccagctgatcaagaacatggcccagggccgccacgtggaggtgtttgagctgctgaagcccccatctgggggcctgggcttctctgtggtgggcctgcggtctgagaacagaggagagctgggcatctttgtgcaggagatccaggagggctctgtggcccacagagatggccgcctgaaggagacagaccagatcctggccatcaatggccaggccctggaccagaccatcacccaccagcaggccatcagcatcctgcagaaggccaaggacacagtgcagctggtgattgcccggggcagcctgccccagctggtgagccccatcgtgagccgcagccccagcgctgccagcaccatcagcgcccacagcaaccctgtgcactggcagcacatggagaccatcgagctggtgaatgatggcagcggcctgggcttcggcatcatcggcggcaaggccactggagtcatcgtgaagaccatcctgcccggcggcgtggccgaccagcacggccgcctgtgcagcggggaccacatcctgaagattggagacacagacctggccggcatgagcagcgagcaggtggcccaggtgctgcggcagtgtggcaacagagtgaagctgatgattgcccggggggccatcgaggagaggacagcccccacagccctgggcatcaccctgagcagcagccccaccagcaccccagagctgcgggtggatgccagcacccagaagggggaggagagcgagacctttgatgtggagctgaccaagaatgtgcagggcctgggcatcaccatcgccggctacatcggggacaagaagctggagcccagcggcatctttgtgaagagcatcaccaagagcagcgctgtggagcatgatggccgcatccagatcggggaccagatcatcgctgtggatggcaccaacctgcagggcttcaccaaccagcaggccgtggaggtgctgcggcacacaggccagacagtgctgctgaccctgatgagaagaggcatgaagcaggaggccgagctgatgagccgggaggatgtgaccaaggatgctgacctgagccctgtgaatgccagcatcatcaaggagaactatgagaaggatgaggacttcctgagcagcaccaggaacaccaacatcctgcccacagaggaggagggctaccccctgctgtctgctgagattgaggagattgaagatgcccagaagcaggaggccgccctgctgaccaagtggcagaggatcatgggcatcaactatgaaattgtggtggcccacgtgtccaagttctctgaaaattctggcctgggcatcagcctggaggccaccgtgggccaccacttcatccgctctgtgctgcctgagggccctgtgggccacagcggcaagctgttctctggagatgagctgctggaggtgaatggcatcaccctgctgggggagaaccaccaggatgtggtgaacatcctgaaggagctgcccatcgaggtgaccatggtgtgctgcagaagaacagtgccccccaccacccagagcgagctggacagcctgggcatccagcacatcgagctggagaagggcagcaagggcctgggcttcagcatcctggactaccaggaccccattgatcctgccagcaccgtcatcatcatccgcagcctggtgcctgggggcattgctgagaaggatggccgcctgctgcccggggaccggctgatgtttgtgaatgatgtgaacctggagaacagcagcctggaggaggccgtggaggccctgaagggggcccccagcggcaccgtgagaattggagtggccaagcccctgcccctgagccctgaggagggctacgtgtctgccaaggaggacagcttcctgtacccaccccacagctgtgaggaggccggcctggccgacaagcccctcttccgggctgacctggccctggtgggcaccaatgatgctgacctggtggatgagagcacctttgagagcccctacagcccagaaaatgacagcatctacagcacccaggccagcatcctgagcctgcacggcagcagctgtggagatggcctgaactacggcagcagcctgcccagcagcccccccaaggatgtgattgagaacagctgtgaccctgtgctggacctgcacatgagcctggaggagctgtacacccagaacctgctgcagaggcaggatgagaacacccccagcgtggacatctccatgggccctgccagcggcttcaccatcaatgactacaccccagccaatgccatcgagcagcagtatgaatgtgagaacaccatcgtgtggacagagagccacctgcccagcgaggtgatcagcagcgctgagctgcccagcgtgctgcctgacagcgctggaaaaggaagtgagtacctgctggagcagagcagcctggcctgcaatgcagaatgtgtgatgctgcagaatgtgtccaaggagagctttgagaggaccatcaacatcgccaagggcaacagcagcctgggcatgacagtgtctgccaacaaggatggcctgggcatgattgtgcgcagcatcatccacggcggggccatcagcagagatggccgcatcgccatcggggactgcatcctgagcatcaatgaggagagcaccatctctgtgaccaatgcccaggcccgggccatgctgcggcggcacagcctcatcggccctgacatcaagatcacctacgtgcctgctgagcacctggaggagttcaagatcagcctgggccagcagagcggccgggtgatggccctggacatcttcagcagctacacaggccgggacatccctgagctgcctgagcgggaggagggggagggggaggagagcgagctgcagaacacagcctacagcaactggaaccagccccggcgggtggagctgtggagggagcccagcaagagcctgggcatcagcatcgtgggcggccggggcatgggcagccggctgagcaatggagaggtgatgaggggcatcttcatcaagcacgtgctggaggacagccctgctgggaagaatggcaccctgaagccaggggaccgcatcgtggaggcccccagccagagcgagagcgagcctgagaaggcccccctgtgcagcgtgcccccacctcctccttctgcctttgctgagatgggcagtgaccacacccagagcagcgccagcaagatcagccaggatgtggacaaggaggatgaatttggctacagctggaagaacatccgggagagatatggcaccctgactggagagctgcacatgattgagctggagaagggccacagcggcctgggcctgagcctggccggcaacaaggacaggagcaggatgtctgtgttcatcgtgggcatcgaccccaatggagctgctgggaaggatggccgcctgcagattgctgatgagctgctggagatcaatggccagatcctgtatggccgcagccaccagaatgccagcagcatcatcaagtgtgcccccagcaaggtgaagatcatcttcatccggaacaaggatgctgtgaaccagatggctgtgtgccctggaaatgctgtggagcccctgcccagcaacagcgagaacctgcagaacaaggagacagagcccaccgtgaccaccagtgatgctgctgtggacctgagcagcttcaagaatgtgcagcacctggagctgcccaaggaccagggcggcctgggcatcgccatcagcgaggaggacaccctgagcggggtcatcatcaagagcctgacagagcacggcgtggccgccacagatggccgcctgaaggtgggggaccagatcctggccgtggatgatgagatcgtggtgggctaccccatcgagaagttcatcagcctgctgaagacagccaagatgacagtgaagctgaccatccacgcagaaaatccagacagccaggccgtgcccagcgctgctggggccgccagcggggagaagaagaacagcagccagagcctgatggtgccccagagcggcagccctgagcctgagagcatccggaacaccagccgcagcagcaccccagccatctttgccagtgaccctgccacctgccccatcatccctggctgtgagaccaccatcgagatcagcaagggccgcacaggcctgggcctgagcatcgtgggcggcagtgacaccctgctgggcgccatcatcatccacgaggtgtatgaggagggcgccgcctgcaaggatggccgcctgtgggccggggaccagatcctggaggtgaatggaattgacctgaggaaggccacccatgatgaggccatcaacgtgctgcggcagaccccccagagggtgcggctgaccctgtacagagatgaggccccctacaaggaggaggaggtgtgtgacaccctgaccatcgagctgcagaagaagccaggcaagggcctgggcctgagcatcgtgggcaagagaaatgacacaggagtgtttgtgtctgacatcgtgaagggcggcattgctgatgctgatggccgcctgatgcagggcgaccagatcctgatggtgaatggagaagatgtgagaaatgccacccaggaggccgtggccgccctgctgaagtgcagcctgggcaccgtgaccctggaggtgggccgcatcaaggccggccccttccacagcgagcggcggcccagccagagcagccaggtgtctgagggcagcctgagcagcttcaccttccccctgagcggcagcagcaccagcgagagcctggagagcagcagcaagaagaatgccctggccagcgagatccagggcctgaggacagtggagatgaagaagggccccacagacagcctgggcatcagcattgctgggggcgtgggcagccccctgggagatgtgcccatcttcatcgccatgatgcaccccaccggggtggccgcccagacccagaagctgcgggtgggggacagaattgtgaccatctgtggcaccagcacagagggcatgacccacacccaggccgtgaacctgctgaagaatgccagcggcagcattgagatgcaggtggtggccggaggagatgtgtctgtggtgacaggccaccagcaggagcccgccagcagcagcctgtccttcaccggcctgaccagcagcagcatcttccaggatgacctgggccccccccagtgcaagagcatcaccctggagcggggcccagatggcctgggcttcagcatcgtgggcggctacggcagcccccatggagacctgcccatctacgtgaagacagtgtttgccaagggggccgcctctgaagatggccgcctgaagagaggagaccagatcatcgctgtgaatggccagagcctggagggcgtgacccatgaggaggccgtggccatcctgaagaggaccaagggcaccgtgaccctgatggtgctgtcctag

SEQ ID NO: 160392 - DNA, 915 bp, Artificial Sequence
  Description of Artificial Sequence: Synthetic coding sequence
atgcagggcgaccagatcctgatggtgaatggagaagatgtgagaaatgccacccaggaggccgtggccgccctgctgaagtgcagcctgggcaccgtgaccctggaggtgggccgcatcaaggccggccccttccacagcgagcggcggcccagccagagcagccaggtgtctgagggcagcctgagcagcttcaccttccccctgagcggcagcagcaccagcgagagcctggagagcagcagcaagaagaatgccctggccagcgagatccagggcctgaggacagtggagatgaagaagggccccacagacagcctgggcatcagcattgctgggggcgtgggcagccccctgggagatgtgcccatcttcatcgccatgatgcaccccaccggggtggccgcccagacccagaagctgcgggtgggggacagaattgtgaccatctgtggcaccagcacagagggcatgacccacacccaggccgtgaacctgctgaagaatgccagcggcagcattgagatgcaggtggtggccggaggagatgtgtctgtggtgacaggccaccagcaggagcccgccagcagcagcctgtccttcaccggcctgaccagcagcagcatcttccaggatgacctgggccccccccagtgcaagagcatcaccctggagcggggcccagatggcctgggcttcagcatcgtgggcggctacggcagcccccatggagacctgcccatctacgtgaagacagtgtttgccaagggggccgcctctgaagatggccgcctgaagagaggagaccagatcatcgctgtgaatggccagagcctggagggcgtgacccatgaggaggccgtggccatcctgaagaggaccaagggcaccgtgaccctgatggtgctgtcctag

SEQ ID NO: 160393 - DNA, 6126 bp, Artificial Sequence; identical to SEQ ID NO: 160390
  Description of Artificial Sequence: Synthetic coding sequence

SEQ ID NO: 160394 - DNA, 6114 bp, Artificial Sequence
  Description of Artificial Sequence: Synthetic coding sequence
atgctggaggccatcgacaagaacagagccctgcatgctgctgagcggctgcagaccaagctgcgggagagaggagatgtggccaatgaagacaagctgagcctgctgaagtctgtgctgcagagccccctcttcagccagatcctgagcctgcagacctctgtgcagcagctgaaggaccaggtgaacatcgccaccagcgccaccagcaacatcgagtatgcccacgtgccccacctgagccctgctgtgatccccaccctgcagaatgaaagcttcctgctgagccccaacaatggaaacctggaggccctgaccggccctggcatcccccacatcaacgggaagccagcctgtgatgaatttgaccagctgatcaagaacatggcccagggccgccacgtggaggtgtttgagctgctgaagcccccatctgggggcctgggcttctctgtggtgggcctgcggtctgagaacagaggagagctgggcatctttgtgcaggagatccaggagggctctgtggcccacagagatggccgcctgaaggagacagaccagatcctggccatcaatggccaggccctggaccagaccatcacccaccagcaggccatcagcatcctgcagaaggccaaggacacagtgcagctggtgattgcccggggcagcctgccccagctggtgagccccatcgtgagccgcagccccagcgctgccagcaccatcagcgcccacagcaaccctgtgcactggcagcacatggagaccatcgagctggtgaatgatggcagcggcctgggcttcggcatcatcggcggcaaggccactggagtcatcgtgaagaccatcctgcccggcggcgtggccgaccagcacggccgcctgtgcagcggggaccacatcctgaagattggagacacagacctggccggcatgagcagcgagcaggtggcccaggtgctgcggcagtgtggcaacagagtgaagctgatgattgcccggggggccatcgaggagaggacagcccccacagccctgggcatcaccctgagcagcagccccaccagcaccccagagctgcgggtggatgccagcacccagaagggggaggagagcgagacctttgatgtggagctgaccaagaatgtgcagggcctgggcatcaccatcgccggctacatcggggacaagaagctggagcccagcggcatctttgtgaagagcatcaccaagagcagcgctgtggagcatgatggccgcatccagatcggggaccagatcatcgctgtggatggcaccaacctgcagggcttcaccaaccagcaggccgtggaggtgctgcggcacacaggccagacagtgctgctgaccctgatgagaagaggcatgaagcaggaggccgagctgatgagccgggaggatgtgaccaaggatgctgacctgagccctgtgaatgccagcatcatcaaggagaactatgagaaggatgaggacttcctgagcagcaccaggaacaccaacatcctgcccacagaggaggagggctaccccctgctgtctgctgagattgaggagattgaagatgcccagaagcaggaggccgccctgctgaccaagtggcagaggatcatgggcatcaactatgaaattgtggtggcccacgtgtccaagttctctgaaaattctggcctgggcatcagcctggaggccaccgtgggccaccacttcatccgctctgtgctgcctgagggccctgtgggccacagcggcaagctgttctctggagatgagctgctggaggtgaatggcatcaccctgctgggggagaaccaccaggatgtggtgaacatcctgaaggagctgcccatcgaggtgaccatggtgtgctgcagaagaacagtgccccccaccacccagagcgagctggacagcctggacctgtgtgacatcgagctgacagagaagccccacgtggacctgggggagttcatcggcagcagcgagacagaagatcctgtgctggccatgacagatgctggccagagcacagaggaggtgcaggcccccctggccatgtgggaggccggcatccagcacatcgagctggagaagggcagcaagggcctgggcttcagcatcctggactaccaggaccccattgatcctgccagcaccgtcatcatcatccgcagcctggtgcctgggggcattgctgagaaggatggccgcctgctgcccggggaccggctgatgtttgtgaatgatgtgaacctggagaacagcagcctggaggaggccgtggaggccctgaagggggcccccagcggcaccgtgagaattggagtggccaagcccctgcccctgagccctgaggagggctacgtgtctgccaaggaggacagcttcctgtacccaccccacagctgtgaggaggccggcctggccgacaagcccctcttccgggctgacctggccctggtgggcaccaatgatgctgacctggtggatgagagcacctttgagagcccctacagcccagaaaatgacagcatctacagcacccaggccagcatcctgagcctgcacggcagcagctgtggagatggcctgaactacggcagcagcctgcccagcagcccccccaaggatgtgattgagaacagctgtgaccctgtgctggacctgcacatgagcctggaggagctgtacacccagaacctgctgcagaggcaggatgagaacacccccagcgtggacatctccatgggccctgccagcggcttcaccatcaatgactacaccccagccaatgccatcgagcagcagtatgaatgtgagaacaccatcgtgtggacagagagccacctgcccagcgaggtgatcagcagcgctgagctgcccagcgtgctgcctgacagcgctggaaaaggaagtgagtacctgctggagcagagcagcctggcctgcaatgcagaatgtgtgatgctgcagaatgtgtccaaggagagctttgagaggaccatcaacatcgccaagggcaacagcagcctgggcatgacagtgtctgccaacaaggatggcctgggcatgattgtgcgcagcatcatccacggcggggccatcagcagagatggccgcatcgccatcggggactgcatcctgagcatcaatgaggagagcaccatctctgtgaccaatgcccaggcccgggccatgctgcggcggcacagcctcatcggccctgacatcaagatcacctacgtgcctgctgagcacctggaggagttcaagatcagcctgggccagcagagcggccgggtgatggccctggacatcttcagcagctacacaggccgggacatccctgagctgcctgagcgggaggagggggagggggaggagagcgagctgcagaacacagcctacagcaactggaaccagccccggcgggtggagctgtggagggagcccagcaagagcctgggcatcagcatcgtgggcggccggggcatgggcagccggctgagcaatggagaggtgatgaggggcatcttcatcaagcacgtgctggaggacagccctgctgggaagaatggcaccctgaagccaggggaccgcatcgtggaggtggatggcatggacctgagagatgccagccatgagcaggccgtggaggccatcaggaaggccggcaaccctgtggtgttcatggtgcagagcatcatcaaccggccccgggcccccagccagagcgagagcgagcctgagaaggcccccctgtgcagcgtgcccccacctccacccagcgcctttgctgagatgggcagtgaccacacccagagcagcgccagcaagatcagccaggatgtggacaaggaggatgaatttggctacagctggaagaacatccgggagagatatggcaccctgaccggggagctgcacatgattgagctggagaagggccacagcggcctgggcctgagcctggccggcaacaaggacaggagcaggatgtctgtgttcatcgtgggcatcgaccccaacggggctgctgggaaggatggccgcctgcagattgctgatgagctgctggagatcaatggccagatcctgtatggccgcagccaccagaatgccagcagcatcatcaagtgtgcccccagcaaggtgaagatcatcttcatccggaacaaggatgctgtgaaccagatggctgtgtgccctggaaatgctgtggagcccctgcccagcaacagcgagaacctgcagaacaaggagacagagcccaccgtgaccaccagtgatgctgctgtggacctgagcagcttcaagaatgtgcagcacctggagctgcccaaggaccagggcggcctgggcatcgccatcagcgaggaggacaccctgtctggagtcatcatcaagagcctgacagaacatggagtggccgccacagatggccgcctgaaggtgggggaccagatcctggccgtggatgatgaaattgtggtgggctaccccatcgagaagttcatcagcctgctgaagacagccaagatgacagtgaagctgaccatccatgctgagaacccagacagccaggccgtgcccagcgctgctggagctgccagcggggagaagaagaacagcagccagagcctgatggtgccccagagcggcagccctgagcctgagagcatccggaacaccagccgcagcagcaccccagccatctttgccagtgaccctgccacctgccccatcatccctggctgtgagaccaccatcgagatcagcaaaggaagaacaggcctgggcctgagcatcgtgggcggcagtgacaccctgctgggcgccatcatcatccacgaggtgtatgaggagggcgccgcctgcaaggatggccgcctgtgggccggggaccagatcctggaggtgaatggcatcgacctgaggaaggccacccatgatgaggccatcaacgtgctgcggcagaccccccagagggtgcggctgaccctgtacagagatgaggccccctacaaggaggaggaggtgtgtgacaccctgaccatcgagctgcagaagaagccaggcaagggcctgggcctgagcatcgtgggcaagagaaatgacaccggggtgtttgtgtctgacatcgtgaagggcggcattgctgatgctgatggccgcctgatgcagggcgaccagatcctgatggtgaatggagaagatgtgagaaatgccacccaggaggccgtggccgccctgctgaagtgcagcctgggcaccgtgaccctggaggtgggccgcatcaaggccggccccttccacagcgagcggcggcccagccagagcagccaggtgtctgagggcagcctgagcagcttcaccttccccctgagcggcagcagcaccagcgagagcctggagagcagcagcaagaagaatgccctggccagcgagatccagggcctgaggacagtggagatgaagaagggccccacagacagcctgggcatcagcattgctggaggagtgggcagccccctgggagatgtgcccatcttcatcgccatgatgcaccccactggagtggccgcccagacccagaagctgcgggtgggggaccgcatcgtgaccatctgtggcaccagcacagagggcatgacccacacccaggccgtgaacctgctgaagaatgccagcggcagcattgagatgcaggtggtggccggaggagatgtgtctgtggtgacaggccaccagcaggagcccgccagcagcagcctgtccttcaccggcctgaccagcagcagcatcttccaggatgacctgggccccccccagtgcaagagcatcaccctggagcggggcccagatggcctgggcttcagcatcgtgggcggctacggcagcccccacggggacctgcccatctacgtgaagacagtgtttgccaagggagctgcctctgaagatggccgcctgaagagaggagaccagatcatcgctgtgaatggccagagcctggagggcgtgacccatgaggaggccgtggccatcctgaagaggaccaagggcaccgtgaccctgatggtgctgtcctag

SEQ ID NO: 160395 - DNA, 6027 bp, Artificial Sequence
  Description of Artificial Sequence: Synthetic coding sequence
atgctggaggccatcgacaagaacagagccctgcatgctgctgagcggctgcagaccaagctgcgggagagaggagatgtggccaatgaagacaagctgagcctgctgaagtctgtgctgcagagccccctcttcagccagatcctgagcctgcagacctctgtgcagcagctgaaggaccaggtgaacatcgccaccagcgccaccagcaacatcgagtatgcccacgtgccccacctgagccctgctgtgatccccaccctgcagaatgaaagcttcctgctgagccccaacaatggaaacctggaggccctgaccggccctggcatcccccacatcaacgggaagccagcctgtgatgaatttgaccagctgatcaagaacatggcccagggccgccacgtggaggtgtttgagctgctgaagcccccatctgggggcctgggcttctctgtggtgggcctgcggtctgagaacagaggagagctgggcatctttgtgcaggagatccaggagggctctgtggcccacagagatggccgcctgaaggagacagaccagatcctggccatcaatggccaggccctggaccagaccatcacccaccagcaggccatcagcatcctgcagaaggccaaggacacagtgcagctggtgattgcccggggcagcctgccccagctggtgagccccatcgtgagccgcagccccagcgctgccagcaccatcagcgcccacagcaaccctgtgcactggcagcacatggagaccatcgagctggtgaatgatggcagcggcctgggcttcggcatcatcggcggcaaggccactggagtcatcgtgaagaccatcctgcccggcggcgtggccgaccagcacggccgcctgtgcagcggggaccacatcctgaagattggagacacagacctggccggcatgagcagcgagcaggtggcccaggtgctgcggcagtgtggcaacagagtgaagctgatgattgcccggggggccatcgaggagaggacagcccccacagccctgggcatcaccctgagcagcagccccaccagcaccccagagctgcgggtggatgccagcacccagaagggggaggagagcgagacctttgatgtggagctgaccaagaatgtgcagggcctgggcatcaccatcgccggctacatcggggacaagaagctggagcccagcggcatctttgtgaagagcatcaccaagagcagcgctgtggagcatgatggccgcatccagatcggggaccagatcatcgctgtggatggcaccaacctgcagggcttcaccaaccagcaggccgtggaggtgctgcggcacacaggccagacagtgctgctgaccctgatgagaagaggcatgaagcaggaggccgagctgatgagccgggaggatgtgaccaaggatgctgacctgagccctgtgaatgccagcatcatcaaggagaactatgagaaggatgaggacttcctgagcagcaccaggaacaccaacatcctgcccacagaggaggagggctaccccctgctgtctgctgagattgaggagattgaagatgcccagaagcaggaggccgccctgctgaccaagtggcagaggatcatgggcatcaactatgaaattgtggtggcccacgtgtccaagttctctgaaaattctggcctgggcatcagcctggaggccaccgtgggccaccacttcatccgctctgtgctgcctgagggccctgtgggccacagcggcaagctgttctctggagatgagctgctggaggtgaatggcatcaccctgctgggggagaaccaccaggatgtggtgaacatcctgaaggagctgcccatcgaggtgaccatggtgtgctgcagaagaacagtgccccccaccacccagagcgagctggacagcctggacctgtgtgacatcgagctgacagagaagccccacgtggacctgggggagttcatcggcagcagcgagacagaagatcctgtgctggccatgacagatgctggccagagcacagaggaggtgcaggcccccctggccatgtgggaggccggcatccagcacatcgagctggagaagggcagcaagggcctgggcttcagcatcctggactaccaggaccccattgatcctgccagcaccgtcatcatcatccgcagcctggtgcctgggggcattgctgagaaggatggccgcctgctgcccggggaccggctgatgtttgtgaatgatgtgaacctggagaacagcagcctggaggaggccgtggaggccctgaagggggcccccagcggcaccgtgagaattggagtggccaagcccctgcccctgagccctgaggagggctacgtgtctgccaaggaggacagcttcctgtacccaccccacagctgtgaggaggccggcctggccgacaagcccctcttccgggctgacctggccctggtgggcaccaatgatgctgacctggtggatgagagcacctttgagagcccctacagcccagaaaatgacagcatctacagcacccaggccagcatcctgagcctgcacggcagcagctgtggagatggcctgaactacggcagcagcctgcccagcagcccccccaaggatgtgattgagaacagctgtgaccctgtgctggacctgcacatgagcctggaggagctgtacacccagaacctgctgcagaggcaggatgagaacacccccagcgtggacatctccatgggccctgccagcggcttcaccatcaatgactacaccccagccaatgccatcgagcagcagtatgaatgtgagaacaccatcgtgtggacagagagccacctgcccagcgaggtgatcagcagcgctgagctgcccagcgtgctgcctgacagcgctggaaaaggaagtgagtacctgctggagcagagcagcctggcctgcaatgcagaatgtgtgatgctgcagaatgtgtccaaggagagctttgagaggaccatcaacatcgccaagggcaacagcagcctgggcatgacagtgtctgccaacaaggatggcctgggcatgattgtgcgcagcatcatccacggcggggccatcagcagagatggccgcatcgccatcggggactgcatcctgagcatcaatgaggagagcaccatctctgtgaccaatgcccaggcccgggccatgctgcggcggcacagcctcatcggccctgacatcaagatcacctacgtgcctgctgagcacctggaggagttcaagatcagcctgggccagcagagcggccgggtgatggccctggacatcttcagcagctacacaggccgggacatccctgagctgcctgagcgggaggagggggagggggaggagagcgagctgcagaacacagcctacagcaactggaaccagccccggcgggtggagctgtggagggagcccagcaagagcctgggcatcagcatcgtgggcggccggggcatgggcagccggctgagcaatggagaggtgatgaggggcatcttcatcaagcacgtgctggaggacagccctgctgggaagaatggcaccctgaagccaggggaccgcatcgtggaggtggatggcatggacctgagagatgccagccatgagcaggccgtggaggccatcaggaaggccggcaaccctgtggtgttcatggtgcagagcatcatcaaccggccccgggcccccagccagagcgagagcgagcctgagaaggcccccctgtgcagcgtgcccccacctccacccagcgcctttgctgagatgggcagtgaccacacccagagcagcgccagcaagatcagccaggatgtggacaaggaggatgaatttggctacagctggaagaacatccgggagagatatggcaccctgaccggggagctgcacatgattgagctggagaagggccacagcggcctgggcctgagcctggccggcaacaaggacaggagcaggatgtctgtgttcatcgtgggcatcgaccccaacggggctgctgggaaggatggccgcctgcagattgctgatgagctgctggagatcaatggccagatcctgtatggccgcagccaccagaatgccagcagcatcatcaagtgtgcccccagcaaggtgaagatcatcttcatccggaacaaggatgctgtgaaccagatggctgtgtgccctggaaatgctgtggagcccctgcccagcaacagcgagaacctgcagaacaaggagacagagcccaccgtgaccaccagtgatgctgctgtggacctgagcagcttcaagaatgtgcagcacctggagctgcccaaggaccagggcggcctgggcatcgccatcagcgaggaggacaccctgtctggagtcatcatcaagagcctgacagaacatggagtggccgccacagatggccgcctgaaggtgggggaccagatcctggccgtggatgatgaaattgtggtgggctaccccatcgagaagttcatcagcctgctgaagacagccaagatgacagtgaagctgaccatccatgctgagaacccagacagccaggccgtgcccagcgctgctggagctgccagcggggagaagaagaacagcagccagagcctgatggtgccccagagcggcagccctgagcctgagagcatccggaacaccagccgcagcagcaccccagccatctttgccagtgaccctgccacctgccccatcatccctggctgtgagaccaccatcgagatcagcaaaggaagaacaggcctgggcctgagcatcgtgggcggcagtgacaccctgctgggcgccatcatcatccacgaggtgtatgaggagggcgccgcctgcaaggatggccgcctgtgggccggggaccagatcctggaggtgaatggcatcgacctgaggaaggccacccatgatgaggccatcaacgtgctgcggcagaccccccagagggtgcggctgaccctgtacagagatgaggccccctacaaggaggaggaggtgtgtgacaccctgaccatcgagctgcagaagaagccaggcaagggcctgggcctgagcatcgtgggcaagagaaatgacaccggggtgtttgtgtctgacatcgtgaagggcggcattgctgatgctgatggccgcctgatgcagggcgaccagatcctgatggtgaatggagaagatgtgagaaatgccacccaggaggccgtggccgccctgctgaaggtgtctgagggcagcctgagcagcttcaccttccccctgagcggcagcagcaccagcgagagcctggagagcagcagcaagaagaatgccctggccagcgagatccagggcctgaggacagtggagatgaagaagggccccacagacagcctgggcatcagcattgctgggggcgtgggcagccccctgggagatgtgcccatcttcatcgccatgatgcaccccaccggggtggccgcccagacccagaagctgcgggtgggggacagaattgtgaccatctgtggcaccagcacagagggcatgacccacacccaggccgtgaacctgctgaagaatgccagcggcagcattgagatgcaggtggtggccggaggagatgtgtctgtggtgacaggccaccagcaggagcccgccagcagcagcctgtccttcaccggcctgaccagcagcagcatcttccaggatgacctgggccccccccagtgcaagagcatcaccctggagcggggcccagatggcctgggcttcagcatcgtgggcggctacggcagcccccatggagacctgcccatctacgtgaagacagtgtttgccaagggggccgcctctgaagatggccgcctgaagagaggagaccagatcatcgctgtgaatggccagagcctggagggcgtgacccatgaggaggccgtggccatcctgaagaggaccaagggcaccgtgaccctgatggtgctgtcctag

SEQ ID NO: 160396 - DNA, 1089 bp, Artificial Sequence
  Description of Artificial Sequence: Synthetic coding sequence
atggagacagatgccccccagcccggcctggccagcccagacagcccccatgacccctgcaagatgttcatcggcggcctgtcctggcagaccacccaggagggcctgcgggagtacttcggccagtttggagaggtgaaggagtgcctggtgatgagggaccccctgaccaagaggagccggggctttggatttgtgaccttcatggaccaggccggcgtggacaaggtgctggcccagagcagacatgagctggacagcaagaccatcgaccccaaggtggccttcccccggcgggcccagcccaagatggtgaccaggaccaagaagatctttgtgggcggcctgtctgtgaacaccaccgtggaggatgtgaagcagtactttgagcagtttgggaaggtggatgatgccatgctgatgtttgacaagaccaccaacagacaccggggcttcggctttgtgacctttgaaagtgaggacatcgtggagaaggtgtgtgagatccacttccacgagatcaacaacaagatggtggagtgcaagaaggcccagcccaaggaggtgatgagccccactggaagtgcccggggccgcagccgggtgatgccctacggcatggatgccttcatgctgggcatcggcatgctgggctacccaggcttccaggccaccacctacgccagccgcagctacacaggcctggcccctggctacacctaccagtttcctgagttccgggtggagaggacccccctgcccagcgcccctgtgctgcctgagctgacagccatccccctgacagcctacggccccatggctgctgctgctgctgctgctgctgtggtgcggggcaccggcagccacccctggaccatggcccctcctcctggcagcacccccagcaggactggaggcttcctgggcaccaccagccctggccccatggccgagctgtatggagctgccaaccaggacagcggcgtgtcctcctacatctctgctgccagccctgcccccagcacaggcttcggccacagcctgggcggccccctgattgccacagccttcaccaacggctaccactag

SEQ ID NO: 160397 - DNA, 627 bp, Artificial Sequence
  Description of Artificial Sequence: Synthetic coding sequence
atggccaccagcgctgtgcccagcgacaacctgcccacctacaagctggtggtggtgggagatggaggagtgggcaagagcgccctgaccatccagttcttccagaagatctttgtgcctgactatgaccccaccattgaagattcctacctgaagcacacagaaattgacaaccagtgggccatcctggatgtgctggacacagctggccaggaggagttcagcgccatgagggagcagtacatgaggactggagatggcttcctgattgtgtacagcgtgacagacaaggccagctttgagcacgtggaccgcttccaccagctgatcctgcgggtgaaggaccgggagagcttccccatgatcctggtggccaacaaggtggacctgatgcacctgaggaagatcacccgggagcagggcaaggagatggccaccaagcacaacatcccctacatcgagaccagcgccaaggacccccccctgaatgtggacaaggccttccatgacctggtgcgggtcatccggcagcagatccctgagaagagccagaagaagaagaagaagaccaagtggaggggggaccgggccaccggcacccacaagctgcagtgtgtgatcctgtag

SEQ ID NO: 160398 - DNA, 627 bp, Artificial Sequence; identical to SEQ ID NO: 160397
  Description of Artificial Sequence: Synthetic coding sequence

SEQ ID NO: 160399 - DNA, 399 bp, Artificial Sequence
  Description of Artificial Sequence: Synthetic coding sequence
atgagggagcagtacatgaggactggagatggcttcctgattgtgtacagcgtgacagacaaggccagctttgagcacgtggaccgcttccaccagctgatcctgcgggtgaaggaccgggagagcttccccatgatcctggtggccaacaaggtggacctgatgcacctgaggaagatcacccgggagcagggcaaggagatggccaccaagcacaacatcccctacatcgagaccagcgccaaggacccccccctgaatgtggacaaggccttccatgacctggtgcgggtcatccggcagcagatccctgagaagagccagaagaagaagaagaagaccaagtggaggggggaccgggccaccggcacccacaagctgcagtgtgtgatcctgtag

SEQ ID NO: 160400 - DNA, 627 bp, Artificial Sequence; identical to SEQ ID NO: 160397
  Description of Artificial Sequence: Synthetic coding sequence

SEQ ID NO: 160401 - DNA, 72 bp, Artificial Sequence
  Description of Artificial Sequence: Synthetic coding sequence
atggccaccagcgctgtgcccagcgacaacctgcccacctacaagctggtggtggtgggagatggcggctag

SEQ ID NO: 160402 - DNA, 2628 bp, Artificial Sequence
  Description of Artificial Sequence: Synthetic coding sequence
atgagggagctggtgaacatccccctggtgcacatcctgaccctggtggccttctctggaacagagaagctgcccaaggcccctgtgatcaccacccccctggagaccgtggatgccctggtggaggaggtggccaccttcatgtgtgctgtggagagctacccccagcctgagatctcctggaccaggaacaagatcctgatcaagctgtttgacacccgctacagcatcagagaaaatggccagctgctgaccatcctgtctgtggaggacagtgatgatggcatctactgctgcacagccaacaatggagtgggcggcgctgtggagagctgtggggccctgcaggtgaagatgaagcccaagatcacccggccccccatcaacgtgaagatcatcgagggcctgaaggctgtgctgccctgcaccaccatgggcaaccccaagcccagcgtgtcctggatcaagggggacagccccctgcgggagaacagcagaattgctgtgctggagagcggcagcctgcgcatccacaacgtgcagaaggaggatgctggccagtaccgctgtgtggccaagaacagcctgggcacagcctacagcaaggtggtgaagctggaggtggaggtgtttgcccgcatcctgcgggcccctgagagccacaacgtgaccttcggcagctttgtgaccctgcactgcacagccaccggcatccctgtgcccaccatcacctggattgaaaatggaaatgctgtgagcagcggcagcatccaggagagcgtgaaggacagagtcatcgacagccggctgcagctgttcatcaccaagccaggcctgtacacctgcatcgccaccaacaagcacggggagaagttcagcacagccaaggccgccgccaccatcagcattgctgagatgctgttcatcagcagcttcagcaagccccagaaggacaacaagggctactgtgcccagtacagaggagaggtgtgcaatgctgtgctggccaaggatgccctggtgttcctgaacaccagctatgctgaccctgaggaggcccaggagctgctggtgcacacagcctggaatgagctgaaggtggtgtcccctgtgtgcaggcctgctgctgaggccctgctgtgcaaccacatcttccaggagtgcagccctggggtggtgcccacccccatccccatctgccgggagtactgcctggccgtgaaggagctgttctgtgccaaggagtggctggtgatggaggagaagacccaccggggcctgtacagaagtgagatgcacctgctgtctgtgcctgaatgttccaagctgcccagcatgcactgggaccccacagcctgtgcccggctgccccacctggactacaacaaggagaacctgaagaccttcccccccatgaccagcagcaagcccagcgtggacatccccaacctgcccagcagcagcagcagcagcttctctgtgagccccacctacagcatgaccgtcatcatcagcatcatgagcagctttgccatctttgtgctgctgaccatcaccaccctgtactgctgcagaagaaggaagcagtggaagaacaagaagcgggagagcgctgctgtgaccctgaccaccctgcccagcgagctgctgctggaccggctgcaccccaaccccatgtaccagaggatgcccctgctgctgaaccccaagctgctgagcctggagtaccccaggaacaacattgaatatgtgcgggacattggagagggcgccttcggccgggtcttccaggcccgggcccctggcctgctgccctatgagcccttcaccatggtggccgtgaagatgctgaaggaggaggccagcgctgacatgcaggccgacttccagcgggaggccgccctgatggccgagtttgacaaccccaacatcgtgaagctgctgggcgtgtgtgctgtgggcaagcccatgtgcctgctgtttgagtacatggcctacggggacctgaatgagttcctgcgctccatgagcccccacacagtgtgcagcctgagccacagcgacctgtccatgagggcccaggtgagcagccctggccccccacccctgagctgtgccgagcagctgtgcatcgcccggcaggtggccgccggcatggcctacctgtctgagaggaagtttgtgcaccgggacctggccaccaggaactgcctggtgggggagaacatggtggtgaagattgctgactttggcctgagcaggaacatctacagcgctgactactacaaggccaatgaaaatgatgccatccccatccgctggatgcctcctgagagcatcttctacaaccgctacaccacagaaagtgatgtgtgggcctacggcgtggtgctgtgggagatcttctcctatggcctgcagccctactacggcatggcccacgaggaggtgatctactacgtgagagatggcaacatcctgagctgcccagagaactgccctgtggagctgtacaacctgatgaggctgtgctggagcaagctgcctgctgaccggcccagcttcaccagcatccaccgcatcctggagaggatgtgtgaaagagctgagggcaccgtgtctgtgtag

SEQ ID NO: 160403 - DNA, 570 bp, Artificial Sequence
  Description of Artificial Sequence: Synthetic coding sequence
atggctggaaatggaagagaggacccccagaggaccctgcagatcagagatgcctttgctgtgcgggccaggatgcagcaggccagccagcacgccctgggcccccacggcctgtgccagacagccaccagccgggagagcgctgctgtgaccctgaccaccctgcccagcgagctgctgctggaccggctgcaccccaaccccatgtaccagaggatgcccctgctgctgaaccccaagctgctgagcctggagtaccccaggaacaacattgaatatgtgcgggacattggagagggcgccttcggccgggtcttccaggcccgggcccctggcctgctgccctatgagcccttcaccatggtggccgtgaagatgctgaaggaggaggccagcgctgacatgcaggccgacttccagcgggaggccgccctgatggccgagtttgacaaccccaacatcgtgaagctgctgggcatgaagatccaggtgcgcatctgcatcagcagtgaaaatagaggcttccccagcttcagccccctggtgcgggccttctccttcagcccctag

SEQ ID NO: 160404 - DNA, 351 bp, Artificial Sequence
  Description of Artificial Sequence: Synthetic coding sequence
atgaagcccaagatcacccggccccccatcaacgtgaagatcatcgagggcctgaaggctgtgctgccctgcaccaccatgggcaaccccaagcccagcgtgtcctggatcaagggggacagccccctgcgggagaacagcagaattgctgtgctggagagcggcagcctgcgcatccacaacgtgcagaaggaggatgctggccagtaccgctgtgtggccaagaacagcctgggcacagcctacagcaaggtggtgaagctggaggtggagggcgccaagggcatccacacccagtttgtggccagcgccctgcagctgcgctccttcctgagctgcccccagatctag

SEQ ID NO: 160405 - DNA, 351 bp, Artificial Sequence; identical to SEQ ID NO: 160404
  Description of Artificial Sequence: Synthetic coding sequence

SEQ ID NO: 160406 - DNA, 570 bp, Artificial Sequence; identical to SEQ ID NO: 160403
  Description of Artificial Sequence: Synthetic coding sequence

SEQ ID NO: 160407 - DNA, 2352 bp, Artificial Sequence
  Description of Artificial Sequence: Synthetic coding sequence
atgagggagctggtgaacatccccctggtgcacatcctgaccctggtggccttctctggaacagagaagctgcccaaggcccctgtgatcaccacccccctggagaccgtggatgccctggtggaggaggtggccaccttcatgtgtgctgtggagagctacccccagcctgagatctcctggaccaggaacaagatcctgatcaagctgtttgacacccgctacagcatcagagaaaatggccagctgctgaccatcctgtctgtggaggacagtgatgatggcatctactgctgcacagccaacaatggagtgggcggcgctgtggagagctgtggggccctgcaggtgaagatgaagcccaagatcacccggccccccatcaacgtgaagatcatcgagggcctgaaggctgtgctgccctgcaccaccatgggcaaccccaagcccagcgtgtcctggatcaagggggacagccccctgcgggagaacagcagaattgctgtgctggagagcggcagcctgcgcatccacaacgtgcagaaggaggatgctggccagtaccgctgtgtggccaagaacagcctgggcacagcctacagcaaggtggtgaagctggaggtggaggaggagagcgagcctgagcaggacaccaaggtgtttgcccgcatcctgcgggcccctgagagccacaacgtgaccttcggcagctttgtgaccctgcactgcacagccaccggcatccctgtgcccaccatcacctggattgaaaatggaaatgctgtgagcagcggcagcatccaggagagcgtgaaggacagagtcatcgacagccggctgcagctgttcatcaccaagccaggcctgtacacctgcatcgccaccaacaagcacggggagaagttcagcacagccaaggccgccgccaccatcagcattgctgacttccgggagtactgcctggccgtgaaggagctgttctgtgccaaggagtggctggtgatggaggagaagacccaccggggcctgtacagaagtgagatgcacctgctgtctgtgcctgaatgttccaagctgcccagcatgcactgggaccccacagcctgtgcccggctgccccacctggccttcccccccatgaccagcagcaagcccagcgtggacatccccaacctgcccagcagcagcagcagcagcttctctgtgagccccacctacagcatgaccgtcatcatcagcatcatgagcagctttgccatctttgtgctgctgaccatcaccaccctgtactgctgcagaagaaggaagcagtggaagaacaagaagcgggagagcgctgctgtgaccctgaccaccctgcccagcgagctgctgctggaccggctgcaccccaaccccatgtaccagaggatgcccctgctgctgaaccccaagctgctgagcctggagtaccccaggaacaacattgaatatgtgcgggacattggagagggcgccttcggccgggtcttccaggcccgggcccctggcctgctgccctatgagcccttcaccatggtggccgtgaagatgctgaaggaggaggccagcgctgacatgcaggccgacttccagcgggaggccgccctgatggccgagtttgacaaccccaacatcgtgaagctgctgggcgtgtgtgctgtgggcaagcccatgtgcctgctgtttgagtacatggcctacggggacctgaatgagttcctgcgctccatgagcccccacacagtgtgcagcctgagccacagcgacctgtccatgagggcccaggtgagcagccctggccccccacccctgagctgtgccgagcagctgtgcatcgcccggcaggtggccgccggcatggcctacctgtctgagaggaagtttgtgcaccgggacctggccaccaggaactgcctggtgggggagaacatggtggtgaagattgctgactttggcctgagcaggaacatctacagcgctgactactacaaggccaatgaaaatgatgccatccccatccgctggatgcctcctgagagcatcttctacaaccgctacaccacagaaagtgatgtgtgggcctacggcgtggtgctgtgggagatcttctcctatggcctgcagccctactacggcatggcccacgaggaggtgatctactacgtgagagatggcaacatcctgagctgcccagagaactgccctgtggagctgtacaacctgatgaggctgtgctggagcaagctgcctgctgaccggcccagcttcaccagcatccaccgcatcctggagaggatgtgtgaaagagctgagggcaccgtgtctgtgtag

SEQ ID NO: 160408 - DNA, 2610 bp, Artificial Sequence
  Description of Artificial Sequence: Synthetic coding sequence
atgagggagctggtgaacatccccctggtgcacatcctgaccctggtggccttctctggaacagagaagctgcccaaggcccctgtgatcaccacccccctggagaccgtggatgccctggtggaggaggtggccaccttcatgtgtgctgtggagagctacccccagcctgagatctcctggaccaggaacaagatcctgatcaagctgtttgacacccgctacagcatcagagaaaatggccagctgctgaccatcctgtctgtggaggacagtgatgatggcatctactgctgcacagccaacaatggagtgggcggcgctgtggagagctgtggggccctgcaggtgaagatgaagcccaagatcacccggccccccatcaacgtgaagatcatcgagggcctgaaggctgtgctgccctgcaccaccatgggcaaccccaagcccagcgtgtcctggatcaagggggacagccccctgcgggagaacagcagaattgctgtgctggagagcggcagcctgcgcatccacaacgtgcagaaggaggatgctggccagtaccgctgtgtggccaagaacagcctgggcacagcctacagcaaggtggtgaagctggaggtggaggtgtttgcccgcatcctgcgggcccctgagagccacaacgtgaccttcggcagctttgtgaccctgcactgcacagccaccggcatccctgtgcccaccatcacctggattgaaaatggaaatgctgtgagcagcggcagcatccaggagagcgtgaaggacagagtcatcgacagccggctgcagctgttcatcaccaagccaggcctgtacacctgcatcgccaccaacaagcacggggagaagttcagcacagccaaggccgccgccaccatcagcattgctgagtggagcaagccccagaaggacaacaagggctactgtgcccagtacagaggagaggtgtgcaatgctgtgctggccaaggatgccctggtgttcctgaacaccagctatgctgaccctgaggaggcccaggagctgctggtgcacacagcctggaatgagctgaaggtggtgtcccctgtgtgcaggcctgctgctgaggccctgctgtgcaaccacatcttccaggagtgcagccctggggtggtgcccacccccatccccatctgccgggagtactgcctggccgtgaaggagctgttctgtgccaaggagtggctggtgatggaggagaagacccaccggggcctgtacagaagtgagatgcacctgctgtctgtgcctgaatgttccaagctgcccagcatgcactgggaccccacagcctgtgcccggctgccccacctggactacaacaaggagaacctgaagaccttcccccccatgaccagcagcaagcccagcgtggacatccccaacctgcccagcagcagcagcagcagcttctctgtgagccccacctacagcatgaccgtcatcatcagcatcatgagcagctttgccatctttgtgctgctgaccatcaccaccctgtactgctgcagaagaaggaagcagtggaagaacaagaagcgggagagcgctgctgtgaccctgaccaccctgcccagcgagctgctgctggaccggctgcaccccaaccccatgtaccagaggatgcccctgctgctgaaccccaagctgctgagcctggagtaccccaggaacaacattgaatatgtgcgggacattggagagggcgccttcggccgggtcttccaggcccgggcccctggcctgctgccctatgagcccttcaccatggtggccgtgaagatgctgaaggaggaggccagcgctgacatgcaggccgacttccagcgggaggccgccctgatggccgagtttgacaaccccaacatcgtgaagctgctgggcgtgtgtgctgtgggcaagcccatgtgcctgctgtttgagtacatggcctacggggacctgaatgagttcctgcgctccatgagcccccacacagtgtgcagcctgagccacagcgacctgtccatgagggcccaggtgagcagccctggccccccacccctgagctgtgccgagcagctgtgcatcgcccggcaggtggccgccggcatggcctacctgtctgagaggaagtttgtgcaccgggacctggccaccaggaactgcctggtgggggagaacatggtggtgaagattgctgactttggcctgagcaggaacatctacagcgctgactactacaaggccaatgaaaatgatgccatccccatccgctggatgcctcctgagagcatcttctacaaccgctacaccacagaaagtgatgtgtgggcctacggcgtggtgctgtgggagatcttctcctatggcctgcagccctactacggcatggcccacgaggaggtgatctactacgtgagagatggcaacatcctgagctgcccagagaactgccctgtggagctgtacaacctgatgaggctgtgctggagcaagctgcctgctgaccggcccagcttcaccagcatccaccgcatcctggagaggatgtgtgaaagagctgagggcaccgtgtctgtgtag

SEQ ID NO: 160409 - DNA, 2604 bp, Artificial Sequence
  Description of Artificial Sequence: Synthetic coding sequence
atgagggagctggtgaacatccccctggtgcacatcctgaccctggtggccttctctggaacagagaagctgcccaaggcccctgtgatcaccacccccctggagaccgtggatgccctggtggaggaggtggccaccttcatgtgtgctgtggagagctacccccagcctgagatctcctggaccaggaacaagatcctgatcaagctgtttgacacccgctacagcatcagagaaaatggccagctgctgaccatcctgtctgtggaggacagtgatgatggcatctactgctgcacagccaacaatggagtgggcggcgctgtggagagctgtggggccctgcaggtgaagatgaagcccaagatcacccggccccccatcaacgtgaagatcatcgagggcctgaaggctgtgctgccctgcaccaccatgggcaaccccaagcccagcgtgtcctggatcaagggggacagccccctgcgggagaacagcagaattgctgtgctggagagcggcagcctgcgcatccacaacgtgcagaaggaggatgctggccagtaccgctgtgtggccaagaacagcctgggcacagcctacagcaaggtggtgaagctggaggtggaggtgtttgcccgcatcctgcgggcccctgagagccacaacgtgaccttcggcagctttgtgaccctgcactgcacagccaccggcatccctgtgcccaccatcacctggattgaaaatggaaatgctgtgagcagcggcagcatccaggagagcgtgaaggacagagtcatcgacagccggctgcagctgttcatcaccaagccaggcctgtacacctgcatcgccaccaacaagcacggggagaagttcagcacagccaaggccgccgccaccatcagcattgctgagatgctgttcatcagcagcttcagcaagccccagaaggacaacaagggctactgtgcccagtacagaggagaggtgtgcaatgctgtgctggccaaggatgccctggtgttcctgaacaccagctatgctgaccctgaggaggcccaggagctgctggtgcacacagcctggaatgagctgaaggtggtgtcccctgtgtgcaggcctgctgctgaggccctgctgtgcaaccacatcttccaggagtgcagccctggggtggtgcccacccccatccccatctgccgggagtactgcctggccgtgaaggagctgttctgtgccaaggagtggctggtgatggaggagaagacccaccggggcctgtacagaagtgagatgcacctgctgtctgtgcctgaatgttccaagctgcccagcatgcactgggaccccacagcctgtgcccggctgccccacctggccttcccccccatgaccagcagcaagcccagcgtggacatccccaacctgcccagcagcagcagcagcagcttctctgtgagccccacctacagcatgaccgtcatcatcagcatcatgagcagctttgccatctttgtgctgctgaccatcaccaccctgtactgctgcagaagaaggaagcagtggaagaacaagaagcgggagagcgctgctgtgaccctgaccaccctgcccagcgagctgctgctggaccggctgcaccccaaccccatgtaccagaggatgcccctgctgctgaaccccaagctgctgagcctggagtaccccaggaacaacattgaatatgtgcgggacattggagagggcgccttcggccgggtcttccaggcccgggcccctggcctgctgccctatgagcccttcaccatggtggccgtgaagatgctgaaggaggaggccagcgctgacatgcaggccgacttccagcgggaggccgccctgatggccgagtttgacaaccccaacatcgtgaagctgctgggcgtgtgtgctgtgggcaagcccatgtgcctgctgtttgagtacatggcctacggggacctgaatgagttcctgcgctccatgagcccccacacagtgtgcagcctgagccacagcgacctgtccatgagggcccaggtgagcagccctggccccccacccctgagctgtgccgagcagctgtgcatcgcccggcaggtggccgccggcatggcctacctgtctgagaggaagtttgtgcaccgggacctggccaccaggaactgcctggtgggggagaacatggtggtgaagattgctgactttggcctgagcaggaacatctacagcgctgactactacaaggccaatgaaaatgatgccatccccatccgctggatgcctcctgagagcatcttctacaaccgctacaccacagaaagtgatgtgtgggcctacggcgtggtgctgtgggagatcttctcctatggcctgcagccctactacggcatggcccacgaggaggtgatctactacgtgagagatggcaacatcctgagctgcccagagaactgccctgtggagctgtacaacctgatgaggctgtgctggagcaagctgcctgctgaccggcccagcttcaccagcatccaccgcatcctggagaggatgtgtgaaagagctgagggcaccgtgtctgtgtag

SEQ ID NO: 160410 - DNA, 2610 bp, Artificial Sequence
  Description of Artificial Sequence: Synthetic coding sequence
atgagggagctggtgaacatccccctggtgcacatcctgaccctggtggccttctctggaacagagaagctgcccaaggcccctgtgatcaccacccccctggagaccgtggatgccctggtggaggaggtggccaccttcatgtgtgctgtggagagctacccccagcctgagatctcctggaccaggaacaagatcctgatcaagctgtttgacacccgctacagcatcagagaaaatggccagctgctgaccatcctgtctgtggaggacagtgatgatggcatctactgctgcacagccaacaatggagtgggcggcgctgtggagagctgtggggccctgcaggtgaagatgaagcccaagatcacccggccccccatcaacgtgaagatcatcgagggcctgaaggctgtgctgccctgcaccaccatgggcaaccccaagcccagcgtgtcctggatcaagggggacagccccctgcgggagaacagcagaattgctgtgctggagagcggcagcctgcgcatccacaacgtgcagaaggaggatgctggccagtaccgctgtgtggccaagaacagcctgggcacagcctacagcaaggtggtgaagctggaggtggaggtgtttgcccgcatcctgcgggcccctgagagccacaacgtgaccttcggcagctttgtgaccctgcactgcacagccaccggcatccctgtgcccaccatcacctggattgaaaatggaaatgctgtgagcagcggcagcatccaggagagcgtgaaggacagagtcatcgacagccggctgcagctgttcatcaccaagccaggcctgtacacctgcatcgccaccaacaagcacggggagaagttcagcacagccaaggccgccgccaccatcagcattgctgccttcagcaagccccagaaggacaacaagggctactgtgcccagtacagaggagaggtgtgcaatgctgtgctggccaaggatgccctggtgttcctgaacaccagctatgctgaccctgaggaggcccaggagctgctggtgcacacagcctggaatgagctgaaggtggtgtcccctgtgtgcaggcctgctgctgaggccctgctgtgcaaccacatcttccaggagtgcagccctggggtggtgcccacccccatccccatctgccgggagtactgcctggccgtgaaggagctgttctgtgccaaggagtggctggtgatggaggagaagacccaccggggcctgtacagaagtgagatgcacctgctgtctgtgcctgaatgttccaagctgcccagcatgcactgggaccccacagcctgtgcccggctgccccacctggactacaacaaggagaacctgaagaccttcccccccatgaccagcagcaagcccagcgtggacatccccaacctgcccagcagcagcagcagcagcttctctgtgagccccacctacagcatgaccgtcatcatcagcatcatgagcagctttgccatctttgtgctgctgaccatcaccaccctgtactgctgcagaagaaggaagcagtggaagaacaagaagcgggagagcgctgctgtgaccctgaccaccctgcccagcgagctgctgctggaccggctgcaccccaaccccatgtaccagaggatgcccctgctgctgaaccccaagctgctgagcctggagtaccccaggaacaacattgaatatgtgcgggacattggagagggcgccttcggccgggtcttccaggcccgggcccctggcctgctgccctatgagcccttcaccatggtggccgtgaagatgctgaaggaggaggccagcgctgacatgcaggccgacttccagcgggaggccgccctgatggccgagtttgacaaccccaacatcgtgaagctgctgggcgtgtgtgctgtgggcaagcccatgtgcctgctgtttgagtacatggcctacggggacctgaatgagttcctgcgctccatgagcccccacacagtgtgcagcctgagccacagcgacctgtccatgagggcccaggtgagcagccctggccccccacccctgagctgtgccgagcagctgtgcatcgcccggcaggtggccgccggcatggcctacctgtctgagaggaagtttgtgcaccgggacctggccaccaggaactgcctggtgggggagaacatggtggtgaagattgctgactttggcctgagcaggaacatctacagcgctgactactacaaggccaatgaaaatgatgccatccccatccgctggatgcctcctgagagcatcttctacaaccgctacaccacagaaagtgatgtgtgggcctacggcgtggtgctgtgggagatcttctcctatggcctgcagccctactacggcatggcccacgaggaggtgatctactacgtgagagatggcaacatcctgagctgcccagagaactgccctgtggagctgtacaacctgatgaggctgtgctggagcaagctgcctgctgaccggcccagcttcaccagcatccaccgcatcctggagaggatgtgtgaaagagctgagggcaccgtgtctgtgtag

SEQ ID NO: 160411 - DNA, 2352 bp, Artificial Sequence
  Description of Artificial Sequence: Synthetic coding sequence
atgagggagctggtgaacatccccctggtgcacatcctgaccctggtggccttctctggaacagagaagctgcccaaggcccctgtgatcaccacccccctggagaccgtggatgccctggtggaggaggtggccaccttcatgtgtgctgtggagagctacccccagcctgagatctcctggaccaggaacaagatcctgatcaagctgtttgacacccgctacagcatcagagaaaatggccagctgctgaccatcctgtctgtggaggacagtgatgatggcatctactgctgcacagccaacaatggagtgggcggcgctgtggagagctgtggggccctgcaggtgaagatgaagcccaagatcacccggccccccatcaacgtgaagatcatcgagggcctgaaggctgtgctgccctgcaccaccatgggcaaccccaagcccagcgtgtcctggatcaagggggacagccccctgcgggagaacagcagaattgctgtgctggagagcggcagcctgcgcatccacaacgtgcagaaggaggatgctggccagtaccgctgtgtggccaagaacagcctgggcacagcctacagcaaggtggtgaagctggaggtggaggaggagagcgagcctgagcaggacaccaaggtgtttgcccgcatcctgcgggcccctgagagccacaacgtgaccttcggcagctttgtgaccctgcactgcacagccaccggcatccctgtgcccaccatcacctggattgaaaatggaaatgctgtgagcagcggcagcatccaggagagcgtgaaggacagagtcatcgacagccggctgcagctgttcatcaccaagccaggcctgtacacctgcatcgccaccaacaagcacggggagaagttcagcacagccaaggccgccgccaccatcagcattgctgcctggaagaagtactgcctggccgtgaaggagctgttctgtgccaaggagtggctggtgatggaggagaagacccaccggggcctgtacagaagtgagatgcacctgctgtctgtgcctgaatgttccaagctgcccagcatgcactgggaccccacagcctgtgcccggctgccccacctggccttcccccccatgaccagcagcaagcccagcgtggacatccccaacctgcccagcagcagcagcagcagcttctctgtgagccccacctacagcatgaccgtcatcatcagcatcatgagcagctttgccatctttgtgctgctgaccatcaccaccctgtactgctgcagaagaaggaagcagtggaagaacaagaagcgggagagcgctgctgtgaccctgaccaccctgcccagcgagctgctgctggaccggctgcaccccaaccccatgtaccagaggatgcccctgctgctgaaccccaagctgctgagcctggagtaccccaggaacaacattgaatatgtgcgggacattggagagggcgccttcggccgggtcttccaggcccgggcccctggcctgctgccctatgagcccttcaccatggtggccgtgaagatgctgaaggaggaggccagcgctgacatgcaggccgacttccagcgggaggccgccctgatggccgagtttgacaaccccaacatcgtgaagctgctgggcgtgtgtgctgtgggcaagcccatgtgcctgctgtttgagtacatggcctacggggacctgaatgagttcctgcgctccatgagcccccacacagtgtgcagcctgagccacagcgacctgtccatgagggcccaggtgagcagccctggccccccacccctgagctgtgccgagcagctgtgcatcgcccggcaggtggccgccggcatggcctacctgtctgagaggaagtttgtgcaccgggacctggccaccaggaactgcctggtgggggagaacatggtggtgaagattgctgactttggcctgagcaggaacatctacagcgctgactactacaaggccaatgaaaatgatgccatccccatccgctggatgcctcctgagagcatcttctacaaccgctacaccacagaaagtgatgtgtgggcctacggcgtggtgctgtgggagatcttctcctatggcctgcagccctactacggcatggcccacgaggaggtgatctactacgtgagagatggcaacatcctgagctgcccagagaactgccctgtggagctgtacaacctgatgaggctgtgctggagcaagctgcctgctgaccggcccagcttcaccagcatccaccgcatcctggagaggatgtgtgaaagagctgagggcaccgtgtctgtgtag

SEQ ID NO: 160412 - DNA, 1167 bp, Artificial Sequence
  Description of Artificial Sequence: Synthetic coding sequence
atggctgtgtctgtgacccccatccgggacaccaagtggctgaccctggaggtgtgccgggagttccagaggggcacctgcagcaggccagacacagagtgcaagtttgcccaccccagcaagagctgccaggtggagaatggccgggtgattgcctgctttgacagcctgaagggccgctgcagccgggagaactgcaagtacctgcaccccccaccccacctgaagacccagctggagatcaatggaagaaacaacctgatccagcagaagaacatggccatgctggcccagcagatgcagctggccaatgccatgatgcctggggcccccctgcagcctgtgcccatgttttctgtggcccccagcctggccaccaatgccagcgctgctgccttcaacccctacctgggccctgtgagccccagcctggtgcctgctgagatcctgcccacagcccccatgctggtgacaggcaaccctggggtgcctgtgcctgctgctgctgctgctgctgcccagaagctgatgaggacagaccggctggaggtgtgccgggagtaccagaggggcaactgcaacagaggagaaaatgactgccgctttgcccaccctgctgacagcaccatgattgacaccaatgacaacacagtgacagtgtgcatggactacatcaagggccgctgcagccgggagaagtgcaagtacttccaccccccagcccacctgcaggccaagatcaaggccgcccagtaccaggtgaaccaggccgctgctgcccaggccgccgccacagctgctgccatgacccagagcgctgtgaagagcctgaagaggcccctggaggccacctttgacctgggcatcccccaggccgtgctgccccccctgcccaagaggcctgccctggagaagaccaatggagccacagctgtgttcaacacaggcatcttccagtaccagcaggccctggccaacatgcagctgcagcagcacacagccttcctgccccctgtgcccatggtgcatggagccaccccagccaccgtgtctgctgccaccaccagcgccacctctgtgccctttgctgccacagccacagccaaccagatccccatcatctctgctgagcacctgaccagccacaagtatgtgacccagatgtag

SEQ ID NO: 160413 - DNA, 909 bp, Artificial Sequence
  Description of Artificial Sequence: Synthetic coding sequence
atggctgtgtctgtgacccccatccgggacaccaagtggctgaccctggaggtgtgccgggagttccagaggggcacctgcagcaggccagacacagagtgcaagtttgcccaccccagcaagagctgccaggtggagaatggccgggtgattgcctgctttgacagcctgaagggccgctgcagccgggagaactgcaagtacctgcaccccccaccccacctgaagacccagctggagatcaatggaagaaacaacctgatccagcagaagaacatggccatgctggcccagcagatgcagctggccaatgccatgatgcctggggcccccctgcagcctgtggtgtgccgggagtaccagaggggcaactgcaacagaggagaaaatgactgccgctttgcccaccctgctgacagcaccatgattgacaccaatgacaacacagtgacagtgtgcatggactacatcaagggccgctgcagccgggagaagtgcaagtacttccaccccccagcccacctgcaggccaagatcaaggccgcccagtaccaggtgaaccaggccgctgctgcccaggccgccgccacagctgctgccatgggcatcccccaggccgtgctgccccccctgcccaagaggcctgccctggagaagaccaatggagccacagctgtgttcaacacaggcatcttccagtaccagcaggccctggccaacatgcagctgcagcagcacacagccttcctgccccctgtgcccatggtgcatggagccaccccagccaccgtgtctgctgccaccaccagcgccacctctgtgccctttgctgccacagccacagccaaccagatccccatcatctctgctgagcacctgaccagccacaagtatgtgacccagatgtag

SEQ ID NO: 160414 - DNA, 1023 bp, Artificial Sequence
  Description of Artificial Sequence: Synthetic coding sequence
atggctgtgtctgtgacccccatccgggacaccaagtggctgaccctggaggtgtgccgggagttccagaggggcacctgcagcaggccagacacagagtgcaagtttgcccaccccagcaagagctgccaggtggagaatggccgggtgattgcctgctttgacagcctgaagggccgctgcagccgggagaactgcaagtacctgcaccccccaccccacctgaagacccagctggagatcaatggaagaaacaacctgatccagcagaagaacatggccatgctggcccagcagatgcagctggccaatgccatgatgcctggggcccccctgcagcctgtgcccatgttttctgtggcccccagcctggccaccaatgccagcgctgctgccttcaacccctacctgggccctgtgagccccagcctggtgcctgctgagatcctgcccacagcccccatgctggtgacaggcaaccctggggtgcctgtgcctgctgctgctgctgctgctgcccagaagctgatgaggacagaccggctggaggtgtgccgggagtaccagaggggcaactgcaacagaggagaaaatgactgccgctttgcccaccctgctgacagcaccatgattgacaccaatgacaacacagtgacagtgtgcatggactacatcaagggccgctgcagccgggagaagtgcaagtacttccaccccccagcccacctgcaggccaagatcaaggccgcccagtaccaggtgaaccaggccgctgctgcccaggccgccgccacagctgctgccatgttcccctggtgcaccgtgctgcggcagcccctgtgcccccagcagcagcacctgccccaggtgttccccagcctgcagcagccccagcccaccagccccatcctggatgccagcaccctgctgggcgccaccagctgcccagctgctgctgggaagatgatccccatcatctctgctgagcacctgaccagccacaagtatgtgacccagatgtag

SEQ ID NO: 160415 - DNA, 1149 bp, Artificial Sequence
  Description of Artificial Sequence: Synthetic coding sequence
atggctgtgtctgtgacccccatccgggacaccaagtggctgaccctggaggtgtgccgggagttccagaggggcacctgcagcaggccagacacagagtgcaagtttgcccaccccagcaagagctgccaggtggagaatggccgggtgattgcctgctttgacagcctgaagggccgctgcagccgggagaactgcaagtacctgcaccccccaccccacctgaagacccagctggagatcaatggaagaaacaacctgatccagcagaagaacatggccatgctggcccagcagatgcagctggccaatgccatgatgcctggggcccccctgcagcctgtgcccatgttttctgtggcccccagcctggccaccaatgccagcgctgctgccttcaacccctacctgggccctgtgagccccagcctggtgcctgctgagatcctgcccacagcccccatgctggtgacaggcaaccctggggtgcctgtgcctgctgctgctgctgctgctgcccagaagctgatgaggacagaccggctggaggtgtgccgggagtaccagaggggcaactgcaacagaggagaaaatgactgccgctttgcccaccctgctgacagcaccatgattgacaccaatgacaacacagtgacagtgtgcatggactacatcaagggccgctgcagccgggagaagtgcaagtacttccaccccccagcccacctgcaggccaagatcaaggccgcccagtaccaggtgaaccaggccgctgctgcccaggccgccgccacagctgctgccatgggcatcccccaggccgtgctgccccccctgcccaagaggcctgccctggagaagaccaatggagccacagctgtgttcaacacaggcatcttccagtaccagcaggccctggccaacatgcagctgcagcagcacacagccttcctgcccccaggcagcatcctgtgcatgaccccagccacctctgtggtgcccatggtgcatggagccaccccagccaccgtgtctgctgccaccaccagcgccacctctgtgccctttgctgccacagccacagccaaccagatccccatcatctctgctgagcacctgaccagccacaagtatgtgacccagatgtag

SEQ ID NO: 160416 - DNA, 1113 bp, Artificial Sequence
  Description of Artificial Sequence: Synthetic coding sequence
atggctgtgtctgtgacccccatccgggacaccaagtggctgaccctggaggtgtgccgggagttccagaggggcacctgcagcaggccagacacagagtgcaagtttgcccaccccagcaagagctgccaggtggagaatggccgggtgattgcctgctttgacagcctgaagggccgctgcagccgggagaactgcaagtacctgcaccccccaccccacctgaagacccagctggagatcaatggaagaaacaacctgatccagcagaagaacatggccatgctggcccagcagatgcagctggccaatgccatgatgcctggggcccccctgcagcctgtgcccatgttttctgtggcccccagcctggccaccaatgccagcgctgctgccttcaacccctacctgggccctgtgagccccagcctggtgcctgctgagatcctgcccacagcccccatgctggtgacaggcaaccctggggtgcctgtgcctgctgctgctgctgctgctgcccagaagctgatgaggacagaccggctggaggtgtgccgggagtaccagaggggcaactgcaacagaggagaaaatgactgccgctttgcccaccctgctgacagcaccatgattgacaccaatgacaacacagtgacagtgtgcatggactacatcaagggccgctgcagccgggagaagtgcaagtacttccaccccccagcccacctgcaggccaagatcaaggccgcccagtaccaggtgaaccaggccgctgctgcccaggccgccgccacagctgctgccatgggcatcccccaggccgtgctgccccccctgcccaagaggcctgccctggagaagaccaatggagccacagctgtgttcaacacaggcatcttccagtaccagcaggccctggccaacatgcagctgcagcagcacacagccttcctgccccctgtgcccatggtgcatggagccaccccagccaccgtgtctgctgccaccaccagcgccacctctgtgccctttgctgccacagccacagccaaccagatccccatcatctctgctgagcacctgaccagccacaagtatgtgacccagatgtag

SEQ ID NO: 160417 - DNA, 1029 bp, Artificial Sequence
  Description of Artificial Sequence: Synthetic coding sequence
atggctgtgtctgtgacccccatccgggacaccaagtggctgaccctggaggtgtgccgggagttccagaggggcacctgcagcaggccagacacagagtgcaagtttgcccaccccagcaagagctgccaggtggagaatggccgggtgattgcctgctttgacagcctgaagggccgctgcagccgggagaactgcaagtacctgcaccccccaccccacctgaagacccagctggagatcaatggaagaaacaacctgatccagcagaagaacatggccatgctggcccagcagatgcagctggccaatgccatgatgcctggggcccccctgcagcctgtgcccatgttttctgtggcccccagcctggccaccaatgccagcgctgctgccttcaacccctacctgggccctgtgagccccagcctggtgcctgctgagatcctgcccacagcccccatgctggtgacaggcaaccctggggtgcctgtgcctgctgctgctgctgctgctgcccagaagctgatgaggacagaccggctggaggtgtgccgggagtaccagaggggcaactgcaacagaggagaaaatgactgccgctttgcccaccctgctgacagcaccatgattgacaccaatgacaacacagtgacagtgtgcatggactacatcaagggccgctgcagccgggagaagtgcaagtacttccaccccccagcccacctgcaggccaagatcaaggccgcccagtaccaggtgaaccaggccgctgctgcccaggccgccgccacagctgctgccatgggcatcccccaggccgtgctgccccccctgcccaagaggcctgccctggagaagaccaatggagccacagctgtgttcaacacaggcatcttccagtaccagcaggccctggccaacatgcagctgcagcagcacacagccttcctgcccccaggcagcatcctgtgcatgaccccagccacctctgtggacacccacaacatctgcaggaccagtgactag

SEQ ID NO: 160418 - DNA, 1167 bp, Artificial Sequence; identical to SEQ ID NO: 160412
  Description of Artificial Sequence: Synthetic coding sequence

SEQ ID NO: 160419 - DNA, 1023 bp, Artificial Sequence; identical to SEQ ID NO: 160414
  Description of Artificial Sequence: Synthetic coding sequence

SEQ ID NO: 160420 - DNA, 909 bp, Artificial Sequence; identical to SEQ ID NO: 160413
  Description of Artificial Sequence: Synthetic coding sequence

SEQ ID NO: 160421 - DNA, 1029 bp, Artificial Sequence; identical to SEQ ID NO: 160417
  Description of Artificial Sequence: Synthetic coding sequence

SEQ ID NO: 160422 - DNA, 1032 bp, Artificial Sequence
  Description of Artificial Sequence: Synthetic coding sequence
atgggccgctgcagccgggagaactgcaagtacctgcaccccccaccccacctgaagacccagctggagatcaatggaagaaacaacctgatccagcagaagaacatggccatgctggcccagcagatgcagctggccaatgccatgatgcctggggcccccctgcagcctgtgcccatgttttctgtggcccccagcctggccaccaatgccagcgctgctgccttcaacccctacctgggccctgtgagccccagcctggtgcctgctgagatcctgcccacagcccccatgctggtgactggaaatcctggggtgcctgtgcctgctgctgctgctgctgctgcccagaagctgatgaggacagaccggctggaggtgtgccgggagtaccagaggggcaactgcaacagaggagaaaatgactgccgctttgcccaccctgctgacagcaccatgattgacaccaatgacaacacagtgacagtgtgcatggactacatcaagggccgctgcagccgggagaagtgcaagtacttccaccccccagcccacctgcaggccaagatcaaggccgcccagtaccaggtgaaccaggccgccgccgcccaggccgccgccacagctgctgccatgacccagagcgctgtgaagagcctgaagaggcccctggaggccacctttgacctgggcatcccccaggccgtgctgccccccctgcccaagaggcctgccctggagaagaccaacggggccacagctgtgttcaacacaggcatcttccagtaccagcaggccctggccaacatgcagctgcagcagcacacagccttcctgcccccaggcagcatcctgtgcatgaccccagccacctctgtggtgcccatggtgcacggggccaccccagccaccgtgtctgctgccaccaccagcgccacctctgtgccctttgctgccacagccacagccaaccagatccccatcatctctgctgagcacctgaccagccacaagtatgtgacccagatgtag

SEQ ID NO: 160423 - DNA, 945 bp, Artificial Sequence
  Description of Artificial Sequence: Synthetic coding sequence
atggctgtgtctgtgacccccatccgggacaccaagtggctgaccctggaggtgtgccgggagttccagaggggcacctgcagcaggccagacacagagtgcaagtttgcccaccccagcaagagctgccaggtggagaatggccgggtgattgcctgctttgacagcctgaagggccgctgcagccgggagaactgcaagtacctgcaccccccaccccacctgaagacccagctggagatcaatggaagaaacaacctgatccagcagaagaacatggccatgctggcccagcagatgcagctggccaatgccatgatgcctggggcccccctgcagcctgtggtgtgccgggagtaccagaggggcaactgcaacagaggagaaaatgactgccgctttgcccaccctgctgacagcaccatgattgacaccaatgacaacacagtgacagtgtgcatggactacatcaagggccgctgcagccgggagaagtgcaagtacttccaccccccagcccacctgcaggccaagatcaaggccgcccagtaccaggtgaaccaggccgctgctgcccaggccgccgccacagctgctgccatgggcatcccccaggccgtgctgccccccctgcccaagaggcctgccctggagaagaccaatggagccacagctgtgttcaacacaggcatcttccagtaccagcaggccctggccaacatgcagctgcagcagcacacagccttcctgcccccaggcagcatcctgtgcatgaccccagccacctctgtggtgcccatggtgcatggagccaccccagccaccgtgtctgctgccaccaccagcgccacctctgtgccctttgctgccacagccacagccaaccagatccccatcatctctgctgagcacctgaccagccacaagtatgtgacccagatgtag

SEQ ID NO: 160424 - DNA, 1005 bp, Artificial Sequence
  Description of Artificial Sequence: Synthetic coding sequence
atgacagctgtgaatgtggccctgatccgggacaccaagtggctgaccctggaggtgtgccgggagttccagaggggcacctgcagcagagcagatgctgactgcaagtttgcccaccccccccgggtgtgccacgtggagaatggccgggtggtggcctgctttgacagcctgaagggccgctgcacccgggagaactgcaagtacctgcaccccccaccccacctgaagacccagctggagatcaatggaagaaacaacctgatccagcagaagacagctgctgccatgtttgcccagcagatgcagctgatgctgcagaatgcccagatgagcagcctgggcagcttccccatgacccccagcatcccagccaacccccccatggccttcaacccctacatcccccaccctggcatgggcctggtgcctgctgagctggtgcccaacacccctgtgctgatccctggcaacccccccctggccatgcctggagctgtgggccccaagctgatgagaagtgacaagctggaggtgtgccgggagttccagaggggcaactgcaccagaggagaaaatgactgccgctatgcccaccccacagatgcctccatgattgaggccagtgacaacacagtgaccatctgcatggactacatcaagggccgctgcagccgggagaagtgcaagtacttccaccccccagcccacctgcaggcccggctgaaggccgcccaccaccagatgaaccacagcgctgccagcgccatggccctgaccaacctgcagctgccccagcctgccttcatcccagctggccccatcctgtgcatggccccagccagcaacatcgtgcccatgatgcatggagccacccccaccaccgtgtctgctgccaccaccccagccacctctgtgccctttgctgcccccaccactggaaaccagatcccccagctgagcattgatgagctgaacagctccatgtttgtgtcccagatgtag

SEQ ID NO: 160425 - DNA, 777 bp, Artificial Sequence
  Description of Artificial Sequence: Synthetic coding sequence
atgtttgcccagcagatgcagctgatgctgcagaatgcccagatgagcagcctgggcagcttccccatgacccccagcatcccagccaacccccccatggccttcaacccctacatcccccaccctggcatgggcctggtgcctgctgagctggtgcccaacacccctgtgctgatccctggcaacccccccctggccatgcctggagctgtgggccccaagctgatgagaagtgacaagctggaggtgtgccgggagttccagaggggcaactgcaccagaggagaaaatgactgccgctatgcccaccccacagatgcctccatgattgaggccagtgacaacacagtgaccatctgcatggactacatcaagggccgctgcagccgggagaagtgcaagtacttccaccccccagcccacctgcaggcccggctgaaggccgcccaccaccagatgaaccacagcgctgccagcgccatggccctgcagcccggcaccctgcagctgatccccaagaggtctgccctggagaagcccaatggagccacccctgtgttcaaccccaccgtcttccactgccagcaggccctgaccaacctgcagctgccccagcctgccttcatcccagctggccccatcctgtgcatggccccagccagcaacatcgtgcccatgatgcacggggccacccccaccaccgtgtctgctgccaccaccccagccacctctgtgccctttgctgcccccaccaccggcaaccagctgaagttctag

SEQ ID NO: 160426 - DNA, 915 bp, Artificial Sequence
  Description of Artificial Sequence: Synthetic coding sequence
atggagcgggccagcaagaacctgaagggccgctgcacccgggagaactgcaagtacctgcaccccccaccccacctgaagacccagctggagatcaatggaagaaacaacctgatccagcagaagacagctgctgccatgtttgcccagcagatgcagctgatgctgcagaatgcccagatgagcagcctgggcagcttccccatgacccccagcatcccagccaacccccccatggccttcaacccctacatcccccaccctggcatgggcctggtgcctgctgagctggtgcccaacacccctgtgctgatccctggcaacccccccctggccatgcctggagctgtgggccccaagctgatgagaagtgacaagctggaggtgtgccgggagttccagaggggcaactgcaccagaggagaaaatgactgccgctatgcccaccccacagatgcctccatgattgaggccagtgacaacacagtgaccatctgcatggactacatcaagggccgctgcagccgggagaagtgcaagtacttccaccccccagcccacctgcaggcccggctgaaggccgcccaccaccagatgaaccacagcgctgccagcgccatggccctgcagcccggcaccctgcagctgatccccaagaggtctgccctggagaagcccaatggagccacccctgtgttcaaccccaccgtcttccactgccagcaggccctgaccaacctgcagctgccccagcctgccttcatcccagctggccccatcctgtgcatggccccagccagcaacatcgtgcccatgatgcacggggccacccccaccaccgtgtctgctgccaccaccccagccacctctgtgccctttgctgcccccaccaccggcaaccagctgaagttctag

SEQ ID NO: 160427 - DNA, 1065 bp, Artificial Sequence
  Description of Artificial Sequence: Synthetic coding sequence
atgacagctgtgaatgtggccctgatccgggacaccaagtggctgaccctggaggtgtgccgggagttccagaggggcacctgcagcagagcagatgctgactgcaagtttgcccaccccccccgggtgtgccacgtggagaatggccgggtggtggcctgctttgacagcctgaagggccgctgcacccgggagaactgcaagtacctgcaccccccaccccacctgaagacccagctggagatcaatggaagaaacaacctgatccagcagaagacagctgctgccatgtttgcccagcagatgcagctgatgctgcagaatgcccagatgagcagcctgggcagcttccccatgacccccagcatcccagccaacccccccatggccttcaacccctacatcccccaccctggcatgggcctggtgcctgctgagctggtgcccaacacccctgtgctgatccctggcaacccccccctggccatgcctggagctgtgggccccaagctgatgagaagtgacaagctggaggtgtgccgggagttccagaggggcaactgcaccagaggagaaaatgactgccgctatgcccaccccacagatgcctccatgattgaggccagtgacaacacagtgaccatctgcatggactacatcaagggccgctgcagccgggagaagtgcaagtacttccaccccccagcccacctgcaggcccggctgaaggccgcccaccaccagatgaaccacagcgctgccagcgccatggccctgcagcccggcaccctgcagctgatccccaagaggtctgccctggagaagcccaatggagccacccctgtgttcaaccccaccgtcttccactgccagcaggccctgaccaacctgcagctgccccagcctgccttcatcccagctggccccatcctgtgcatggccccagccagcaacatcgtgcccatgatgcacggggccacccccaccaccgtgtctgctgccaccaccccagccacctctgtgccctttgctgcccccaccaccggcaaccagctgaagttctag

SEQ ID NO: 160428 - DNA, 1029 bp, Artificial Sequence
  Description of Artificial Sequence: Synthetic coding sequence
atgacagctgtgaatgtggccctgatccgggacaccaagtggctgaccctggaggtgtgccgggagttccagaggggcacctgcagcagagcagatgctgactgcaagtttgcccaccccccccgggtgtgccacgtggagaatggccgggtggtggcctgctttgacagcctgaagggccgctgcacccgggagaactgcaagtacctgcaccccccaccccacctgaagacccagctggagatcaatggaagaaacaacctgatccagcagaagacagctgctgccatgtttgcccagcagatgcagctgatgctgcagaatgcccagatgagcagcctgggcagcttccccatgacccccagcatcccagccaacccccccatggccttcaacccctacatcccccaccctggcatgggcctggtgcctgctgagctggtgcccaacacccctgtgctgatccctggcaacccccccctggccatgcctggagctgtgggccccaagctgatgagaagtgacaagctggaggtgtgccgggagttccagaggggcaactgcaccagaggagaaaatgactgccgctatgcccaccccacagatgcctccatgattgaggccagtgacaacacagtgaccatctgcatggactacatcaagggccgctgcagccgggagaagtgcaagtacttccaccccccagcccacctgcaggcccggctgaaggccgcccaccaccagatgaaccacagcgctgccagcgccatggccctgcagcccggcaccctgcagctgatccccaagaggtctgccctggagaagcccaatggagccacccctgtgttcaaccccaccgtcttccactgccagcaggccctgaccaacctgcagctgccccagcctgccttcatcccagctgtgcccatgatgcacggggccacccccaccaccgtgtctgctgccaccaccccagccacctctgtgccctttgctgcccccaccaccggcaaccagctgaagttctag

SEQ ID NO: 160429 - DNA, 777 bp, Artificial Sequence; identical to SEQ ID NO: 160425
  Description of Artificial Sequence: Synthetic coding sequence

SEQ ID NO: 160430 - DNA, 672 bp, Artificial Sequence
  Description of Artificial Sequence: Synthetic coding sequence
atgtttgcccagcagatgcagctgatgctgcagaatgcccagatgagcagcctgggcagcttccccatgacccccagcatcccagccaacccccccatggccttcaacccctacatcccccaccctggcatgggcctggtgcctgctgagctggtgcccaacacccctgtgctgatccctggcaacccccccctggccatgcctggagctgtgggccccaagctgatgagaagtgacaagctggaggtgtgccgggagttccagaggggcaactgcaccagaggagaaaatgactgccgctatgcccaccccacagatgcctccatgattgaggccagtgacaacacagtgaccatctgcatggactacatcaagggccgctgcagccgggagaagtgcaagtacttccaccccccagcccacctgcaggcccggctgaaggccgcccaccaccagatgaaccacagcgctgccagcgccatggccctgcagcccggcaccctgcagctgatccccaagaggtctgccctggagaagcccaatggagccacccctgtgttcaaccccaccgtcttccactgccagcaggccctgaccaacctgcagctgccccagcctgccttcatcccagctggccccatcctgtgcatggccccagccagcaacatctag

SEQ ID NO: 160431 - DNA, 729 bp, Artificial Sequence
  Description of Artificial Sequence: Synthetic coding sequence
atgtttgcccagcagatgcagctgatgctgcagaatgcccagatgagcagcctgggcagcttccccatgacccccagcatcccagccaacccccccatggccttcaacccctacatcccccaccctggcatgggcctggtgcctgctgagctggtgcccaacacccctgtgctgatccctggcaacccccccctggccatgcctggagctgtgggccccaagctgatgagaagtgacaagctggaggtgtgccgggagttccagaggggcaactgcaccagaggagaaaatgactgccgctatgcccaccccacagatgcctccatgattgaggccagtgacaacacagtgaccatctgcatggactacatcaagggccgctgcagccgggagaagtgcaagtacttccaccccccagcccacctgcaggcccggctgaaggccgcccaccaccagatgaaccacagcgctgccagcgccatggccctgcagcccggcaccctgcagctgatccccaagaggtctgccctggagaagcccaatggagccacccctgtgttcaaccccaccgtcttccactgccagcaggccctgaccaacctgcagctgccccagcctgccttcatcccagctggccccatcctgtgcatggccccagccagcaacatcgtgcccatgatgcacggggccacccccaccaccgtgtctgctgccaccaccccagcctag

SEQ ID NO: 160432 - DNA, 453 bp, Artificial Sequence
  Description of Artificial Sequence: Synthetic coding sequence
atcaagggccgctgcagccgggagaagtgcaagtacttccaccccccagcccacctgcaggcccggctgaaggccgcccaccaccagatgaaccacagcgctgccagcgccatggccctgcagcccggcaccctgcagctgatccccaagaggtctgccctggagaagcccaacggggccacccctgtgttcaaccccaccgtcttccactgccagcaggccctgaccaacctgcagctgccccagcctgccttcatcccagctggccccatcctgtgcatggccccagccagcaacatcgtgcccatgatgcatggagccacccccaccaccgtgtctgctgccaccaccccagccacctctgtgccctttgctgcccccaccactggaaaccagatcccccagctgagcattgatgagctgaacagctccatgtttgtgtcccagatgtag

SEQ ID NO: 160433 - DNA, 879 bp, Artificial Sequence
  Description of Artificial Sequence: Synthetic coding sequence
atggagcgggccagcaagaacctgaagggccgctgcacccgggagaactgcaagtacctgcaccccccaccccacctgaagacccagctggagatcaatggaagaaacaacctgatccagcagaagacagctgctgccatgtttgcccagcagatgcagctgatgctgcagaatgcccagatgagcagcctgggcagcttccccatgacccccagcatcccagccaacccccccatggccttcaacccctacatcccccaccctggcatgggcctggtgcctgctgagctggtgcccaacacccctgtgctgatccctggcaacccccccctggccatgcctggagctgtgggccccaagctgatgagaagtgacaagctggaggtgtgccgggagttccagaggggcaactgcaccagaggagaaaatgactgccgctatgcccaccccacagatgcctccatgattgaggccagtgacaacacagtgaccatctgcatggactacatcaagggccgctgcagccgggagaagtgcaagtacttccaccccccagcccacctgcaggcccggctgaaggccgcccaccaccagatgaaccacagcgctgccagcgccatggccctgcagcccggcaccctgcagctgatccccaagaggtctgccctggagaagcccaatggagccacccctgtgttcaaccccaccgtcttccactgccagcaggccctgaccaacctgcagctgccccagcctgccttcatcccagctgtgcccatgatgcacggggccacccccaccaccgtgtctgctgccaccaccccagccacctctgtgccctttgctgcccccaccaccggcaaccagctgaagttctag

SEQ ID NO: 160434 - DNA, 1377 bp, Artificial Sequence
  Description of Artificial Sequence: Synthetic coding sequence
atggagctggagaagcgggagaagaggagcctgctgaacaagaacctggaggagaagctgactgtgtctgctgggggcagcgaggccaagcccctcatcttcacctttgtgcccaccgtgcggcggctgcccacccacacccagctggccgacaccagcaagttcctggtgaagatccctgaggagagcagtgacaagagccctgagaccgtgaacagaagcaagagcaatgactacctgaccctgaatgccggcagccagcaggagcgggaccaggccaagctgacctgccccagcgaggtgtctggcaccatcctgcaggagcgggagtttgaggccaacaagctgcagggcatgcagcagagcgacctcttcaaggccgagtatgtgctgattgtggacagcgagggggaggatgaagctgccagcaggaaggtggagcagggccccccaggcggcatcggcacagctgctgtgcggcccaagagcctggccatcagcagcagcctggtgtctgatgtggtgcggcccaagacccagggcacagacctgaagaccagcagccaccctgagatgctgcacggcatggccccccagcagaagcacggccagcagtacaagaccaagagcagctacaaggcctttgctgccatccccaccaacaccctgctgctggagcagaaggccctggatgagcccgccaagacagagagcgtgtccaaggacaacaccctggagccccctgtggagctgtacttccctgcccagctgcggcagcagacagaggagctgtgtgccaccatcgacaaggtgctgcaggacagcctgtccatgcacagcagtgacagccccagccgcagccccaagaccctgctgggcagtgacacagtgaagacccccaccaccctgcccagggctgctggccgggagaccaagtatgccaacctgagcagccccagcagcacagtgtctgagagccagctgaccaagccaggagtcatccggcctgtgcctgtgaagagccgcatcctgctgaagaaggaggaggaggtgtatgagcccaaccccttcagcaagtacctggaggacaacagcgacctcttcagcgagcaggatgtgacagtgccccccaagcctgtgtccctgcaccccctgtaccagaccaagctgtaccccccagccaagagcctgctgcacccccagaccctgagccacgccgactgcctggcccctggccccttcagccacctgtccttcagcctgagtgatgagcaggagaacagccacaccctgctgagccacaatgcctgcaacaagctgagccaccccatggtggccatccctgagcacgaggccctggacagcaaggagcagtag

SEQ ID NO: 160435 - DNA, 873 bp, Artificial Sequence
  Description of Artificial Sequence: Synthetic coding sequence
atgaccagctgcatcctgagcggcagcatccagaccaccccccaggtgtctgctgggggcagcgaggccaagcccctcatcttcacctttgtgcccaccgtgcggcggctgcccacccacacccagctggccgacaccagcaagttcctggtgaagatccctgaggagagcagtgacaagagccctgagaccgtgaacagaagcaagagcaatgactacctgaccctgaatgccggcagccagcaggagcgggaccaggccaagctgacctgccccagcgaggtgtctggcaccatcctgcaggagcgggagtttgaggccaacaagctgcagggcatgcagcagagcgacctcttcaaggccgagtatgtgctgattgtggacagcgagggggaggatgaagctgccagcaggaaggtggagcagggccccccaggcggcatcggcacagctgctgtgcggcccaagagcctggccatcagcagcagcctggtgtctgatgtggtgcggcccaagacccagggcacagacctgaagaccagcagccaccctgagatgctgcacggcatggccccccagcagaagcacggccagacccccaccaccctgcccagggctgctggccgggagaccaagtatgccaacctgagcagccccagcagcacagtgtctgagagccagctgaccaagccaggagtcatccggcctgtgcctgtgaagagccgcatcctgctgaagaaggaggaggaggtgtatgagcccaaccccttcagcaagtacctggaggacaacagcgacctcttcagcgagcagctgagccaccccatggtggccatccctgagcacgaggccctggacagcaaggagcagtag

SEQ ID NO: 160436 - DNA, 705 bp, Artificial Sequence
  Description of Artificial Sequence: Synthetic coding sequence
atgtgctcctggtacctgggctttgaatgtagcagcaagagcaatgactacctgaccctgaatgccggcagccagcaggagcgggaccaggccaagctgacctgccccagcgaggtgtctggcaccatcctgcaggagcgggagtttgaggccaacaagctgcagggcatgcagcagagcgacctcttcaaggccgagtatgtgctgattgtggacagcgagggggaggatgaagctgccagcaggaaggtggagcagggccccccaggcggcatcggcacagctgctgtgcggcccaagagcctggccatcagcagcagcctggtgtctgatgtggtgcggcccaagacccagggcacagacctgaagaccagcagccaccctgagatgctgcacggcatggccccccagcagaagcacggccagacccccaccaccctgcccagggctgctggccgggagaccaagtatgccaacctgagcagccccagcagcacagtgtctgagagccagctgaccaagccaggagtcatccggcctgtgcctgtgaagagccgcatcctgctgaagaaggaggaggaggtgtatgagcccaaccccttcagcaagtacctggaggacaacagcgacctcttcagcgagcagctgagccaccccatggtggccatccctgagcacgaggccctggacagcaaggagcagtag

SEQ ID NO: 160437 - DNA, 489 bp, Artificial Sequence
  Description of Artificial Sequence: Synthetic coding sequence
atgcagcagagcgacctcttcaaggccgagtatgtgctgattgtggacagcgagggggaggatgaagctgccagcaggaaggtggagcagggccccccaggcggcatcggcacagctgctgtgcggcccaagagcctggccatcagcagcagcctggtgtctgatgtggtgcggcccaagacccagggcacagacctgaagaccagcagccaccctgagatgctgcacggcatggccccccagcagaagcacggccagcagtacaagaccaagagcagctacaaggcctttgctgccatccccaccaacaccctgctgctggagcagaaggccctggatgagcccgccaagacagagagcgtgtccaaggacaacaccctggagccccctgtggagacccccaccaccctgcccagggctgctggccgggagaccaagtatgccaacctgagcagccccagcagcacagtgtctgagagccagctgtag

SEQ ID NO: 160438 - DNA, 2208 bp, Artificial Sequence
  Description of Artificial Sequence: Synthetic coding sequence
atggctgctggaggagctgtggccgccgcccctgagtgccgcctgctgccctatgccctgcacaagtggagcagcttcagcagcacctacctgcctgagaacatcctggtggacaagcccaatgaccagagcagccgctggagcagcgagagcaactacccaccccagtacctgatcctgaagctggagaggcctgccatcgtgcagaacatcaccttcggcaagtatgagaagacccacgtgtgcaacctgaagaagttcaaggtgtttggaggcatgaatgaggagaacatgacagagctgctgagcagcggcctgaagaatgactacaacaaggagaccttcaccctgaagcacaagattgatgagcagatgttcccctgccgcttcatcaagatcgtgcccctgctgtcctggggccccagcttcaacttcagcatctggtacgtggagctgtctggaattgatgatcctgacatcgtgcagccctgcctgaactggtacagcaagtaccgggagcaggaggccatccggctgtgcctgaagcacttccggcagcacaactacacagaggcctttgagagcctgcagaagaagaccaagatcgccctggagcaccccatgctgacagacatccatgacaagctggtgctgaagggggactttgatgcctgtgaggagctgattgagaaggctgtgaatgatggcctcttcaaccagtacatcagccagcaggagtacaagccccgctggagccagatcatccccaagagcaccaagggagatggagaggacaaccggcccggcatgaggggcggccaccagatggtgattgatgtgcagacagagaccgtgtacctgtttggaggctgggatggcacccaggacctggccgacttctgggcctacagcgtgaaggagaaccagtggacctgcatcagccgggacacagagaaggaaaatggccccagcgcccggagctgccacaagatgtgcatcgacatccagaggcggcagatctacaccctgggccgctacctggacagctctgtgaggaacagcaagagcctgaagagtgacttctaccgctatgacatcgacaccaacacctggatgctgctgtctgaggacacagctgctgatggcggccccaagctggtgtttgaccaccagatgtgcatggacagcgagaagcacatgatctacaccttcggcggccgcatcctgacctgcaatggatctgtggatgacagccgggccagcgagccccagttcagcggcctgtttgccttcaactgccagtgccagacctggaagctgctgcgggaggacagctgcaatgccggccctgaggacatccagagcagaattggccactgcatgctgttccacagcaagaaccgctgcctgtatgtgtttggaggccagaggagcaagacctacctgaatgacttcttctcctatgatgtggacagcgaccacgtggacatcatcagtgatggcaccaagaaggacagcggcatggtgcccatgacaggcttcacccagagggccaccatcgaccctgagctgaatgagatccacgtgctgagcggcctgagcaaggacaaggagaagcgggaggagaatgtgagaaattccttctggatctatgacatcgtgagaaattcctggagctgtgtgtacaagaatgaccaggccgccaaggacaaccccaccaagagcctgcaggaggaggagccctgccccaggtttgcccaccagctggtgtatgatgagctgcacaaggtgcactacctgtttggaggcaaccctgggaagagctgcagccccaagatgaggctggatgacttctggagcctgaagctgtgccggcccagcaaggactacctgctgcggcactgcaagtacctgatcaggaagcacagatttgaggagaaggcccaggtggaccccctgagcgccctgaagtacctgcagaatgacctgtacatcaccgtggaccacagcgaccctgaggagaccaaggagttccagctgctggccagcgccctcttcaagagcggcagtgacttcaccgccctgggcttcagtgatgtggaccacacctacgcccagaggacccagctgtttgacaccctggtgaacttcttcccagacagcatgaccccacccaagggcaacctggtggacctgatcaccctgtag

SEQ ID NO: 160439 - DNA, 558 bp, Artificial Sequence
  Description of Artificial Sequence: Synthetic coding sequence
atgacaggcttcacccagagggccaccatcgaccctgagctgaatgagatccacgtgctgagcggcctgagcaaggacaaggagaagcgggaggagaatgtgagaaattccttctggatctatgacatcgtgagaaattcctggagctgtgtgtacaagaatgaccaggccgccaaggacaaccccaccaagagcctgcaggaggaggagccctgccccaggtttgcccaccagctggtgtatgatgagctgcacaaggtgcactacctgtttggaggcaaccctgggaagagctgcagccccaagatgaggctggatgacttctggagcctgaagctgtgccggcccagcaaggactacctgctgcggcactgcaagtacctgatcaggaagcacagatttgaggagaaggcccaggtggaccccctgagcgccctgaagtacctgcagaatgacctgtacatcaccgtggaccacagcgaccctgaggagaccaaggaggccttcctgatgtggatcacccccatgctgaaggagctgagcagcctgaccccctag

SEQ ID NO: 160440 - DNA, 3060 bp, Artificial Sequence
  Description of Artificial Sequence: Synthetic coding sequence
atgatggctgctgctgctgctgctgctgctggcagcagcagcagcggcggcggcggcggcggcagcggcagcagcagcagcagcagtgacaccagcagcactggagaggaggagaggatgagaagactcttccagacctgtgatggagatggagatggctacatcagcagaaatgacctgctgatggtgtgccggcagctgaacatggaggagagcgtggccgagatcatgaaccagctgggcgcagatgaaaatggcaagatctccttccaggacttcacccgctgcaggatgcagctggtgcgggagatcaggaaggaggaggtggacctgagcgccaagagtgacaacagctgcaccaagaagctgcgggacagaattgcctcctggcccaccagcagtgacaacagcctgggcgccctgtctgctgcccgggagagctgggagtatgacagcggggcccgggacctgcagagcccagatgtgcagagccagagcgccctgcagaagctgctggagtatggaggcagcagcctgcaccagcaggccgccctgcacaagctgctgacccagagcccccacatcggcaacagcgtgggcggcagctacctggagctggccaacaccctgcacagcgctgccctggccagcctgaagggggacatcgtggagctgaacaagaggctgcagcagacagagcgggagcgggacctgctggagaagaagctggccaaggcccagtgtgagcagagccacctgatgagggagcatgaagatgtgcaggagaggaccaccctgcgctatgaggagcgcatcacagagctgcacagcgtgattgctgagctgaacaagaagattgaccggctgcagggcaccaccatccgggaggaggatgagtacagcgagctgcggtctgagctgagccagagccagcacgaggtgaatgaagacagccgctccatggaccaggaccagacctctgtgtccatccctgagaaccagagcaccatggtgacagctgacatggacaactgcagcgacctgaacagcgagctgcagagggtgctgaccggcctggagaatgtggtgtgtggcaggaagaagagcagctgcagcctgtctgtggccgaggtggacaagcacatcgagcagctgaccacagccagcgagcactgtgacctggccatcaagacagtggaggagattgagggcgtgctgggccgggacctgtaccccaacctggccgaggagaggagccgctgggagaaggagctggccggcctgcgggaggagaatgaaagcctgacagccatgctgtgcagcaaggaggaggagctgaacagaaccaaggccaccatgaatgccatccgggaggagcgggaccggctgcggaggagagtgcgggagctgcagacccggctgcagagcgtgcaggccaccggccccagcagccctggccgcctgaccagcaccaaccggcccatcaaccccagcactggagagctgagcaccagcagcagcagcaatgacatccccatcgccaagattgctgagcgggtgaagctgagcaagaccaggtctgagagcagcagcagtgacaggcctgtgctgggcagcgagatcagcagcattggagtgagcagctctgtggccgagcacctggcccacagcctgcaggactgcagcaacatccaggagatcttccagaccctgtacagccacggcagcgccatcagcgagagcaagatccgggagtttgaggtggagacagagcggctgaacagcagaattgagcacctgaagagccagaatgacctgctgaccatcaccctggaggagtgcaagagcaatgctgagaggatgtccatgctggtgggcaagtatgagagcaatgccacagccctgcggctggccctgcagtacagcgagcagtgcatcgaggcctatgagctgctgctggccctggccgagagcgagcagagcctcatcctgggccagttccgggccgccggcgtgggcagcagccctggggaccagagcggagatgagaacatcacccagatgctgaagagggcccatgactgcaggaagacagcagaaaatgctgccaaggccctgctgatgaagctggatggcagctgtggcggggcctttgctgtggccggctgcagcgtgcagccctgggagagcctgagcagcaacagccacaccagcaccaccagcagcacagccagcagctgtgacacagagttcaccaaggaggatgagcagaggctgaaggactacatccagcagctgaagaatgacagagctgctgtgaagctgaccatgctggagctggagagcatccacatcgaccccctgtcctatgatgtgaagcccaggggggacagccagaggctggacctggagaatgctgtgctgatgcaggagctgatggccatgaaggaggagatggccgagctgaaggcccagctgtacctgctggagaaggagaagaaggccctggagctgaagctgagcacccgggaggcccaggagcaggcctacctggtgcacatcgagcacctgaagtctgaggtggaggagcagaaggagcagaggatgaggagcctgagcagcaccagcagcggcagcaaggacaagccaggcaaggaatgtgctgatgctgccagccctgccctgagcctggccgagctgcggaccacctgcagtgaaaatgagctggccgctgagttcaccaatgccatccggcgggagaagaagctgaaggcccgggtgcaggagctggtgtctgccctggagcggctgaccaagagcagcgagatccgccaccagcagagcgctgagtttgtgaatgacctgaagagggccaacagcaacctggtggccgcctatgagaaggccaagaagaagcaccagaacaagctgaagaagctggagagccagatgatggccatggtggagagacatgagacccaggtgaggatgctgaagcagagaattgccctgctggaggaggagaacagccggccccacaccaatgagaccagcctgtag

SEQ ID NO: 160441 - DNA, 564 bp, Artificial Sequence
  Description of Artificial Sequence: Synthetic coding sequence
atgtctgggggcggcacagagacccctgtgggctgtgaggccgcccctgggggcggcagcaagaagagggacagcctgggcacagctggcagcgcccacctgatcatcaaggacctgggggagatccacagccggctgctggaccacaggcctgtgatccagggcgagacccgctactttgtgaaggagtttgaggagaagaggggcctgcgggagatgagggtgctggagaacctgaagaacatgatccacgagaccaatgagcacaccctgcccaagtgccgggacaccatgagggacagcctgagccaggtgctgcagaggctgcaggccgccaatgattctgtgtgccgcctgcagcagcgggagcaggagaggaagaagatccacagcgaccacctggtggccagcgagaagcagcacatgctgcagtgggacaacttcatgaaggagcagcccaacaagagagctgaggtggatgaggagcacaggaaggccatggagcggctgaaggagcagtatgcagagatggagaaggacctggccaagttcagcaccttctag

SEQ ID NO: 160442 - DNA, 372 bp, Artificial Sequence
  Description of Artificial Sequence: Synthetic coding sequence
atggagaagaggggcctgcgggagatgagggtgctggagaacctgaagaacatgatccacgagaccaatgagcacaccctgcccaagtgccgggacaccatgagggacagcctgagccaggtgctgcagaggctgcaggccgccaatgattctgtgtgccgcctgcagcagcgggagcaggagaggaagaagatccacagcgaccacctggtggccagcgagaagcagcacatgctgcagtgggacaacttcatgaaggagcagcccaacaagagagctgaggtggatgaggagcacaggaaggccatggagcggctgaaggagcagtatgcagagatggagaaggacctggccaagttcagcaccttctag

SEQ ID NO: 160443 - DNA, 3987 bp, Artificial Sequence
  Description of Artificial Sequence: Synthetic coding sequence
atggagagccgggaccctgcccagcccatgagccctggagaggccacccagagcggggcccggcctgctgacagatatggcctgctgaagcacagccgggagttcctggacttcttctgggacatcgccaagccagagcaggagacccggctggccgccacagagaagctgctggagtacctgcggggccggcccaagggcagcgagatgaagtatgccctgaagaggctcatcaccggcctgggcgtgggccgggagacagcccggccctgctacagcctggccctggcccagctgctgcagagctttgaggacctgcccctgtgcagcatcctgcagcagatccaggagaagtatgacctgcaccaggtgaagaaggccatgctgcggcctgccctgtttgccaacctgtttggagtgctggccctcttccagagcggccgcctggtgaaggaccaggaggccctgatgaagtctgtgaagctgctgcaggccctggcccagtaccagaaccacctgcaggagcagcccaggaaggccctggtggacatcctgtctgaggtgtccaaggccaccctgcaggagatcctgcctgaggtgctgaaggctgacctgaacatcatcctgagcagccctgagcagctggagctgttcctgctggcccagcagaaggtgcccagcaagctgaagaagctggtgggctctgtgaacctcttcagtgatgaaaatgtgccccggctggtgaatgtgctgaagatggccgccagctctgtgaagaaggacaggaagctgcctgccatcgccctggacctgctgcggctggccctgaaggaggacaagttcccccgcttctggaaggaggtggtggagcagggcctgctgaagatgcagttctggccagccagctacctgtgcttccggctgctgggcgccgccctgcccctgctgaccaaggagcagctgcacctggtgatgcagggagatgtgatccgccactatggagagcacgtgtgcacagccaagctgcccaagcagttcaagtttgcccctgagatggatgattatgtgggcaccttcctggagggctgccaggatgatcctgagcggcagctggccgtgctggtggccttcagctctgtgaccaaccagggcctgcctgtgacccccaccttctggagggtggtgcgcttcctgagccccccagccctgcagggctacgtggcctggctgcgggccatgttcctgcagcctgacctggacagcctggtggacttcagcaccaacaaccagaagaaggcccaggacagcagcctgcacatgcctgagagagctgtgttccggctgaggaagtggatcatcttccggctggtgtccatcgtggacagcctgcacctggagatggaggaggccctgacagagcaggtggcccgcttctgcctcttccacagcttctttgtgaccaagaagcccaccagccagatccctgagaccaagcaccccttctccttccccctggagaaccaggcccgggaggccgtgtcctctgccttcttcagcctgctgcagaccctgagcacccagttcaagcaggcccctggccagacccagggcggccagccctggacctaccacctggtgcagtttgctgacctgctgctgaaccacagccacaacgtgaccaccgtgacccccttcaccgcccagcagaggcaggcctgggacaggatgctgcagaccctgaaggagctggaggcccacagcgctgaggcccgggctgctgccttccagcacctgctgctgctggtgggcatccacctgctgaagagccctgctgagagctgtgacctgctgggggacatccagacctgcatcaggaagagcctgggggagaagcccaggaggagcaggaccaagaccatcgacccccaggagcccccctgggtggaggtgctggtggagatcctgctggccctgctggcccagcccagccacctgatgaggcaggtggcccggtctgtgtttggccacatctgcagccacctgaccccccgggccctgcagctgatcctggatgtgctgaaccctgagaccagtgaagatgaaaatgacagagtggtggtgacagatgacagtgatgagcggcggctgaagggagctgaggacaagtctgaggagggggaggacaacagaagcagcgagagcgaggaggagagcgagggggaggagagcgaggaggaggagagagatggagatgtggaccagggcttccgggagcagctgatgacagtgctgcaggccggcaaggccctgggcggagaagattctgaaaatgaggaggagctgggagatgaggccatgatggccctggaccagagcctggccagcctgtttgctgagcagaagctgcgcatccaggccaggagagatgagaagaacaagctgcagaaggagaaggccctgcggcgggacttccagatccgggtgctggacctggtggaggtgctggtgaccaagcagccagaaaatgccctggtgctggagctgctggagcccctgctgagcatcatcagaagaagcctgcggagcagcagcagcaagcaggagcaggacctgctgcacaagacagcccgcatcttcacccaccacctgtgccgggcccggcgctactgccacgacctgggggagagagctggggccctgcacgcccaggtggagcggctggtgcagcaggccggccggcagcctgacagccccacagccctgtaccacttcaatgccagcctgtacctgctgcgggtgctgaagggcaacacagctgagggctgtgtgcatgagacccaggagaagcagaaggccggcacagaccccagccacatgcccaccggcccccaggccgccagctgcctggacctgaacctggtgaccagggtgtacagcacagccctgagcagcttcctgaccaagaggaacagccccctgactgtgcccatgttcctgagcctcttcagccgccaccctgtgctgtgccagagcctgctgcccatcctggtgcagcacatcactggacctgtgcggcccaggcaccaggcctgcctgctgctgcagaagaccctgtccatgagggaggtgcgcagctgctttgaggaccctgagtggaagcagctgatgggccaggtgctggccaaggtgacagagaacctgcgggtgctgggggaggcccagaccaaggcccagcaccagcaggccctgagcagcctggagctgctgaatgtgctcttccgcacctgcaagcatgagaagctgaccctggacctgactgtgctgctgggcgtgctgcagggccagcagcagagcctgcagcagggcgcccacagcacaggcagcagccggctgcatgacctgtactggcaggccatgaagaccctgggcgtgcagaggcccaagctggagaagaaggatgccaaggagatccccagcgccacccagagccccatcagcaagaagaggaagaagaagggcttcctgcctgagaccaagaagaggaagaagaggaagtcagaagatggcaccccagcagaagatggcaccccagctgccaccggcggcagccagcccccatccatgggcaggaagaagaggaacagaaccaaggccaaggtgcctgcccaggccaacggcacccccaccaccaagagccctgcccctggggcccccaccaggagccccagcaccccagccaagagccccaagctgcagaagaagaaccagaagcccagccaggtgaatggagcccctggcagccccacagagcccgccggccagaagcagcaccagaaggccctgcccaagaagggcgtgctgggcaagagccccctgagcgccctggccaggaagaaggcccggctgagcctggtgatccgcagccccagcctgctgcagagcggggccaagaagaaggcccaggtgaggaaggccggcaagccctag

SEQ ID NO: 160444 - DNA, 3999 bp, Artificial Sequence
  Description of Artificial Sequence: Synthetic coding sequence
atggagagccgggaccctgcccagcccatgagccctggagaggccacccagagcggggcccggcctgctgacagatatggcctgctgaagcacagccgggagttcctggacttcttctgggacatcgccaagccagagcaggagacccggctggccgccacagagaagctgctggagtacctgcggggccggcccaagggcagcgagatgaagtatgccctgaagaggctcatcaccggcctgggcgtgggccgggagacagcccggccctgctacagcctggccctggcccagctgctgcagagctttgaggacctgcccctgtgcagcatcctgcagcagatccaggagaagtatgacctgcaccaggtgaagaaggccatgctgcggcctgccctgtttgccaacctgtttggagtgctggccctcttccagagcggccgcctggtgaaggaccaggaggccctgatgaagtctgtgaagctgctgcaggccctggcccagtaccagaaccacctgcaggagcagcccaggaaggccctggtggacatcctgtctgaggtgtccaaggccaccctgcaggagatcctgcctgaggtgctgaaggctgacctgaacatcatcctgagcagccctgagcagctggagctgttcctgctggcccagcagaaggtgcccagcaagctgaagaagctggtgggctctgtgaacctcttcagtgatgaaaatgtgccccggctggtgaatgtgctgaagatggccgccagctctgtgaagaaggacaggaagctgcctgccatcgccctggacctgctgcggctggccctgaaggaggacaagttcccccgcttctggaaggaggtggtggagcagggcctgctgaagatgcagttctggccagccagctacctgtgcttccggctgctgggcgccgccctgcccctgctgaccaaggagcagctgcacctggtgatgcagggagatgtgatccgccactatggagagcacgtgtgcacagccaagctgcccaagcagttcaagtttgcccctgagatggatgattatgtgggcaccttcctggagggctgccaggatgatcctgagcggcagctggccgtgctggtggccttcagctctgtgaccaaccagggcctgcctgtgacccccaccttctggagggtggtgcgcttcctgagccccccagccctgcagggctacgtggcctggctgcgggccatgttcctgcagcctgacctggacagcctggtggacttcagcaccaacaaccagaagaaggcccaggacagcagcctgcacatgcctgagagagctgtgttccggctgaggaagtggatcatcttccggctggtgtccatcgtggacagcctgcacctggagatggaggaggccctgacagagcaggtggcccgcttctgcctcttccacagcttctttgtgaccaagaagcccaccagccagatccctgagaccaagcaccccttctccttccccctggagaaccaggcccgggaggccgtgtcctctgccttcttcagcctgctgcagaccctgagcacccagttcaagcaggcccctggccagacccagggcggccagccctggacctaccacctggtgcagtttgctgacctgctgctgaaccacagccacaacgtgaccaccgtgacccccttcaccgcccagcagaggcaggcctgggacaggatgctgcagaccctgaaggagctggaggcccacagcgctgaggcccgggctgctgccttccagcacctgctgctgctggtgggcatccacctgctgaagagccctgctgagagctgtgacctgctgggggacatccagacctgcatcaggaagagcctgggggagaagcccaggaggagcaggaccaagaccatcgacccccaggagcccccctgggtggaggtgctggtggagatcctgctggccctgctggcccagcccagccacctgatgaggcaggtggcccggtctgtgtttggccacatctgcagccacctgaccccccgggccctgcagctgatcctggatgtgctgaaccctgagaccagtgaagatgaaaatgacagagtggtggtgacagatgacagtgatgagcggcggctgaagggagctgaggacaagtctgaggagggggaggacaacagaagcagcgagagcgaggaggagagcgagggggaggagagcgaggaggaggagagagatggagatgtggaccagggcttccgggagcagctgatgacagtgctgcaggccggcaaggccctgggcggagaagattctgaaaatgaggaggagctgggagatgaggccatgatggccctggaccagagcctggccagcctgtttgctgagcagaagctgcgcatccaggccaggagagatgagaagaacaagctgcagaaggagaaggccctgcggcgggacttccagatccgggtgctggacctggtggaggtgctggtgaccaagcagccagaaaatgccctggtgctggagctgctggagcccctgctgagcatcatcagaagaagcctgcggagcagcagcagcaagcaggagcaggacctgctgcacaagacagcccgcatcttcacccaccacctgtgccgggcccggcgctactgccacgacctgggggagagagctggggccctgcacgcccaggtggagcggctggtgcagcaggccggccggcagcctgacagccccacagccctgtaccacttcaatgccagcctgtacctgctgcgggtgctgaagggcaacacagctgagggctgtgtgcatgagacccaggagaagcagaaggccggcacagaccccagccacatgcccaccggcccccaggccgccagctgcctggacctgaacctggtgaccagggtgtacagcacagccctgagcagcttcctgaccaagaggaacagccccctgactgtgcccatgttcctgagcctcttcagccgccaccctgtgctgtgccagagcctgctgcccatcctggtgcagcacatcactggacctgtgcggcccaggcaccaggcctgcctgctgctgcagaagaccctgtccatgagggaggtgcgcagctgctttgaggaccctgagtggaagcagctgatgggccaggtgctggccaaggtgacagagaacctgcgggtgctgggggaggcccagaccaaggcccagcaccagcaggccctgagcagcctggagctgctgaatgtgctcttccgcacctgcaagcatgagaagctgaccctggacctgactgtgctgctgggcgtgctgcagggccagcagcagagcctgcagcagggcgcccacagcacaggcagcagccggctgcatgacctgtactggcaggccatgaagaccctgggcgtgcagaggcccaagctggagaagaaggatgccaaggagatccccagcgccacccagagccccatcagcaagaagaggaagaagaagggcttcctgcctgagaccaagaagaggaagaagaggaagtcagaagatggcaccccagcagaagatggcaccccagctgccaccggcggcagccagcccccatccatgggcaggaagaagaggaacagaaccaaggccaaggtgcctgcccaggccaacggcacccccaccaccaagagccctgcccctggggcccccaccaggagccccagcaccccagccaagagccccaagctgcagaagaagaaccagaagcccagccaggtgaatggagcccctggcagccccacagagcccgccggccagaagcagcaccagaaggccctgcccaagaagggcgtgctgggcaagagccccctgagcgccctggccaggaagaaggcccggctgagcctggtgatccgcagccccagcctgctgcagagcggggccaagaagaaggcccagaccctgcgcttcaccatcagcagcagcaagaagtag

SEQ ID NO: 160445 - DNA, 1812 bp, Artificial Sequence
  Description of Artificial Sequence: Synthetic coding sequence
atggagagccgggaccctgcccagcccatgagccctggagaggccacccagagcggggcccggcctgctgacagatatggcctgctgaagcacagccgggagttcctggacttcttctgggacatcgccaagccagagcaggagacccggctggccgccacagagaagctgctggagtacctgcggggccggcccaagggcagcgagatgaagtatgccctgaagaggctcatcaccggcctgggcgtgggccgggagacagcccggccctgctacagcctggccctggcccagctgctgcagagctttgaggacctgcccctgtgcagcatcctgcagcagatccaggagaagtatgacctgcaccaggtgaagaaggccatgctgcggcctgccctgtttgccaacctgtttggagtgctggccctcttccagagcggccgcctggtgaaggaccaggaggccctgatgaagtctgtgaagctgctgcaggccctggcccagtaccagaaccacctgcaggagcagcccaggaaggccctggtggacatcctgtctgaggtgtccaaggccaccctgcaggagatcctgcctgaggtgctgaaggctgacctgaacatcatcctgagcagccctgagcagctggagctgttcctgctggcccagcagaaggtgcccagcaagctgaagaagctggtgggctctgtgaacctcttcagtgatgaaaatgtgccccggctggtgaatgtgctgaagatggccgccagctctgtgaagaaggacaggaagctgcctgccatcgccctggacctgctgcggctggccctgaaggaggacaagttcccccgcttctggaaggaggtggtggagcagggcctgctgaagatgcagttctggccagccagctacctgtgcttccggctgctgggcgccgccctgcccctgctgaccaaggagcagctgcacctggtgatgcagggagatgtgatccgccactatggagagcacgtgtgcacagccaagctgcccaagcagttcaagtttgcccctgagatggatgattatgtgggcaccttcctggagggctgccaggatgatcctgagcggcagctggccgtgctggtggccttcagctctgtgaccaaccagggcctgcctgtgacccccaccttctggagggtggtgcgcttcctgagccccccagccctgcagggctacgtggcctggctgcgggccatgttcctgcagcctgacctggacagcctggtggacttcagcaccaacaaccagaagaaggcccaggacagcagcctgcacatgcctgagagagctgtgttccggctgaggaagtggatcatcttccggctggtgtccatcgtggacagcctgcacctggagatggaggaggccctgacagagcaggtggcccgcttctgcctcttccacagcttctttgtgaccaagaagcccaccagccagatccctgagaccaagccccaggagaggtctgagggccctgcccagccccctcatgcccctgggggccctgagcggcccaagctggagaagaaggatgccaaggagatccccagcgcagaagatggcaccccagctgccaccggcggcagccagcccccatccatgggcaggaagaagaggaacagaaccaaggccaaggtgcctgcccaggccaacggcacccccaccaccaagagccctgcccctggggcccccaccaggagccccagcaccccagccaagagccccaagctgcagaagaaggcccaggtgaggaaggccggcaagccctag

SEQ ID NO: 160446 - DNA, 2487 bp, Artificial Sequence
  Description of Artificial Sequence: Synthetic coding sequence
atggctgctgaggaggctgatgtggacatcgagggagatgtggtggccgccgccggggcccagcccggcagcggggagaacacagcctctgtgctgcagaaggaccactacctggacagctcctggaggacagaaaatggcctcatcccctggaccctggacaacaccatcagcgaggagaacagagctgtgattgagaagatgctgctggaggaggagtactacctgagcaagaagagccagcctgagaaggtgtggctggaccagaaggaggatgacaagaagtacatgaagagcctgcagaagacagccaagatcatggtgcacagccccaccaagccagccagctacagcgtgaagtggaccatcgaggagaaggagctgtttgagcagggcctggccaagtttggccgccgctggaccaagatcagcaagctgattggcagcaggacagtgctgcaggtgaagagctatgcccggcagtacttcaagaacaaggtgaagtgtggcctggacaaggagacccccaaccagaagacaggccacaacctgcaggtgaagaatgaagataaaggcaccaaggcctggacccccagctgcctgcggggccgggctgaccccaacctgaatgctgtgaagattgagaagctgagtgatgatgaggaggtggacatcacagatgaggtggatgagctgagcagccagaccccccagaagaacagcagcagtgacctgctgctggacttccccaacagcaagatgcatgagaccaaccagggcgagttcatcaccagtgacagccaggaggccctcttcagcaagagcagccggggctgcctgcagaatgagaagcaggatgagaccctgagcagcagcgagatcaccctgtggacagagaagcagagcaatggagacaagaagagcattgagctgaatgaccagaagttcaatgaactcatcaagaactgcaacaagcatgatggccggggcatcatcgtggatgcccggcagctgcccagccctgagccctgtgagatccagaagaacctgaatgacaatgagatgctgttccacagctgccagatggtggaggagagccatgaggaggaggagctgaagcccccagagcaggagattgaaattgacaggaacatcatccaggaggaggagaagcaggccatccctgagttctttgagggccggcaggccaagaccccagagcgctacctgaagatccggaactacatcctggaccagtgggagatctgcaagcccaagtacctgaacaagacctctgtgcggcccggcctgaagaactgtggagatgtgaactgcatcggccgcatccacacctacctggagctgattggagccatcaactttggctgtgagcaggccgtgtacaaccggccccagacagtggacaaggtgcgcatccgggacaggaaggatgctgtggaggcctaccagctggcccagaggctgcagagcatgaggaccaggagaagaagagtgcgggacccctggggcaactggtgtgatgccaaggacctggagggccagacctttgagcacctgtctgctgaggagctggccaagaggcgggaggaggagaagggccggcctgtgaagagcctgaaggtgccccggcccaccaagagcagctttgaccccttccagctgatcccctgcaacttcttcagcgaggagaagcaggagcccttccaggtgaaggtggccagcgaggccctgctgatcatggacctgcacgcccacgtgtccatggccgaggtgattggcctgctgggcggccgctacagcgaggtggacaaggtggtggaggtgtgtgccgctgagccctgcaacagcctgagcacaggcctgcagtgtgagatggaccctgtgtcccagacccaggccagcgagaccctggccgtgcggggcttcagcgtcatcggctggtaccacagccacccagcctttgaccccaaccccagcctgcgggacatcgacacccaggccaagtaccagagctacttcagcagaggaggagccaagttcatcggcatgattgtgagcccctacaacagaaacaaccccctgccctacagccagatcacctgcctggtgatcagcgaggagatcagcccagatggcagctaccgcctgccctacaagtttgaggtgcagcagatgctggaggagccccagtggggcctggtgtttgagaagacccgctggatcatcgagaagtaccgcctgagccacagctctgtgcccatggacaagatcttccggcgggacagcgacctgacctgcctgcagaagctgctggagtgcatgaggaagaccctgagcaaggtgaccaactgcttcatggccgaggagttcctgacagaaattgagaacctcttcctgagcaactacaagagcaaccaggagaatggagtgacagaggagaactgcaccaaggagctgctgatgtag

SEQ ID NO: 160447 - DNA, 843 bp, Artificial Sequence
  Description of Artificial Sequence: Synthetic coding sequence
atgcccaagaaggccaagcccaccggcagcggcaaggaggagggccctgccccctgcaagcagatgaagctggaggccgccggcggccccagcgccctgaactttgacagccccagcagcctgtttgagagcctcatcagccccatcaagacagagaccttcttcaaggagttctgggagcagaagcccctgctgatccagagagatgatcctgccctggccacctactacggcagcctcttcaagctgacagacctgaagagcctgtgcagccggggcatgtactacggcagagatgtgaatgtgtgccgctgtgtgaatggcaagaagaaggtgctgaacaaggatggcaaggcccacttcctgcagctgaggaaggactttgaccagaagagggccaccatccagttccaccagccccagcgcttcaaggatgagctgtggaggatccaggagaagctggagtgctacttcggcagcctggtgggcagcaatgtgtacatcaccccagctggcagccagggcctgcccccccactatgatgatgtggaggtgttcatcctgcagctggagggggagaagcactggaggctgtaccaccccaccgtgcccctggcccgggagtacagcgtggaggccgaggagagaattggccggcctgtgcatgagttcatgctgaagccaggggacctgctgtacttcccccggggcaccatccaccaggccgacaccccagctggcctggcccacagcacccacgtgaccatcagcacctaccagaacaatgatgctggggccaggatgagaagatgtgacctgcgggccatcgccccccagaagtag

SEQ ID NO: 160448 - DNA, 1398 bp, Artificial Sequence
  Description of Artificial Sequence: Synthetic coding sequence
atgcccaagaaggccaagcccaccggcagcggcaaggaggagggccctgccccctgcaagcagatgaagctggaggccgccggcggccccagcgccctgaactttgacagccccagcagcctgtttgagagcctcatcagccccatcaagacagagaccttcttcaaggagttctgggagcagaagcccctgctgatccagagagatgatcctgccctggccacctactacggcagcctcttcaagctgacagacctgaagagcctgtgcagccggggcatgtactacggcagagatgtgaatgtgtgccgctgtgtgaatggcaagaagaaggtgctgaacaaggatggcaaggcccacttcctgcagctgaggaaggactttgaccagaagagggccaccatccagttccaccagccccagcgcttcaaggatgagctgtggaggatccaggagaagctggagtgctacttcggcagcctggtgggcagcaatgtgtacatcaccccagctggcagccagggcctgcccccccactatgatgatgtggaggtgttcatcctgcagctggagggggagaagcactggaggctgtaccaccccaccgtgcccctggcccgggagtacagcgtggaggccgaggagagaattggccggcctgtgcatgagttcatgctgaagccaggggacctgctgtacttcccccggggcaccatccaccaggccgacaccccagctggcctggcccacagcacccacgtgaccatcagcacctaccagaacaacagctggggagacttcctgctggacaccatcagcggcctggtgtttgacacagccaaggaggatgtggagctgaggacaggcatcccccggcagctgctgctgcaggtggagagcaccaccgtggccacccggcggctgagcggcttcctgcggaccctggccgaccggctggagggcaccaaggagctgctgagcagtgacatgaagaaggacttcatcatgcaccggctgcccccctacagcgctggagatggagctgagctgagcaccccaggcggcaagctgccccggctggacagcgtggtgcggctgcagttcaaggaccacatcgtgctgactgtgctgcctgaccaggaccagagtgatgaggcccaggagaagatggtgtacatctaccacagcctgaagaacagccgggagacccacatgatgggaaatgaggaggagacagagttccacggcctgcgcttccccctgagccacctggatgccctgaagcagatctggaacagccctgccatctctgtgaaggacctgaagctgaccacagatgaggagaaggagagcctggtgctgagcctgtggacagaatgtctcatccaggtggtgtag

SEQ ID NO: 160449 - DNA, 1395 bp, Artificial Sequence
  Description of Artificial Sequence: Synthetic coding sequence
atgcccaagaaggccaagcccaccggcagcggcaaggaggagggccctgccccctgcaagcagatgaagctggaggccgccggcggccccagcgccctgaactttgacagccccagcagcctgtttgagagcctcatcagccccatcaagacagagaccttcttcaaggagttctgggagcagaagcccctgctgatccagagagatgatcctgccctggccacctactacggcagcctcttcaagctgacagacctgaagagcctgtgcagccggggcatgtactacggcagagatgtgaatgtgtgccgctgtgtgaatggcaagaagaaggtgctgaacaaggatggcaaggcccacttcctgcagctgaggaaggactttgaccagaagagggccaccatccagttccaccagccccagcgcttcaaggatgagctgtggaggatccaggagaagctggagtgctacttcggcagcctggtgggcagcaatgtgtacatcaccccagctggcagccagggcctgcccccccactatgatgatgtggaggtgttcatcctgcagctggagggggagaagcactggaggctgtaccaccccaccgtgcccctggcccgggagtacagcgtggaggccgaggagagaattggccggcctgtgcatgagttcatgctgaagccaggggacctgctgtacttcccccggggcaccatccaccaggccgacaccccagctggcctggcccacagcacccacgtgaccatcagcacctaccagaacaacagctggggagacttcctgctggacaccatcagcggcctggtgtttgacacagccaaggaggatgtggagctgaggacaggcatcccccggcagctgctgctggtggagagcaccaccgtggccacccggcggctgagcggcttcctgcggaccctggccgaccggctggagggcaccaaggagctgctgagcagtgacatgaagaaggacttcatcatgcaccggctgcccccctacagcgctggagatggagctgagctgagcacccctgggggcaagctgccccggctggacagcgtggtgcggctgcagttcaaggaccacatcgtgctgactgtgctgcctgaccaggaccagagtgatgaggcccaggagaagatggtgtacatctaccacagcctgaagaacagccgggagacccacatgatgggaaatgaggaggagacagagttccacggcctgcgcttccccctgagccacctggatgccctgaagcagatctggaacagccctgccatctctgtgaaggacctgaagctgaccacagatgaggagaaggagagcctggtgctgagcctgtggacagagtgcctgatccaggtggtgtag

SEQ ID NO: 160450 - DNA, 1398 bp, Artificial Sequence; identical to SEQ ID NO: 160448
  Description of Artificial Sequence: Synthetic coding sequence

SEQ ID NO: 160451 - DNA, 636 bp, Artificial Sequence
  Description of Artificial Sequence: Synthetic coding sequence
atgctgctgcaggtgccctgcaacagctggggagacttcctgctggacaccatcagcggcctggtgtttgacacagccaaggaggatgtggagctgaggacaggcatcccccggcagctgctgctgcaggtggagagcaccaccgtggccacccggcggctgagcggcttcctgcggaccctggccgaccggctggagggcaccaaggagctgctgagcagtgacatgaagaaggacttcatcatgcaccggctgcccccctacagcgctggagatggagctgagctgagcaccccaggcggcaagctgccccggctggacagcgtggtgcggctgcagttcaaggaccacatcgtgctgactgtgctgcctgaccaggaccagagtgatgaggcccaggagaagatggtgtacatctaccacagcctgaagaacagccgggagacccacatgatgggaaatgaggaggagacagagttccacggcctgcgcttccccctgagccacctggatgccctgaagcagatctggaacagccctgccatctctgtgaaggacctgaagctgaccacagatgaggagaaggagagcctggtgctgagcctgtggacagaatgtctcatccaggtggtgtag

SEQ ID NO: 160452 - DNA, 339 bp, Artificial Sequence
  Description of Artificial Sequence: Synthetic coding sequence
atgcccaagaaggccaagcccaccggcagcggcaaggaggagggccctgccccctgcaagcagatgaagctggaggccgccggcggccccagcgccctgaactttgacagccccagcagcctgtttgagagcctcatcagccccatcaagacagagaccttcttcaaggagttctgggagcagaagcccctgctgatccagagagatgatcctgccctggccacctactacggcagcctcttcaagctgacagacctgaagagcctgtgcagccggggcatgtactacggcagagatgtgaatgtgtgccgctgtgtgaatggcaagaagaaggtgtag

SEQ ID NO: 160453 - DNA, 459 bp, Artificial Sequence
  Description of Artificial Sequence: Synthetic coding sequence
atgggcccccccagcctgcacagccccacccccagcctgggccccctgggcgccctggtgctgagcagccagcacaccagcccagacagctgcaagagcccctggaccctgaaggctgtgcgggccgcccggcaggccgctgacttcaccctgaaggtggaggtggagtgcagcagcctgcaggaggccgtgcaggccgctgaggccggggctgacctggtgctgctggacaacttcaagccagaggagctgcaccccacagccaccgtgctgaaggcccagttccccagcgtggccgtggaggccagcggcggcatcaccctggacaacctgccccagttctgtggcccccacattgatgtgatctccatgggcatgctgacccaggccgccccagccctggacttcagcctgaagctgtttgccaaggaggtggcccctgtgcccaagatccactag

SEQ ID NO: 160454 - DNA, 1434 bp, Artificial Sequence
  Description of Artificial Sequence: Synthetic coding sequence
atgtttcctgtgttcccctgcaccctgctggccccacccttccctgtgctgggcctggacagcagaggagtgggcggcctgatgaacagcttccccccaccccagggccacgcccagaaccccctgcaggtgggcgctgagctgcagagccgcttctttgccagccagggctgtgcccagagccccttccaggccgccccagcccccccacccaccccccaggccccagctgctgagcccctgcaggtggacctgctgcctgtgctggccgccgcccaggagagcgctgctgctgctgctgctgctgctgctgctgctgctgctgtggccgccgcccccccagccccagctgctgccagcacagtggacacagctgccctgaagcagcccccagcccctcctcctcctcctcctcctgtgtctgccccagctgctgaggccgcccccccagccagcgctgccaccatcgctgctgctgctgccacagctgtggtggcccccaccagcacagtggccgtggcccctgtggccagcgccctggagaagaagaccaagagcaagggcccctacatctgtgccctgtgtgccaaggagttcaagaatggctacaacctgcggagacatgaggccatccacactggagccaaggccggccgggtgcccagcggggccatgaagatgcccaccatggtgcccctgagcctgctgtctgtgccccagctgagcggggccggcggcggcggcggggaggccggggccggcggcggcgctgctgctgtggccgccggcggcgtggtgaccaccacagccagcggcaagaggatcaggaagaaccacgcctgtgagatgtgtgggaaggccttcagagatgtgtaccacctgaacagacacaagctgagccacagtgatgagaagccctaccagtgccctgtgtgccagcagcgcttcaagaggaaggacaggatgagctaccacgtgcgcagccatgatggagctgtgcacaagccctacaactgcagccactgtgggaagagcttcagcaggccagaccacctgaacagccacgtgcggcaggtgcacagcacagagcggcccttcaagtgtgagaagtgtgaggccgcctttgccaccaaggaccggctgcgggcccacacagtgagacatgaggagaaggtgccctgccacgtgtgtgggaagatgctgagcagcgcctacatcagtgaccacatgaaggtgcacagccagggcccccaccacgtgtgtgagctgtgcaacaagggcaccggggaggtgtgccccatggctgctgctgctgctgctgctgctgctgctgctgctgctgctgtggccgccccacccacagctgtgggcagcctgagcggggctgagggcgtgcctgtgagcagccagcccctgcccagccagccctggtag

SEQ ID NO: 160455 - DNA, 759 bp, Artificial Sequence
  Description of Artificial Sequence: Synthetic coding sequence
atgaagatgcccaccatggtgcccctgagcctgctgtctgtgccccagctgagcggggccggcggcggcggcggggaggccggggccggcggcggcgctgctgctgtggccgccggcggcgtggtgaccaccacagccagcggcaagaggatcaggaagaaccacgcctgtgagatgtgtgggaaggccttcagagatgtgtaccacctgaacagacacaagctgagccacagtgatgagaagccctaccagtgccctgtgtgccagcagcgcttcaagaggaaggacaggatgagctaccacgtgcgcagccaccggcgctgtgccaagccctacaactgcagccactgcggcaagagcttcagcaggccagaccacctgaacagccacgtgcggcaggtgcacagcacagagcggcccttcaagtgtgagaagtgtgaggccgcctttgccaccaaggaccggctgcgggcccacacagtgagacatgaggagaaggtgccctgccacgtgtgtgggaagatgctgagcagcgcctacatcagtgaccacatgaaggtgcacagccagggcccccaccacgtgtgtgagctgtgcaacaagggcactggagaggtgtgccccatggctgctgctgctgctgctgctgctgctgctgctgctgctgctgtggccgccccacccacagctgtgggcagcctgtctggagctgagggcgtgcctgtgagcagccagcccctgcccagccagccctggtag

SEQ ID NO: 160456 - DNA, 1365 bp, Artificial Sequence
  Description of Artificial Sequence: Synthetic coding sequence
atggaccccagcaactggagcagcttcatcttccagggccacgcccagaaccccctgcaggtgggcgctgagctgcagagccgcttctttgccagccagggctgtgcccagagccccttccaggccgccccagcccccccacccaccccccaggccccagctgctgagcccctgcaggtggacctgctgcctgtgctggccgccgcccaggagagcgctgctgctgctgctgctgctgctgctgctgctgctgctgtggccgccgcccccccagccccagctgctgccagcacagtggacacagctgccctgaagcagcccccagcccctcctcctcctcctcctcctgtgtctgccccagctgctgaggccgcccccccagccagcgctgccaccatcgctgctgctgctgccacagctgtggtggcccccaccagcacagtggccgtggcccctgtggccagcgccctggagaagaagaccaagagcaagggcccctacatctgtgccctgtgtgccaaggagttcaagaatggctacaacctgcggagacatgaggccatccacactggagccaaggccggccgggtgcccagcggggccatgaagatgcccaccatggtgcccctgagcctgctgtctgtgccccagctgtctggagctgggggcggcggcggggaggccggggccggcggcggcgctgctgctgtggccgccggcggcgtggtgaccaccacagccagcggcaagaggatcaggaagaaccacgcctgtgagatgtgtgggaaggccttcagagatgtgtaccacctgaacagacacaagctgagccacagtgatgagaagccctaccagtgccctgtgtgccagcagcgcttcaagaggaaggacaggatgagctaccacgtgcgcagccatgatggagctgtgcacaagccctacaactgcagccactgcggcaagagcttcagcaggccagaccacctgaacagccacgtgcggcaggtgcacagcacagagcggcccttcaagtgtgagaagtgtgaggccgcctttgccaccaaggaccggctgcgggcccacacagtgagacatgaggagaaggtgccctgccacgtgtgtgggaagatgctgagcagcgcctacatcagtgaccacatgaaggtgcacagccagggcccccaccacgtgtgtgagctgtgcaacaagggcactggagaggtgtgccccatggctgctgctgctgctgctgctgctgctgctgctgctgctgctgtggccgccccacccacagctgtgggcagcctgtctggagctgagggcgtgcctgtgagcagccagcccctgcccagccagccctggtag

SEQ ID NO: 160457 - DNA, 2955 bp, Artificial Sequence
  Description of Artificial Sequence: Synthetic coding sequence
atgagggccccagcccggggcaccggctgctgcggccgcagcggcggccgctggctggccggggccgcccagccccgctgcctgtgggccggcggggccggccagcgcttcatggtgcctgggggcaccatgaagagcctgaagaaggacagccggctgcgcatcacccccacccggctgctggaggcctctgaaaatgtgaaggagaagaagagggccaagggccctgagcagcccacccccaccatccaggaggagcctgagcctgtgtccaatgtgctgcagggagatgacatcctggccctggccatcaagaaggaggacctgaaggagcagcacatcccccggctgacagagaaggaggacaagagggtcatcacccagaagttcatcatcaggaagctgaagcccatggaccccaggaggaaggtgtgccacctggtggcccggcctgccaacccagatgaggccaccaagcccctggactacagcggccctggggacagctttgatggcagtgaccagatcctgccccaccacatcctgggcagcctgcaggacttcaagagaattgccctggcccggggcaacacccagctggccgagcgcatccccaccagcccctgcctgatgaccctcatctctgctgagggggagagcaagcagaaggcccccaaggaggagaagaggcctccctgggcccccccaccccagcacaacttcctgaagaactggcagaggaacacagccctgaggaagaagcagcaggaggccctgtctgagcacctgaagaagcctgtgtctgagctgctgatgcacactggagagacctaccgccgcatccaggaggagcgggagctgattgactgcaccctgcccacccggcgggacaggaagtcctgggagaacagcggcttctggagccggctggagtacctgggagatgagatgacaggcctggtgatgaccaagaccaagacccagaggggcctgatggagcccatcacccacatcaggaagccccacagcatccgggtggagaccggcctgcctgcccagagagatgccagctaccgctacacctgggacaggagcctcttcctgatctacagaaggaaggagctgcagaggatcatggaggagctggacttcagccagcaggacattgatggcctggaggtggtgggcaagggctggcccttctctgctgtgacagtggaggactacacagtgtttgagaggagccagggcagcagcagcgaggacacagcctacctgggcaccctggccagcagcagtgatgtgtccatgcccatcctgggccccagcctgctcttctgtgggaagccagcctgctggatccggggcagcaacccccaggacaagaggcaggtgggcattgctgcccacctgacctttgagaccctggagggggagaagaccagcagcgagctgactgtggtgaacaacggcaccgtggccatctggtatgactggaggcggcagcaccagcctgacaccttccaggacctgaagaagaacaggatgcagcgcttctactttgacaaccgggagggcgtcatcctgcccggggagatcaagaccttcaccttcttcttcaagagcctgacagctggggtcttccgggagttctgggagttccgcacccaccccaccctgctgggcggggccatcctgcaggtgaacctgcatgctgtgtccctgacccaggatgtgtttgaagatgagaggaaggtgctggagagcaagctgacagcccacgaggccgtgacagtggtgcgggaggtgctgcaggagctgctgatgggcgtgctgaccccagagaggacccccagccctgtggatgcctacctgacagaggaggacctcttccgccacaggaacccccccctgcactatgagcaccaggtggtgcagagcctgcaccagctgtggaggcagtacatgaccctgcctgccaaggccgaggaggcccggcctggggacaaggagcacgtgagccccatcgccacagagaaggcctctgtgaatgctgagctgctgccccgcttccgcagccccatcagcgagacccaggtgcccaggccagaaaatgaggccctgcgggagagcggcagccagaaggcccgggtgggcaccaagagcccccagaggaagagcatcatggaggagatcctggtggaggagagcccagatgtggacagcaccaagagcccctgggagccagatggcctgcccctgctggagtggaacctgtgcctggaggacttcaggaaggctgtgatggtgctgcctgatgagaaccaccgggaggatgccctgatgaggctgaacaaggccgccctggagctgtgccagaagccccggcccctgcagagcaacctgctgcaccagatgtgcctgcagctgtggagagatgtgattgacagcctggtgggccacagcatgtggctgcggtctgtgctgggcctgcctgagaaggagaccatctacctgaatgtgcctgaggagcaggaccagaagagcccccccatcatggaggtgaaggtgcctgtgggcaaggccggcaaggaggagaggaagggggccgcccaggagaagaagcagctgggcatcaaggacaaggaggacaagaagggggccaagctgctgggcaaggaggaccggcccaacagcaagaagcacaaggccaaggatgacaagaaggtgatcaagagcgccagccaggaccgcttcagcctggaggaccccaccccagacatcatcctgagcagccaggagcccatcgaccccctggtgatgggcaagtacacccagagcctgcacagcgaggtgcggggcctgctggacaccctggtgacagacctgatggtgctggctgatgagctgagccccatcaagaatgtggaggaggccctgcggctgtgcaggtag

SEQ ID NO: 160458 - DNA, 2829 bp, Artificial Sequence
  Description of Artificial Sequence: Synthetic coding sequence
atggtgcctgggggcaccatgaagagcctgaagaaggacagccggctgcgcatcacccccacccggctgctggaggcctctgaaaatgtgaaggagaagaagagggccaagggccctgagcagcccacccccaccatccaggaggagcctgagcctgtgtccaatgtgctgcagggagatgacatcctggccctggccatcaagaaggaggacctgaaggagcagcacatcccccggctgacagagaaggaggacaagagggtcatcacccagaagttcatcatcaggaagctgaagcccatggaccccaggaggaaggtgtgccacctggtggcccggcctgccaacccagatgaggccaccaagcccctggactacagcggccctggggacagctttgatggcagtgaccagatcctgccccaccacatcctgggcagcctgcaggacttcaagagaattgccctggcccggggcaacacccagctggccgagcgcatccccaccagcccctgcctgatgaccctcatctctgctgagggggagagcaagcagaaggcccccaaggaggagaagaggcctccctgggcccccccaccccagcacaacttcctgaagaactggcagaggaacacagccctgaggaagaagcagcaggaggccctgtctgagcacctgaagaagcctgtgtctgagctgctgatgcacactggagagacctaccgccgcatccaggaggagcgggagctgattgactgcaccctgcccacccggcgggacaggaagtcctgggagaacagcggcttctggagccggctggagtacctgggagatgagatgacaggcctggtgatgaccaagaccaagacccagaggggcctgatggagcccatcacccacatcaggaagccccacagcatccgggtggagaccggcctgcctgcccagagagatgccagctaccgctacacctgggacaggagcctcttcctgatctacagaaggaaggagctgcagaggatcatggaggagctggacttcagccagcaggacattgatggcctggaggtggtgggcaagggctggcccttctctgctgtgacagtggaggactacacagtgtttgagaggagccagggcagcagcagcgaggacacagcctacctgggcaccctggccagcagcagtgatgtgtccatgcccatcctgggccccagcctgctcttctgtgggaagccagcctgctggatccggggcagcaacccccaggacaagaggcaggtgggcattgctgcccacctgacctttgagaccctggagggggagaagaccagcagcgagctgactgtggtgaacaatggaacagtggccatctggtatgactggaggcggcagcaccagcctgacaccttccaggacctgaagaagaacaggatgcagcgcttctactttgacaaccgggagggcgtcatcctgcctggagagatcaagaccttcaccttcttcttcaagagcctgacagctggggtcttccgggagttctgggagttccgcacccaccccaccctgctgggcggggccatcctgcaggtgaacctgcatgctgtgtccctgacccaggatgtgtttgaagatgagaggaaggtgctggagagcaagctgacagcccatgaagctgtgacagtggtgcgggaggtgctgcaggagctgctgatgggcgtgctgaccccagagaggacccccagccctgtggatgcctacctgacagaagaagatctcttccgccacagaaatccacccctgcactatgagcaccaggtggtgcagagcctgcaccagctgtggaggcagtacatgaccctgcctgccaaggccgaggaggcccggcctggggacaaggagcacgtgagccccatcgccacagagaaggcctctgtgaatgctgagctgctgccccgcttccgcagccccatcagcgagacccaggtgcccaggccagaaaatgaggccctgcgggagagcggcagccagaaggcccgggtgggcaccaagagcccccagaggaagagcatcatggaggagatcctggtggaggagagcccagatgtggacagcaccaagagcccctgggagccagatggcctgcccctgctggagtggaacctgtgcctggaggacttcaggaaggctgtgatggtgctgcctgatgagaaccacagagaagatgccctgatgaggctgaacaaggccgccctggagctgtgccagaagccccggcccctgcagagcaacctgctgcaccagatgtgcctgcagctgtggagagatgtgattgacagcctggtgggccacagcatgtggctgcggtctgtgctgggcctgcctgagaaggagaccatctacctgaatgtgcctgaggagcaggaccagaagagcccccccatcatggaggtgaaggtgcctgtgggcaaggccggcaaggaggagaggaaaggagctgcccaggagaagaagcagctgggcatcaaggacaaggaggacaagaagggggccaagctgctgggcaaggaggaccggcccaacagcaagaagcacaaggccaaggatgacaagaaggtgatcaagagcgccagccaggaccgcttcagcctggaggaccccaccccagacatcatcctgagcagccaggagcccatcgaccccctggtgatgggcaagtacacccagagcctgcacagcgaggtgcaccctggccgctgtgtgccctgggagaacaccatgcagggcgccttccccagcaccacccgctgtggcggcagctgcctgtag

SEQ ID NO: 160459 - DNA, 1992 bp, Artificial Sequence
  Description of Artificial Sequence: Synthetic coding sequence
cgcagcagaggagctgaggccacagagagcaagctgagcggcggcttccgctggacccagaagaccagccccacccagggcgacagcgccatcacccacagcctgtacaggatgatcttcctgacagccctgcccctcttctggatcatgatcagcgccagccggggcggccactggggcgcctggatgcccagcagcatcagcgcctttgagggcacctgtgtgtccatcccctgccgctttgacttcccagatgagctgcggcctgctgtggtgcatggagtgtggtacttcaacagcccctaccccaagaactacccacctgtggtgttcaagagcaggacccaggtggtgcatgagagcttccagggccgcagccggctgctgggggacctgggcctgaggaactgcaccctgctgctgagcaatgtgtccccagagctgggcggcaagtactacttccggggggacctgggcggctacaaccagtacaccttcagcgagcacagcgtgctggacatcgtgaacacccccaacatcgtggtgcccccagaggtggtggccggcacagaggtggaggtgtcctgcatggtgcctgacaactgcccagagctgcggcctgagctgtcctggctgggccacgagggcctgggggagcctgctgtgctgggccgcctgcgggaggatgagggcacctgggtgcaggtgtccctgctgcactttgtgcccacccgggaggccaacggccaccggctgggctgccaggccagcttccccaacaccaccctgcagtttgagggctacgcctccatggatgtgaagtacccacctgtgattgtggagatgaacagctctgtggaggccatcgagggcagccacgtgtccctgctgtgtggggctgacagcaaccccccacccctgctgacctggatgagagatggcaccgtgctgcgggaggccgtggccgagagcctgctgctggagctggaggaggtgaccccagcagaagatggagtgtatgcctgcctggctgaaaatgcctacggccaggacaacagaacagtgggcctgtctgtgatgtatgccccctggaagcccaccgtgaatggcaccatggtggccgtggagggggagaccgtgtccatcctgtgcagcacccagagcaacccagaccccatcctgaccatcttcaaggagaagcagatcctgagcaccgtcatctatgagagcgagctgcagctggagctgcctgctgtgtccccagaagatgatggagagtactggtgtgtggccgagaaccagtatggccagagggccacagccttcaacctgtctgtggagtttgcccctgtgctgctgctggagagccactgtgccgccgcccgggacacagtgcagtgcctgtgtgtggtgaagagcaaccctgagcccagcgtggcctttgagctgcccagcagaaatgtgacagtgaatgaaagtgagcgggagtttgtgtacagcgagaggagcggcctggtgctgaccagcatcctgaccctgcggggccaggcccaggccccacccagggtcatctgcacagccaggaacctgtatggagccaagagcctggagctgcccttccagggcgcccaccggctgatgtgggccaagattggccctgtgggcgctgtggtggcctttgccatcctgattgccatcgtgtgctacatcacccagaccaggaggaagaagaatgtgacagagagccccagcttctctgctggggacaacccccctgtgctcttcagcagtgacttccgcatcagcggggcccctgagaagtatgagagcgagcggcggctgggcagcgagcggcggctgctgggcctgcggggggagcccccagagctggacctgagctacagccacagcgacctgggcaagaggcccaccaaggacagctacaccctgacagaggagctggccgagtatgcagagatccgggtgaagtag

SEQ ID NO: 160460 - DNA, 1749 bp, Artificial Sequence
  Description of Artificial Sequence: Synthetic coding sequence
atgatcttcctgacagccctgcccctcttctggatcatgatcagcgccagcagaggaggccactggggcgcctggatgcccagcagcatcagcgcctttgagggcacctgtgtgtccatcccctgccgctttgacttcccagatgagctgcggcctgctgtggtgcacggcgtgtggtacttcaacagcccctaccccaagaactacccacctgtggtgttcaagagcaggacccaggtggtgcatgagagcttccagggccgcagccggctgctgggggacctgggcctgaggaactgcaccctgctgctgagcaatgtgtccccagagctgggcggcaagtactacttccggggggacctgggcggctacaaccagtacaccttcagcgagcacagcgtgctggacatcgtgaacacccccaacatcgtggtgcccccagaggtggtggccggcacagaggtggaggtgtcctgcatggtgcctgacaactgcccagagctgcggcctgagctgtcctggctgggccacgagggcctgggggagcctgctgtgctgggccgcctgagagaagatgagggcacctgggtgcaggtgtccctgctgcactttgtgcccacccgggaggccaacggccaccggctgggctgccaggccagcttccccaacaccaccctgcagtttgagggctacgcctccatggatgtgaagtacccacctgtgattgtggagatgaacagctctgtggaggccatcgagggcagccacgtgtccctgctgtgtggggctgacagcaaccccccacccctgctgacctggatgagagatggcaccgtgctgcgggaggccgtggccgagagcctgctgctggagctggaggaggtgaccccagcagaagatggagtgtatgcctgcctggccgagaatgcctacggccaggacaacagaacagtgggcctgtctgtgatgtatgccccctggaagcccaccgtgaatggcaccatggtggccgtggagggggagaccgtgtccatcctgtgcagcacccagagcaacccagaccccatcctgaccatcttcaaggagaagcagatcctgagcaccgtcatctatgaaagtgagctgcagctggagctgcctgctgtgtccccagaagatgatggagagtactggtgtgtggccgagaaccagtatggccagagggccacagccttcaacctgtctgtggagtttgcccctgtgctgctgctggagagccactgtgccgccgcccgggacacagtgcagtgcctgtgtgtggtgaagagcaaccctgagcccagcgtggcctttgagctgcccagcagaaatgtgacagtgaatgaaagtgagcgggagtttgtgtacagcgagaggagcggcctggtgctgaccagcatcctgaccctgcggggccaggcccaggccccacccagggtcatctgcacagccaggaacctgtatggagccaagagcctggagctgcccttccagggcgcccaccggctgatgtgggccaagattggccctgtgggcgctgtggtggcctttgccatcctgattgccatcgtgtgctacatcacccagaccaggaggaagaagaatgtgacagagagccccagcttctctgctggggacaacccccctgtgctcttcagcagtgacttccgcatcagcggggcccctgagaagtatgagagcaaggaggtgtccaccctggagagccactag

SEQ ID NO: 160461 - DNA, 1881 bp, Artificial Sequence
  Description of Artificial Sequence: Synthetic coding sequence
atgatcttcctgacagccctgcccctcttctggatcatgatcagcgccagcagaggaggccactggggcgcctggatgcccagcagcatcagcgcctttgagggcacctgtgtgtccatcccctgccgctttgacttcccagatgagctgcggcctgctgtggtgcacggcgtgtggtacttcaacagcccctaccccaagaactacccacctgtggtgttcaagagcaggacccaggtggtgcatgagagcttccagggccgcagccggctgctgggggacctgggcctgaggaactgcaccctgctgctgagcaatgtgtccccagagctgggcggcaagtactacttccggggggacctgggcggctacaaccagtacaccttcagcgagcacagcgtgctggacatcgtgaacacccccaacatcgtggtgcccccagaggtggtggccggcacagaggtggaggtgtcctgcatggtgcctgacaactgcccagagctgcggcctgagctgtcctggctgggccacgagggcctgggggagcctgctgtgctgggccgcctgagagaagatgagggcacctgggtgcaggtgtccctgctgcactttgtgcccacccgggaggccaacggccaccggctgggctgccaggccagcttccccaacaccaccctgcagtttgagggctacgcctccatggatgtgaagtacccacctgtgattgtggagatgaacagctctgtggaggccatcgagggcagccacgtgtccctgctgtgtggggctgacagcaaccccccacccctgctgacctggatgagagatggcaccgtgctgcgggaggccgtggccgagagcctgctgctggagctggaggaggtgaccccagcagaagatggagtgtatgcctgcctggccgagaatgcctacggccaggacaacagaacagtgggcctgtctgtgatgtatgccccctggaagcccaccgtgaatggcaccatggtggccgtggagggggagaccgtgtccatcctgtgcagcacccagagcaacccagaccccatcctgaccatcttcaaggagaagcagatcctgagcaccgtcatctatgaaagtgagctgcagctggagctgcctgctgtgtccccagaagatgatggagagtactggtgtgtggccgagaaccagtatggccagagggccacagccttcaacctgtctgtggagtttgcccctgtgctgctgctggagagccactgtgccgccgcccgggacacagtgcagtgcctgtgtgtggtgaagagcaaccctgagcccagcgtggcctttgagctgcccagcagaaatgtgacagtgaatgaaagtgagcgggagtttgtgtacagcgagaggagcggcctggtgctgaccagcatcctgaccctgcggggccaggcccaggccccacccagggtcatctgcacagccaggaacctgtatggagccaagagcctggagctgcccttccagggcgcccaccggctgatgtgggccaagattggccctgtgggcgctgtggtggcctttgccatcctgattgccatcgtgtgctacatcacccagaccaggaggaagaagaatgtgacagagagccccagcttctctgctggggacaacccccctgtgctcttcagcagtgacttccgcatcagcggggcccctgagaagtatgaaagtgaaagaaggctgggcagcgagcggcggctgctgggcctgcggggggagcccccagagctggacctgagctacagccacagcgacctgggcaagaggcccaccaaggacagctacaccctgacagaggagctggccgagtatgcagagatccgggtgaagtag

SEQ ID NO: 160462 - DNA, 1806 bp, Artificial Sequence
  Description of Artificial Sequence: Synthetic coding sequence
atgcccagcagcatcagcgcctttgagggcacctgtgtgtccatcccctgccgctttgacttcccagatgagctgcggcctgctgtggtgcatggagtgtggtacttcaacagcccctaccccaagaactacccacctgtggtgttcaagagcaggacccaggtggtgcatgagagcttccagggccgcagccggctgctgggggacctgggcctgaggaactgcaccctgctgctgagcaatgtgtccccagagctgggcggcaagtactacttccggggggacctgggcggctacaaccagtacaccttcagcgagcacagcgtgctggacatcgtgaacacccccaacatcgtggtgcccccagaggtggtggccggcacagaggtggaggtgtcctgcatggtgcctgacaactgcccagagctgcggcctgagctgtcctggctgggccacgagggcctgggggagcctgctgtgctgggccgcctgcgggaggatgagggcacctgggtgcaggtgtccctgctgcactttgtgcccacccgggaggccaacggccaccggctgggctgccaggccagcttccccaacaccaccctgcagtttgagggctacgcctccatggatgtgaagtacccacctgtgattgtggagatgaacagctctgtggaggccatcgagggcagccacgtgtccctgctgtgtggggctgacagcaaccccccacccctgctgacctggatgagagatggcaccgtgctgcgggaggccgtggccgagagcctgctgctggagctggaggaggtgaccccagcagaagatggagtgtatgcctgcctggctgaaaatgcctacggccaggacaacagaacagtgggcctgtctgtgatgtatgccccctggaagcccaccgtgaatggcaccatggtggccgtggagggggagaccgtgtccatcctgtgcagcacccagagcaacccagaccccatcctgaccatcttcaaggagaagcagatcctgagcaccgtcatctatgagagcgagctgcagctggagctgcctgctgtgtccccagaagatgatggagagtactggtgtgtggccgagaaccagtatggccagagggccacagccttcaacctgtctgtggagtttgcccctgtgctgctgctggagagccactgtgccgccgcccgggacacagtgcagtgcctgtgtgtggtgaagagcaaccctgagcccagcgtggcctttgagctgcccagcagaaatgtgacagtgaatgaaagtgagcgggagtttgtgtacagcgagaggagcggcctggtgctgaccagcatcctgaccctgcggggccaggcccaggccccacccagggtcatctgcacagccaggaacctgtatggagccaagagcctggagctgcccttccagggcgcccaccggctgatgtgggccaagattggccctgtgggcgctgtggtggcctttgccatcctgattgccatcgtgtgctacatcacccagaccaggaggaagaagaatgtgacagagagccccagcttctctgctggggacaacccccctgtgctcttcagcagtgacttccgcatcagcggggcccctgagaagtatgagagcgagcggcggctgggcagcgagcggcggctgctgggcctgcggggggagcccccagagctggacctgagctacagccacagcgacctgggcaagaggcccaccaaggacagctacaccctgacagaggagctggccgagtatgcagagatccgggtgaagtag

SEQ ID NO: 160463 - DNA, 915 bp, Artificial Sequence
  Description of Artificial Sequence: Synthetic coding sequence
atgggcaaccacgccggcaagcgggagctgaatgctgagaaggccagcaccaacagcgagaccaacagaggagagagcgagaagaagaggaacctgggggagctgagcaggaccaccagtgaagataatgaggtgtttggagaggctgatgccaaccagaacaacggcaccagcagccaggacacagctgtgacagacagcaagaggacagctgaccccaagaatgcctggcaggatgcccaccctgctgaccccggcagccggccccacctgatccgcctcttcagcagagatgcccctggaagagaggacaacaccttcaaggaccggcccagcgagagtgatgagctgcagaccatccaggaggacagcgctgccaccagcgagagcctggatgtgatggccagccagaagaggcccagccagagacatggcagcaagtacctggccacagccagcaccatggaccacgcccggcacggcttcctgcccaggcaccgggacaccggcatcctggacagcatcggccgcttctttggaggagacagaggagcccccaagaggggcagcggcaaggacagccaccacccagccaggacagcccactacggcagcctgccccagaagagccacggccgcacccaggatgaaaatcctgtggtgcacttcttcaagaacatcgtgacccccaggaccccaccacccagccagggcaagggccggggcctgagcctgagccgcttctcctggggcgctgagggccagaggcctggcttcggctatggaggccgggccagtgactacaagagcgcccacaagggcttcaagggcgtggatgcccagggcaccctgagcaagatcttcaagctgggcggccgggacagccgcagcggcagccccatggcccggaggtag

SEQ ID NO: 160464 - DNA, 561 bp, Artificial Sequence
  Description of Artificial Sequence: Synthetic coding sequence
atggccagccagaagaggcccagccagagacatggcagcaagtacctggccacagccagcaccatggaccacgcccggcacggcttcctgcccaggcaccgggacaccggcatcctggacagcatcggccgcttcttcggcggggacagaggagcccccaagaggggcagcggcaaggtgccctggctgaagccaggccgcagccccctgcccagccacgcccggagccagcccggcctgtgcaacatgtacaaggacagccaccacccagccaggacagcccactacggcagcctgccccagaagagccacggccgcacccaggatgagaaccctgtggtgcacttcttcaagaacatcgtgacccccaggaccccaccacccagccagggcaaaggagctgagggccagaggcctggcttcggctatggaggccgggccagtgactacaagagcgcccacaagggcttcaagggcgtggatgcccagggcaccctgagcaagatcttcaagctgggcggccgggacagccgcagcggcagccccatggcccggaggtag

SEQ ID NO: 160465 - DNA, 594 bp, Artificial Sequence
  Description of Artificial Sequence: Synthetic coding sequence
atggccagccagaagaggcccagccagagacatggcagcaagtacctggccacagccagcaccatggaccacgcccggcacggcttcctgcccaggcaccgggacaccggcatcctggacagcatcggccgcttcttcggcggggacagaggagcccccaagaggggcagcggcaaggtgccctggctgaagccaggccgcagccccctgcccagccacgcccggagccagcccggcctgtgcaacatgtacaaggacagccaccacccagccaggacagcccactacggcagcctgccccagaagagccacggccgcacccaggatgagaaccctgtggtgcacttcttcaagaacatcgtgacccccaggaccccaccacccagccagggcaagggccggggcctgagcctgagccgcttctcctggggcgctgagggccagaggcctggcttcggctacggcggccgggccagtgactacaagagcgcccacaagggcttcaagggcgtggatgcccagggcaccctgagcaagatcttcaagctgggcggccgggacagccgcagcggcagccccatggcccggaggtag

SEQ ID NO: 160466 - DNA, 594 bp, Artificial Sequence
  Description of Artificial Sequence: Synthetic coding sequence
atgggcaaccacgccggcaagcgggagctgaatgctgagaaggccagcaccaacagcgagaccaacagaggagagagcgagaagaagaggaacctgggggagctgagcaggaccaccagtgaagataatgaggtgtttggagaggctgatgccaaccagaacaacggcaccagcagccaggacacagctgtgacagacagcaagaggacagctgaccccaagaatgcctggcaggatgcccaccctgctgaccccggcagccggccccacctgatccgcctcttcagcagagatgcccctggaagagaggacaacaccttcaaggaccggcccagcgagagtgatgagctgcagaccatccaggaggacagcgctgccaccagcgagagcctggatgtgatggccagccagaagaggcccagccagagacatggcagcaagtacctggccacagccagcaccatggaccacgcccggcacggcttcctgcccaggcaccgggacaccggcatcctggacagcatcggccgcttctttggaggagacagaggagcccccaagaggggcagcggcaaggtgtcctctgaggagtag

SEQ ID NO: 160467 - DNA, 594 bp, Artificial Sequence; identical to SEQ ID NO: 160466
  Description of Artificial Sequence: Synthetic coding sequence

SEQ ID NO: 160468 - DNA, 483 bp, Artificial Sequence
  Description of Artificial Sequence: Synthetic coding sequence
atggccagccagaagaggcccagccagagacatggcagcaagtacctggccacagccagcaccatggaccacgcccggcacggcttcctgcccaggcaccgggacaccggcatcctggacagcatcggccgcttcttcggcggggacagaggagcccccaagaggggcagcggcaaggacagccaccacccagccaggacagcccactacggcagcctgccccagaagagccacggccgcacccaggatgagaaccctgtggtgcacttcttcaagaacatcgtgacccccaggaccccaccacccagccagggcaaaggagctgagggccagaggcctggcttcggctatggaggccgggccagtgactacaagagcgcccacaagggcttcaagggcgtggatgcccagggcaccctgagcaagatcttcaagctgggcggccgggacagccgcagcggcagccccatggcccggaggtag

SEQ ID NO: 160469 - DNA, 516 bp, Artificial Sequence
  Description of Artificial Sequence: Synthetic coding sequence
atggccagccagaagaggcccagccagagacatggcagcaagtacctggccacagccagcaccatggaccacgcccggcacggcttcctgcccaggcaccgggacaccggcatcctggacagcatcggccgcttcttcggcggggacagaggagcccccaagaggggcagcggcaaggacagccaccacccagccaggacagcccactacggcagcctgccccagaagagccacggccgcacccaggatgagaaccctgtggtgcacttcttcaagaacatcgtgacccccaggaccccaccacccagccagggcaagggccggggcctgagcctgagccgcttctcctggggcgctgagggccagaggcctggcttcggctacggcggccgggccagtgactacaagagcgcccacaagggcttcaagggcgtggatgcccagggcaccctgagcaagatcttcaagctgggcggccgggacagccgcagcggcagccccatggcccggaggtag

SEQ ID NO: 160470 - DNA, 261 bp, Artificial Sequence
  Description of Artificial Sequence: Synthetic coding sequence
atggccagccagaagaggcccagccagagacatggcagcaagtacctggccacagccagcaccatggaccacgcccggcacggcttcctgcccaggcaccgggacaccggcatcctggacagcatcggccgcttcttcggcggggacagaggagcccccaagaggggcagcggcaaggacagccaccacccagccaggacagcccactacggcagcctgccccagaagagccacggccgcacccaggatgagaacccctag

SEQ ID NO: 160471 - DNA, 888 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccgtgggcctggtgttcctgtgcctgcagtaccgcctgcggggcaagctgcgggcagaaattgagaacctgcacaggacctttgacccccacttcctgcgggtgccctgctggaagatcaccctcttcgtcatcgtgcctgtgctgggccccctggtggccctgatcatctgctacaactggctgcaccggcggctggccggccagttcctggaggagctgaggaagttcagcagcctgtgctacaagcagaggatcaagagccaggagcgggagacagaggccacccggggccggggcggcctgctgcgggaccacatcccccggggcaaggaggagctggagagcctgggcggcggcaagaccccacctggaagatag

SEQ ID NO: 160472 - DNA, 642 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccgtgggcctggtgttcctgtgcctgcagtaccgcctgcggggcaagctgcgggcagaaattgagaacctgcacaggaccttcggccagttcctggaggagctgctcttccacctggaggccctgagcggctag

SEQ ID NO: 160473 - DNA, 396 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgctgaccccttctactgggtgtccccaggagtgctggtgctgctggccgtgctgcctgtgctgctgctgcagatcaccgtgggcctcatcttcctgtgcctgcagtaccgcctgcggggcaagctgcgggcagaaattgagaacctgcacaggacctttgacccccacttcctgcgggtgccctgctggaagatcaccctcttcgtcatcgtgcctgtgctgggccccctggtggccctgatcatctgctacaactggctgcaccggcggctggccggccagttcctggaggagctgaggaaccccttctag

SEQ ID NO: 160474 - DNA, 621 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccgtgggcctcatcttcctgtgcctgcagtaccgcctgcggggcaagctgcgggcagaaattgagaacctgcacaggacctttgtgttccacctggaggccctgtctggatag

SEQ ID NO: 160475 - DNA, 759 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccgtgggcctcatcttcctgtgcctgcagtaccgcctgcggggcaagctgcgggcagaaattgagaacctgcacaggacctttgacccccacttcctgcgggtgccctgctggaagatcaccctcttcgtcatcgtgcctgtgctgggccccctggtggccctgatcatctgctacaactggctgcaccggcggctggccggccagttcctggaggagctgctcttccacctggaggccctgtctggatag

SEQ ID NO: 160476 - DNA, 516 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggtgagccacagcgtgacccaggactggctgcagtggcatgaccacggcagcctgcagcccccaccaccccggctgaagtag

SEQ ID NO: 160477 - DNA, 744 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccgtgggcctcatcttcctgtgcctgcagtaccgcctgcggggcaagctgcgggcagaaattgagaacctgcacaggacctttgacccccacttcctgcgggtgccctgctggaagatcaccctcttcgtcatcgtgcctgtgctgggccccctggtggccctgatcatctgctacaactggctgcaccggcggctggccggccagttcctggaggagctgaggaaccccttctag

SEQ ID NO: 160478 - DNA, 396 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgctgaccccttctactgggtgtccccaggagtgctggtgctgctggccgtgctgcctgtgctgctgctgcagatcaccgtgggcctggtgttcctgtgcctgcagtaccgcctgcggggcaagctgcgggcagaaattgagaacctgcacaggacctttgacccccacttcctgcgggtgccctgctggaagatcaccctcttcgtcatcgtgcctgtgctgggccccctggtggccctgatcatctgctacaactggctgcaccggcggctggccggccagttcctggaggagctgaggaaccccttctag

SEQ ID NO: 160479 - DNA, 744 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccgtgggcctggtgttcctgtgcctgcagtaccgcctgcggggcaagctgcgggcagaaattgagaacctgcacaggacctttgacccccacttcctgcgggtgccctgctggaagatcaccctcttcgtcatcgtgcctgtgctgggccccctggtggccctgatcatctgctacaactggctgcaccggcggctggccggccagttcctggaggagctgaggaaccccttctag

SEQ ID NO: 160480 - DNA, 744 bp, Artificial Sequence; identical to SEQ ID NO: 160479
  Description of Artificial Sequence: Synthetic coding sequence

SEQ ID NO: 160481 - DNA, 690 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccgtgggcctggtgttcctgtgcctgcagtaccgcctgcggggcaagctgcgggcagaaattgagaacctgcacaggacctttgagagctttggagtgctgggcccccaggtgaaggagcccaagaagacaggccagttcctggaggagctgctcttccacctggaggccctgagcggctag

SEQ ID NO: 160482 - DNA, 642 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccgtgggcctcatcttcctgtgcctgcagtaccgcctgcggggcaagctgcgggcagaaattgagaacctgcacaggaccttcggccagttcctggaggagctgctcttccacctggaggccctgagcggctag

SEQ ID NO: 160483 - DNA, 675 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccgtgggcctcatcttcctgtgcctgcagtaccgcctgcggggcaagctgcgggcagaaattgagaacctgcacaggacctttgagagctttggagtgctgggcccccaggtgaaggagcccaagaagacaggccagttcctggaggagctgaggaaccccttctag

SEQ ID NO: 160484 - DNA, 675 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccctgggcctggtgttcctgtgcctgcagtaccgcctgcggggcaagctgcgggcagaaattgagaacctgcacaggacctttgagagctttggagtgctgggcccccaggtgaaggagcccaagaagacaggccagttcctggaggagctgaggaaccccttctag

SEQ ID NO: 160485 - DNA, 690 bp, Artificial Sequence; identical to SEQ ID NO: 160481
  Description of Artificial Sequence: Synthetic coding sequence

SEQ ID NO: 160486 - DNA, 642 bp, Artificial Sequence; identical to SEQ ID NO: 160472
  Description of Artificial Sequence: Synthetic coding sequence

SEQ ID NO: 160487 - DNA, 540 bp, Artificial Sequence
  Description of Artificial Sequence: Synthetic coding sequence
tgacagttccgggtcatcggccccaggcaccccatccgggccctggtgggagatgaggtggagctgccctgccgcatcagccctgggaagaatgccaccggcatggaggtgggctggtaccggccccccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgagggcggcttcacctgcttcttccgggaccacagctaccaggaggaggccgccatggagctgaaggtggaggaccccttctactgggtgtcccctggggtgctggtgctgctggccgtgctgcctgtgctgctgctgcagatcaccgtgggcctggtgttcctgtgcctgcagtaccgcctgcggggcaagctgcgggcagaaattgagaacctgcacaggaccttcggccagttcctggaggagctgaggaaccccttctag

SEQ ID NO: 160488 - DNA, 396 bp, Artificial Sequence; identical to SEQ ID NO: 160478
  Description of Artificial Sequence: Synthetic coding sequence

SEQ ID NO: 160489 - DNA, 615 bp, Artificial Sequence
  Description of Artificial Sequence: Synthetic coding sequence
agcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccgtgggcctggtgttcctgtgcctgcagtaccgcctgcggggcaagctgcgggcagaaattgagaacctgcacaggacctttgtgttccacctggaggccctgtctggatag

SEQ ID NO: 160490 - DNA, 396 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgctgaccccttctactgggtgtccccaggagtgctggtgctgctggccgtgctgcctgtgctgctgctgcagatcaccctgggcctggtgttcctgtgcctgcagtaccgcctgcggggcaagctgcgggcagaaattgagaacctgcacaggacctttgacccccacttcctgcgggtgccctgctggaagatcaccctcttcgtcatcgtgcctgtgctgggccccctggtggccctgatcatctgctacaactggctgcaccggcggctggccggccagttcctggaggagctgaggaaccccttctag

SEQ ID NO: 160491 - DNA, 675 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccgtgggcctggtgttcctgtgcctgcagtaccgcctgcggggcaagctgcgggcagaaattgagaacctgcacaggacctttgagagctttggagtgctgggcccccaggtgaaggagcccaagaagacaggccagttcctggaggagctgaggaaccccttctag

SEQ ID NO: 160492 - DNA, 675 bp, Artificial Sequence; identical to SEQ ID NO: 160491
  Description of Artificial Sequence: Synthetic coding sequence

SEQ ID NO: 160493 - DNA, 675 bp, Artificial Sequence; identical to SEQ ID NO: 160491
  Description of Artificial Sequence: Synthetic coding sequence

SEQ ID NO: 160494 - DNA, 759 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccgtgggcctggtgttcctgtgcctgcagtaccgcctgcggggcaagctgcgggcagaaattgagaacctgcacaggacctttgacccccacttcctgcgggtgccctgctggaagatcaccctcttcgtcatcgtgcctgtgctgggccccctggtggccctgatcatctgctacaactggctgcaccggcggctggccggccagttcctggaggagctgctcttccacctggaggccctgtctggatag

SEQ ID NO: 160495 - DNA, 744 bp, Artificial Sequence; identical to SEQ ID NO: 160479
  Description of Artificial Sequence: Synthetic coding sequence

SEQ ID NO: 160496 - DNA, 540 bp, Artificial Sequence; identical to SEQ ID NO: 160487
  Description of Artificial Sequence: Synthetic coding sequence

SEQ ID NO: 160497 - DNA, 540 bp, Artificial Sequence; identical to SEQ ID NO: 160487
  Description of Artificial Sequence: Synthetic coding sequence

SEQ ID NO: 160498 - DNA, 759 bp, Artificial Sequence; identical to SEQ ID NO: 160494
  Description of Artificial Sequence: Synthetic coding sequence

SEQ ID NO: 160499 - DNA, 690 bp, Artificial Sequence; identical to SEQ ID NO: 160481
  Description of Artificial Sequence: Synthetic coding sequence

SEQ ID NO: 160500 - DNA, 888 bp, Artificial Sequence; identical to SEQ ID NO: 160471
  Description of Artificial Sequence: Synthetic coding sequence

SEQ ID NO: 160501 - DNA, 642 bp, Artificial Sequence; identical to SEQ ID NO: 160472
  Description of Artificial Sequence: Synthetic coding sequence

SEQ ID NO: 160502 - DNA, 759 bp, Artificial Sequence; identical to SEQ ID NO: 160494
  Description of Artificial Sequence: Synthetic coding sequence

SEQ ID NO: 160503 - DNA, 540 bp, Artificial Sequence; identical to SEQ ID NO: 160487
  Description of Artificial Sequence: Synthetic coding sequence

SEQ ID NO: 160504 - DNA, 888 bp, Artificial Sequence; identical to SEQ ID NO: 160471
  Description of Artificial Sequence: Synthetic coding sequence

SEQ ID NO: 160505 - DNA, 888 bp, Artificial Sequence; identical to SEQ ID NO: 160471
  Description of Artificial Sequence: Synthetic coding sequence

SEQ ID NO: 160506 - DNA, 396 bp, Artificial Sequence; identical to SEQ ID NO: 160478
  Description of Artificial Sequence: Synthetic coding sequence

SEQ ID NO: 160507 - DNA, 759 bp, Artificial Sequence; identical to SEQ ID NO: 160494
  Description of Artificial Sequence: Synthetic coding sequence

SEQ ID NO: 160508 - DNA, 744 bp, Artificial Sequence; identical to SEQ ID NO: 160479
  Description of Artificial Sequence: Synthetic coding sequence

SEQ ID NO: 160509 - DNA, 615 bp, Artificial Sequence; identical to SEQ ID NO: 160489
  Description of Artificial Sequence: Synthetic coding sequence

SEQ ID NO: 160510 - DNA, 888 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccctgggcctggtgttcctgtgcctgcagtaccgcctgcggggcaagctgcgggcagaaattgagaacctgcacaggacctttgacccccacttcctgcgggtgccctgctggaagatcaccctcttcgtcatcgtgcctgtgctgggccccctggtggccctgatcatctgctacaactggctgcaccggcggctggccggccagttcctggaggagctgaggaagttcagcagcctgtgctacaagcagaggatcaagagccaggagcgggagacagaggccacccggggccggggcggcctgctgcgggaccacatcccccggggcaaggaggagctggagagcctgggcggcggcaagaccccacctggaagatag

SEQ ID NO: 160511 - DNA, 690 bp, Artificial Sequence; identical to SEQ ID NO: 160481
  Description of Artificial Sequence: Synthetic coding sequence

SEQ ID NO: 160512 - DNA, 396 bp, Artificial Sequence; identical to SEQ ID NO: 160478
  Description of Artificial Sequence: Synthetic coding sequence

SEQ ID NO: 160513 - DNA, 540 bp, Artificial Sequence
  Description of Artificial Sequence: Synthetic coding sequence
tgacagttccgggtcatcggccccaggcaccccatccgggccctggtgggagatgaggtggagctgccctgccgcatcagccctgggaagaatgccaccggcatggaggtgggctggtaccggccccccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgagggcggcttcacctgcttcttccgggaccacagctaccaggaggaggccgccatggagctgaaggtggaggaccccttctactgggtgtcccctggggtgctggtgctgctggccgtgctgcctgtgctgctgctgcagatcaccctgggcctggtgttcctgtgcctgcagtaccgcctgcggggcaagctgcgggcagaaattgagaacctgcacaggaccttcggccagttcctggaggagctgaggaaccccttctag

SEQ ID NO: 160514 - DNA, 627 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccgtgggcctcatcttcctgtgcctgcagtaccgcctgcggggcaagctgcgggcagaaattgagaacctgcacaggaccttcggccagttcctggaggagctgaggaaccccttctag

SEQ ID NO: 160515 - DNA, 744 bp, Artificial Sequence; identical to SEQ ID NO: 160479
  Description of Artificial Sequence: Synthetic coding sequence

SEQ ID NO: 160516 - DNA, 396 bp, Artificial Sequence; identical to SEQ ID NO: 160478
  Description of Artificial Sequence: Synthetic coding sequence

SEQ ID NO: 160517 - DNA, 642 bp, Artificial Sequence; identical to SEQ ID NO: 160472
  Description of Artificial Sequence: Synthetic coding sequence

SEQ ID NO: 160518 - DNA, 615 bp, Artificial Sequence
  Description of Artificial Sequence: Synthetic coding sequence
agcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccctgggcctggtgttcctgtgcctgcagtaccgcctgcggggcaagctgcgggcagaaattgagaacctgcacaggacctttgtgttccacctggaggccctgtctggatag

SEQ ID NO: 160519 - DNA, 675 bp, Artificial Sequence; identical to SEQ ID NO: 160491
  Description of Artificial Sequence: Synthetic coding sequence

SEQ ID NO: 160520 - DNA, 690 bp, Artificial Sequence; identical to SEQ ID NO: 160481
  Description of Artificial Sequence: Synthetic coding sequence

SEQ ID NO: 160521 - DNA, 888 bp, Artificial Sequence; identical to SEQ ID NO: 160471
  Description of Artificial Sequence: Synthetic coding sequence

SEQ ID NO: 160522 - DNA, 540 bp, Artificial Sequence; identical to SEQ ID NO: 160487
  Description of Artificial Sequence: Synthetic coding sequence

SEQ ID NO: 160523 - DNA, 642 bp, Artificial Sequence; identical to SEQ ID NO: 160472
  Description of Artificial Sequence: Synthetic coding sequence

SEQ ID NO: 160524 - DNA, 759 bp, Artificial Sequence; identical to SEQ ID NO: 160494
  Description of Artificial Sequence: Synthetic coding sequence

SEQ ID NO: 160525 - DNA, 642 bp, Artificial Sequence; identical to SEQ ID NO: 160472
  Description of Artificial Sequence: Synthetic coding sequence

SEQ ID NO: 160526 - DNA, 675 bp, Artificial Sequence; identical to SEQ ID NO: 160491
  Description of Artificial Sequence: Synthetic coding sequence

SEQ ID NO: 160527 - DNA, 615 bp, Artificial Sequence; identical to SEQ ID NO: 160489
  Description of Artificial Sequence: Synthetic coding sequence

SEQ ID NO: 160528 - DNA, 675 bp, Artificial Sequence; identical to SEQ ID NO: 160491
  Description of Artificial Sequence: Synthetic coding sequence

SEQ ID NO: 160529 - DNA, 759 bp, Artificial Sequence; identical to SEQ ID NO: 160494
  Description of Artificial Sequence: Synthetic coding sequence

SEQ ID NO: 160530 - DNA, 744 bp, Artificial Sequence; identical to SEQ ID NO: 160479
  Description of Artificial Sequence: Synthetic coding sequence

SEQ ID NO: 160531 - DNA, 615 bp, Artificial Sequence; identical to SEQ ID NO: 160489
  Description of Artificial Sequence: Synthetic coding sequence

SEQ ID NO: 160532 - DNA, 888 bp, Artificial Sequence; identical to SEQ ID NO: 160471
  Description of Artificial Sequence: Synthetic coding sequence

SEQ ID NO: 160533 - DNA, 759 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccctgggcctggtgttcctgtgcctgcagtaccgcctgcggggcaagctgcgggcagaaattgagaacctgcacaggacctttgacccccacttcctgcgggtgccctgctggaagatcaccctcttcgtcatcgtgcctgtgctgggccccctggtggccctgatcatctgctacaactggctgcaccggcggctggccggccagttcctggaggagctgctcttccacctggaggccctgtctggatag

SEQ ID NO: 160534 - DNA, 540 bp, Artificial Sequence; identical to SEQ ID NO: 160487
  Description of Artificial Sequence: Synthetic coding sequence

SEQ ID NO: 160535 - DNA, 396 bp, Artificial Sequence; identical to SEQ ID NO: 160478
  Description of Artificial Sequence: Synthetic coding sequence

SEQ ID NO: 160536 - DNA, 744 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccctgggcctggtgttcctgtgcctgcagtaccgcctgcggggcaagctgcgggcagaaattgagaacctgcacaggacctttgacccccacttcctgcgggtgccctgctggaagatcaccctcttcgtcatcgtgcctgtgctgggccccctggtggccctgatcatctgctacaactggctgcaccggcggctggccggccagttcctggaggagctgaggaaccccttctag

SEQ ID NO: 160537 - DNA, 642 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccctgggcctggtgttcctgtgcctgcagtaccgcctgcggggcaagctgcgggcagaaattgagaacctgcacaggaccttcggccagttcctggaggagctgctcttccacctggaggccctgagcggctag

SEQ ID NO: 160538 - DNA, 615 bp, Artificial Sequence; identical to SEQ ID NO: 160489
  Description of Artificial Sequence: Synthetic coding sequence

SEQ ID NO: 160539 - DNA, 690 bp, Artificial Sequence; identical to SEQ ID NO: 160481
  Description of Artificial Sequence: Synthetic coding sequence

SEQ ID NO: 160540 - DNA, 615 bp, Artificial Sequence; identical to SEQ ID NO: 160489
  Description of Artificial Sequence: Synthetic coding sequence

SEQ ID NO: 160541 - DNA, 690 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccctgggcctggtgttcctgtgcctgcagtaccgcctgcggggcaagctgcgggcagaaattgagaacctgcacaggacctttgagagctttggagtgctgggcccccaggtgaaggagcccaagaagacaggccagttcctggaggagctgctcttccacctggaggccctgagcggctag

SEQ ID NO: 160542 - DNA, 690 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccgtgggcctcatcttcctgtgcctgcagtaccgcctgcggggcaagctgcgggcagaaattgagaacctgcacaggacctttgagagctttggagtgctgggcccccaggtgaaggagcccaagaagacaggccagttcctggaggagctgctcttccacctggaggccctgagcggctag

SEQ ID NO: 160543 - DNA, 516 bp, Artificial Sequence; identical to SEQ ID NO: 160476
  Description of Artificial Sequence: Synthetic coding sequence

SEQ ID NO: 160544 - DNA, 534 bp, Artificial Sequence
  Description of Artificial Sequence: Synthetic coding sequence
atgagccacatctcctgggaggagcgctacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccgtgggcctggtgttcctgtgcctgcagtaccgcctgcggggcaagctgcgggcagaaattgagaacctgcacaggacctttgacccccacttcctgcgggtgccctgctggaagatcaccctcttcgtcatcgtgcctgtgctgggccccctggtggccctgatcatctgctacaactggctgcaccggcggctggccggccagttcctggaggagctgaggaaccccttctag

SEQ ID NO: 160545 - DNA, 174 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggcctggtggccgtggcccgctcctggctgattgctgccagcaccagccaggcccaggtgatcctgctgacccagcccctggagtag

SEQ ID NO: 160546 - DNA, 627 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccgtgggcctggtgttcctgtgcctgcagtaccgcctgcggggcaagctgcgggcagaaattgagaacctgcacaggaccttcggccagttcctggaggagctgaggaaccccttctag

SEQ ID NO: 160547 - DNA, 516 bp, Artificial Sequence; identical to SEQ ID NO: 160476
  Description of Artificial Sequence: Synthetic coding sequence

SEQ ID NO: 160548 - DNA, 516 bp, Artificial Sequence; identical to SEQ ID NO: 160476
  Description of Artificial Sequence: Synthetic coding sequence

SEQ ID NO: 160549 - DNA, 621 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccgtgggcctggtgttcctgtgcctgcagtaccgcctgcggggcaagctgcgggcagaaattgagaacctgcacaggacctttgtgttccacctggaggccctgtctggatag

SEQ ID NO: 160550 - DNA, 627 bp, Artificial Sequence; identical to SEQ ID NO: 160546
  Description of Artificial Sequence: Synthetic coding sequence

SEQ ID NO: 160551 - DNA, 621 bp, Artificial Sequence; identical to SEQ ID NO: 160549
  Description of Artificial Sequence: Synthetic coding sequence

SEQ ID NO: 160552 - DNA, 534 bp, Artificial Sequence; identical to SEQ ID NO: 160544
  Description of Artificial Sequence: Synthetic coding sequence

SEQ ID NO: 160553 - DNA, 621 bp, Artificial Sequence; identical to SEQ ID NO: 160549
  Description of Artificial Sequence: Synthetic coding sequence

SEQ ID NO: 160554 - DNA, 621 bp, Artificial Sequence; identical to SEQ ID NO: 160549
  Description of Artificial Sequence: Synthetic coding sequence

SEQ ID NO: 160555 - DNA, 534 bp, Artificial Sequence; identical to SEQ ID NO: 160544
  Description of Artificial Sequence: Synthetic coding sequence

SEQ ID NO: 160556 - DNA, 621 bp, Artificial Sequence; identical to SEQ ID NO: 160549
  Description of Artificial Sequence: Synthetic coding sequence

SEQ ID NO: 160557 - DNA, 174 bp, Artificial Sequence; identical to SEQ ID NO: 160545
  Description of Artificial Sequence: Synthetic coding sequence

SEQ ID NO: 160558 - DNA, 621 bp, Artificial Sequence; identical to SEQ ID NO: 160549
  Description of Artificial Sequence: Synthetic coding sequence

SEQ ID NO: 160559 - DNA, 516 bp, Artificial Sequence; identical to SEQ ID NO: 160476
  Description of Artificial Sequence: Synthetic coding sequence

SEQ ID NO: 160560 - DNA, 621 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgccggccagttccgggtgattggccccaggcaccccatccgggccctggtgggagatgaggtggagctgccctgccgcatcagccctgggaagaatgccaccggcatggaggtgggctggtacagaccacccttcagccgggtggtgcacctgtacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccctgggcctggtgttcctgtgcctgcagtaccgcctgcggggcaagctgcgggcagaaattgagaacctgcacaggacctttgtgttccacctggaggccctgtctggatag

SEQ ID NO: 160561 - DNA, 516 bp, Artificial Sequence; identical to SEQ ID NO: 160476
  Description of Artificial Sequence: Synthetic coding sequence

SEQ ID NO: 160562 - DNA, 516 bp, Artificial Sequence; identical to SEQ ID NO: 160476
  Description of Artificial Sequence: Synthetic coding sequence

SEQ ID NO: 160563 - DNA, 627 bp, Artificial Sequence; identical to SEQ ID NO: 160546
  Description of Artificial Sequence: Synthetic coding sequence

SEQ ID NO: 160564 - DNA, 174 bp, Artificial Sequence; identical to SEQ ID NO: 160545
  Description of Artificial Sequence: Synthetic coding sequence

SEQ ID NO: 160565 - DNA, 627 bp, Artificial Sequence; identical to SEQ ID NO: 160546
  Description of Artificial Sequence: Synthetic coding sequence

SEQ ID NO: 160566 - DNA, 174 bp, Artificial Sequence; identical to SEQ ID NO: 160545
  Description of Artificial Sequence: Synthetic coding sequence

SEQ ID NO: 160567 - DNA, 534 bp, Artificial Sequence; identical to SEQ ID NO: 160544
  Description of Artificial Sequence: Synthetic coding sequence

SEQ ID NO: 160568 - DNA, 516 bp, Artificial Sequence; identical to SEQ ID NO: 160476
  Description of Artificial Sequence: Synthetic coding sequence

SEQ ID NO: 160569 - DNA, 534 bp, Artificial Sequence
  Description of Artificial Sequence: Synthetic coding sequence
atgagccacatctcctgggaggagcgctacagaaatggcaaggaccaggatggagaccaggcccctgagtaccggggccgcacagagctgctgaaggatgccatcggggagggcaaggtgaccctgcgcatcagaaatgtgcgcttcagtgatgaaggaggcttcacctgcttcttccgggaccacagctaccaggaggaggccgccatggagctgaaggtggaggaccccttctactgggtgtccccaggagtgctggtgctgctggccgtgctgcctgtgctgctgctgcagatcaccctgggcctggtgttcctgtgcctgcagtaccgcctgcggggcaagctgcgggcagaaattgagaacctgcacaggacctttgacccccacttcctgcgggtgccctgctggaagatcaccctcttcgtcatcgtgcctgtgctgggccccctggtggccctgatcatctgctacaactggctgcaccggcggctggccggccagttcctggaggagctgaggaaccccttctag

SEQ ID NO: 160570 - DNA, 627 bp, Artificial Sequence; identical to SEQ ID NO: 160546
  Description of Artificial Sequence: Synthetic coding sequence

SEQ ID NO: 160571 - DNA, 174 bp, Artificial Sequence; identical to SEQ ID NO: 160545
  Description of Artificial Sequence: Synthetic coding sequence

SEQ ID NO: 160572 - DNA, 174 bp, Artificial Sequence; identical to SEQ ID NO: 160545
  Description of Artificial Sequence: Synthetic coding sequence

SEQ ID NO: 160573 - DNA, 534 bp, Artificial Sequence; identical to SEQ ID NO: 160544
  Description of Artificial Sequence: Synthetic coding sequence

SEQ ID NO: 160574 - DNA, 516 bp, Artificial Sequence; identical to SEQ ID NO: 160476
  Description of Artificial Sequence: Synthetic coding sequence

SEQ ID NO: 160575 - DNA, 534 bp, Artificial Sequence; identical to SEQ ID NO: 160544
  Description of Artificial Sequence: Synthetic coding sequence

SEQ ID NO: 160576 - DNA, 174 bp, Artificial Sequence; identical to SEQ ID NO: 160545
  Description of Artificial Sequence: Synthetic coding sequence

SEQ ID NO: 160577 - DNA, 627 bp, Artificial Sequence; identical to SEQ ID NO: 160546
  Description of Artificial Sequence: Synthetic coding sequence

SEQ ID NO: 160578 - DNA, 327 bp, Artificial Sequence
  Description of Artificial Sequence: Synthetic coding sequence
atggccagcctgagccggcccagcctgcccagctgcctgtgcagcttcctgctgctgctgctgctgcaggtgagcagcagctatgctgaccccttctactgggtgtccccaggagtgctggtgctgctggccgtgctgcctgtgctgctgctgcagatcaccgtgggcctcatcttcctgtgcctgcagtaccgcctgcggggcaagctgcgggcagaaattgagaacctgcacaggacctttgagagctttggagtgctgggcccccaggtgaaggagcccaagaagacaggccagttcctggaggagctgaggaaccccttctag

SEQ ID NO: 160579 - DNA, 753 bp, Artificial Sequence
  Description of Artificial Sequence: Synthetic coding sequence
atggcccctggggcccccagcagcagccccagccccatcctggccgtgctgctcttcagcagcctggtgctgagccctgcccaggccatcgtggtgtacacagaccgggaggtgcatggagctgtgggcagccgggtgaccctgcactgcagcttctggagcagcgagtgggtgtctgatgacatctccttcacctggagataccagcctgagggcggcagagatgccatcagcatcttccactacgccaagggccagccctacattgatgaggtgggcaccttcaaggagcgcatccagtgggtgggggacccccgctggaaggatggcagcatcgtcatccacaacctggactacagcgacaatggcaccttcacctgtgatgtgaagaaccccccagacatcgtgggcaagaccagccaggtgaccctgtatgtgtttgagaaggtgcccaccaggtatggagtggtgctgggcgccgtcatcggcggcgtgctgggcgtggtgctgctgctgctgctgctcttctacgtggtgcgctactgctggctgcggcggcaggccgccctgcagaggcggctgagcgccatggagaagggcaagctgcacaagccaggcaaggatgccagcaagaggggccggcagacccctgtgctgtaccagtgctggaccacagctgaggcccccaagctgtctgtgagaagaagaccccggggctggggcagcctggcccgcatcagaaattctggatag

SEQ ID NO: 160580 - DNA, 777 bp, Artificial Sequence
  Description of Artificial Sequence: Synthetic coding sequence
atgctgcgggccccagccccagccccagccatggcccctggggcccccagcagcagccccagccccatcctggccgtgctgctcttcagcagcctggtgctgagccctgcccaggccatcgtggtgtacacagaccgggaggtgcatggagctgtgggcagccgggtgaccctgcactgcagcttctggagcagcgagtgggtgtctgatgacatctccttcacctggagataccagcctgagggcggcagagatgccatcagcatcttccactacgccaagggccagccctacattgatgaggtgggcaccttcaaggagcgcatccagtgggtgggggacccccgctggaaggatggcagcatcgtcatccacaacctggactacagcgacaatggcaccttcacctgtgatgtgaagaaccccccagacatcgtgggcaagaccagccaggtgaccctgtatgtgtttgagaaggtgcccaccaggtatggagtggtgctgggcgccgtcatcggcggcgtgctgggcgtggtgctgctgctgctgctgctcttctacgtggtgcgctactgctggctgcggcggcaggccgccctgcagaggcggctgagcgccatggagaagggcaagctgcacaagccaggcaaggatgccagcaagaggggccggcagacccctgtgctgtatgccatgctggaccacagccgcagcaccaaggctgtgtctgagaagaaggccaagggcctgggggagagcaggaaggacaagaagtag

SEQ ID NO: 160581 - DNA, 747 bp, Artificial Sequence
  Description of Artificial Sequence: Synthetic coding sequence
atggcccctggggcccccagcagcagccccagccccatcctggccgtgctgctcttcagcagcctggtgctgagccctgcccaggccatcgtggtgtacacagaccgggaggtgcatggagctgtgggcagccgggtgaccctgcactgcagcttctggagcagcgagtgggtgtctgatgacatctccttcacctggagataccagcctgagggcggcagagatgccatcagcatcttccactacgccaagggccagccctacattgatgaggtgggcaccttcaaggagcgcatccagtgggtgggggacccccgctggaaggatggcagcatcgtcatccacaacctggactacagcgacaatggcaccttcacctgtgatgtgaagaaccccccagacatcgtgggcaagaccagccaggtgaccctgtatgtgtttgagaaggtgcccaccaggtatggagtggtgctgggcgccgtcatcggcggcgtgctgggcgtggtgctgctgctgctgctgctcttctacgtggtgcgctactgctggctgcggcggcaggccgccctgcagaggcggctgagcgccatggagaagggcaagctgcacaagccaggcaaggatgccagcaagaggggccggcagacccctgtgctgtatgccatgctggaccacagccgcagcaccaaggctgtgtctgagaagaaggccaagggcctgggggagagcaggaaggacaagaagtag

SEQ ID NO: 160582 - DNA, 747 bp, Artificial Sequence; identical to SEQ ID NO: 160581
  Description of Artificial Sequence: Synthetic coding sequence

SEQ ID NO: 160583 - DNA, 648 bp, Artificial Sequence
  Description of Artificial Sequence: Synthetic coding sequence
atgtatggcaagagcagcaccagggctgtgctgctgctgctgggcatccagctgacagccctgtggcccatcgctgctgtggagatctacaccagccgggtgctggaggccgtgaatggaacagatgcccggctgaagtgcaccttcagcagctttgcccctgtgggagatgccctgactgtgacctggaacttccggcccctggatggcggccctgagcagtttgtgttctactaccacatcgaccccttccagcccatgagcggccgcttcaaggacagagtgtcctgggatggcaaccctgagagatatgatgccagcatcctgctgtggaagctgcagtttgatgacaatggcacctacacctgccaggtgaagaaccccccagatgtggatggagtgattggagagatccggctgtctgtggtgcacacagtgcgcttcagcgagatccacttcctggccctggccatcggcagcgcctgtgccctgatgatcatcatcgtcatcgtggtggtgctcttccagcactacaggaagaagcgctgggccgagcgggcccacaaggtggtggagatcaagagcaaggaggaggagcggctgaaccaggagaagaaggtgtctgtgtacctggaggacacagactag

SEQ ID NO: 160584 - DNA, 648 bp, Artificial Sequence; identical to SEQ ID NO: 160583
  Description of Artificial Sequence: Synthetic coding sequence

SEQ ID NO: 160585 - DNA, 708 bp, Artificial Sequence
  Description of Artificial Sequence: Synthetic coding sequence
atgcagcagagaggagctgctggcagccggggctgtgccctcttccccctgctgggcgtgctcttcttccagggcgtgtacatcgtgttcagcctggagatccgggcagatgcccacgtgcggggctacgtgggggagaagatcaagctgaagtgcaccttcaagagcaccagtgatgtgacagacaagctgaccatcgactggacctaccggccccccagcagcagccacacagtgtccatcttccactaccagagcttccagtaccccaccacagctggcaccttccgggaccgcatctcctgggtgggcaatgtgtacaagggagatgccagcatcagcatcagcaaccccaccatcaaggacaatggcaccttcagctgtgctgtgaagaaccccccagatgtgcaccacaacatccccatgacagagctgactgtgacagagcggggcttcggcaccatgctgagctctgtggccctgctgagcatcctggtgtttgtgcccagcgctgtggtggtggccctgctgctggtgaggatgggcaggaaggccgccggcctgaagaagaggagccgcagcggctacaagaagagcagcattgaggtgtctgatgacacagaccaggaggaggaggaggcctgcatggcccggctgtgtgtgcgctgtgctgaatgtctggacagcgactatgaggagacctactag

SEQ ID NO: 160586 - DNA, 672 bp, Artificial Sequence
  Description of Artificial Sequence: Synthetic coding sequence
atgcagcagagaggagctgctggcagccggggctgtgccctcttccccctgctgggcgtgctcttcttccaggatgcccacgtgcggggctacgtgggggagaagatcaagctgaagtgcaccttcaagagcaccagtgatgtgacagacaagctgaccatcgactggacctaccggccccccagcagcagccacacagtgtccatcttccactaccagagcttccagtaccccaccacagctggcaccttccgggaccgcatctcctgggtgggcaatgtgtacaagggagatgccagcatcagcatcagcaaccccaccatcaaggacaatggcaccttcagctgtgctgtgaagaaccccccagatgtgcaccacaacatccccatgacagagctgactgtgacagagcggggcttcggcaccatgctgagctctgtggccctgctgagcatcctggtgtttgtgcccagcgctgtggtggtggccctgctgctggtgaggatgggcaggaaggccgccggcctgaagaagaggagccgcagcggctacaagaagagcagcattgaggtgtctgatgacacagaccaggaggaggaggaggcctgcatggcccggctgtgtgtgcgctgtgctgaatgtctggacagcgactatgaggagacctactag

SEQ ID NO: 160587 - DNA, 3366 bp, Artificial Sequence
  Description of Artificial Sequence: Synthetic coding sequence
atgagcctggagaatgaagacaagagggcccggaccaggagcaaggccctgcggggccccccagagaccacagctgctgacctgagctgccccaccccaggctgcaccggcagcggccacgtgcggggcaagtacagccgccacaggagcctgcagagctgccccctggccaagaagaggaagctggagggcgctgaggccgagcacctggtgtccaagaggaagagccaccccctgaagctggccctggatgagggctatggagtggacagtgatggcagcgaggacacagaggtgaaggatgcctctgtgtctgatgagagcgagggcaccctggagggcgctgaggccgagaccagcggccaggatgagatccacaggcctgagacagctgagggccgcagccctgtgaagagccacttcggcagcaaccccatcggcagcgccacagccagcagcaagggcagctacagcagctaccagggcatcatcgccaccagcctgctgaacctgggccagattgctgaggagaccctggtggaggaggacctgggccaggccgccaagccaggccctggcatcgtgcacctgctgcaggaggccgctgagggcgccgccagcgaggagggggagaagggcctcttcatccagccagaagatgctgaggaggtggtggaggtgaccacagagaggagccaggacctgtgcccccagagcctggaggatgctgccagcgaggagagcagcaagcagaagggcatcctgagccatgaggaggaggatgaggaggaggaggaggaggaggaggaggaggaggaggatgaggaggaggaggaggaggaggaggaggaggaggaggaggaggaggaggaggaggaggaggaggaggaggaggaggaggaggaggaggaggaggaggccgccccagatgtgatcttccaggaggacaccagccacaccagcgcccagaaggcccctgagctgcggggccctgagagccccagccccaagccagagtacagcgtgattgtggaggtgcggagtgatgatgacaaggatgaggacacccacagcaggaagagcacagtgacagatgaaagtgagatgcaggacatgatgacccggggcaacctgggcctgctggagcaggccatcgccctgaaggccgagcaggtgaggacagtgtgtgagcccggctgccccccagctgagcagagccagctgggcctgggggagcccgggaaggccgccaagcccctggacacagtgaggaagagctactacagcaaggaccccagcagagctgagaagcgggagatcaagtgccccaccccaggctgtgatggcaccggccacgtgacaggcctgtacccccaccacaggagcctgagcggctgcccccacaaggaccgcatccccccagagatcctggccatgcatgaaaatgtgctgaagtgccccaccccaggctgcaccggccagggccacgtgaacagcaacagaaacacccacaggagcctgagcggctgccccatcgctgctgctgagaagctggccaagagccatgagaagcagcagccccagacaggagaccccagcaagagcagcagcaacagcgaccgcatcctgcggcccatgtgctttgtgaagcagctggaggtgcccccctacggcagctaccggcccaacgtggccccagccaccccccgggccaacctggccaaggagctggagaagttcagcaaggtgacctttgattatgccagctttgatgcccaggtgtttgggaagaggatgctggcccccaagatccagaccagcgagaccagccccaaggccttccagtgctttgactacagccaggatgctgaggccgcccacatggccgccacagccatcctgaacctgagcacccgctgctgggagatgcctgagaacctgagcaccaagccccaggacctgcccagcaagtctgtggacatcgaggtggatgaaaatggcaccctggacctgtccatgcacaagcacaggaagcgggagaatgccttccccagcagcagcagctgcagcagcagccctggggtgaagagcccagatgccagccagaggcacagcagcaccagcgcccccagcagctccatgaccagcccccagagcagccaggccagccggcaggatgagtgggaccggcccctggactacaccaagcccagccggctgcgggaggaggagcctgaggagagcgagcctgctgcccacagctttgccagcagcgaggctgatgaccaggaggtgtctgaggagaactttgaggagaggaagtacccaggagaggtgaccctgaccaacttcaagctgaagttcctgagcaaggacatcaagaaggagctgctgacctgccccaccccaggctgtgatggcagcggccacatcaccggcaactatgccagccacaggagcctgagcggctgccccctggccgacaagagcctgaggaacctgatggccgcccacagcgctgacctgaagtgccccaccccaggctgtgatggcagcggccacatcaccggcaactatgccagccacaggagcctgagcggctgcccccgggccaagaagagcggcgtgaaggtggcccccaccaaggatgacaaggaggaccctgagctgatgaagtgccctgtgcccggctgtgtgggcctgggccacatcagcggcaagtatgccagccacaggtctgccagcggctgccccctggccgcccggcggcagaaggagggcagcctgaatggcagcagcttctcctggaagagcctgaagaatgaaggccccacctgccccaccccaggctgtgatggcagcggccacgccaacggcagcttcctgacccacaggagcctgagcggctgcccccgggccacctttgctgggaagaagggcaagctgtctggagatgaggtgctgagccccaagttcaagaccagtgatgtgctggagaatgatgaggagatcaagcagctgaaccaggagatccgggacctgaatgaaagcaacagcgagatggaggccgccatggtgcagctgcagagccagatcagctccatggagaagaacctgaagaacatcgaggaggagaacaagctgattgaggagcagaatgaggccctcttcctggagctgagcggcctgagccaggccctgatccagagcctggccaacatccggctgccccacatggagcccatctgtgagcagaactttgatgcctacgtgtccaccctgacagacatgtacagcaaccaggaccctgagaacaaggacctgctggagagcatcaagcaggccgtgcggggcatccaggtgtag

SEQ ID NO: 160588 - DNA, 1776 bp, Artificial Sequence
  Description of Artificial Sequence: Synthetic coding sequence
atgagcctggagaatgaagacaagagggcccggaccaggagcaaggccctgcggggccccccagagaccacagctgctgacctgagctgccccaccccaggctgcaccggcagcggccacgtgcggggcaagtacagccgccacaggagcctgcagagctgccccctggccaagaagaggaagctggagggcgctgaggccgagcacctggtgtccaagaggaagagccaccccctgaagctggccctggatgagggctatggagtggacagtgatggcagcgaggacacagaggtgaaggatgcctctgtgtctgatgagagcgagggcaccctggagggcgctgaggccgagaccagcggccaggatgagatccacaggcctgagacagctgaggaccccagcagagctgagaagcgggagatcaagtgccccaccccaggctgtgatggcaccggccacgtgacaggcctgtacccccaccacaggagcctgagcggctgcccccacaaggaccgcatccccccagagatcctggccatgcatgaaaatgtgctgaagtgccccaccccaggctgcaccggccagggccacgtgaacagcaacagaaacacccacaggagcctgagcggctgccccatcgctgctgctgagaagctggccaagagccatgagaagcagcagccccagacaggagaccccagcaagagcagcagcaacagcgaccgcatcctgcggcccatgtgctttgtgaagcagctggaggtgcccccctacggcagctaccggcccaacgtggccccagccaccccccgggccaacctggccaaggagctggagaagttcagcaaggtgacctttgattatgccagctttgatgcccaggtgtttgggaagaggatgctggcccccaagatccagaccagcgagaccagccccaaggccttccagtgctttgactacagccaggatgctgaggccgcccacatggccgccacagccatcctgaacctgagcacccgctgctgggagatgcctgagaacctgagcaccaagccccaggacctgcccagcaagtctgtggacatcgaggtggatgaaaatggcaccctggacctgtccatgcacaagcacaggaagcgggagaatgccttccccagcagcagcagctgcagcagcagccctggggtgaagagcccagatgccagccagaggcacagcagcaccagcgcccccagcagctccatgaccagcccccagagcagccaggccagccggcaggatgagtgggaccggcccctggactacaccaagcccagccggctgcgggaggaggagcctgaggagagcgagcctgctgcccacagctttgccagcagcgaggctgatgaccaggaggtgtctgaggagaactttgaggagaggaagtacccaggagaggtgaccctgaccaacttcaagctgaagttcctgagcaaggacatcaagaaggagctgctgacctgccccaccccaggctgtgatggcagcggccacatcaccggcaactatgccagccaccggcgctgccccaccccaggctgtgatggcagcggccacatcactggaaattatgccagccacaggagcctgagcggctgcccccgggccaagaagtctggagtgaaggtggcccccaccaaggatgacaaggaggaccctgagctgatgaagtatgtgggcccctgctggctgttccactgcatcgccgagctgcgcttcagctgtgtgctgtag

SEQ ID NO: 160589 - DNA, 3447 bp, Artificial Sequence
  Description of Artificial Sequence: Synthetic coding sequence
atgagcctggagaatgaagacaagagggcccggaccaggagcaaggccctgcggggccccccagagaccacagctgctgacctgagctgccccaccccaggctgcaccggcagcggccacgtgcggggcaagtacagccgccacaggagcctgcagagctgccccctggccaagaagaggaagctggagggcgctgaggccgagcacctggtgtccaagaggaagagccaccccctgaagctggccctggatgagggctatggagtggacagtgatggcagcgaggacacagaggtgaaggatgcctctgtgtctgatgagagcgagggcaccctggagggcgctgaggccgagaccagcggccaggatgagatccacaggcctgagacagctgagggccgcagccctgtgaagagccacttcggcagcaaccccatcggcagcgccacagccagcagcaagggcagctacagcagctaccagggcatcatcgccaccagcctgctgaacctgggccagattgctgaggagaccctggtggaggaggacctgggccaggccgccaagccaggccctggcatcgtgcacctgctgcaggaggccgctgagggcgccgccagcgaggagggggagaagggcctcttcatccagccagaagatgctgaggaggtggtggaggtgaccacagagaggagccaggacctgtgcccccagagcctggaggatgctgccagcgaggagagcagcaagcagaagggcatcctgagccatgaggaggaggatgaggaggaggaggaggaggaggaggaggaggaggaggatgaggaggaggaggaggaggaggaggaggaggaggaggaggaggaggaggaggaggaggaggaggaggaggaggaggaggaggaggaggaggaggaggccgccccagatgtgatcttccaggaggacaccagccacaccagcgcccagaaggcccctgagctgcggggccctgagagccccagccccaagccagagtacagcgtgattgtggaggtgcggagtgatgatgacaaggatgaggacacccacagcaggaagagcacagtgacagatgaaagtgagatgcaggacatgatgacccggggcaacctgggcctgctggagcaggccatcgccctgaaggccgagcaggtgaggacagtgtgtgagcccggctgccccccagctgagcagagccagctgggcctgggggagcccgggaaggccgccaagcccctggacacagtgaggaagagctactacagcaaggaccccagcagagctgagaagcgggagatcaagtgccccaccccaggctgtgatggcaccggccacgtgacaggcctgtacccccaccacaggagcctgagcggctgcccccacaaggaccgcatccccccagagatcctggccatgcatgaaaatgtgctgaagtgccccaccccaggctgcaccggccagggccacgtgaacagcaacagaaacacccacaggagcctgagcggctgccccatcgctgctgctgagaagctggccaagagccatgagaagcagcagccccagacaggagaccccagcaagagcagcagcaacagcgaccgcatcctgcggcccatgtgctttgtgaagcagctggaggtgcccccctacggcagctaccggcccaacgtggccccagccaccccccgggccaacctggccaaggagctggagaagttcagcaaggtgacctttgattatgccagctttgatgcccaggtgtttgggaagaggatgctggcccccaagatccagaccagcgagaccagccccaaggccttccagagcaagcccttccccaaggccagcagccccaggcacagccccagcagcagctatgtgcgcagcaccagcagcagcagcgctggctttgactacagccaggatgctgaggccgcccacatggccgccacagccatcctgaacctgagcacccgctgctgggagatgcctgagaacctgagcaccaagccccaggacctgcccagcaagtctgtggacatcgaggtggatgaaaatggcaccctggacctgtccatgcacaagcacaggaagagagaaaatgccttccccagcagcagcagctgcagcagcagccctggggtgaagagcccagatgccagccagaggcacagcagcaccagcgcccccagcagctccatgaccagcccccagagcagccaggccagccggcaggatgagtgggaccggcccctggactacaccaagcccagccggctgcgggaggaggagcctgaggagagcgagcctgctgcccacagctttgccagcagcgaggctgatgaccaggaggtgtctgaagaaaattttgaggagaggaagtacccaggagaggtgaccctgaccaacttcaagctgaagttcctgagcaaggacatcaagaaggagctgctgacctgccccaccccaggctgtgatggcagcggccacatcactggaaattatgccagccacaggagcctgagcggctgccccctggccgacaagagcctgaggaacctgatggccgcccacagcgctgacctgaagtgccccaccccaggctgtgatggcagcggccacatcactggaaattatgccagccacaggagcctgagcggctgcccccgggccaagaagtctggagtgaaggtggcccccaccaaggatgacaaggaggaccctgagctgatgaagtgccctgtgcccggctgtgtgggcctgggccacatcagcggcaagtatgccagccacaggtctgccagcggctgccccctggccgcccggcggcagaaggagggcagcctgaatggcagcagcttctcctggaagagcctgaagaatgaaggccccacctgccccaccccaggctgtgatggcagcggccacgccaacggcagcttcctgacccacaggagcctgagcggctgcccccgggccacctttgctgggaagaagggcaagctgtctggagatgaggtgctgagccccaagttcaagaccagtgatgtgctggagaatgatgaggagatcaagcagctgaaccaggagatccgggacctgaatgaaagcaacagcgagatggaggccgccatggtgcagctgcagagccagatcagctccatggagaagaacctgaagaacatcgaggaggagaacaagctgattgaggagcagaatgaggccctcttcctggagctgagcggcctgagccaggccctgatccagagcctggccaacatccggctgccccacatggagcccatctgtgagcagaactttgatgcctacgtgtccaccctgacagacatgtacagcaaccaggaccctgagaacaaggacctgctggagagcatcaagcaggccgtgcggggcatccaggtgtag

SEQ ID NO: 160590 - DNA, 3399 bp, Artificial Sequence
  Description of Artificial Sequence: Synthetic coding sequence
atggaggtggacacagaggagaagaggcacaggaccaggagcaaaggagtgcgggtgcctgtggagcccgccatccaggagctgttcagctgccccaccccaggctgtgatggcagcggccacgtgtctgggaagtatgcccggcacaggtctgtgtatggctgccccctggccaagaagaggaagacccaggacaagcagccccaggagcccgcccccaagaggaagccctttgctgtgaaggctgacagcagctctgtggatgaatgtgatgacagtgatggaacagaggacatggatgagaaggaggaggatgaggaggaggaggaggaggaggaggaggagaatgaagaccaccagatgaactgccacaacacccgcatcatgcaggacacagagaaggatgacaacaacaatgatgaatatgacaactatgatgagctggtggccaagagcctgctgaacctgggcaagattgctgaagatgctgcctaccgggccaggacagaaagtgagatgaacagcaacaccagcaacagcctggaggatgacagcgacaagaatgaaaacctgggcaggaagtctgagctgagcctggacctggacagtgatgtggtgcgggagaccgtggacagcctgaagctgctggcccagggccacggcgtggtgctgtctgagaacatgaatgacagaaattatgctgacagcatgagccagcaggacagcaggaacatgaactacgtgatgctgggcaagcccatgaacaacggcctgatggagaagatggtggaggagagtgatgaggaggtgtgcctgagcagcctggagtgcctgaggaaccagtgctttgacctggccaggaagctgtctgagaccaacccccaggagaggaacccccagcagaacatgaacatccggcagcacgtgcggcctgaggaggacttccctggccgcaccccagacaggaactacagcgacatgctgaacctgatgaggctggaggagcagctgagccccaggagccgggtgtttgccagctgtgccaaggaggatggctgccacgagagagatgatgacaccacctctgtgaacagcgacagaagtgaggaggtgtttgacatgaccaagggcaacctgaccctgctggagaaggccatcgccctggagacagagcgggccaaggccatgagggagaagatggccatggaggccggccggcgggacaacatgaggagctatgaggaccagagcccccggcagctgcccggggaggacaggaagcccaagagcagtgacagccacgtgaagaagccctactatgaccccagcaggacagagaagaaggagagcaaatgtcccaccccaggctgtgatggcaccggccacgtgacaggcctgtacccccaccacaggagcctgagcggctgcccccacaaggacagagtgcccccagagatcctggccatgcatgagagcgtgctgaagtgccccaccccaggctgcaccggccggggccacgtgaacagcaacagaaacagccacaggagcctgagcggctgccccatcgctgctgctgagaagctggccaaggcccaggagaagcaccagagctgtgatgtgtccaagagcagccaggccagtgacagagtgctgcggcccatgtgctttgtgaagcagctggagatcccccagtatggctacagaaacaacgtgcccaccaccacccccaggagcaacctggccaaggagctggagaagtacagcaagaccagctttgagtacaacagctatgacaaccacacctacggcaagagggccatcgcccccaaggtgcagacccgggacatcagccccaagggctatgatgatgccaagcgctactgcaaggaccccagccccagcagcagcagcaccagcagctatgcccccagcagcagcagcaacctgagctgtggcggcggcagcagcgccagcagcacctgcagcaagagcagctttgactacacccatgacatggaggccgcccacatggccgccacagccatcctgaacctgagcacccgctgccgggagatgccccagaacctgagcaccaagccccaggacctgtgtgccaccagaaatccagacatggaggtggatgaaaatggcaccctggacctgtccatgaacaagcagaggccccgggacagctgctgccccatcctgacccccctggagcccatgagcccccagcagcaggccgtgatgaacaaccgctgcttccagctgggggagggggactgctgggacctgcctgtggactacaccaagatgaagcccaggagaattgatgaagatgagagcaaggacatcaccccagaggacctggaccccttccaggaggccctggaggagcggcgctacccaggagaggtgaccatccccagccccaagcccaagtacccccagtgcaaggagagcaagaaggacctgatcaccctgagcggctgccccctggccgacaagagcatccgctccatgctggccaccagcagccaggagctgaagtgccccaccccaggctgtgatggcagcggccacatcactggaaattatgccagccacaggagcctgagcggctgcccccgggccaagaagagcggcatcagaattgcccagagcaaggaggacaaggaggaccaggagcccatccgctgccctgtgcccggctgtgatggccagggccacatcaccgggaagtatgccagccacaggtctgccagcggctgccccctggccgccaagaggcagaaggatggctacctgaatggcagccagttctcctggaagtctgtgaagacagagggcatgagctgccccaccccaggctgtgatggcagcggccacgtgtctggcagcttcctgacccacaggagcctgagcggctgcccccgggccaccagcgccatgaagaaggccaagctgagcggggagcagatgctgaccatcaagcagagggccagcaatggaattgaaaatgatgaggagatcaagcagctggatgaggagatcaaggagctgaatgaaagcaacagccagatggaggccgacatgatcaagctgcggacccagatcaccaccatggagagcaacctgaagaccatcgaggaggagaacaaggtgattgagcagcagaatgaaagcctgctgcacgagctggccaacctgagccagagcctcatccacagcctggccaacatccagctgccccacatggaccccatcaatgagcagaactttgatgcctacgtgaccaccctgacagagatgtacaccaaccaggaccgctaccagagccctgagaacaaggccctgctggagaacatcaagcaggccgtgcggggcatccaggtgtag

SEQ ID NO: 160591 - DNA, 3561 bp, Artificial Sequence
  Description of Artificial Sequence: Synthetic coding sequence
atggaggtggacacagaggagaagaggcacaggaccaggagcaaaggagtgcgggtgcctgtggagcccgccatccaggagctgttcagctgccccaccccaggctgtgatggcagcggccacgtgtctgggaagtatgcccggcacaggtctgtgtatggctgccccctggccaagaagaggaagacccaggacaagcagccccaggagcccgcccccaagaggaagccctttgctgtgaaggctgacagcagctctgtggatgaatgtgatgacagtgatggaacagaggacatggatgagaaggaggaggatgaaggagaggagtacagcgaggacaatgatgagcctggagatgaagatgaagaagatgaggagggggaccgggaggaggaggaggagattgaggaggaggatgaagatgatgatgaagatggagaagatgtggaggatgaggaggaggaggaggaggaggaggaggaggaggaggaggaggaggagaatgaagaccaccagatgaactgccacaacacccgcatcatgcaggacacagagaaggatgacaacaacaatgatgaatatgacaactatgatgagctggtggccaagagcctgctgaacctgggcaagattgctgaagatgctgcctaccgggccaggacagaaagtgagatgaacagcaacaccagcaacagcctggaggatgacagcgacaagaatgaaaacctgggcaggaagtctgagctgagcctggacctggacagtgatgtggtgcgggagaccgtggacagcctgaagctgctggcccagggccacggcgtggtgctgtctgagaacatgaatgacagaaattatgctgacagcatgagccagcaggacagcaggaacatgaactacgtgatgctgggcaagcccatgaacaacggcctgatggagaagatggtggaggagagtgatgaggaggtgtgcctgagcagcctggagtgcctgaggaaccagtgctttgacctggccaggaagctgtctgagaccaacccccaggagaggaacccccagcagaacatgaacatccggcagcacgtgcggcctgaggaggacttccctggccgcaccccagacaggaactacagcgacatgctgaacctgatgaggctggaggagcagctgagccccaggagccgggtgtttgccagctgtgccaaggaggatggctgccacgagagagatgatgacaccacctctgtgaacagcgacagaagtgaggaggtgtttgacatgaccaagggcaacctgaccctgctggagaaggccatcgccctggagacagagcgggccaaggccatgagggagaagatggccatggaggccggccggcgggacaacatgaggagctatgaggaccagagcccccggcagctgcccggggaggacaggaagcccaagagcagtgacagccacgtgaagaagccctactacggcaaggaccccagcaggacagagaagaaggagagcaaatgtcccaccccaggctgtgatggcaccggccacgtgacaggcctgtacccccaccacaggagcctgagcggctgcccccacaaggacagagtgcccccagagatcctggccatgcatgagagcgtgctgaagtgccccaccccaggctgcaccggccggggccacgtgaacagcaacagaaacagccacaggagcctgagcggctgccccatcgctgctgctgagaagctggccaaggcccaggagaagcaccagagctgtgatgtgtccaagagcagccaggccagtgacagagtgctgcggcccatgtgctttgtgaagcagctggagatcccccagtatggctacagaaacaacgtgcccaccaccacccccaggagcaacctggccaaggagctggagaagtacagcaagaccagctttgagtacaacagctatgacaaccacacctacggcaagagggccatcgcccccaaggtgcagacccgggacatcagccccaagggctatgatgatgccaagcgctactgcaaggaccccagccccagcagcagcagcaccagcagctatgcccccagcagcagcagcaacctgagctgtggcggcggcagcagcgccagcagcacctgcagcaagagcagctttgactacacccatgacatggaggccgcccacatggccgccacagccatcctgaacctgagcacccgctgccgggagatgccccagaacctgagcaccaagccccaggacctgtgtgccaccagaaatccagacatggaggtggatgaaaatggcaccctggacctgtccatgaacaagcagaggccccgggacagctgctgccccatcctgacccccctggagcccatgagcccccagcagcaggccgtgatgaacaaccgctgcttccagctgggggagggggactgctgggacctgcctgtggactacaccaagatgaagcccaggagaattgatgaagatgagagcaaggacatcaccccagaggacctggaccccttccaggaggccctggaggagcggcgctacccaggagaggtgaccatccccagccccaagcccaagtacccccagtgcaaggagagcaagaaggacctgatcaccctgagcggctgccccctggccgacaagagcatccgctccatgctggccaccagcagccaggagctgaagtgccccaccccaggctgtgatggcagcggccacatcactggaaattatgccagccacaggagcctgagcggctgcccccgggccaagaagagcggcatcagaattgcccagagcaaggaggacaaggaggaccaggagcccatccgctgccctgtgcccggctgtgatggccagggccacatcaccgggaagtatgccagccacaggtctgccagcggctgccccctggccgccaagaggcagaaggatggctacctgaatggcagccagttctcctggaagtctgtgaagacagagggcatgagctgccccaccccaggctgtgatggcagcggccacgtgtctggcagcttcctgacccacaggagcctgagcggctgcccccgggccaccagcgccatgaagaaggccaagctgagcggggagcagatgctgaccatcaagcagagggccagcaatggaattgaaaatgatgaggagatcaagcagctggatgaggagatcaaggagctgaatgaaagcaacagccagatggaggccgacatgatcaagctgcggacccagatcaccaccatggagagcaacctgaagaccatcgaggaggagaacaaggtgattgagcagcagaatgaaagcctgctgcacgagctggccaacctgagccagagcctcatccacagcctggccaacatccagctgccccacatggaccccatcaatgagcagaactttgatgcctacgtgaccaccctgacagagatgtacaccaaccaggaccgctaccagagccctgagaacaaggccctgctggagaacatcaagcaggccgtgcggggcatccaggtgtag

SEQ ID NO: 160592 - DNA, 555 bp, Artificial Sequence
  Description of Artificial Sequence: Synthetic coding sequence
atgagctgccccaccccaggctgtgatggcagcggccacgtgtctggcagcttcctgacccacaggagcctgagcggctgcccccgggccaccagcgccatgaagaaggccaagctgagcggggagcagatgctgaccatcaagcagagggccagcaatggaattgaaaatgatgaggagatcaagcagctggatgaggagatcaaggagctgaatgaaagcaacagccagatggaggccgacatgatcaagctgcggacccaggtgaccatcaccaccatggagagcaacctgaagaccatcgaggaggagaacaaggtgattgagcagcagaatgaaagcctgctgcacgagctggccaacctgagccagagcctcatccacagcctggccaacatccagctgccccacatggaccccatcaatgagcagaactttgatgcctacgtgaccaccctgacagagatgtacaccaaccaggaccgctaccagagccctgagaacaaggccctgctggagaacatcaagcaggccgtgcggggcatccaggtgtag

SEQ ID NO: 160593 - DNA, 3555 bp, Artificial Sequence
  Description of Artificial Sequence: Synthetic coding sequence
atggaggtggacacagaggagaagaggcacaggaccaggagcaaaggagtgcgggtgcctgtggagcccgccatccaggagctgttcagctgccccaccccaggctgtgatggcagcggccacgtgtctgggaagtatgcccggcacaggtctgtgtatggctgccccctggccaagaagaggaagacccaggacaagcagccccaggagcccgcccccaagaggaagccctttgctgtgaaggctgacagcagctctgtggatgaatgtgatgacagtgatggaacagaggacatggatgagaaggaggaggatgaaggagaggagtacagcgaggacaatgatgagcctggagatgaagatgaagaagatgaggagggggaccgggaggaggaggaggagattgaggaggaggatgaagatgatgatgaagatggagaagatgtggaggatgaggaggaggaggaggaggaggaggaggaggaggaggaggaggaggagaatgaagaccaccagatgaactgccacaacacccgcatcatgcaggacacagagaaggatgacaacaacaatgatgaatatgacaactatgatgagctggtggccaagagcctgctgaacctgggcaagattgctgaagatgctgcctaccgggccaggacagaaagtgagatgaacagcaacaccagcaacagcctggaggatgacagcgacaagaatgaaaacctgggcaggaagtctgagctgagcctggacctggacagtgatgtggtgcgggagaccgtggacagcctgaagctgctggcccagggccacggcgtggtgctgtctgagaacatgaatgacagaaattatgctgacagcatgagccagcaggacagcaggaacatgaactacgtgatgctgggcaagcccatgaacaacggcctgatggagaagatggtggaggagagtgatgaggaggtgtgcctgagcagcctggagtgcctgaggaaccagtgctttgacctggccaggaagctgtctgagaccaacccccaggagaggaacccccagcagaacatgaacatccggcagcacgtgcggcctgaggaggacttccctggccgcaccccagacaggaactacagcgacatgctgaacctgatgaggctggaggagcagctgagccccaggagccgggtgtttgccagctgtgccaaggaggatggctgccacgagagagatgatgacaccacctctgtgaacagcgacagaagtgaggaggtgtttgacatgaccaagggcaacctgaccctgctggagaaggccatcgccctggagacagagcgggccaaggccatgagggagaagatggccatggaggccggccggcgggacaacatgaggagctatgaggaccagagcccccggcagctgcccggggaggacaggaagcccaagagcagtgacagccacgtgaagaagccctactatgaccccagcaggacagagaagaaggagagcaaatgtcccaccccaggctgtgatggcaccggccacgtgacaggcctgtacccccaccacaggagcctgagcggctgcccccacaaggacagagtgcccccagagatcctggccatgcatgagagcgtgctgaagtgccccaccccaggctgcaccggccggggccacgtgaacagcaacagaaacagccacaggagcctgagcggctgccccatcgctgctgctgagaagctggccaaggcccaggagaagcaccagagctgtgatgtgtccaagagcagccaggccagtgacagagtgctgcggcccatgtgctttgtgaagcagctggagatcccccagtatggctacagaaacaacgtgcccaccaccacccccaggagcaacctggccaaggagctggagaagtacagcaagaccagctttgagtacaacagctatgacaaccacacctacggcaagagggccatcgcccccaaggtgcagacccgggacatcagccccaagggctatgatgatgccaagcgctactgcaaggaccccagccccagcagcagcagcaccagcagctatgcccccagcagcagcagcaacctgagctgtggcggcggcagcagcgccagcagcacctgcagcaagagcagctttgactacacccatgacatggaggccgcccacatggccgccacagccatcctgaacctgagcacccgctgccgggagatgccccagaacctgagcaccaagccccaggacctgtgtgccaccagaaatccagacatggaggtggatgaaaatggcaccctggacctgtccatgaacaagcagaggccccgggacagctgctgccccatcctgacccccctggagcccatgagcccccagcagcaggccgtgatgaacaaccgctgcttccagctgggggagggggactgctgggacctgcctgtggactacaccaagatgaagcccaggagaattgatgaagatgagagcaaggacatcaccccagaggacctggaccccttccaggaggccctggaggagcggcgctacccaggagaggtgaccatccccagccccaagcccaagtacccccagtgcaaggagagcaagaaggacctgatcaccctgagcggctgccccctggccgacaagagcatccgctccatgctggccaccagcagccaggagctgaagtgccccaccccaggctgtgatggcagcggccacatcactggaaattatgccagccacaggagcctgagcggctgcccccgggccaagaagagcggcatcagaattgcccagagcaaggaggacaaggaggaccaggagcccatccgctgccctgtgcccggctgtgatggccagggccacatcaccgggaagtatgccagccacaggtctgccagcggctgccccctggccgccaagaggcagaaggatggctacctgaatggcagccagttctcctggaagtctgtgaagacagagggcatgagctgccccaccccaggctgtgatggcagcggccacgtgtctggcagcttcctgacccacaggagcctgagcggctgcccccgggccaccagcgccatgaagaaggccaagctgagcggggagcagatgctgaccatcaagcagagggccagcaatggaattgaaaatgatgaggagatcaagcagctggatgaggagatcaaggagctgaatgaaagcaacagccagatggaggccgacatgatcaagctgcggacccagatcaccaccatggagagcaacctgaagaccatcgaggaggagaacaaggtgattgagcagcagaatgaaagcctgctgcacgagctggccaacctgagccagagcctcatccacagcctggccaacatccagctgccccacatggaccccatcaatgagcagaactttgatgcctacgtgaccaccctgacagagatgtacaccaaccaggaccgctaccagagccctgagaacaaggccctgctggagaacatcaagcaggccgtgcggggcatccaggtgtag

SEQ ID NO: 160594 - DNA, 552 bp, Artificial Sequence
  Description of Artificial Sequence: Synthetic coding sequence
atgagccagaagccagccaaggagggcccccggctgagcaagaaccagaagtacagcgagcacttcagcatccactgctgcccccccttcaccttcctgaacagcaagaaggagatcgtggacaggaagtacagcatctgcaagagcggctgcttctaccagaagaaggaggaggactggatctgctgtgcctgccagaagaccaggaccagccggcgggccaagagcccccagaggcccaagcagcagcctgctgcccctcctgctgtggtgcgggccccagccaagcccaggagcccccccaggtctgagcggcagcccaggagcccccccaggtctgagcggcagcccaggagcccccccaggtctgagcggcagcccaggagcccccccaggtctgagcggcagccccggcccaggcctgaggtgcggcccccaccagccaagcagaggcctccccagaagagcaagcagcagcccaggagcagccccctgcggggccctggggccagcagaggaggcagccctgtgaaggccagccgcttctggtag

SEQ ID NO: 160595 - DNA, 246 bp, Artificial Sequence
  Description of Artificial Sequence: Synthetic coding sequence
atgagccagaagccagccaaggagggcccccggctgagcaagaaccagaagtacagcgagcacttcagcatccactgctgcccccccttcaccttcctgaacagcaagaaggagatcgtggacaggaagtacagcatctgcaagagcggctgcttctaccagaagaaggaggaggactggatctgctgtgcctgccagaagacccggctgaagaggaagatccggcccacccccaagaagaagtag

SEQ ID NO: 160596 - DNA, 246 bp, Artificial Sequence; identical to SEQ ID NO: 160595
  Description of Artificial Sequence: Synthetic coding sequence

SEQ ID NO: 160597 - DNA, 246 bp, Artificial Sequence; identical to SEQ ID NO: 160595
  Description of Artificial Sequence: Synthetic coding sequence

SEQ ID NO: 160598 - DNA, 552 bp, Artificial Sequence; identical to SEQ ID NO: 160594
  Description of Artificial Sequence: Synthetic coding sequence

SEQ ID NO: 160599 - DNA, 552 bp, Artificial Sequence; identical to SEQ ID NO: 160594
  Description of Artificial Sequence: Synthetic coding sequence

SEQ ID NO: 160600 - DNA, 246 bp, Artificial Sequence; identical to SEQ ID NO: 160595
  Description of Artificial Sequence: Synthetic coding sequence

SEQ ID NO: 160601 - DNA, 552 bp, Artificial Sequence; identical to SEQ ID NO: 160594
  Description of Artificial Sequence: Synthetic coding sequence

SEQ ID NO: 160602 - DNA, 246 bp, Artificial Sequence; identical to SEQ ID NO: 160595
  Description of Artificial Sequence: Synthetic coding sequence

SEQ ID NO: 160603 - DNA, 177 bp, Artificial Sequence
  Description of Artificial Sequence: Synthetic coding sequence
atgagccagaagccagccaaggagggcccccggctgagcaagaaccagaagtacagcgagcacttcagcatccactgctgcccccccttcaccttcctgaacagcaagaaggagatcgtggacaggaagtacagcatctgcaagagcggctgcttctaccagaagaaggaggagtag

SEQ ID NO: 160604 - DNA, 423 bp, Artificial Sequence
  Description of Artificial Sequence: Synthetic coding sequence
atgctgcaggccgctgacttcatcgagaggacagaaacagctggggagctgagccggggcctcatcggcgtgctgagcagccagatctcctggtgcctgctgaatgtgaacctgagcaagctgcccacccggctgcagaggctgagctgcagcgtgctgaacagcagccctgccatgagaggaggagcccggggccggccccagctgaccctggagcggcccctgcggcccggctgccgcctgcacagctgcagcgaggccgagaagggcggctttgtgcggaggaaggagatcatcctcttccccccctgtgaagatcctgcccggggctggctgagcgccaaccctggccgggagcccagccctggcatctgctggcacctgaacctgggcctgcccagcctgcacaactgtgaggagtag

SEQ ID NO: 160605 - DNA, 816 bp, Artificial Sequence
  Description of Artificial Sequence: Synthetic coding sequence
atgtttggcctgaagagaaatgctgtgattggcctgaacctgtactgcggcggggccggcctgggcgccggcagcggcggggccaccaggcctgggggccgcctgctggccacagagaaggaggccagcgcccggcgggagatcggcggcggggaggccggggctgtgattggaggcagcgctggggccagcccccccagcaccctgaccccagacagccggcgggtggcccggcccccacccatcggggctgaggtgcctgatgtgacagccaccccagcccggctgctcttctttgcccccaccaggagagctgcccccctggaggagatggaggccccagctgctgatgccatcatgagccctgaggaggagctggatggctatgagcctgagcccctgggcaagaggcctgctgtgctgcccctgctggagctggtgggggagagcggcaacaacaccagcacagatggcagcctgcccagcaccccacctcctgctgaggaggaggaggatgagctgtaccggcagagcctggagatcatcagccgctacctgcgggagcaggccactggagccaaggacaccaagcccatgggccgcagcggggccaccagcaggaaggccctggagaccctgcggcgggtgggagatggagtgcagaggaaccacgagacagccttccagggctgggtgtgtggggtgctgccctgccggggcccccggcgctggcaccaggagtgtgccgccggcttctgccgctgctgctggagccgctcctggtttggcatcagcaacaagatcgccctgctgtag

SEQ ID NO: 160606 - DNA, 1053 bp, Artificial Sequence
  Description of Artificial Sequence: Synthetic coding sequence
atgtttggcctgaagagaaatgctgtgattggcctgaacctgtactgcggcggggccggcctgggcgccggcagcggcggggccaccaggcctgggggccgcctgctggccacagagaaggaggccagcgcccggcgggagatcggcggcggggaggccggggctgtgattggaggcagcgctggggccagcccccccagcaccctgaccccagacagccggcgggtggcccggcccccacccatcggggctgaggtgcctgatgtgacagccaccccagcccggctgctcttctttgcccccaccaggagagctgcccccctggaggagatggaggccccagctgctgatgccatcatgagccctgaggaggagctggatggctatgagcctgagcccctgggcaagaggcctgctgtgctgcccctgctggagctggtgggggagagcggcaacaacaccagcacagatggcagcctgcccagcaccccacctcctgctgaggaggaggaggatgagctgtaccggcagagcctggagatcatcagccgctacctgcgggagcaggccactggagccaaggacaccaagcccatgggccgcagcggggccaccagcaggaaggccctggagaccctgcggcgggtgggagatggagtgcagaggaaccacgagacagccttccagggcatgctgaggaagctggacatcaagaatgaagatgatgtgaagagcctgagccgggtgatgatccacgtgttcagtgatggagtgaccaactggggccgcatcgtgaccctcatcagctttggagcctttgtggccaagcacctgaagaccatcaaccaggagagctgcatcgagcccctggccgagagcatcacagatgtgctggtgaggaccaagagggactggctggtgaagcagaggggctgggatggctttgtggagttcttccacgtggaggacctggagggcggcatcagaaatgtgctgctggcctttgctggggtggccggcgtgggcgccggcctggcctacctgatcagatag

SEQ ID NO: 160607 - DNA, 840 bp, Artificial Sequence
  Description of Artificial Sequence: Synthetic coding sequence
atgtttggcctgaagagaaatgctgtgattggcctgaacctgtactgcggcggggccggcctgggcgccggcagcggcggggccaccaggcctgggggccgcctgctggccacagagatggaggccccagctgctgatgccatcatgagccctgaggaggagctggatggctatgagcctgagcccctgggcaagaggcctgctgtgctgcccctgctggagctggtgggggagagcggcaacaacaccagcacagatggcagcctgcccagcaccccacctcctgctgaggaggaggaggatgagctgtaccggcagagcctggagatcatcagccgctacctgcgggagcaggccaccggggccaaggacaccaagcccatgggccgcagcggggccaccagcaggaaggccctggagaccctgcggcgggtgggagatggagtgcagagaaatcatgaaacagccttccagggcatgctgaggaagctggacatcaagaatgaagatgatgtgaagagcctgagccgggtgatgattcatgtgttcagtgatggagtgaccaactggggcagaattgtgaccctcatcagctttggagcctttgtggccaagcacctgaagaccatcaaccaggagagctgcatcgagcccctggccgagagcatcacagatgtgctggtgaggaccaagagggactggctggtgaagcagaggggctgggatggctttgtggagttcttccacgtggaggacctggagggcggcatcagaaatgtgctgctggcctttgctggggtggccggcgtgggcgccggcctggcctacctgatcagatag

SEQ ID NO: 160608 - DNA, 1224 bp, Artificial Sequence
  Description of Artificial Sequence: Synthetic coding sequence
atggtgaatgagtacaagaagatcctgctgctgaagggctttgagctgatggatgactaccacttcaccagcatcaagagcctgctggcctatgacctgggcctgaccaccaagatgcaggaggagtacaaccgcatcaagatcacagacctgatggagaagaagttccagggcgtggcctgcctggacaagctgattgagctggccaaggacatgcccagcctgaagaacctggtgaacaacctgaggaaggagaagagcaaggtggccaagaagatcaagacccaggagaaggcccctgtgaagaagatcaaccaggaggaggtgggcctggccgccccagcccccacagccaggaacaagctgaccagcgaggcccggggccgcatccctgtggcccagaagaggaagacccccaacaaggagaagacagaggccaagaggaacaaggtgtcccaggagcagagcaagcccccaggccccagcggggccagcaccagcgctgctgtggaccacccccccctgccccagaccagcagcagcacccccagcaacaccagcttcacccccaaccaggagacccaggcccagaggcaggtggatgccaggagaaatgtgccccagaatgaccctgtgacagtggtggtgctgaaggccacagcccccttcaagtatgagagcccagaaaatggcaagagcaccatgtttcatgccaccgtggccagcaagacccagtacttccacgtgaaggtgtttgacatcaacctgaaggagaagtttgtgaggaagaaggtgatcaccatcagtgactacagtgaatgtaaaggagtgatggagatcaaggaggccagctctgtgtctgacttcaaccagaactttgaggtgcccaaccgcatcatcgagatcgccaacaagacccccaagatcagccagctgtacaagcaggccagcggcaccatggtgtatggcctcttcatgctgcagaagaagtctgtgcacaagaagaacaccatctatgagatccaggacaacacaggctccatggatgtggtgggcagcggcaagtggcacaacatcaagtgtgagaagggggacaagctgcggctcttctgcctgcagctgaggacagtggacaggaagctgaagctggtgtgtggcagccacagcttcatcaaggtgatcaaggccaagaagaacaaggagggccccatgaatgtgaactag

SEQ ID NO: 160609 - DNA, 315 bp, Artificial Sequence
  Description of Artificial Sequence: Synthetic coding sequence
tgacccaaccgcatcatcgagatcgccaacaagacccccaagatcagccagctgtacaagcaggccagcggcaccatggtgtatggcctcttcatgctgcagaagaagtctgtgcacaagaagaacaccatctatgagatccaggacaacacaggctccatggatgtggtgggcagcggcaagtggcacaacatcaagtgtgagaagggggacaagctgcggctcttctgcctgcagctgaggacagtggacaggaagctgaagctggtgatcaaggccaagaagaacaaggagggccccatgaatgtgaactag

SEQ ID NO: 160610 - DNA, 795 bp, Artificial Sequence
  Description of Artificial Sequence: Synthetic coding sequence
atgaggccagacagagctgaggcccctggccccccagccatggccgccggcggccctggagctggcagcgctgcccctgtgagcagcaccagcagcctgcccctggccgccctgaacatgagggtgagaagaaggctgagcctcttcctgaatgtgaggacccaggtggccgctgactggacagccctggccgaggagatggactttgagtacctggagatccggcagctggagacccaggccgaccccaccggccgcctgctggatgcctggcagggccggcctggggcctctgtgggccgcctgctggagctgctgaccaagctgggcagagatgatgtgctgctggagctgggccccagcatcggccacatgcctgagagatttgatgccttcatctgctactgccccagcgacatccagtttgtgcaggagatgatccggcagctggagcagaccaactaccgcctgaagctgtgtgtgtctgacagagatgtgctgcccggcacctgtgtgtggagcatcgccagcgagctgattgagaagcgctgcaggaggatggtggtggtggtgtctgatgactacctgcagagcaaagaatgtgacttccagaccaagtttgccctgagcctgagccctggggcccaccagaagaggctcatccccatcaagtacaaggccatgaagaaggagttccccagcatcctgcgcttcatcaccgtgtgtgactacaccaacccctgcaccaagtcctggttctggacccggctggccaaggccctgagcctgccctag

SEQ ID NO: 160611 - DNA, 615 bp, Artificial Sequence
  Description of Artificial Sequence: Synthetic coding sequence
atgaggccagacagagctgaggcccctggccccccagccatggccgccggcggccctggagctggcagcgctgcccctgtgagcagcaccagcagcctgcccctggccgccctgaacatgagggtgagaagaaggctgagcctcttcctgaatgtgaggacccaggtggccgctgactggacagccctggccgaggagatggactttgagtacctggagatccggcagctggagacccaggccgaccccaccggccgcctgctggatgcctggcagggccggcctggggcctctgtgggccgcctgctggagctgctgaccaagctgggcagagatgatgtgctgctggagctgggccccagcattgaggaggactgccagaagtacatcctgaagcagcagcaggaggaggccgagaagcccctgcaggtggccgctgtggacagctctgtgcccaggacagctgagctggccggcatcaccaccctggatgaccccctgggcgccgccggctggtggtggctgagcctgatgatcacctgccgggccagaaatgtgaccagccggcccaacctgcacagcgccagcctgcaggtgcccatccgcagtgactag

SEQ ID NO: 160612 - DNA, 480 bp, Artificial Sequence
  Description of Artificial Sequence: Synthetic coding sequence
atgaggccagacagagctgaggcccctggccccccagccatggccgccggcggccctggagctggcagcgctgcccctgtgagcagcaccagcagcctgcccctggccgccctgaacatgagggtgagaagaaggctgagcctcttcctgaatgtgaggacccaggtggccgctgactggacagccctggccgaggagatggactttgagtacctggagatccggcagctggagacccaggccgaccccaccggccgcctgctggatgcctggcagggccggcctggggcctctgtgggccgcctgctggagctgctgaccaagctgggcagagatgatgtgctgctggagctgggccccagcatcggggctgctggctggtggtggctgagcctgatgatcacctgccgggccagaaatgtgaccagccggcccaacctgcacagcgccagcctgcaggtgcccatccgcagtgactag

SEQ ID NO: 160613 - DNA, 807 bp, Artificial Sequence
  Description of Artificial Sequence: Synthetic coding sequence
atgttcaggatgctgaacagcagctttgaagatgaccccttcttcagcgagagcatcctggcccaccgggagaacatgaggcagatgatccgctccttcagcgagcccttcggccgggacctgctgagcatcagtgatggccggggccgggcccacaacagaagaggccacaatgatggagaggacagcctgacccacacagatgtgtcctccttccagaccatggaccagatggtgagcaacatgaggaactacatgcagaagctggagaggaactttggccagctgtctgtggaccccaacggccacagcttctgcagcagctctgtgatgacctacagcaagattggagatgagccccccaaggtgttccaggccagcacccagacccggcgggcccctgggggcatcaaggagaccaggaaggccatgagggacagcgacagcggcctggagaagatggccatcggccaccacatccatgaccgggcccacgtgatcaagaagagcaagaacaagaagacaggagatgaggaggtgaaccaggagttcatcaacatgaatgaaagtgatgcccacgcctttgatgaggagtggcagagcgaggtgctgaagtacaagccaggccgccacaacctgggcaacaccaggatgaggtctgtgggccacgagaaccctggcagccgggagctgaagagaagagagaagccccagcagagccctgccattgaacatggaagaagaagcaatgtgctgggggacaagctgcacatcaagggcagctctgtgaagagcaacaagaagtag

SEQ ID NO: 160614 - DNA, 732 bp, Artificial Sequence
  Description of Artificial Sequence: Synthetic coding sequence
atgaggcagatgatccgctccttcagcgagcccttcggccgggacctgctgagcatcagtgatggccggggccgggcccacaacagaagaggccacaatgatggagaggacagcctgacccacacagatgtgagcagcttccagaccatggaccagatggtgagcaacatgaggaactacatgcagaagctggagaggaactttggccagctgtctgtggaccccaacggccacagcttctgcagcagctctgtgatgacctacagcaagattggagatgagccccccaaggtgttccaggccagcacccagacccggcgggcccctgggggcatcaaggagaccaggaaggccatgagggacagcgacagcggcctggagaagatggccatcggccaccacatccatgaccgggcccacgtgatcaagaagagcaagaacaagaagacaggagatgaggaggtgaaccaggagttcatcaacatgaatgaaagtgatgcccacgcctttgatgaggagtggcagagcgaggtgctgaagtacaagccaggccgccacaacctgggcaacaccaggatgaggtctgtgggccatgaaaatcctggcagccgggagctgaagaggcgggagaagccccagcagagccctgccatcgagcacggccgccgcagcaatgtgctgggggacaagctgcacatcaagggcagctctgtgaagagcaacaagaagtag

SEQ ID NO: 160615 - DNA, 900 bp, Artificial Sequence
  Description of Artificial Sequence: Synthetic coding sequence
atgctgaaggaggtgctgcagcgggagggcaagagctacaagtctgagaccctgatgtacatcaagaaggcccgggccagcgagaacaagctgtctgagagcatcctggcccaccgggagaacatgaggcagatgatccgctccttcagcgagcccttcggccgggacctgctgagcatcagtgatggccggggccgggcccacaacagaagaggccacaatgatggagaggacagcctgacagccaccagctgcagcctggtgccctttggagactttggaggcatgcacacagatgtgagcagcttccagaccatggaccagatggtgagcaacatgaggaactacatgcagaagctggagaggaactttggccagctgtctgtggaccccaacggccacagcttctgcagcagctctgtgatgacctacagcaagattggagatgagccccccaaggtgttccaggccagcacccagacccggcgggcccctgggggcatcaaggagaccaggaaggccatgagggacagcgacagcggcctggagaagatggccatcggccaccacatccatgaccgggcccacgtgatcaagaagagcaagaacaagaagacaggagatgaggaggtgaaccaggagttcatcaacatgaatgaaagtgatgcccacgcctttgatgaggagtggcagagcgaggtgctgaagtacaagccaggccgccacaacctgggcaacaccaggatgaggtctgtgggccatgaaaatcctggcagccgggagctgaagaggcgggagaagccccagcagagccctgccatcgagcacggccgccgcagcaatgtgctgggggacaagctgcacatcaagggcagctctgtgaagagcaacaagaagtag

SEQ ID NO: 160616 - DNA, 777 bp, Artificial Sequence
  Description of Artificial Sequence: Synthetic coding sequence
atgaggcagatgatccgctccttcagcgagcccttcggccgggacctgctgagcatcagtgatggccggggccgggcccacaacagaagaggccacaatgatggagaggacagcctgacagccaccagctgcagcctggtgccctttggagactttggaggcatgcacacagatgtgtcctccttccagaccatggaccagatggtgagcaacatgaggaactacatgcagaagctggagaggaactttggccagctgtctgtggaccccaacggccacagcttctgcagcagctctgtgatgacctacagcaagattggagatgagccccccaaggtgttccaggccagcacccagacccggcgggcccctgggggcatcaaggagaccaggaaggccatgagggacagcgacagcggcctggagaagatggccatcggccaccacatccatgaccgggcccacgtgatcaagaagagcaagaacaagaagacaggagatgaggaggtgaaccaggagttcatcaacatgaatgaaagtgatgcccacgcctttgatgaggagtggcagagcgaggtgctgaagtacaagccaggccgccacaacctgggcaacaccaggatgaggtctgtgggccacgagaaccctggcagccgggagctgaagagaagagagaagccccagcagagccctgccattgaacatggaagaagaagcaatgtgctgggggacaagctgcacatcaagggcagctctgtgaagagcaacaagaagtag

SEQ ID NO: 160617 - DNA, 777 bp, Artificial Sequence; identical to SEQ ID NO: 160616
  Description of Artificial Sequence: Synthetic coding sequence

SEQ ID NO: 160618 - DNA, 732 bp, Artificial Sequence; identical to SEQ ID NO: 160614
  Description of Artificial Sequence: Synthetic coding sequence

SEQ ID NO: 160619 - DNA, 732 bp, Artificial Sequence; identical to SEQ ID NO: 160614
  Description of Artificial Sequence: Synthetic coding sequence

SEQ ID NO: 160620 - DNA, 603 bp, Artificial Sequence
  Description of Artificial Sequence: Synthetic coding sequence
atgaggcagatgatccgctccttcagcgagcccttcggccgggacctgctgagcatcagtgatggccggggccgggcccacaacagaagaggccacaatgatggagaggacagcctgacccacacagatgtgagcagcttccagaccatggaccagatggtgagcaacatgaggaactacatgcagaagctggagaggaacttcatcaaggagaccaggaaggccatgagggacagcgacagcggcctggagaagatggccatcggccaccacatccatgaccgggcccacgtgatcaagaagagcaagaacaagaagacaggagatgaggaggtgaaccaggagttcatcaacatgaatgaaagtgatgcccacgcctttgatgaggagtggcagagcgaggtgctgaagtacaagccaggccgccacaacctgggcaacaccaggatgaggtctgtgggccacgagaaccctggcagccgggagctgaagagaagagagaagccccagcagagccctgccattgaacatggaagaagaagcaatgtgctgggggacaagctgcacatcaagggcagctctgtgaagagcaacaagaagtag

SEQ ID NO: 160621 - DNA, 747 bp, Artificial Sequence
  Description of Artificial Sequence: Synthetic coding sequence
atgttccgcttcatgagagatgtggagcctgaggaccccatgttcctgatggacccctttgccatccaccggcagcacatgagcaggatgctgagcggcggcttcggctacagccccttcctgagcatcacagatggcaacatgcctggcaccaggcctgccagcaggaggatgcagcaggccggggctgtgagccccttcggcatgctgggcatgtctgggggcttcatggacatgtttggcatgatgaatgacatgattggcaacatggagcacatgacagctgggggcaactgccagaccttcagcagcagcaccgtcatctcctacagcaacacaggagatggagcccccaaggtgtaccaggagaccagcgagatgaggtctgcccctgggggcatccgggagaccaggagaacagtgcgggacagcgacagcggcctggagcagatgagcatcggccaccacatccgggaccgggcccacatcctgcagaggagcaggaaccacaggactggagaccaggaggagcggcaggactacatcaacctggatgaaagtgaagctgctgcctttgatgatgagtggaggcgggagaccagccgcttccggcagcagaggcccctggagttccggcggctggagagcagtggagctgggggccggcgggcagagggccccccccggctggccatccagggccctgaggacagccccagccggcagagccgccgctatgactggtag

SEQ ID NO: 160622 - DNA, 747 bp, Artificial Sequence; identical to SEQ ID NO: 160621
  Description of Artificial Sequence: Synthetic coding sequence

SEQ ID NO: 160623 - DNA, 747 bp, Artificial Sequence; identical to SEQ ID NO: 160621
  Description of Artificial Sequence: Synthetic coding sequence

SEQ ID NO: 160624 - DNA, 747 bp, Artificial Sequence; identical to SEQ ID NO: 160621
  Description of Artificial Sequence: Synthetic coding sequence

SEQ ID NO: 160625 - DNA, 684 bp, Artificial Sequence
  Description of Artificial Sequence: Synthetic coding sequence
atgatggccgccggggccgccctggccctggccctgtggctgctgatgcctcctgtggaggtgggcggggccggccccccacccatccaggatggagagttcaccttcctgctgcctgctggcaggaagcagtgcttctaccagagcgccccagccaatgccagcctggagacagagtaccaggtgattggaggagctggcctggatgtggacttcaccctggagagcccccagggcgtgctgctggtgtctgagagcaggaaggcagatggagtgcacacagtggagcccacagaggccggggactacaagctgtgctttgacaacagcttcagcaccatcagcgagaagctggtgttctttgagctgatctttgacagcctgcaggatgatgaggaggtggagggctgggccgaggccgtggagcctgaggagatgctggatgtgaagatggaggacatcaaggagagcattgagaccatgaggacccggctggagaggagcatccagatgctgaccctgctgcgggcctttgaggcccgggacaggaacctgcaggagggcaacctggagcgggtgaacttctggagcgctgtgaatgtggccgtgctgctgctggtggccgtgctgcaggtgtgcaccctgaagcgcttcttccaggacaagaggcctgtgcccacctag

SEQ ID NO: 160626 - DNA, 873 bp, Artificial Sequence
  Description of Artificial Sequence: Synthetic coding sequence
atgaggcctgctgtgctgggcagcccagaccgggcccccccagaagatgagggccctgtgatggtgaagctggaggacagcgaggaggagggggaggccgccctgtgggaccccggccctgaggccgcccggctgcgcttccgctgcttccgctatgaggaggccaccggcccccaggaggccctggcccagctgcgggagctgtgccggcagtggctgcggcctgaggtgcgcagcaaggagcagatgctggagctgctggtgctggagcagttcctgggcgccctgcccccagagatccaggcccgggtgcagggccagaggcctggcagccctgaggaggccgccgccctggtggatggcctgcggcgggagcccggcggcccccggcgctgggtgacagtgcaggtgcagggccaggaggtgctgtctgagaagatggagcccagcagcttccagcccctgcctgagacagagccccccaccccagagcccggccccaagaccccacccaggaccatgcaggagagccccctgggcctgcaggtgaaggaggagagcgaggtgacagaagattctgacttcctggagagcggccccctggccgccacccaggagagcgtgcccaccctgctgcctgaggaggcccagagatgtggcaccgtgctggaccagatcttcccccacagcaagacaggccctgagggccccagctggagggagcacccccgggccctgtggcatgaggaggccggcggcatcttcagccctggagctggagctggagctgccccagccctgggcgccggctggctgggcgctgctgtggccatgtatgtggcccgctgcagcgccaatgctgccacctgctag

SEQ ID NO: 160627 - DNA, 2205 bp, Artificial Sequence
  Description of Artificial Sequence: Synthetic coding sequence
atgaggcctgctgtgctgggcagcccagaccgggcccccccagaagatgagggccctgtgatggtgaagctggaggacagcgaggaggagggggaggccgccctgtgggaccccggccctgaggccgcccggctgcgcttccgctgcttccgctatgaggaggccaccggcccccaggaggccctggcccagctgcgggagctgtgccggcagtggctgcggcctgaggtgcgcagcaaggagcagatgctggagctgctggtgctggagcagttcctgggcgccctgcccccagagatccaggcccgggtgcagggccagaggcctggcagccctgaggaggccgccgccctggtggatggcctgcggcgggagcccggcggcccccggcgctgggtgacagtgcaggtgcagggccaggaggtgctgtctgagaagatggagcccagcagcttccagcccctgcctgagacagagccccccaccccagagcccggccccaagaccccacccaggaccatgcaggagagccccctgggcctgcaggtgaaggaggagagcgaggtgacagaagattctgacttcctggagagcggccccctggccgccacccaggagagcgtgcccaccctgctgcctgaggaggcccagagatgtggcaccgtgctggaccagatcttcccccacagcaagacaggccctgagggccccagctggagggagcacccccgggccctgtggcatgaggaggccggcggcatcttcagccctggctttgccctgcagctgggcagcatctctgctggccctggctctgtgagcccccacctgcacgtgccctgggacctgggcatggccggcctgagcggccagatccagagccccagccgggagggcggctttgcccacgccctgctgctgcccagcgacctgcggtctgagcaggaccccacagatgaggacccctgccggggcgtgggccctgccctgatcaccacccgctggaggagcccccggggccgcagccggggccggcccagcactggaggaggagtggtgcggggcggccgctgtgatgtgtgtgggaaggtgttcagccagaggagcaacctgctgcggcaccagaagatccacactggagagcggccctttgtgtgcagtgaatgtggccgctccttcagccgcagcagccacctgctgcggcaccagctgacccacacagaggagcggccctttgtgtgtggggactgtggccagggctttgtgcgcagcgcccggctggaggagcacagaagagtgcacactggagagcagcccttccgctgtgccgagtgtggccagagcttccggcagaggagcaacctgctgcagcaccagaggatccacggggaccccccaggccctggggccaagcccccagcccctcctggggcccctgagcccccaggccccttcccctgcagtgaatgtcgggagagctttgcccggcgggctgtgctgctggagcaccaggccgtgcacactggagacaagagctttggctgtgtggagtgtggggagcgcttcggccgccgctctgtgctgctgcagcaccggcgggtgcacagcggggagcggccctttgcctgtgctgaatgtggccagagcttccggcagaggagcaacctgacccagcaccggcgcatccacactggagagcggccctttgcctgtgctgaatgtgggaaggccttccggcagaggcccaccctgacccagcacctgcgggtgcacactggagagaagccctttgcctgcccagaatgtggccagcgcttcagccagaggctgaagctgaccaggcaccagaggacccacactggagagaagccctaccactgtggagaatgtggcctgggcttcacccaggtgtcccggctgacagagcaccagaggatccacactggagagcggccctttgcctgcccagaatgtggccagagcttccggcagcacgccaacctgacccagcaccggcgcatccacactggagagcggccctatgcctgcccagaatgtgggaaggccttccggcagaggcccaccctgacccagcacctgcggacccaccggcgggagaagccctttgcctgccaggactgtggccgccgcttccaccagagcaccaagctgatccagcaccagagggtgcacagcgctgagtag

SEQ ID NO: 160628 - DNA, 1539 bp, Artificial Sequence
  Description of Artificial Sequence: Synthetic coding sequence
atggcccacagctgccgctggaggtttcctgcccggcccggcaccaccggcggcggcggcggcggcggccggcggggcctgggcggggccccccggcagagggtgcctgccctgctgctgcccccaggcccccctgtgggcggcggcggccctggggccccacccagccccccagctgtggccgctgctgctgctgctgctggcagcagcggggccggcgtgcctggaggagctgctgctgccagcgctgccagcagcagcagcgccagcagcagcagcagcagcagcagcagcgccagcagcggccctgccctgctgcgggtgggccctggctttgatgctgccctgcaggtgtctgctgccatcggcaccaacctgcggcgcttccgggctgtgtttggagagagcggcggcggcggcggcagcggggagctgaccacccagatcccctgctcctggaggaccaagggccacatccatgacaagaagacagagcccttccggctgctggcctggagctggtgcctgaatgatgagcagttcctgggcttcggcagtgatgaggaggtgcgggtgcgcagccccaccaggagccccagcgtgaagaccagccccaggaagccccggggccggcccaggagcggcagtgacaggaacagcgccatcctgagtgaccccagcgtcttcagccccctgaacaagtctgagaccaagagcggggacaagatcaagaagaaggacagcaagagcattgagaagaagaggggccggccccccaccttccctggggtgaagatcaagatcacccacggcaaggacatcagcgagctgcccaagggcaacaaggaggacagcctgaagaagatcaagaggacccccagcgccaccttccagcaggccaccaagatcaagaagctgcgggccggcaagctgagccccctgaagagcaagttcaagacaggcaagctgcagattggaaggaagggcgtgcagatcgtgagaagaagaggccggccccccagcacagagcgcatcaagaccccatctggcctgctgatcaacagcgagctggagaagccccagaaggtgaggaaggacaaggagggcaccccacccctgaccaaggaggacaagacagtggtgcggcagagcccccggcgcatcaagcctgtgcgcatcatccccagcagcaagaggacagatgccaccatcgccaagcagctgctgcagagggccaagaagggggcccagaagaagattgagaaggaggccgcccagctgcagggcaggaaggtgaagacccaggtgaagaacatccggcagttcatcatgcctgtggtgtctgccatcagcagccgcatcatcaagaccccccggcgcttcattgaagatgaagattatgacccccccatcaagatcgcccggctggagagcacccccaacagccgcttcagcgcccccagctgtggcagcagcgagaagagcagcgctgccagccagcacagcagccagatgagcagtgacagcagccgctcctag

SEQ ID NO: 160629 - DNA, 11796 bp, Artificial Sequence
  Description of Artificial Sequence: Synthetic coding sequence
atggcccacagctgccgctggaggtttcctgcccggcccggcaccaccggcggcggcggcggcggcggccggcggggcctgggcggggccccccggcagagggtgcctgccctgctgctgcccccaggcccccctgtgggcggcggcggccctggggccccacccagccccccagctgtggccgctgctgctgctgctgctggcagcagcggggccggcgtgcctggaggagctgctgctgccagcgctgccagcagcagcagcgccagcagcagcagcagcagcagcagcagcgccagcagcggccctgccctgctgcgggtgggccctggctttgatgctgccctgcaggtgtctgctgccatcggcaccaacctgcggcgcttccgggctgtgtttggagagagcggcggcggcggcggcagcggggaggatgagcagttcctgggctttggaagtgatgaggaggtgcgggtgcgcagccccaccaggagccccagcgtgaagaccagccccaggaagccccggggccggcccaggagcggcagtgacagaaattctgccatcctgagtgaccccagcgtcttcagccccctgaacaagtctgagaccaagagcggggacaagatcaagaagaaggacagcaagagcattgagaagaagaggggccggccccccaccttccctggggtgaagatcaagatcacccacggcaaggacatcagcgagctgcccaagggcaacaaggaggacagcctgaagaagatcaagaggaccccatctgccaccttccagcaggccaccaagatcaagaagctgcgggccggcaagctgagccccctgaagagcaagttcaagacaggcaagctgcagatcggcaggaaaggagtgcagatcgtgagaagaagaggccggccccccagcacagagcgcatcaagacccccagcggcctgctgatcaacagcgagctggagaagccccagaaggtgaggaaggacaaggagggcaccccacccctgaccaaggaggacaagacagtggtgcggcagagcccccggcgcatcaagcctgtgcgcatcatccccagcagcaagaggacagatgccaccatcgccaagcagctgctgcagagggccaagaagggggcccagaagaagattgagaaggaggccgcccagctgcagggcaggaaggtgaagacccaggtgaagaacatccggcagttcatcatgcctgtggtgtctgccatcagcagccgcatcatcaagaccccccggcgcttcattgaagatgaggactatgacccccccatcaagatcgcccggctggagagcacccccaacagccgcttcagcgcccccagctgtggcagcagcgagaagagcagcgctgccagccagcacagcagccagatgagcagtgacagcagccgcagcagcagccccagcgtggacaccagcacagacagccaggccagcgaggagatccaggtgctgcctgaggagaggagtgacaccccagaggtgcacccccccctgcccatcagccagagcccagaaaatgaaagcaatgaccggcgcagccgccgctacagcgtgtctgagaggagctttggcagcaggaccaccaagaagctgagcaccctgcagagcgccccccagcagcagaccagcagcagccccccaccacccctgctgaccccacctccacccctgcagcctgccagcagcatcagtgaccacaccccctggctgatgccacccaccatccccctggccagccccttcctgcctgccagcacagcccccatgcagggcaagaggaagagcatcctgcgggagcccaccttccgctggaccagcctgaagcacagccgctctgagccccagtacttcagcagcgccaagtatgccaaggagggcctcatcaggaagcccatctttgacaacttccggcccccacccctgaccccagaagatgtgggctttgccagcggcttcagcgccagcggcacagctgccagcgcccggctcttcagccccctgcacagcggcaccaggtttgacatgcacaagaggagccccctgctgcgggccccccgcttcaccccatctgaggcccacagccgcatctttgagagcgtgaccctgcccagcaacagaacatctgctggcaccagcagcagtggagtgagcaacaggaagaggaagaggaaggtgttcagccccatccgctctgagcccaggagccccagccacagcatgaggaccaggagcggccgcctgagcagcagcgagctgagccccctgaccccacccagctctgtgagcagcagcctgagcatctctgtgagccccctggccaccagcgccctgaaccccaccttcaccttccccagccacagcctgacccagagcggggagagcgctgagaagaaccagaggcccaggaagcagaccagcgccccagctgagcccttcagcagcagcagccccacccccctcttcccctggttcaccccaggcagccagacagagcggggcaggaacaaggacaaggcccctgaggagctgagcaaggacagagatgctgacaagtctgtggagaaggacaagagccgggagcgggaccgggagcgggagaaggagaacaagcgggagagcaggaaggagaagaggaagaagggcagcgagatccagagcagcagcgccctgtaccctgtgggccgggtgtccaaggagaaggtggtgggagaagatgtggccaccagcagcagcgccaagaaggccactggaaggaagaagagcagcagccatgattctggaacagacatcacctctgtgaccctgggggacaccacagctgtgaagaccaagatcctgatcaagaagggccggggcaacctggagaagaccaacctggacctgggccccacagcccccagcctggagaaggagaagaccctgtgcctgagcacccccagcagcagcacagtgaagcacagcaccagcagcatcggctccatgctggcccaggccgacaagctgcccatgacagacaagagggtggccagcctgctgaagaaggccaaggcccagctgtgcaagattgagaagagcaagagcctgaagcagacagaccagcccaaggcccagggccaggagagtgacagcagcgagacctctgtgcggggcccccgcatcaagcacgtgtgcagaagagctgctgtggccctgggcaggaagagagctgtgtttcctgatgacatgcccaccctgagcgccctgccctgggaggagcgggagaagatcctgagctccatgggaaatgatgacaagagcagcattgctggctctgaagatgctgagcccctggccccacccatcaagcccatcaagcctgtgaccaggaacaaggccccccaggagccccctgtgaagaagggccgccgcagcagaagatgtggccagtgccccggctgccaggtgcctgaggactgtggggtgtgcaccaactgcctggacaagcccaagtttggaggcaggaacatcaagaagcagtgctgcaagatgaggaagtgccagaacctgcagtggatgcccagcaaggcctacctgcagaagcaggccaaggctgtgaagaagaaggagaagaagagcaagaccagcgagaagaaggacagcaaggagagctctgtggtgaagaatgtggtggacagcagccagaagcccaccccatctgcccgggaggaccctgcccccaagaagagcagcagcgagcccccacccaggaagcctgtggaggagaagtctgaggagggcaatgtgtctgcccctggccctgagagcaagcaggccaccaccccagccagcaggaagagcagcaagcaggtgtcccagcctgccctggtgatccccccccagccccccaccaccggcccccccaggaaggaggtgcccaagaccaccccatctgagcccaagaagaagcagcccccacctcctgagagcggccctgagcagagcaagcagaagaaggtggccccccggcccagcatccctgtgaagcagaagcccaaggagaaggagaagcccccacctgtgaacaagcaggagaatgccggcaccctgaacatcctgagcaccctgagcaatggaaacagcagcaagcagaagatcccagcagatggagtgcaccgcatccgggtggacttcaagtttgtgtactgccaggtgtgctgtgagcccttccacaagttctgcctggaggagaatgaaagacccctggaggaccagctggagaactggtgctgccgccgctgcaagttctgccacgtgtgtggccggcagcaccaggccaccaagcagctgctggagtgcaacaagtgcaggaacagctaccaccctgagtgcctgggccccaactaccccaccaagcccaccaagaagaagaaggtgtggatctgcaccaagtgtgtgcgctgcaagagctgtggcagcaccaccccaggcaagggctgggatgcccagtggagccatgacttcagcctgtgccacgactgtgccaagctgtttgccaagggcaacttctgccccctgtgtgacaagtgctatgatgatgatgattatgagagcaagatgatgcagtgtgggaaatgtgaccgctgggtgcacagcaaatgtgagaacctgagtgatgagatgtatgagatcctgagcaacctgcctgagagcgtggcctacacctgtgtgaactgcacagagcggcaccctgctgagtggaggctggccctggagaaggagctgcagatcagcctgaagcaggtgctgacagccctgctgaacagcaggaccaccagccacctgctgcgctaccggcaggccgccaagcccccagacctgaaccctgagacagaggagagcatccccagccgcagcagccctgagggccctgacccccctgtgctgacagaggtgtccaagcaggatgaccagcagcccctggacctggagggcgtgaagaggaagatggaccagggcaactacacctctgtgctggagttcagtgatgacatcgtgaagatcatccaggccgccatcaacagtgatggcggccagcctgagatcaagaaggccaacagcatggtgaagagcttcttcatccggcagatggagagggtcttcccctggttctctgtgaagaagagccgcttctgggagcccaacaaggtgagcagcaacagcggcatgctgcccaatgctgtgctgccccccagcctggaccacaactatgcccagtggcaggagcgggaggagaacagccacacagagcagccccccctgatgaagaagatcatcccagcccccaagcccaagggccctggagagccagacagccccacccccctgcacccccccaccccacccatcctgagcacagacaggagccgggaggacagccctgagctgaaccccccacctggcatcgaggacaaccggcagtgtgccctgtgcctgacctatggagatgattctgccaatgatgctggccgcctgctgtacatcggccagaatgagtggacccacgtgaactgtgccctgtggagcgctgaggtgtttgaagatgatgatggcagcctgaagaatgtgcacatggccgtcatccggggcaagcagctgcgctgtgagttctgccagaagccaggggccaccgtgggctgctgcctgaccagctgcaccagcaactaccacttcatgtgcagccgggccaagaactgtgtgttcctggatgacaagaaggtgtactgccagaggcaccgggacctgatcaagggggaggtggtgcctgaaaatggatttgaggtgttcagaagagtgtttgtggactttgagggcatcagcctgcggaggaagttcctgaatggcctggagcctgagaacatccacatgatgattggctccatgaccatcgactgcctgggcatcctgaatgacctgagtgactgtgaggacaagctgttccccatcggctaccagtgcagccgggtgtactggagcaccacagatgccaggaagagatgtgtgtacacctgcaagatcgtggagtgccggccccctgtggtggagccagacatcaacagcacagtggagcatgatgaaaatagaaccatcgcccacagccccaccagcttcacagagagcagcagcaaggagagccagaacacagctgagatcatcagcccccccagcccagacaggcctccccacagccagaccagcggcagctgctactaccacgtgatcagcaaggtgccccgcatccgcacccccagctacagccccacccagaggagccctggctgccggcccctgcccagcgctggcagccccacccccaccacccatgaaattgtgacagtgggggaccccctgctgagcagcggcctgcggagcatcggcagcagaagacacagcaccagcagcctgagcccccagaggagcaagctgcgcatcatgagccccatgaggactggaaacacctacagcagaaataatgtgtcctctgtgtccaccaccggcacagccacagacctggagagcagcgccaaggtggtggaccacgtgctgggccccctgaacagcagcaccagcctgggccagaacaccagcaccagcagcaacctgcagaggacagtggtgacagtgggcaacaagaacagccacctggatggcagcagcagcagcgagatgaagcagagcagcgccagtgacctggtgtccaagagcagcagcctgaagggggagaagaccaaggtgctgagcagcaagagcagcgagggcagcgcccacaacgtggcctacccaggcatccccaagctggccccccaggtgcacaacaccaccagccgggagctgaatgtgtccaagattggcagctttgctgagcccagctctgtgtccttcagcagcaaggaggccctgtccttcccccacctgcacctgcggggccagagaaatgaccgggaccagcacacagacagcacccagagcgccaacagcagcccagatgaggacacagaggtgaagaccctgaagctgagcggcatgagcaacagaagcagcatcatcaatgagcacatgggcagcagcagccgggaccggcggcagaagggcaagaagagctgcaaggagaccttcaaggagaagcacagcagcaagagcttcctggagcccggccaggtgaccaccggggaggagggcaacctgaagccagagttcatggatgaggtgctgaccccagagtacatgggccagaggccctgcaacaacgtgtccagtgacaagattggagacaagggcctgtccatgcctggggtgcccaaggccccacccatgcaggtggagggcagcgccaaggagctgcaggcccccaggaagaggacagtgaaggtgaccctgacccccctgaagatggagaatgaaagccagagcaagaatgccctgaaggagagcagccctgccagccccctgcagatcgagagcaccagccccacagagcccatcagcgcctctgaaaatcctggagatggccctgtggcccagcccagccccaacaacaccagctgccaggacagccagagcaacaactaccagaacctgcctgtgcaggacaggaacctgatgctgcctgatggccccaagccccaggaggatggcagcttcaagaggcgctacccccggcgcagcgcccgggcccggagcaacatgttcttcggcctgacccccctgtatggagtgcgctcctatggagaggaggacatccccttctacagcagcagcacaggcaagaagaggggcaagaggtctgctgagggccaggtggatggagcagatgacctgagcaccagtgatgaagatgacctgtactactacaacttcaccaggacagtcatcagcagtggaggagaggagcggctggccagccacaacctcttccgggaggaggagcagtgtgacctgcccaagatcagccagctggatggagtggatgatggaacagaaagtgacacctctgtgacagccaccaccaggaagagcagccagatccccaagagaaatggcaaggaaaatggaacagagaacctgaagattgacagaccagaagatgctggggagaaggagcacgtgaccaagagctctgtgggccacaagaatgagcccaagatggacaactgccacagcgtgtcccgggtgaagacccagggccaggacagcctggaggcccagctgagcagcctggagagcagccggcgggtgcacaccagcacccccagcgacaagaacctgctggacacctacaacacagagctgctgaagagtgacagcgacaacaacaacagtgatgactgtggcaacatcctgcccagcgacatcatggactttgtgctgaagaacacccccagcatgcaggccctgggggagagccctgagagcagcagcagcgagctgctgaacctgggggagggcctgggcctggacagcaaccgggagaaggacatgggcctgtttgaggtgttcagccagcagctgcccaccacagagcctgtggacagctctgtgagcagcagcatctctgctgaggagcagtttgagctgcccctggagctgcccagcgacctgtctgtgctgaccaccaggagccccaccgtgcccagccagaaccccagccggctggccgtcatcagtgacagcggggagaagagggtgaccatcacagagaagtctgtggccagcagcgagagtgaccctgccctgctgagccctggggtggaccccaccccagagggccacatgaccccagaccacttcatccagggccacatggatgctgaccacatcagcagccccccctgtggctctgtggagcagggccacggcaacaaccaggacctgaccaggaacagcagcaccccaggcctgcaggtgcctgtgagccccaccgtgcccatccagaaccagaagtatgtgcccaacagcacagacagccctggccccagccagatcagcaatgctgctgtgcagaccaccccaccccacctgaagccagccacagagaagctgattgtggtgaaccagaacatgcagcccctgtatgtgctgcagaccctgcccaacggggtgacccagaagatccagctgaccagctctgtgagcagcaccccatctgtgatggagaccaacacctctgtgctgggccccatgggcggcggcctgaccctgaccaccggcctgaaccccagcctgcccaccagccagagcctcttccccagcgccagcaagggcctgctgcccatgagccaccaccagcacctgcacagcttccctgctgccacccagagcagcttcccccccaacatcagcaacccccccagcggcctgctgattggagtgcagcccccaccagacccccagctgctggtgtctgagagcagccagaggacagacctgagcaccaccgtggccacccccagcagcggcctgaagaagaggcccatcagccggctgcagaccaggaagaacaagaagctggcccccagcagcacccccagcaacatcgcccccagtgatgtggtgagcaacatgaccctcatcaacttcacccccagccagctgcccaaccaccccagcctgctggacctgggcagcctgaacaccagcagccacaggacagtgcccaacatcatcaagaggagcaagagcagcatcatgtactttgagcccgcccccctgctgccccagagcgtgggcggcacagctgccacagctgctggcaccagcaccatcagccaggacaccagccacctgaccagcggctctgtgtctggcctggccagcagcagctctgtgctgaatgtggtgtccatgcagaccaccaccacccccaccagcagcgcctctgtgcccggccacgtgaccctgaccaacccccggctgctgggcaccccagacatcggcagcatcagcaacctgctgatcaaggccagccagcagagcctgggcatccaggaccagcctgtggccctgccccccagcagcggcatgttcccccagctgggcaccagccagacccccagcacagctgccatcacagctgccagcagcatctgtgtgctgcccagcacccagaccaccggcatcacagctgccagccccagcggggaggctgatgagcactaccagctgcagcacgtgaaccagctgctggccagcaagacaggcatccacagcagccagagggacctggacagcgccagcggcccccaggtgagcaacttcacccagacagtggatgcccccaacagcatgggcctggagcagaacaaggccctgagcagcgctgtgcaggccagccccaccagccctgggggcagccccagcagccccagcagcggccagaggtctgccagccccagcgtgcccggccccaccaagcccaagcccaagaccaagcgcttccagctgcccctggacaagggaaatggcaagaagcacaaggtgagccacctgcggaccagcagcagcgaggcccacatcccagaccaggagaccaccagcctgaccagcggcaccggcaccccaggagctgaggccgagcagcaggacacagcctctgtggagcagagcagccagaaggaatgtggccagcctgctggccaggtggccgtgctgcctgaggtgcaggtgacccagaacccagccaatgagcaggagagcgctgagcccaagacagtggaggaggaggagagcaacttcagcagccccctgatgctgtggctgcagcaggagcagaagaggaaggagagcatcacagagaagaagcccaagaagggcctggtgtttgagatcagcagtgatgatggcttccagatctgtgccgagagcattgaagatgcctggaagagcctgacagacaaggtgcaggaggcccggagcaatgcccggctgaagcagctgagctttgctggggtgaatggcctgaggatgctgggcatcctgcatgatgctgtggtgttcctgattgagcagctgagcggggccaagcactgcaggaactacaagttccgcttccacaagccagaggaggccaatgagccccccctgaacccccacggcagcgcccgggcagaggtgcacctgaggaagagcgcctttgacatgttcaacttcctggccagcaagcaccggcagcccccagagtacaaccccaatgatgaggaggaggaggaggtgcagctgaagagcgcccggcgggccacctccatggacctgcccatgcccatgaggttccgccacctgaagaagaccagcaaggaggccgtgggcgtgtaccgcagccccatccacggccggggcctcttctgcaagagaaatattgatgctggggagatggtgattgaatatgctggaaatgtcatccgcagcatccagacagacaagcgggagaagtactatgacagcaagggcatcggctgctacatgttcagaattgatgacagcgaggtggtggatgccaccatgcacggcaatgctgcccgcttcatcaaccacagctgtgagcccaactgctacagcagggtcatcaacattgatggccagaagcacatcgtcatctttgccatgaggaagatctacagaggagaggagctgacctatgactacaagttccccattgaagatgccagcaacaagctgccctgcaactgtggggccaagaagtgcaggaagttcctgaactag

SEQ ID NO: 160630 - DNA, 8640 bp, Artificial Sequence
  Description of Artificial Sequence: Synthetic coding sequence
catgcccacccagaatgtctgaccatggagcgggagaagatcctgagctccatgggaaatgatgacaagagcagcattgctggctctgaagatgctgagcccctggccccacccatcaagcccatcaagcctgtgaccaggaacaaggccccccaggagccccctgtgaagaagggccgccgcagcagaagatgtggccagtgccccggctgccaggtgcctgaggactgtggggtgtgcaccaactgcctggacaagcccaagtttggaggcaggaacatcaagaagcagtgctgcaagatgaggaagtgccagaacctgcagtggatgcccagcaaggcctacctgcagaagcaggccaaggctgtgaagaagaaggagaagaagagcaagaccagcgagaagaaggacagcaaggagagctctgtggtgaagaatgtggtggacagcagccagaagcccaccccatctgcccgggaggaccctgcccccaagaagagcagcagcgagcccccacccaggaagcctgtggaggagaagtctgaggagggcaatgtgtctgcccctggccctgagagcaagcaggccaccaccccagccagcaggaagagcagcaagcaggtgtcccagcctgccctggtgatccccccccagccccccaccaccggcccccccaggaaggaggtgcccaagaccaccccatctgagcccaagaagaagcagcccccacctcctgagagcggccctgagcagagcaagcagaagaaggtggccccccggcccagcatccctgtgaagcagaagcccaaggagaaggagaagcccccacctgtgaacaagcaggagaatgccggcaccctgaacatcctgagcaccctgagcaatggaaacagcagcaagcagaagatcccagcagatggagtgcaccgcatccgggtggacttcaaggaggactgtgaggccgagaatgtgtgggagatgggcggcctgggcatcctgacctctgtgcccatcaccccccgggtggtgtgcttcctgtgtgccagcagcggccacgtggagtttgtgtactgccaggtgtgctgtgagcccttccacaagttctgcctggaggagaatgaaagacccctggaggaccagctggagaactggtgctgccgccgctgcaagttctgccacgtgtgtggccggcagcaccaggccaccaagcagctgctggagtgcaacaagtgcaggaacagctaccaccctgagtgcctgggccccaactaccccaccaagcccaccaagaagaagaaggtgtggatctgcaccaagtgtgtgcgctgcaagagctgtggcagcaccaccccaggcaagggctgggatgcccagtggagccatgacttcagcctgtgccacgactgtgccaagctgtttgccaagggcaacttctgccccctgtgtgacaagtgctatgatgatgatgattatgagagcaagatgatgcagtgtgggaaatgtgaccgctgggtgcacagcaaatgtgagaacctgagtgatgagatgtatgagatcctgagcaacctgcctgagagcgtggcctacacctgtgtgaactgcacagagcggcaccctgctgagtggaggctggccctggagaaggagctgcagatcagcctgaagcaggtgctgacagccctgctgaacagcaggaccaccagccacctgctgcgctaccggcaggccgccaagcccccagacctgaaccctgagacagaggagagcatccccagccgcagcagccctgagggccctgacccccctgtgctgacagaggtgtccaagcaggatgaccagcagcccctggacctggagggcgtgaagaggaagatggaccagggcaactacacctctgtgctggagttcagtgatgacatcgtgaagatcatccaggccgccatcaacagtgatggcggccagcctgagatcaagaaggccaacagcatggtgaagagcttcttcatccggcagatggagagggtcttcccctggttctctgtgaagaagagccgcttctgggagcccaacaaggtgagcagcaacagcggcatgctgcccaatgctgtgctgccccccagcctggaccacaactatgcccagtggcaggagcgggaggagaacagccacacagagcagccccccctgatgaagaagatcatcccagcccccaagcccaagggccctggagagccagacagccccacccccctgcacccccccaccccacccatcctgagcacagacaggagccgggaggacagccctgagctgaaccccccacctggcatcgaggacaaccggcagtgtgccctgtgcctgacctatggagatgattctgccaatgatgctggccgcctgctgtacatcggccagaatgagtggacccacgtgaactgtgccctgtggagcgctgaggtgtttgaagatgatgatggcagcctgaagaatgtgcacatggccgtcatccggggcaagcagctgcgctgtgagttctgccagaagccaggggccaccgtgggctgctgcctgaccagctgcaccagcaactaccacttcatgtgcagccgggccaagaactgtgtgttcctggatgacaagaaggtgtactgccagaggcaccgggacctgatcaagggggaggtggtgcctgaaaatggatttgaggtgttcagaagagtgtttgtggactttgagggcatcagcctgcggaggaagttcctgaatggcctggagcctgagaacatccacatgatgattggctccatgaccatcgactgcctgggcatcctgaatgacctgagtgactgtgaggacaagctgttccccatcggctaccagtgcagccgggtgtactggagcaccacagatgccaggaagagatgtgtgtacacctgcaagatcgtggagtgccggccccctgtggtggagccagacatcaacagcacagtggagcatgatgaaaatagaaccatcgcccacagccccaccagcttcacagagagcagcagcaaggagagccagaacacagctgagatcatcagcccccccagcccagacaggcctccccacagccagaccagcggcagctgctactaccacgtgatcagcaaggtgccccgcatccgcacccccagctacagccccacccagaggagccctggctgccggcccctgcccagcgctggcagccccacccccaccacccatgaaattgtgacagtgggggaccccctgctgagcagcggcctgcggagcatcggcagcagaagacacagcaccagcagcctgagcccccagaggagcaagctgcgcatcatgagccccatgaggactggaaacacctacagcagaaataatgtgtcctctgtgtccaccaccggcacagccacagacctggagagcagcgccaaggtggtggaccacgtgctgggccccctgaacagcagcaccagcctgggccagaacaccagcaccagcagcaacctgcagaggacagtggtgacagtgggcaacaagaacagccacctggatggcagcagcagcagcgagatgaagcagagcagcgccagtgacctggtgtccaagagcagcagcctgaagggggagaagaccaaggtgctgagcagcaagagcagcgagggcagcgcccacaacgtggcctacccaggcatccccaagctggccccccaggtgcacaacaccaccagccgggagctgaatgtgtccaagattggcagctttgctgagcccagctctgtgtccttcagcagcaaggaggccctgtccttcccccacctgcacctgcggggccagagaaatgaccgggaccagcacacagacagcacccagagcgccaacagcagcccagatgaggacacagaggtgaagaccctgaagctgagcggcatgagcaacagaagcagcatcatcaatgagcacatgggcagcagcagccgggaccggcggcagaagggcaagaagagctgcaaggagaccttcaaggagaagcacagcagcaagagcttcctggagcccggccaggtgaccaccggggaggagggcaacctgaagccagagttcatggatgaggtgctgaccccagagtacatgggccagaggccctgcaacaacgtgtccagtgacaagattggagacaagggcctgtccatgcctggggtgcccaaggccccacccatgcaggtggagggcagcgccaaggagctgcaggcccccaggaagaggacagtgaaggtgaccctgacccccctgaagatggagaatgaaagccagagcaagaatgccctgaaggagagcagccctgccagccccctgcagatcgagagcaccagccccacagagcccatcagcgcctctgaaaatcctggagatggccctgtggcccagcccagccccaacaacaccagctgccaggacagccagagcaacaactaccagaacctgcctgtgcaggacaggaacctgatgctgcctgatggccccaagccccaggaggatggcagcttcaagaggcgctacccccggcgcagcgcccgggcccggagcaacatgttcttcggcctgacccccctgtatggagtgcgctcctatggagaggaggacatccccttctacagcagcagcacaggcaagaagaggggcaagaggtctgctgagggccaggtggatggagcagatgacctgagcaccagtgatgaagatgacctgtactactacaacttcaccaggacagtcatcagcagtggaggagaggagcggctggccagccacaacctcttccgggaggaggagcagtgtgacctgcccaagatcagccagctggatggagtggatgatggaacagaaagtgacacctctgtgacagccaccaccaggaagagcagccagatccccaagagaaatggcaaggaaaatggaacagagaacctgaagattgacagaccagaagatgctggggagaaggagcacgtgaccaagagctctgtgggccacaagaatgagcccaagatggacaactgccacagcgtgtcccgggtgaagacccagggccaggacagcctggaggcccagctgagcagcctggagagcagccggcgggtgcacaccagcacccccagcgacaagaacctgctggacacctacaacacagagctgctgaagagtgacagcgacaacaacaacagtgatgactgtggcaacatcctgcccagcgacatcatggactttgtgctgaagaacacccccagcatgcaggccctgggggagagccctgagagcagcagcagcgagctgctgaacctgggggagggcctgggcctggacagcaaccgggagaaggacatgggcctgtttgaggtgttcagccagcagctgcccaccacagagcctgtggacagctctgtgagcagcagcatctctgctgaggagcagtttgagctgcccctggagctgcccagcgacctgtctgtgctgaccaccaggagccccaccgtgcccagccagaaccccagccggctggccgtcatcagtgacagcggggagaagagggtgaccatcacagagaagtctgtggccagcagcgagagtgaccctgccctgctgagccctggggtggaccccaccccagagggccacatgaccccagaccacttcatccagggccacatggatgctgaccacatcagcagccccccctgtggctctgtggagcagggccacggcaacaaccaggacctgaccaggaacagcagcaccccaggcctgcaggtgcctgtgagccccaccgtgcccatccagaaccagaagtatgtgcccaacagcacagacagccctggccccagccagatcagcaatgctgctgtgcagaccaccccaccccacctgaagccagccacagagaagctgattgtggtgaaccagaacatgcagcccctgtatgtgctgcagaccctgcccaacggggtgacccagaagatccagctgaccagctctgtgagcagcaccccatctgtgatggagaccaacacctctgtgctgggccccatgggcggcggcctgaccctgaccaccggcctgaaccccagcctgcccaccagccagagcctcttccccagcgccagcaagggcctgctgcccatgagccaccaccagcacctgcacagcttccctgctgccacccagagcagcttcccccccaacatcagcaacccccccagcggcctgctgattggagtgcagcccccaccagacccccagctgctggtgtctgagagcagccagaggacagacctgagcaccaccgtggccacccccagcagcggcctgaagaagaggcccatcagccggctgcagaccaggaagaacaagaagctggcccccagcagcacccccagcaacatcgcccccagtgatgtggtgagcaacatgaccctcatcaacttcacccccagccagctgcccaaccaccccagcctgctggacctgggcagcctgaacaccagcagccacaggacagtgcccaacatcatcaagaggagcaagagcagcatcatgtactttgagcccgcccccctgctgccccagagcgtgggcggcacagctgccacagctgctggcaccagcaccatcagccaggacaccagccacctgaccagcggctctgtgtctggcctggccagcagcagctctgtgctgaatgtggtgtccatgcagaccaccaccacccccaccagcagcgcctctgtgcccggccacgtgaccctgaccaacccccggctgctgggcaccccagacatcggcagcatcagcaacctgctgatcaaggccagccagcagagcctgggcatccaggaccagcctgtggccctgccccccagcagcggcatgttcccccagctgggcaccagccagacccccagcacagctgccatcacagctgccagcagcatctgtgtgctgcccagcacccagaccaccggcatcacagctgccagccccagcggggaggctgatgagcactaccagctgcagcacgtgaaccagctgctggccagcaagacaggcatccacagcagccagagggacctggacagcgccagcggcccccaggtgagcaacttcacccagacagtggatgcccccaacagcatgggcctggagcagaacaaggccctgagcagcgctgtgcaggccagccccaccagccctgggggcagccccagcagccccagcagcggccagaggtctgccagccccagcgtgcccggccccaccaagcccaagcccaagaccaagcgcttccagctgcccctggacaagggaaatggcaagaagcacaaggtgagccacctgcggaccagcagcagcgaggcccacatcccagaccaggagaccaccagcctgaccagcggcaccggcaccccaggagctgaggccgagcagcaggacacagcctctgtggagcagagcagccagaaggaatgtggccagcctgctggccaggtggccgtgctgcctgaggtgcaggtgacccagaacccagccaatgagcaggagagcgctgagcccaagacagtggaggaggaggagagcaacttcagcagccccctgatgctgtggctgcagcaggagcagaagaggaaggagagcatcacagagaagaagcccaagaagggcctggtgtttgagatcagcagtgatgatggcttccagatctgtgccgagagcattgaagatgcctggaagagcctgacagacaaggtgcaggaggcccggagcaatgcccggctgaagcagctgagctttgctggggtgaatggcctgaggatgctgggcatcctgcatgatgctgtggtgttcctgattgagcagctgagcggggccaagcactgcaggaactacaagttccgcttccacaagccagaggaggccaatgagccccccctgaacccccacggcagcgcccgggcagaggtgcacctgaggaagagcgcctttgacatgttcaacttcctggccagcaagcaccggcagcccccagagtacaaccccaatgatgaggaggaggaggaggtgcagctgaagagcgcccggcgggccacctccatggacctgcccatgcccatgaggttccgccacctgaagaagaccagcaaggaggccgtgggcgtgtaccgcagccccatccacggccggggcctcttctgcaagagaaatattgatgctggggagatggtgattgaatatgctggaaatgtcatccgcagcatccagacagacaagcgggagaagtactatgacagcaagggcatcggctgctacatgttcagaattgatgacagcgaggtggtggatgccaccatgcacggcaatgctgcccgcttcatcaaccacagctgtgagcccaactgctacagcagggtcatcaacattgatggccagaagcacatcgtcatctttgccatgaggaagatctacagaggagaggagctgacctatgactacaagttccccattgaagatgccagcaacaagctgccctgcaactgtggggccaagaagtgcaggaagttcctgaactag

SEQ ID NO: 160631 - DNA, 11910 bp, Artificial Sequence
  Description of Artificial Sequence: Synthetic coding sequence
atggcccacagctgccgctggaggtttcctgcccggcccggcaccaccggcggcggcggcggcggcggccggcggggcctgggcggggccccccggcagagggtgcctgccctgctgctgcccccaggcccccctgtgggcggcggcggccctggggccccacccagccccccagctgtggccgctgctgctgctgctgctggcagcagcggggccggcgtgcctggaggagctgctgctgccagcgctgccagcagcagcagcgccagcagcagcagcagcagcagcagcagcgccagcagcggccctgccctgctgcgggtgggccctggctttgatgctgccctgcaggtgtctgctgccatcggcaccaacctgcggcgcttccgggctgtgtttggagagagcggcggcggcggcggcagcggggaggatgagcagttcctgggctttggaagtgatgaggaggtgcgggtgcgcagccccaccaggagccccagcgtgaagaccagccccaggaagccccggggccggcccaggagcggcagtgacagaaattctgccatcctgagtgaccccagcgtcttcagccccctgaacaagtctgagaccaagagcggggacaagatcaagaagaaggacagcaagagcattgagaagaagaggggccggccccccaccttccctggggtgaagatcaagatcacccacggcaaggacatcagcgagctgcccaagggcaacaaggaggacagcctgaagaagatcaagaggaccccatctgccaccttccagcaggccaccaagatcaagaagctgcgggccggcaagctgagccccctgaagagcaagttcaagacaggcaagctgcagatcggcaggaaaggagtgcagatcgtgagaagaagaggccggccccccagcacagagcgcatcaagacccccagcggcctgctgatcaacagcgagctggagaagccccagaaggtgaggaaggacaaggagggcaccccacccctgaccaaggaggacaagacagtggtgcggcagagcccccggcgcatcaagcctgtgcgcatcatccccagcagcaagaggacagatgccaccatcgccaagcagctgctgcagagggccaagaagggggcccagaagaagattgagaaggaggccgcccagctgcagggcaggaaggtgaagacccaggtgaagaacatccggcagttcatcatgcctgtggtgtctgccatcagcagccgcatcatcaagaccccccggcgcttcattgaagatgaggactatgacccccccatcaagatcgcccggctggagagcacccccaacagccgcttcagcgcccccagctgtggcagcagcgagaagagcagcgctgccagccagcacagcagccagatgagcagtgacagcagccgcagcagcagccccagcgtggacaccagcacagacagccaggccagcgaggagatccaggtgctgcctgaggagaggagtgacaccccagaggtgcacccccccctgcccatcagccagagcccagaaaatgaaagcaatgaccggcgcagccgccgctacagcgtgtctgagaggagctttggcagcaggaccaccaagaagctgagcaccctgcagagcgccccccagcagcagaccagcagcagccccccaccacccctgctgaccccacctccacccctgcagcctgccagcagcatcagtgaccacaccccctggctgatgccacccaccatccccctggccagccccttcctgcctgccagcacagcccccatgcagggcaagaggaagagcatcctgcgggagcccaccttccgctggaccagcctgaagcacagccgctctgagccccagtacttcagcagcgccaagtatgccaaggagggcctcatcaggaagcccatctttgacaacttccggcccccacccctgaccccagaagatgtgggctttgccagcggcttcagcgccagcggcacagctgccagcgcccggctcttcagccccctgcacagcggcaccaggtttgacatgcacaagaggagccccctgctgcgggccccccgcttcaccccatctgaggcccacagccgcatctttgagagcgtgaccctgcccagcaacagaacatctgctggcaccagcagcagtggagtgagcaacaggaagaggaagaggaaggtgttcagccccatccgctctgagcccaggagccccagccacagcatgaggaccaggagcggccgcctgagcagcagcgagctgagccccctgaccccacccagctctgtgagcagcagcctgagcatctctgtgagccccctggccaccagcgccctgaaccccaccttcaccttccccagccacagcctgacccagagcggggagagcgctgagaagaaccagaggcccaggaagcagaccagcgccccagctgagcccttcagcagcagcagccccacccccctcttcccctggttcaccccaggcagccagacagagcggggcaggaacaaggacaaggcccctgaggagctgagcaaggacagagatgctgacaagtctgtggagaaggacaagagccgggagcgggaccgggagcgggagaaggagaacaagcgggagagcaggaaggagaagaggaagaagggcagcgagatccagagcagcagcgccctgtaccctgtgggccgggtgtccaaggagaaggtggtgggagaagatgtggccaccagcagcagcgccaagaaggccactggaaggaagaagagcagcagccatgattctggaacagacatcacctctgtgaccctgggggacaccacagctgtgaagaccaagatcctgatcaagaagggccggggcaacctggagaagaccaacctggacctgggccccacagcccccagcctggagaaggagaagaccctgtgcctgagcacccccagcagcagcacagtgaagcacagcaccagcagcatcggctccatgctggcccaggccgacaagctgcccatgacagacaagagggtggccagcctgctgaagaaggccaaggcccagctgtgcaagattgagaagagcaagagcctgaagcagacagaccagcccaaggcccagggccaggagagtgacagcagcgagacctctgtgcggggcccccgcatcaagcacgtgtgcagaagagctgctgtggccctgggcaggaagagagctgtgtttcctgatgacatgcccaccctgagcgccctgccctgggaggagcgggagaagatcctgagctccatgggaaatgatgacaagagcagcattgctggctctgaagatgctgagcccctggccccacccatcaagcccatcaagcctgtgaccaggaacaaggccccccaggagccccctgtgaagaagggccgccgcagcagaagatgtggccagtgccccggctgccaggtgcctgaggactgtggggtgtgcaccaactgcctggacaagcccaagtttggaggcaggaacatcaagaagcagtgctgcaagatgaggaagtgccagaacctgcagtggatgcccagcaaggcctacctgcagaagcaggccaaggctgtgaagaagaaggagaagaagagcaagaccagcgagaagaaggacagcaaggagagctctgtggtgaagaatgtggtggacagcagccagaagcccaccccatctgcccgggaggaccctgcccccaagaagagcagcagcgagcccccacccaggaagcctgtggaggagaagtctgaggagggcaatgtgtctgcccctggccctgagagcaagcaggccaccaccccagccagcaggaagagcagcaagcaggtgtcccagcctgccctggtgatccccccccagccccccaccaccggcccccccaggaaggaggtgcccaagaccaccccatctgagcccaagaagaagcagcccccacctcctgagagcggccctgagcagagcaagcagaagaaggtggccccccggcccagcatccctgtgaagcagaagcccaaggagaaggagaagcccccacctgtgaacaagcaggagaatgccggcaccctgaacatcctgagcaccctgagcaatggaaacagcagcaagcagaagatcccagcagatggagtgcaccgcatccgggtggacttcaaggaggactgtgaggccgagaatgtgtgggagatgggcggcctgggcatcctgacctctgtgcccatcaccccccgggtggtgtgcttcctgtgtgccagcagcggccacgtggagtttgtgtactgccaggtgtgctgtgagcccttccacaagttctgcctggaggagaatgaaagacccctggaggaccagctggagaactggtgctgccgccgctgcaagttctgccacgtgtgtggccggcagcaccaggccaccaagcagctgctggagtgcaacaagtgcaggaacagctaccaccctgagtgcctgggccccaactaccccaccaagcccaccaagaagaagaaggtgtggatctgcaccaagtgtgtgcgctgcaagagctgtggcagcaccaccccaggcaagggctgggatgcccagtggagccatgacttcagcctgtgccacgactgtgccaagctgtttgccaagggcaacttctgccccctgtgtgacaagtgctatgatgatgatgattatgagagcaagatgatgcagtgtgggaaatgtgaccgctgggtgcacagcaaatgtgagaacctgagtgatgagatgtatgagatcctgagcaacctgcctgagagcgtggcctacacctgtgtgaactgcacagagcggcaccctgctgagtggaggctggccctggagaaggagctgcagatcagcctgaagcaggtgctgacagccctgctgaacagcaggaccaccagccacctgctgcgctaccggcaggccgccaagcccccagacctgaaccctgagacagaggagagcatccccagccgcagcagccctgagggccctgacccccctgtgctgacagaggtgtccaagcaggatgaccagcagcccctggacctggagggcgtgaagaggaagatggaccagggcaactacacctctgtgctggagttcagtgatgacatcgtgaagatcatccaggccgccatcaacagtgatggcggccagcctgagatcaagaaggccaacagcatggtgaagagcttcttcatccggcagatggagagggtcttcccctggttctctgtgaagaagagccgcttctgggagcccaacaaggtgagcagcaacagcggcatgctgcccaatgctgtgctgccccccagcctggaccacaactatgcccagtggcaggagcgggaggagaacagccacacagagcagccccccctgatgaagaagatcatcccagcccccaagcccaagggccctggagagccagacagccccacccccctgcacccccccaccccacccatcctgagcacagacaggagccgggaggacagccctgagctgaaccccccacctggcatcgaggacaaccggcagtgtgccctgtgcctgacctatggagatgattctgccaatgatgctggccgcctgctgtacatcggccagaatgagtggacccacgtgaactgtgccctgtggagcgctgaggtgtttgaagatgatgatggcagcctgaagaatgtgcacatggccgtcatccggggcaagcagctgcgctgtgagttctgccagaagccaggggccaccgtgggctgctgcctgaccagctgcaccagcaactaccacttcatgtgcagccgggccaagaactgtgtgttcctggatgacaagaaggtgtactgccagaggcaccgggacctgatcaagggggaggtggtgcctgaaaatggatttgaggtgttcagaagagtgtttgtggactttgagggcatcagcctgcggaggaagttcctgaatggcctggagcctgagaacatccacatgatgattggctccatgaccatcgactgcctgggcatcctgaatgacctgagtgactgtgaggacaagctgttccccatcggctaccagtgcagccgggtgtactggagcaccacagatgccaggaagagatgtgtgtacacctgcaagatcgtggagtgccggccccctgtggtggagccagacatcaacagcacagtggagcatgatgaaaatagaaccatcgcccacagccccaccagcttcacagagagcagcagcaaggagagccagaacacagctgagatcatcagcccccccagcccagacaggcctccccacagccagaccagcggcagctgctactaccacgtgatcagcaaggtgccccgcatccgcacccccagctacagccccacccagaggagccctggctgccggcccctgcccagcgctggcagccccacccccaccacccatgaaattgtgacagtgggggaccccctgctgagcagcggcctgcggagcatcggcagcagaagacacagcaccagcagcctgagcccccagaggagcaagctgcgcatcatgagccccatgaggactggaaacacctacagcagaaataatgtgtcctctgtgtccaccaccggcacagccacagacctggagagcagcgccaaggtggtggaccacgtgctgggccccctgaacagcagcaccagcctgggccagaacaccagcaccagcagcaacctgcagaggacagtggtgacagtgggcaacaagaacagccacctggatggcagcagcagcagcgagatgaagcagagcagcgccagtgacctggtgtccaagagcagcagcctgaagggggagaagaccaaggtgctgagcagcaagagcagcgagggcagcgcccacaacgtggcctacccaggcatccccaagctggccccccaggtgcacaacaccaccagccgggagctgaatgtgtccaagattggcagctttgctgagcccagctctgtgtccttcagcagcaaggaggccctgtccttcccccacctgcacctgcggggccagagaaatgaccgggaccagcacacagacagcacccagagcgccaacagcagcccagatgaggacacagaggtgaagaccctgaagctgagcggcatgagcaacagaagcagcatcatcaatgagcacatgggcagcagcagccgggaccggcggcagaagggcaagaagagctgcaaggagaccttcaaggagaagcacagcagcaagagcttcctggagcccggccaggtgaccaccggggaggagggcaacctgaagccagagttcatggatgaggtgctgaccccagagtacatgggccagaggccctgcaacaacgtgtccagtgacaagattggagacaagggcctgtccatgcctggggtgcccaaggccccacccatgcaggtggagggcagcgccaaggagctgcaggcccccaggaagaggacagtgaaggtgaccctgacccccctgaagatggagaatgaaagccagagcaagaatgccctgaaggagagcagccctgccagccccctgcagatcgagagcaccagccccacagagcccatcagcgcctctgaaaatcctggagatggccctgtggcccagcccagccccaacaacaccagctgccaggacagccagagcaacaactaccagaacctgcctgtgcaggacaggaacctgatgctgcctgatggccccaagccccaggaggatggcagcttcaagaggcgctacccccggcgcagcgcccgggcccggagcaacatgttcttcggcctgacccccctgtatggagtgcgctcctatggagaggaggacatccccttctacagcagcagcacaggcaagaagaggggcaagaggtctgctgagggccaggtggatggagcagatgacctgagcaccagtgatgaagatgacctgtactactacaacttcaccaggacagtcatcagcagtggaggagaggagcggctggccagccacaacctcttccgggaggaggagcagtgtgacctgcccaagatcagccagctggatggagtggatgatggaacagaaagtgacacctctgtgacagccaccaccaggaagagcagccagatccccaagagaaatggcaaggaaaatggaacagagaacctgaagattgacagaccagaagatgctggggagaaggagcacgtgaccaagagctctgtgggccacaagaatgagcccaagatggacaactgccacagcgtgtcccgggtgaagacccagggccaggacagcctggaggcccagctgagcagcctggagagcagccggcgggtgcacaccagcacccccagcgacaagaacctgctggacacctacaacacagagctgctgaagagtgacagcgacaacaacaacagtgatgactgtggcaacatcctgcccagcgacatcatggactttgtgctgaagaacacccccagcatgcaggccctgggggagagccctgagagcagcagcagcgagctgctgaacctgggggagggcctgggcctggacagcaaccgggagaaggacatgggcctgtttgaggtgttcagccagcagctgcccaccacagagcctgtggacagctctgtgagcagcagcatctctgctgaggagcagtttgagctgcccctggagctgcccagcgacctgtctgtgctgaccaccaggagccccaccgtgcccagccagaaccccagccggctggccgtcatcagtgacagcggggagaagagggtgaccatcacagagaagtctgtggccagcagcgagagtgaccctgccctgctgagccctggggtggaccccaccccagagggccacatgaccccagaccacttcatccagggccacatggatgctgaccacatcagcagccccccctgtggctctgtggagcagggccacggcaacaaccaggacctgaccaggaacagcagcaccccaggcctgcaggtgcctgtgagccccaccgtgcccatccagaaccagaagtatgtgcccaacagcacagacagccctggccccagccagatcagcaatgctgctgtgcagaccaccccaccccacctgaagccagccacagagaagctgattgtggtgaaccagaacatgcagcccctgtatgtgctgcagaccctgcccaacggggtgacccagaagatccagctgaccagctctgtgagcagcaccccatctgtgatggagaccaacacctctgtgctgggccccatgggcggcggcctgaccctgaccaccggcctgaaccccagcctgcccaccagccagagcctcttccccagcgccagcaagggcctgctgcccatgagccaccaccagcacctgcacagcttccctgctgccacccagagcagcttcccccccaacatcagcaacccccccagcggcctgctgattggagtgcagcccccaccagacccccagctgctggtgtctgagagcagccagaggacagacctgagcaccaccgtggccacccccagcagcggcctgaagaagaggcccatcagccggctgcagaccaggaagaacaagaagctggcccccagcagcacccccagcaacatcgcccccagtgatgtggtgagcaacatgaccctcatcaacttcacccccagccagctgcccaaccaccccagcctgctggacctgggcagcctgaacaccagcagccacaggacagtgcccaacatcatcaagaggagcaagagcagcatcatgtactttgagcccgcccccctgctgccccagagcgtgggcggcacagctgccacagctgctggcaccagcaccatcagccaggacaccagccacctgaccagcggctctgtgtctggcctggccagcagcagctctgtgctgaatgtggtgtccatgcagaccaccaccacccccaccagcagcgcctctgtgcccggccacgtgaccctgaccaacccccggctgctgggcaccccagacatcggcagcatcagcaacctgctgatcaaggccagccagcagagcctgggcatccaggaccagcctgtggccctgccccccagcagcggcatgttcccccagctgggcaccagccagacccccagcacagctgccatcacagctgccagcagcatctgtgtgctgcccagcacccagaccaccggcatcacagctgccagccccagcggggaggctgatgagcactaccagctgcagcacgtgaaccagctgctggccagcaagacaggcatccacagcagccagagggacctggacagcgccagcggcccccaggtgagcaacttcacccagacagtggatgcccccaacagcatgggcctggagcagaacaaggccctgagcagcgctgtgcaggccagccccaccagccctgggggcagccccagcagccccagcagcggccagaggtctgccagccccagcgtgcccggccccaccaagcccaagcccaagaccaagcgcttccagctgcccctggacaagggaaatggcaagaagcacaaggtgagccacctgcggaccagcagcagcgaggcccacatcccagaccaggagaccaccagcctgaccagcggcaccggcaccccaggagctgaggccgagcagcaggacacagcctctgtggagcagagcagccagaaggaatgtggccagcctgctggccaggtggccgtgctgcctgaggtgcaggtgacccagaacccagccaatgagcaggagagcgctgagcccaagacagtggaggaggaggagagcaacttcagcagccccctgatgctgtggctgcagcaggagcagaagaggaaggagagcatcacagagaagaagcccaagaagggcctggtgtttgagatcagcagtgatgatggcttccagatctgtgccgagagcattgaagatgcctggaagagcctgacagacaaggtgcaggaggcccggagcaatgcccggctgaagcagctgagctttgctggggtgaatggcctgaggatgctgggcatcctgcatgatgctgtggtgttcctgattgagcagctgagcggggccaagcactgcaggaactacaagttccgcttccacaagccagaggaggccaatgagccccccctgaacccccacggcagcgcccgggcagaggtgcacctgaggaagagcgcctttgacatgttcaacttcctggccagcaagcaccggcagcccccagagtacaaccccaatgatgaggaggaggaggaggtgcagctgaagagcgcccggcgggccacctccatggacctgcccatgcccatgaggttccgccacctgaagaagaccagcaaggaggccgtgggcgtgtaccgcagccccatccacggccggggcctcttctgcaagagaaatattgatgctggggagatggtgattgaatatgctggaaatgtcatccgcagcatccagacagacaagcgggagaagtactatgacagcaagggcatcggctgctacatgttcagaattgatgacagcgaggtggtggatgccaccatgcacggcaatgctgcccgcttcatcaaccacagctgtgagcccaactgctacagcagggtcatcaacattgatggccagaagcacatcgtcatctttgccatgaggaagatctacagaggagaggagctgacctatgactacaagttccccattgaagatgccagcaacaagctgccctgcaactgtggggccaagaagtgcaggaagttcctgaactag

SEQ ID NO: 160632 - DNA, 336 bp, Artificial Sequence
  Description of Artificial Sequence: Synthetic coding sequence
gacttcaaggatgagcagttcctgggcttcggcagtgatgaggaggtgcgggtgcgcagccccaccaggagccccagcggctccatgctggcccaggccgacaagctgcccatgacagacaagagggtggccagcctgctgaagaaggccaaggcccagctgtgcaagattgagaagagcaagagcctgaagcagacagaccagcccaaggcccagggccaggagagtgacagcagcgagacctctgtgcggggcccccgcatcaagcacgtgtgcagaagagctgctgtggccctgggcaggaagagagctgtgtttcctgatgacatgccctag

SEQ ID NO: 160633 - DNA, 4320 bp, Artificial Sequence
  Description of Artificial Sequence: Synthetic coding sequence
atggcccacagctgccgctggaggtttcctgcccggcccggcaccaccggcggcggcggcggcggcggccggcggggcctgggcggggccccccggcagagggtgcctgccctgctgctgcccccaggcccccctgtgggcggcggcggccctggggccccacccagccccccagctgtggccgctgctgctgctgctgctggcagcagcggggccggcgtgcctggaggagctgctgctgccagcgctgccagcagcagcagcgccagcagcagcagcagcagcagcagcagcgccagcagcggccctgccctgctgcgggtgggccctggctttgatgctgccctgcaggtgtctgctgccatcggcaccaacctgcggcgcttccgggctgtgtttggagagagcggcggcggcggcggcagcggggagctgaccacccagatcccctgctcctggaggaccaagggccacatccatgacaagaagacagagcccttccggctgctggcctggagctggtgcctgaatgatgagcagttcctgggcttcggcagtgatgaggaggtgcgggtgcgcagccccaccaggagccccagcgtgaagaccagccccaggaagccccggggccggcccaggagcggcagtgacaggaacagcgccatcctgagtgaccccagcgtcttcagccccctgaacaagtctgagaccaagagcggggacaagatcaagaagaaggacagcaagagcattgagaagaagaggggccggccccccaccttccctggggtgaagatcaagatcacccacggcaaggacatcagcgagctgcccaagggcaacaaggaggacagcctgaagaagatcaagaggacccccagcgccaccttccagcaggccaccaagatcaagaagctgcgggccggcaagctgagccccctgaagagcaagttcaagacaggcaagctgcagattggaaggaagggcgtgcagatcgtgagaagaagaggccggccccccagcacagagcgcatcaagaccccatctggcctgctgatcaacagcgagctggagaagccccagaaggtgaggaaggacaaggagggcaccccacccctgaccaaggaggacaagacagtggtgcggcagagcccccggcgcatcaagcctgtgcgcatcatccccagcagcaagaggacagatgccaccatcgccaagcagctgctgcagagggccaagaagggggcccagaagaagattgagaaggaggccgcccagctgcagggcaggaaggtgaagacccaggtgaagaacatccggcagttcatcatgcctgtggtgtctgccatcagcagccgcatcatcaagaccccccggcgcttcattgaagatgaagattatgacccccccatcaagatcgcccggctggagagcacccccaacagccgcttcagcgcccccagctgtggcagcagcgagaagagcagcgctgccagccagcacagcagccagatgagcagtgacagcagccgcagcagcagccccagcgtggacaccagcacagacagccaggccagcgaggagatccaggtgctgcctgaggagaggagtgacaccccagaggtgcacccccccctgcccatcagccagagcccagaaaatgaaagcaatgacagaagaagccgccgctacagcgtgtctgagaggagctttggcagcaggaccaccaagaagctgagcaccctgcagagcgccccccagcagcagaccagcagcagccccccaccacccctgctgaccccacctccacccctgcagcctgccagcagcatcagtgaccacaccccctggctgatgccacccaccatccccctggccagccccttcctgcctgccagcacagcccccatgcagggcaagaggaagagcatcctgcgggagcccaccttccgctggaccagcctgaagcacagccgctctgagccccagtacttcagcagcgccaagtatgccaaggagggcctcatcaggaagcccatctttgacaacttccggcccccacccctgaccccagaagatgtgggctttgccagcggcttcagcgccagcggcacagctgccagcgcccggctcttcagccccctgcacagcggcaccaggtttgacatgcacaagaggagccccctgctgcgggccccccgcttcacccccagcgaggcccacagccgcatctttgaatctgtgaccctgcccagcaacagaaccagcgctggcaccagcagcagcggcgtgagcaacaggaagaggaagaggaaggtgttcagccccatccgctctgagcccaggagccccagccacagcatgaggaccaggagcggccgcctgagcagcagcgagctgagccccctgaccccacccagctctgtgagcagcagcctgagcatctctgtgagccccctggccaccagcgccctgaaccccaccttcaccttccccagccacagcctgacccagagcggggagagcgctgagaagaaccagaggcccaggaagcagaccagcgccccagctgagcccttcagcagcagcagccccacccccctcttcccctggttcaccccaggcagccagacagagcggggcaggaacaaggacaaggcccctgaggagctgagcaaggacagagatgctgacaagtctgtggagaaggacaagagccgggagcgggaccgggagcgggagaaggagaacaagcgggagagcaggaaggagaagaggaagaagggcagcgagatccagagcagcagcgccctgtaccctgtgggccgggtgtccaaggagaaggtggtgggggaggatgtggccaccagcagcagcgccaagaaggccaccggcaggaagaagagcagcagccatgacagcggcacagacatcacctctgtgaccctgggggacaccacagctgtgaagaccaagatcctgatcaagaagggccggggcaacctggagaagaccaacctggacctgggccccacagcccccagcctggagaaggagaagaccctgtgcctgagcacccccagcagcagcacagtgaagcacagcaccagcagcatcggctccatgctggcccaggccgacaagctgcccatgacagacaagagggtggccagcctgctgaagaaggccaaggcccagctgtgcaagattgagaagagcaagagcctgaagcagacagaccagcccaaggcccagggccaggagagtgacagcagcgagacctctgtgcggggcccccgcatcaagcacgtgtgccggcgggctgctgtggccctgggcaggaagagagctgtgtttcctgatgacatgcccaccctgagcgccctgccctgggaggagcgggagaagatcctgagctccatgggaaatgatgacaagagcagcattgctggctctgaagatgctgagcccctggccccacccatcaagcccatcaagcctgtgaccaggaacaaggccccccaggagccccctgtgaagaagggcagaagaagccgccgctgtggccagtgccccggctgccaggtgcctgaggactgtggggtgtgcaccaactgcctggacaagcccaagtttggaggaagaaacatcaagaagcagtgctgcaagatgaggaagtgccagaacctgcagtggatgcccagcaaggcctacctgcagaagcaggccaaggctgtgaagaagaaggagaagaagagcaagaccagcgagaagaaggacagcaaggagagctctgtggtgaagaatgtggtggacagcagccagaagcccacccccagcgccagagaagatcctgcccccaagaagagcagcagcgagcccccacccaggaagcctgtggaggagaagtctgaggagggcaatgtgtctgcccctggccctgagagcaagcaggccaccaccccagccagcaggaagagcagcaagcaggtgtcccagcctgccctggtgattcctccccagccccccaccactggaccacccaggaaggaggtgcccaagaccacccccagcgagcccaagaagaagcagcccccacctcctgagagcggccctgagcagagcaagcagaagaaggtggccccccggcccagcatccctgtgaagcagaagcccaaggagaaggagaagcccccacctgtgaacaagcaggagaatgccggcaccctgaacatcctgagcaccctgagcaatggaaacagcagcaagcagaagatcccagcagatggagtgcaccgcatccgggtggacttcaagtag

SEQ ID NO: 160634 - DNA, 11919 bp, Artificial Sequence
  Description of Artificial Sequence: Synthetic coding sequence
atggcccacagctgccgctggaggtttcctgcccggcccggcaccaccggcggcggcggcggcggcggccggcggggcctgggcggggccccccggcagagggtgcctgccctgctgctgcccccaggcccccctgtgggcggcggcggccctggggccccacccagccccccagctgtggccgctgctgctgctgctgctggcagcagcggggccggcgtgcctggaggagctgctgctgccagcgctgccagcagcagcagcgccagcagcagcagcagcagcagcagcagcgccagcagcggccctgccctgctgcgggtgggccctggctttgatgctgccctgcaggtgtctgctgccatcggcaccaacctgcggcgcttccgggctgtgtttggagagagcggcggcggcggcggcagcggggaggatgagcagttcctgggctttggaagtgatgaggaggtgcgggtgcgcagccccaccaggagccccagcgtgaagaccagccccaggaagccccggggccggcccaggagcggcagtgacagaaattctgccatcctgagtgaccccagcgtcttcagccccctgaacaagtctgagaccaagagcggggacaagatcaagaagaaggacagcaagagcattgagaagaagaggggccggccccccaccttccctggggtgaagatcaagatcacccacggcaaggacatcagcgagctgcccaagggcaacaaggaggacagcctgaagaagatcaagaggaccccatctgccaccttccagcaggccaccaagatcaagaagctgcgggccggcaagctgagccccctgaagagcaagttcaagacaggcaagctgcagatcggcaggaaaggagtgcagatcgtgagaagaagaggccggccccccagcacagagcgcatcaagacccccagcggcctgctgatcaacagcgagctggagaagccccagaaggtgaggaaggacaaggagggcaccccacccctgaccaaggaggacaagacagtggtgcggcagagcccccggcgcatcaagcctgtgcgcatcatccccagcagcaagaggacagatgccaccatcgccaagcagctgctgcagagggccaagaagggggcccagaagaagattgagaaggaggccgcccagctgcagggcaggaaggtgaagacccaggtgaagaacatccggcagttcatcatgcctgtggtgtctgccatcagcagccgcatcatcaagaccccccggcgcttcattgaagatgaggactatgacccccccatcaagatcgcccggctggagagcacccccaacagccgcttcagcgcccccagctgtggcagcagcgagaagagcagcgctgccagccagcacagcagccagatgagcagtgacagcagccgcagcagcagccccagcgtggacaccagcacagacagccaggccagcgaggagatccaggtgctgcctgaggagaggagtgacaccccagaggtgcacccccccctgcccatcagccagagcccagaaaatgaaagcaatgaccggcgcagccgccgctacagcgtgtctgagaggagctttggcagcaggaccaccaagaagctgagcaccctgcagagcgccccccagcagcagaccagcagcagccccccaccacccctgctgaccccacctccacccctgcagcctgccagcagcatcagtgaccacaccccctggctgatgccacccaccatccccctggccagccccttcctgcctgccagcacagcccccatgcagggcaagaggaagagcatcctgcgggagcccaccttccgctggaccagcctgaagcacagccgctctgagccccagtacttcagcagcgccaagtatgccaaggagggcctcatcaggaagcccatctttgacaacttccggcccccacccctgaccccagaagatgtgggctttgccagcggcttcagcgccagcggcacagctgccagcgcccggctcttcagccccctgcacagcggcaccaggtttgacatgcacaagaggagccccctgctgcgggccccccgcttcaccccatctgaggcccacagccgcatctttgagagcgtgaccctgcccagcaacagaacatctgctggcaccagcagcagtggagtgagcaacaggaagaggaagaggaaggtgttcagccccatccgctctgagcccaggagccccagccacagcatgaggaccaggagcggccgcctgagcagcagcgagctgagccccctgaccccacccagctctgtgagcagcagcctgagcatctctgtgagccccctggccaccagcgccctgaaccccaccttcaccttccccagccacagcctgacccagagcggggagagcgctgagaagaaccagaggcccaggaagcagaccagcgccccagctgagcccttcagcagcagcagccccacccccctcttcccctggttcaccccaggcagccagacagagcggggcaggaacaaggacaaggcccctgaggagctgagcaaggacagagatgctgacaagtctgtggagaaggacaagagccgggagcgggaccgggagcgggagaaggagaacaagcgggagagcaggaaggagaagaggaagaagggcagcgagatccagagcagcagcgccctgtaccctgtgggccgggtgtccaaggagaaggtggtgggagaagatgtggccaccagcagcagcgccaagaaggccactggaaggaagaagagcagcagccatgattctggaacagacatcacctctgtgaccctgggggacaccacagctgtgaagaccaagatcctgatcaagaagggccggggcaacctggagaagaccaacctggacctgggccccacagcccccagcctggagaaggagaagaccctgtgcctgagcacccccagcagcagcacagtgaagcacagcaccagcagcatcggctccatgctggcccaggccgacaagctgcccatgacagacaagagggtggccagcctgctgaagaaggccaaggcccagctgtgcaagattgagaagagcaagagcctgaagcagacagaccagcccaaggcccagggccaggagagtgacagcagcgagacctctgtgcggggcccccgcatcaagcacgtgtgcagaagagctgctgtggccctgggcaggaagagagctgtgtttcctgatgacatgcccaccctgagcgccctgccctgggaggagcgggagaagatcctgagctccatgggaaatgatgacaagagcagcattgctggctctgaagatgctgagcccctggccccacccatcaagcccatcaagcctgtgaccaggaacaaggccccccaggagccccctgtgaagaagggccgccgcagcagaagatgtggccagtgccccggctgccaggtgcctgaggactgtggggtgtgcaccaactgcctggacaagcccaagtttggaggcaggaacatcaagaagcagtgctgcaagatgaggaagtgccagaacctgcagtggatgcccagcaaggcctacctgcagaagcaggccaaggctgtgaagaagaaggagaagaagagcaagaccagcgagaagaaggacagcaaggagagctctgtggtgaagaatgtggtggacagcagccagaagcccaccccatctgcccgggaggaccctgcccccaagaagagcagcagcgagcccccacccaggaagcctgtggaggagaagtctgaggagggcaatgtgtctgcccctggccctgagagcaagcaggccaccaccccagccagcaggaagagcagcaagcaggtgtcccagcctgccctggtgatccccccccagccccccaccaccggcccccccaggaaggaggtgcccaagaccaccccatctgagcccaagaagaagcagcccccacctcctgagagcggccctgagcagagcaagcagaagaaggtggccccccggcccagcatccctgtgaagcagaagcccaaggagaaggagaagcccccacctgtgaacaagcaggagaatgccggcaccctgaacatcctgagcaccctgagcaatggaaacagcagcaagcagaagatcccagcagatggagtgcaccgcatccgggtggacttcaaggaggactgtgaggccgagaatgtgtgggagatgggcggcctgggcatcctgacctctgtgcccatcaccccccgggtggtgtgcttcctgtgtgccagcagcggccacgtggagtttgtgtactgccaggtgtgctgtgagcccttccacaagttctgcctggaggagaatgaaagacccctggaggaccagctggagaactggtgctgccgccgctgcaagttctgccacgtgtgtggccggcagcaccaggccaccaagcagctgctggagtgcaacaagtgcaggaacagctaccaccctgagtgcctgggccccaactaccccaccaagcccaccaagaagaagaaggtgtggatctgcaccaagtgtgtgcgctgcaagagctgtggcagcaccaccccaggcaagggctgggatgcccagtggagccatgacttcagcctgtgccacgactgtgccaagctgtttgccaagggcaacttctgccccctgtgtgacaagtgctatgatgatgatgattatgagagcaagatgatgcagtgtgggaaatgtgaccgctgggtgcacagcaaatgtgagaacctgtctggaacagaagatgagatgtatgagatcctgagcaacctgcctgagagcgtggcctacacctgtgtgaactgcacagagcggcaccctgctgagtggaggctggccctggagaaggagctgcagatcagcctgaagcaggtgctgacagccctgctgaacagcaggaccaccagccacctgctgcgctaccggcaggccgccaagcccccagacctgaaccctgagacagaggagagcatccccagccgcagcagccctgagggccctgacccccctgtgctgacagaggtgtccaagcaggatgaccagcagcccctggacctggagggcgtgaagaggaagatggaccagggcaactacacctctgtgctggagttcagtgatgacatcgtgaagatcatccaggccgccatcaacagtgatggcggccagcctgagatcaagaaggccaacagcatggtgaagagcttcttcatccggcagatggagagggtcttcccctggttctctgtgaagaagagccgcttctgggagcccaacaaggtgagcagcaacagcggcatgctgcccaatgctgtgctgccccccagcctggaccacaactatgcccagtggcaggagcgggaggagaacagccacacagagcagccccccctgatgaagaagatcatcccagcccccaagcccaagggccctggagagccagacagccccacccccctgcacccccccaccccacccatcctgagcacagacaggagccgggaggacagccctgagctgaaccccccacctggcatcgaggacaaccggcagtgtgccctgtgcctgacctatggagatgacagcgccaatgatgctggccgcctgctgtacatcggccagaatgagtggacccacgtgaactgtgccctgtggagcgctgaggtgtttgaagatgatgatggcagcctgaagaatgtgcacatggctgtgatccggggcaagcagctgcgctgtgagttctgccagaagccaggggccaccgtgggctgctgcctgaccagctgcaccagcaactaccacttcatgtgcagccgggccaagaactgtgtgttcctggatgacaagaaggtgtactgccagaggcaccgggacctgatcaagggggaggtggtgcctgaaaatggatttgaggtgttccggcgggtgtttgtggactttgagggcatcagcctgcggaggaagttcctgaatggcctggagcctgagaacatccacatgatgattggctccatgaccatcgactgcctgggcatcctgaatgacctgagtgactgtgaggacaagctgttccccatcggctaccagtgcagccgggtgtactggagcaccacagatgccaggaagagatgtgtgtacacctgcaagatcgtggagtgcaggcctcctgtggtggagccagacatcaacagcacagtggagcatgatgagaacagaaccatcgcccacagccccaccagcttcacagagagcagcagcaaggagagccagaacacagctgagatcatcagcccccccagcccagaccggcccccccacagccagaccagcggcagctgctactaccacgtgatcagcaaggtgccccgcatccgcacccccagctacagccccacccagaggagccctggctgccggcccctgcccagcgctggcagccccacccccaccacccatgagatcgtgacagtgggggaccccctgctgagcagcggcctgcggagcatcggcagccgccgccacagcaccagcagcctgagcccccagaggagcaagctgcgcatcatgagccccatgaggacaggcaacacctacagcaggaacaacgtgtcctctgtgtccaccactggaacagccacagacctggagagcagcgccaaggtggtggaccacgtgctgggccccctgaacagcagcaccagcctgggccagaacaccagcaccagcagcaacctgcagaggacagtggtgacagtgggcaacaagaacagccacctggatggcagcagcagcagcgagatgaagcagagcagcgccagtgacctggtgtccaagagcagcagcctgaagggggagaagaccaaggtgctgagcagcaagagcagcgagggcagcgcccacaacgtggcctacccaggcatccccaagctggccccccaggtgcacaacaccaccagccgggagctgaatgtgtccaagattggcagctttgctgagcccagctctgtgtccttcagcagcaaggaggccctgtccttcccccacctgcacctgcggggccagagaaatgaccgggaccagcacacagacagcacccagagcgccaacagcagcccagatgaggacacagaggtgaagaccctgaagctgagcggcatgagcaacagaagcagcatcatcaatgagcacatgggcagcagcagccgggaccggcggcagaagggcaagaagagctgcaaggagaccttcaaggagaagcacagcagcaagagcttcctggagcccggccaggtgaccactggagaggagggcaacctgaagccagagttcatggatgaggtgctgaccccagagtacatgggccagaggccctgcaacaacgtgtccagtgacaagatcggggacaagggcctgtccatgcctggggtgcccaaggccccacccatgcaggtggagggcagcgccaaggagctgcaggcccccaggaagaggacagtgaaggtgaccctgacccccctgaagatggagaatgaaagccagagcaagaatgccctgaaggagagcagccctgccagccccctgcagatcgagagcaccagccccacagagcccatcagcgccagcgagaaccctggagatggccctgtggcccagcccagccccaacaacaccagctgccaggacagccagagcaacaactaccagaacctgcctgtgcaggacaggaacctgatgctgcctgatggccccaagccccaggaggatggcagcttcaagaggcgctaccccaggagaagtgcccgggcccggagcaacatgttcttcggcctgacccccctgtatggagtgcgctcctatggagaggaggacatccccttctacagcagcagcacaggcaagaagaggggcaagaggtctgctgagggccaggtggatggagcagatgacctgagcaccagtgatgaagatgacctgtactactacaacttcaccaggacagtcatcagcagcggcggggaggagcggctggccagccacaacctcttccgggaggaggagcagtgtgacctgcccaagatcagccagctggatggagtggatgatggaacagaaagtgacacctctgtgacagccaccaccaggaagagcagccagatccccaagagaaatggcaaggaaaatggaacagagaacctgaagattgacagaccagaagatgctggggagaaggagcacgtgaccaagagctctgtgggccacaagaatgagcccaagatggacaactgccacagcgtgtcccgggtgaagacccagggccaggacagcctggaggcccagctgagcagcctggagagcagcagaagagtgcacaccagcacccccagcgacaagaacctgctggacacctacaacacagagctgctgaagagtgacagcgacaacaacaacagtgatgactgtggcaacatcctgcccagcgacatcatggactttgtgctgaagaacacccccagcatgcaggccctgggggagagccctgagagcagcagcagcgagctgctgaacctgggggagggcctgggcctggacagcaaccgggagaaggacatgggcctgtttgaggtgttcagccagcagctgcccaccacagagcctgtggacagctctgtgagcagcagcatctctgctgaggagcagtttgagctgcccctggagctgcccagcgacctgtctgtgctgaccaccaggagccccaccgtgcccagccagaaccccagccggctggccgtcatcagtgacagcggggagaagagggtgaccatcacagagaagtctgtggccagcagcgagagtgaccctgccctgctgagccctggggtggaccccaccccagagggccacatgaccccagaccacttcatccagggccacatggatgctgaccacatcagcagccccccctgtggctctgtggagcagggccacggcaacaaccaggacctgaccaggaacagcagcaccccaggcctgcaggtgcctgtgagccccaccgtgcccatccagaaccagaagtatgtgcccaacagcacagacagccctggccccagccagatcagcaatgctgctgtgcagaccaccccaccccacctgaagccagccacagagaagctgattgtggtgaaccagaacatgcagcccctgtatgtgctgcagaccctgcccaatggagtgacccagaagatccagctgaccagctctgtgagcagcacccccagcgtgatggagaccaacacctctgtgctgggccccatgggcggcggcctgaccctgaccaccggcctgaaccccagcctgcccaccagccagagcctcttccccagcgccagcaagggcctgctgcccatgagccaccaccagcacctgcacagcttccctgctgccacccagagcagcttcccccccaacatcagcaaccccccatctggcctgctgattggagtgcagcccccaccagacccccagctgctggtgtctgagagcagccagaggacagacctgagcaccaccgtggccacccccagcagcggcctgaagaagaggcccatcagccggctgcagaccaggaagaacaagaagctggcccccagcagcacccccagcaacatcgcccccagtgatgtggtgagcaacatgaccctcatcaacttcacccccagccagctgcccaaccaccccagcctgctggacctgggcagcctgaacaccagcagccacaggacagtgcccaacatcatcaagaggagcaagagcagcatcatgtactttgagcccgcccccctgctgccccagagcgtgggcggcacagctgccacagctgctggcaccagcaccatcagccaggacaccagccacctgaccagcggctctgtgtctggcctggccagcagcagctctgtgctgaatgtggtgtccatgcagaccaccaccacccccaccagcagcgcctctgtgcccggccacgtgaccctgaccaacccccggctgctgggcaccccagacatcggcagcatcagcaacctgctgatcaaggccagccagcagagcctgggcatccaggaccagcctgtggccctgccccccagcagcggcatgttcccccagctgggcaccagccagacccccagcacagctgccatcacagctgccagcagcatctgtgtgctgcccagcacccagaccaccggcatcacagctgccagccccagcggggaggctgatgagcactaccagctgcagcacgtgaaccagctgctggccagcaagacaggcatccacagcagccagagggacctggacagcgccagcggcccccaggtgagcaacttcacccagacagtggatgcccccaacagcatgggcctggagcagaacaaggccctgagcagcgctgtgcaggccagccccaccagccctgggggcagccccagcagccccagcagcggccagaggtctgccagccccagcgtgcccggccccaccaagcccaagcccaagaccaagcgcttccagctgcccctggacaagggaaatggcaagaagcacaaggtgagccacctgcggaccagcagcagcgaggcccacatcccagaccaggagaccaccagcctgaccagcggcaccggcaccccaggagctgaggccgagcagcaggacacagcctctgtggagcagagcagccagaaggaatgtggccagcctgctggccaggtggccgtgctgcctgaggtgcaggtgacccagaacccagccaatgagcaggagagcgctgagcccaagacagtggaggaggaggagagcaacttcagcagccccctgatgctgtggctgcagcaggagcagaagaggaaggagagcatcacagagaagaagcccaagaagggcctggtgtttgagatcagcagtgatgatggcttccagatctgtgccgagagcattgaagatgcctggaagagcctgacagacaaggtgcaggaggcccggagcaatgcccggctgaagcagctgagctttgctggggtgaatggcctgaggatgctgggcatcctgcatgatgctgtggtgttcctgattgagcagctgagcggggccaagcactgcaggaactacaagttccgcttccacaagccagaggaggccaatgaaccacccctgaacccccacggcagcgcccgggcagaggtgcacctgaggaagagcgcctttgacatgttcaacttcctggccagcaagcaccggcagcccccagagtacaaccccaatgatgaggaggaggaggaggtgcagctgaagagcgcccggcgggccacctccatggacctgcccatgcccatgaggttccgccacctgaagaagaccagcaaggaggccgtgggcgtgtaccgcagccccatccacggccggggcctcttctgcaagaggaacattgatgctggggagatggtgattgaatatgctggaaatgtcatccgcagcatccagacagacaagcgggagaagtactatgacagcaaaggaattggctgctacatgttcagaattgatgattctgaggtggtggatgccaccatgcatggaaatgctgcccgcttcatcaaccacagctgtgagcccaactgctacagcagggtcatcaacattgatggccagaagcacatcgtcatctttgccatgaggaagatctacagaggagaggagctgacctatgactacaagttccccattgaagatgccagcaacaagctgccctgcaactgtggggccaagaagtgcaggaagttcctgaactag

SEQ ID NO: 160635 - DNA, 1680 bp, Artificial Sequence
  Description of Artificial Sequence: Synthetic coding sequence
atggacaaccagtgcaccgtgcaggtgcggctggagctgggccaccgggcccagctgaggaagaagcccaccacagagggcttcacccatgactggatggtgtttgtgcggggccctgagcagtgtgacatccagcactttgtggagaaggtggtgttctggctgcatgacagcttccccaagcccaggagagtgtgcaaggagcccccctacaaggtggaggagagcggctacgccggcttcatcatgcccatcgaggtgcacttcaagaacaaggaggagcccaggaaggtgtgcttcacctatgacctcttcctgaacctggagggcaacccccctgtgaaccacctgcgctgtgagaagctgaccttcaacaaccccaccacagagttccgctacaagctgctgcgggccggcggcgtgatggtgatgcctgagggcgctgacacagtgtcccggcccagcccagactaccccatgctgcccaccatccccctgagcgccttcagtgaccccaagaagaccaagcccagccacggcagcaaggatgccaacaaggagagcagcaagaccagcaagccccacaaggtgaccaaggagcaccgggagcggcccaggaaggacagcgagagcaagagcagcagcaaggagctggagcgggagcaggccaagagcagcaaggacaccagcaggaagctgggggagggccgcctgcccaaggaggagaaggcccccccacccaaggccgccttcaaggagcccaagatggccctgaaggagaccaagctggagagcaccagccccaagggcggccccccacctcctcctcctcctccaccccgggccagcagcaagaggcctgccacagctgacagccccaagcccagcgccaagaagcagaagaagagcagcagcaagggcagccgcagcgcccctggcaccagccccaggaccagcagcagcagcagcttcagtgacaagaagccagccaaggacaagagcagcaccagaggagagaaggtgaaggccgagagcgagccccgggaggccaagaaggccctggaggtggaggagagcaacagtgaagatgaggccagcttcaagtctgagagcgcccagagcagccccagcaacagcagcagcagcagtgacagcagcagtgacagcgactttgagcccagccagaaccacagccagggccccctgcgctccatggtggaggacctgcagagcgaggagagtgatgaagatgacagcagcagtggagaggaggccgccggcaagaccaaccctggccgggacagccggctgtccttcagtgacagcgagagtgacaacagcgctgacagcagcctgcccagccgggagcccccaccaccccagaagcccccaccacccaacagcaaggtgtctggaagaagaagccctgagagctgcagcaagccagagaagatcctgaagaagggcacctatgacaaggcctacacagatgagctggtggagctgcaccggcggctgatggccctgcgggagagaaatgtgctgcagcagatcgtgaacctgattgaggagaccggccacttcaacgtgaccaacaccacctttgattttgacctcttcagcctggatgagaccaccgtgaggaagctgcagagctgcctggaggccgtggccacctag

SEQ ID NO: 160636 - DNA, 273 bp, Artificial Sequence
  Description of Artificial Sequence: Synthetic coding sequence
atgagggaccctgtgagcagccagtacagcagcttcctgttctggaggatgcccatccctgagctggacctgtctgagctggagggcctgggcctgagtgacacagccacctacaaggtgaaggacagctctgtgggcaagatgattggccaggccacagctgctgaccaggagaagaacccagaaggagatggcctgctggagtacagcaccttcaacttctggagggcccccatcgccagcatccacagctttgagctggacctgctgtag

SEQ ID NO: 160637 - DNA, 417 bp, Artificial Sequence
  Description of Artificial Sequence: Synthetic coding sequence
atgaaggacctgcacagtgatgacaatgaggaggagagtgatgaggtggaggacaatgacaatgattctgagatggagaggcctgtgaacagaggaggcagccgcagcagaagagtgtccctgagtgatggcagtgacagcgagagcagcagcgccagcagccccctgcaccacgagcccccaccacccctgctgaagaccaacaacaaccagatcctggaggtgaagagccccatcaagcagagcaagagtgacaagcagatcaagaatggagaatgtgacaagatcgtgaacctgattgaggagaccggccacttccacatcaccaacaccacctttgattttgacctgtgcagcctggacaagaccaccgtgaggaagctgcagagctacctggagaccagcggcaccagctag

SEQ ID NO: 160638 - DNA, 489 bp, Artificial Sequence
  Description of Artificial Sequence: Synthetic coding sequence
atgaaggacctgcacagtgatgacaatgaggaggagagtgatgaggtggaggacaatgacaatgattctgagatggagaggcctgtgaacagaggaggcagccgcagcagaagagtgtccctgagtgatggcagtgacagcgagagcagcagcgccagcagccccctgcaccacgagcccccaccacccctgctgaagaccaacaacaaccagatcctggaggtgaagagccccatcaagcagagcaagagtgacaagcagatcaagaatggagaatgtgacaaggcctacctggatgagctggtggagctgcaccggcggctgatgaccctgcgggagcggcacatcctgcagcagatcgtgaacctgattgaggagaccggccacttccacatcaccaacaccacctttgattttgacctgtgcagcctggacaagaccaccgtgaggaagctgcagagctacctggagaccagcggcaccagctag

SEQ ID NO: 160639 - DNA, 417 bp, Artificial Sequence; identical to SEQ ID NO: 160637
  Description of Artificial Sequence: Synthetic coding sequence

SEQ ID NO: 160640 - DNA, 1707 bp, Artificial Sequence
  Description of Artificial Sequence: Synthetic coding sequence
atggccagcagctgtgctgtgcaggtgaagctggagctgggccaccgggcccaggtgaggaagaagcccaccgtggagggcttcacccatgactggatggtgtttgtgcggggccctgagcacagcaacatccagcactttgtggagaaggtggtgttccacctgcacgagagcttcccccggcccaagagggtgtgcaaggaccccccctacaaggtggaggagagcggctacgccggcttcatcctgcccatcgaggtgtacttcaagaacaaggaggagcccaggaaggtgcgctttgattatgacctcttcctgcacctggagggccacccccctgtgaaccacctgcgctgtgagaagctgaccttcaacaaccccacagaggacttccggaggaagctgctgaaggccggcggggaccccaacagaagcatccacaccagcagcagcagcagcagcagcagcagcagcagcagcagcagcagcagcagcagcagcagcagcagcagcagcagcagcagcagcagcagcagcagcagcagcagcagcagcagcagcagcagcagcaccagcttcagcaagccccacaagctgatgaaggagcacaaggagaagcccagcaaggacagccgggagcacaagagcgccttcaaggagcccagccgggaccacaacaagagcagcaaggagagcagcaagaagcccaaggagaacaagcccctgaaggaggagaagatcgtgcccaagatggccttcaaggagcccaagcccatgagcaaggagcccaagccagacagcaacctgctgaccatcaccagcggccaggacaagaaggcccccagcaagaggcctcccatcagtgacagcgaggagctgagcgccaagaagaggaagaagagcagcagcgaggccctcttcaagagcttcagcagcgccccacccctcatcctgacctgcagcgctgacaagaagcagatcaaggacaagagccacgtgaagatgggcaaggtgaagattgagagcgagaccagcgagaagaagaagagcaccctgcccccatttgatgacatcgtggaccccaatgacagtgatgtggaggagaacatcagcagcaagagtgacagcgagcagcccagccctgccagcagcagcagcagcagcagcagcagcttcacccccagccagacccggcagcagggccccctgcggagcatcatgaaggacctgcacagtgatgacaatgaggaggagagtgatgaggtggaggacaatgacaatgattctgagatggagaggcctgtgaacagaggaggcagccgcagcagaagagtgtccctgagtgatggcagtgacagcgagagcagcagcgccagcagccccctgcaccacgagcccccaccacccctgctgaagaccaacaacaaccagatcctggaggtgaagagccccatcaagcagagcaagagtgacaagcagatcaagaatggagaatgtgacaaggcctacctggatgagctggtggagctgcaccggcggctgatgaccctgcgggagcggcacatcctgcagcagatcgtgaacctgattgaggagaccggccacttccacatcaccaacaccacctttgattttgacctgtgcagcctggacaagaccaccgtgaggaagctgcagagctacctggagaccagcggcaccagctag

SEQ ID NO: 160641 - DNA, 1698 bp, Artificial Sequence
  Description of Artificial Sequence: Synthetic coding sequence
atgtgtgctgtgcaggtgaagctggagctgggccaccgggcccaggtgaggaagaagcccaccgtggagggcttcacccatgactggatggtgtttgtgcggggccctgagcacagcaacatccagcactttgtggagaaggtggtgttccacctgcacgagagcttcccccggcccaagagggtgtgcaaggaccccccctacaaggtggaggagagcggctacgccggcttcatcctgcccatcgaggtgtacttcaagaacaaggaggagcccaggaaggtgcgctttgattatgacctcttcctgcacctggagggccacccccctgtgaaccacctgcgctgtgagaagctgaccttcaacaaccccacagaggacttccggaggaagctgctgaaggccggcggggaccccaacagaagcatccacaccagcagcagcagcagcagcagcagcagcagcagcagcagcagcagcagcagcagcagcagcagcagcagcagcagcagcagcagcagcagcagcagcagcagcagcagcagcagcagcagcagcagcaccagcttcagcaagccccacaagctgatgaaggagcacaaggagaagcccagcaaggacagccgggagcacaagagcgccttcaaggagcccagccgggaccacaacaagagcagcaaggagagcagcaagaagcccaaggagaacaagcccctgaaggaggagaagatcgtgcccaagatggccttcaaggagcccaagcccatgagcaaggagcccaagccagacagcaacctgctgaccatcaccagcggccaggacaagaaggcccccagcaagaggcctcccatcagtgacagcgaggagctgagcgccaagaagaggaagaagagcagcagcgaggccctcttcaagagcttcagcagcgcccctcctctcatcctgacctgcagcgctgacaagaagcagatcaaggacaagagccacgtgaagatgggcaaggtgaagattgaaagtgagaccagcgagaagaagaagagcaccctgcccccatttgatgacatcgtggaccccaatgacagtgatgtggaggagaacatcagcagcaagagtgacagcgagcagcccagccctgccagcagcagcagcagcagcagcagcagcttcacccccagccagacccggcagcagggccccctgcggagcatcatgaaggacctgcacagtgatgacaatgaggaggagagtgatgaggtggaggacaatgacaatgacagcgagatggagaggcctgtgaacagaggaggcagccgcagccggcgggtgtccctgagtgatggcagtgacagcgagagcagcagcgccagcagccccctgcaccacgagcccccaccacccctgctgaagaccaacaacaaccagatcctggaggtgaagagccccatcaagcagagcaagagtgacaagcagatcaagaatggagaatgtgacaaggcctacctggatgagctggtggagctgcaccggcggctgatgaccctgcgggagcggcacatcctgcagcagatcgtgaacctgattgaggagaccggccacttccacatcaccaacaccacctttgattttgacctgtgcagcctggacaagaccaccgtgaggaagctgcagagctacctggagaccagcggcaccagctag

SEQ ID NO: 160642 - DNA, 1824 bp, Artificial Sequence
  Description of Artificial Sequence: Synthetic coding sequence
atgcagagggccccacccttccccttcatgtgtgtgtccagaagaaggaagaagtgccaggcccagaggagcctgcccaagccccggctgcctgtgatccacggctgcctgagcagcccctgcccccagtgtgctgtgcaggtgaagctggagctgggccaccgggcccaggtgaggaagaagcccaccgtggagggcttcacccatgactggatggtgtttgtgcggggccctgagcacagcaacatccagcactttgtggagaaggtggtgttccacctgcacgagagcttcccccggcccaagagggtgtgcaaggaccccccctacaaggtggaggagagcggctacgccggcttcatcctgcccatcgaggtgtacttcaagaacaaggaggagcccaggaaggtgcgctttgattatgacctcttcctgcacctggagggccacccccctgtgaaccacctgcgctgtgagaagctgaccttcaacaaccccacagaggacttccggaggaagctgctgaaggccggcggggaccccaacagaagcatccacaccagcagcagcagcagcagcagcagcagcagcagcagcagcagcagcagcagcagcagcagcagcagcagcagcagcagcagcagcagcagcagcagcagcagcagcagcagcagcagcagcagcagcaccagcttcagcaagccccacaagctgatgaaggagcacaaggagaagcccagcaaggacagccgggagcacaagagcgccttcaaggagcccagccgggaccacaacaagagcagcaaggagagcagcaagaagcccaaggagaacaagcccctgaaggaggagaagatcgtgcccaagatggccttcaaggagcccaagcccatgagcaaggagcccaagccagacagcaacctgctgaccatcaccagcggccaggacaagaaggcccccagcaagaggcctcccatcagtgacagcgaggagctgagcgccaagaagaggaagaagagcagcagcgaggccctcttcaagagcttcagcagcgcccctcctctcatcctgacctgcagcgctgacaagaagcagatcaaggacaagagccacgtgaagatgggcaaggtgaagattgaaagtgagaccagcgagaagaagaagagcaccctgcccccatttgatgacatcgtggaccccaatgacagtgatgtggaggagaacatcagcagcaagagtgacagcgagcagcccagccctgccagcagcagcagcagcagcagcagcagcttcacccccagccagacccggcagcagggccccctgcggagcatcatgaaggacctgcacagtgatgacaatgaggaggagagtgatgaggtggaggacaatgacaatgacagcgagatggagaggcctgtgaacagaggaggcagccgcagccggcgggtgtccctgagtgatggcagtgacagcgagagcagcagcgccagcagccccctgcaccacgagcccccaccacccctgctgaagaccaacaacaaccagatcctggaggtgaagagccccatcaagcagagcaagagtgacaagcagatcaagaatggagaatgtgacaaggcctacctggatgagctggtggagctgcaccggcggctgatgaccctgcgggagcggcacatcctgcagcagatcgtgaacctgattgaggagaccggccacttccacatcaccaacaccacctttgattttgacctgtgcagcctggacaagaccaccgtgaggaagctgcagagctacctggagaccagcggcaccagctag

SEQ ID NO: 160643 - DNA, 4986 bp, Artificial Sequence
  Description of Artificial Sequence: Synthetic coding sequence
atgtctgctgggggcagagatgaggagaggaggaagctggccgacatcatccaccactggaatgccaaccggctggacctgtttgagatcagccagcccacagaggacctggagttccacggcgtgatgaggttctacttccaggacaaggccgccggcaactttgccaccaagtgcatccgggtgagcagcacagccaccacccaggacgtcatcgagaccctggccgagaagttccggccagacatgaggatgctgagcagccccaagtacagcctgtatgaggtgcacgtgtctggagagcggcggctggacattgatgagaagcccctggtggtgcagctgaactggaacaaggatgaccgggagggccgctttgtgctgaagaatgaaaatgatgccatcccccccaagaaggcccagagcaatggacctgagaagcaggagaaggagggcgtcatccagaacttcaagaggaccctgagcaagaaggagaagaaggagaagaagaagcgggagaaggaggccctgcggcaggccagtgacaaggatgaccggcccttccagggagaagatgtggagaacagccggctggccgctgaggtgtacaaggacatgcctgagaccagcttcaccaggaccatcagcaaccctgaggtggtgatgaagagaagacggcagcagaagctggagaagaggatgcaggagttccgcagcagtgatggccgcccagacagcggcggcaccctgcgcatctatgctgacagcctgaagcccaacatcccctacaagaccatcctgctgagcaccacagatcctgctgactttgctgtggccgaggccctggagaagtatggcctggagaaggagaaccccaaggactactgcatcgcccgggtgatgctgcccccaggggcccagcacagtgatgagaagggggccaaggagatcatcctggatgatgatgaatgtcccctgcagatcttccgggagtggcccagcgacaagggcatcctggtgttccagctgaagagaagacctccagaccacatccccaagaagaccaagaagcacctggagggcaagacccccaagggcaaggagcgggcagatggcagcggctacggcagcaccctgcccccagagaagctgccctacctggtggagctgagccctggaagaagaaaccactttgcctactacaactaccacacctatgaagatggcagtgacagccgggacaagcccaagctgtaccgcctgcagctgtctgtgacagaggtgggcacagagaagctggatgacaacagcatccagctgtttggacctggcatccagccccaccactgtgacctgaccaacatggatggagtggtgacagtgacccccaggtccatggatgctgagacctacgtggagggccagaggatcagcgagaccaccatgctgcagagcggcatgaaggtgcagtttggagccagccacgtgttcaagtttgtggaccccagccaggaccacgccctggccaagaggtctgtggatggcggcctgatggtgaagggccccaggcacaagccaggcatcgtgcaggagaccacctttgacctgggcggggacatccacagcggcacagccctgcccaccagcaagagcaccacccggctggacagcgacagagtgagcagcgccagcagcacagctgagcggggcatggtgaagcccatgatccgggtggagcagcagcctgactaccgccggcaggagagcaggacccaggatgccagcggccctgagctgatcctgcctgccagcattgagttccgggagagcagcgaggacagcttcctgagcgccatcatcaactacaccaacagcagcacagtgcacttcaagctgagccccacctacgtgctgtacatggcctgccgctacgtgctgagcaaccagtacagaccagacatcagccccacagagaggacccacaaggtgattgctgtggtgaacaagatggtgtccatgatggagggcgtcatccagaagcagaagaacattgctggggccctggccttctggatggccaatgccagcgagctgctgaacttcatcaagcaggaccgggacctgagccgcatcaccctggatgcccaggatgtgctggcccacctggtgcagatggccttcaagtacctggtgcactgcctgcagagcgagctgaacaactacatgcctgccttcctggatgatcctgaggagaacagcctgcagaggcccaagattgatgatgtgctgcacaccctgactggagccatgagcctgctgcggcgctgccgggtgaatgctgccctgaccatccagctgttcagccagctgttccacttcatcaacatgtggctgttcaaccggctggtgacagatcctgacagcggcctgtgcagccactactggggcgccatcatccggcagcagctgggccacatcgaggcctgggccgagaagcagggcctggagctggccgctgactgccacctgagccgcatcgtgcaggccaccaccctgctgaccatggacaagtatgccccagatgacatccccaacatcaacagcacctgcttcaagctgaacagcctgcagctgcaggccctgctgcagaactaccactgtgccccagatgagcccttcatccccacagacctgattgaaaatgtggtgacagtggctgaaaatacagcagatgagctggcccggagtgatggccgggaggtgcagctggaggaggaccctgacctgcagctgcccttcctgctgcctgaagatggctacagctgtgatgtggtgaggaacatccccaacggcctgcaggagttcctggaccccctgtgccagaggggcttctgccgcctcatcccccacaccaggagccctggcacctggaccatctactttgaaggagctgactatgagagccacctgctgagagaaaatacagagctggccatccccctgaggaaggagcctgagatcatcaccgtgaccctgaagaagcagaatggcatgggcctgagcatcgtggccgccaagggggccggccaggacaagctgggcatctacgtgaagtctgtggtgaagggcggcgctgctgatgtggatggccgcctggccgccggggaccagctgctgtctgtggatggccgcagcctggtgggcctgagccaggagagagctgctgagctgatgaccaggaccagctctgtggtgaccctggaggtggccaagcagggcgccatctaccacggcctggccaccctgctgaaccagcccagccccatgatgcagaggatcagtgaccggcggggcagcggcaagccccggcccaagtctgagggctttgagctgtacaacaacagcacccagaatggcagccctgagagcccccagctgccctgggccgagtacagcgagcccaagaagctgcctggagatgaccggctgatgaagaacagagctgaccacaggagcagccccaacgtggccaaccagccccccagccctgggggcaagagcgcctatgccagcggcaccacagccaagatcacctctgtgtccacaggcaacctgtgcacagaggagcagaccccaccacccaggcctgaggcctaccccatccccacccagacctacacccgggagtacttcaccttccctgccagcaagagccaggacaggatggccccaccccagaaccagtggcccaactatgaggagaagccccacatgcacacagacagcaaccacagcagcatcgccatccagagggtgaccaggagccaggaggagctgcgggaggacaaggcctaccagctggagcggcaccgcatcgaggccgccatggacaggaagagtgacagcgacatgtggatcaaccagagcagcagcctggacagcagcaccagcagccaggagcacctgaaccacagcagcaagtctgtgaccccagccagcaccctgaccaagagcggccctggccgctggaagaccccagctgccatcccagccacccctgtggccgtgtcccagcccatcagaacagacctgcccccacctcctcctcctcctcctgtgcactacgccggggactttgatggcatgtccatggacctgcccctgcccccacctccttctgccaaccagatcggcctgcccagcgcccaggtggccgctgctgagaggaggaagcgggaggagcaccagcgctggtatgagaaggagaaggcccggctggaggaggagcgggagaggaagaggcgggagcaggagaggaagctgggccagatgaggacccagagcctgaacccagcccccttcagccccctgacagcccagcagatgaagccagagaagcccagcaccctgcagaggccccaggagaccgtcatccgggagctgcagccccagcagcagcccaggaccatcgagcggcgggacctgcagtacatcaccgtgtccaaggaggagctgagcagcggggacagcctgagcccagacccctggaagagagatgccaaggagaagctggagaagcagcagcagatgcacatcgtggacatgctgagcaaggagatccaggagctgcagagcaagccagacagatctgctgaggagagtgaccggctgaggaagctgatgctggagtggcagttccagaagaggctgcaggagagcaagcagaaggatgaagatgatgaggaggaggaggatgatgatgtggacaccatgctgatcatgcagaggctggaggccgagcggcgggcccggcagacagccatgcctgccatctctgtgctggacctgctgcaggatgaggagcggcggcggcagcagcagctggaggagatgaggaagcgggaggctgaagatcgggcccggcaggaggaggagcggcggcggcaggaggaggagaggaccaagagagatgctgaggagaagtag

SEQ ID NO: 160644 - DNA, 4998 bp, Artificial Sequence
  Description of Artificial Sequence: Synthetic coding sequence
atgtctgctgggggcagagatgaggagaggaggaagctggccgacatcatccaccactggaatgccaaccggctggacctgtttgagatcagccagcccacagaggacctggagttccacggcgtgatgaggttctacttccaggacaaggccgccggcaactttgccaccaagtgcatccgggtgagcagcacagccaccacccaggacgtcatcgagaccctggccgagaagttccggccagacatgaggatgctgagcagccccaagtacagcctgtatgaggtgcacgtgtctggagagcggcggctggacattgatgagaagcccctggtggtgcagctgaactggaacaaggatgaccgggagggccgctttgtgctgaagaatgaaaatgatgccatcccccccaagaaggcccagagcaatggacctgagaagcaggagaaggagggcgtcatccagaacttcaagaggaccctgagcaagaaggagaagaaggagaagaagaagcgggagaaggaggccctgcggcaggccagtgacaaggatgaccggcccttccagggagaagatgtggagaacagccggctggccgctgaggtgtacaaggacatgcctgagaccagcttcaccaggaccatcagcaaccctgaggtggtgatgaagagaagacggcagcagaagctggagaagaggatgcaggagttccgcagcagtgatggccgcccagacagcggcggcaccctgcgcatctatgctgacagcctgaagcccaacatcccctacaagaccatcctgctgagcaccacagatcctgctgactttgctgtggccgaggccctggagaagtatggcctggagaaggagaaccccaaggactactgcatcgcccgggtgatgctgcccccaggggcccagcacagtgatgagaagggggccaaggagatcatcctggatgatgatgaatgtcccctgcagatcttccgggagtggcccagcgacaagggcatcctggtgttccagctgaagagaagacctccagaccacatccccaagaagaccaagaagcacctggagggcaagacccccaagggcaaggagcgggcagatggcagcggctacggcagcaccctgcccccagagaagctgccctacctggtggagctgagccctggaagaagaaaccactttgcctactacaactaccacacctatgaagatggcagtgacagccgggacaagcccaagctgtaccgcctgcagctgtctgtgacagaggtgggcacagagaagctggatgacaacagcatccagctgtttggacctggcatccagccccaccactgtgacctgaccaacatggatggagtggtgacagtgacccccaggtccatggatgctgagacctacgtggagggccagaggatcagcgagaccaccatgctgcagagcggcatgaaggtgcagtttggagccagccacgtgttcaagtttgtggaccccagccaggaccacgccctggccaagaggtctgtggatggcggcctgatggtgaagggccccaggcacaagccaggcatcgtgcaggagaccacctttgacctgggcggggacatccacagcggcacagccctgcccaccagcaagagcaccacccggctggacagcgacagagtgagcagcgccagcagcacagctgagcggggcatggtgaagcccatgatccgggtggagcagcagcctgactaccgccggcaggagagcaggacccaggatgccagcggccctgagctgatcctgcctgccagcattgagttccgggagagcagcgaggacagcttcctgagcgccatcatcaactacaccaacagcagcacagtgcacttcaagctgagccccacctacgtgctgtacatggcctgccgctacgtgctgagcaaccagtacagaccagacatcagccccacagagaggacccacaaggtgattgctgtggtgaacaagatggtgtccatgatggagggcgtcatccagaagcagaagaacattgctggggccctggccttctggatggccaatgccagcgagctgctgaacttcatcaagcaggaccgggacctgagccgcatcaccctggatgcccaggatgtgctggcccacctggtgcagatggccttcaagtacctggtgcactgcctgcagagcgagctgaacaactacatgcctgccttcctggatgatcctgaggagaacagcctgcagaggcccaagattgatgatgtgctgcacaccctgactggagccatgagcctgctgcggcgctgccgggtgaatgctgccctgaccatccagctgttcagccagctgttccacttcatcaacatgtggctgttcaaccggctggtgacagatcctgacagcggcctgtgcagccactactggggcgccatcatccggcagcagctgggccacatcgaggcctgggccgagaagcagggcctggagctggccgctgactgccacctgagccgcatcgtgcaggccaccaccctgctgaccatggacaagtatgccccagatgacatccccaacatcaacagcacctgcttcaagctgaacagcctgcagctgcaggccctgctgcagaactaccactgtgccccagatgagcccttcatccccacagacctgattgaaaatgtggtgacagtggctgaaaatacagcagatgagctggcccggagtgatggccgggaggtgcagctggaggaggaccctgacctgcagctgcccttcctgctgcctgaagatggctacagctgtgatgtggtgaggaacatccccaacggcctgcaggagttcctggaccccctgtgccagaggggcttctgccgcctcatcccccacaccaggagccctggcacctggaccatctactttgaaggagctgactatgagagccacctgctgagagaaaatacagagctggcccagcccctgaggaaggagcctgagatcatcaccgtgaccctgaagaagcagaatggcatgggcctgagcatcgtggccgccaagggggccggccaggacaagctgggcatctacgtgaagtctgtggtgaagggcggcgctgctgatgtggatggccgcctggccgccggggaccagctgctgtctgtggatggccgcagcctggtgggcctgagccaggagagagctgctgagctgatgaccaggaccagctctgtggtgaccctggaggtggccaagcagggcgccatctaccacggcctggccaccctgctgaaccagcccagccccatgatgcagaggatcagtgaccggcggggcagcggcaagccccggcccaagtctgagggctttgagctgtacaacaacagcacccagaatggcagccctgagagcccccagctgccctgggccgagtacagcgagcccaagaagctgcctggagatgaccggctgatgaagaacagagctgaccacaggagcagccccaacgtggccaaccagccccccagccctgggggcaagagcgcctatgccagcggcaccacagccaagatcacctctgtgtccacaggcaacctgtgcacagaggagcagaccccaccacccaggcctgaggcctaccccatccccacccagacctacacccgggagtacttcaccttccctgccagcaagagccaggacaggatggccccaccccagaaccagtggcccaactatgaggagaagccccacatgcacacagacagcaaccacagcagcatcgccatccagagggtgaccaggagccaggaggagctgcgggaggacaaggcctaccagctggagcggcaccgcatcgaggccgccatggacaggaagagtgacagcgacatgtggatcaaccagagcagcagcctggacagcagcaccagcagccaggagcacctgaaccacagcagcaagtctgtgaccccagccagcaccctgaccaagagcggccctggccgctggaagaccccagctgccatcccagccacccctgtggccgtgtcccagcccatcagaacagacctgcccccacctcctcctcctcctcctgtgcactacgccggggactttgatggcatgtccatggacctgcccctgcccccacctccttctgccaaccagatcggcctgcccagcgcccaggtggccgctgctgagaggaggaagcgggaggagcaccagcgctggtatgagaaggagaaggcccggctggaggaggagcgggagaggaagaggcgggagcaggagaggaagctgggccagatgaggacccagagcctgaacccagcccccttcagccccctgacagcccagcagatgaagccagagaagcccagcaccctgcagaggccccaggagaccgtcatccgggagctgcagccccagcagcagcccaggaccatcgagcggcgggacctgcagtacatcaccgtgtccaaggaggagctgagcagcggggacagcctgagcccagacccctggaagagagatgccaaggagaagctggagaagcagcagcagatgcacatcgtggacatgctgagcaaggagatccaggagctgcagagcaagccagacagatctgctgaggagagtgaccggctgaggaagctgatgctggagtggcagttccagaagaggctgcaggagagcaagcagaaggatgaagatgatgaggaggaggaggatgatgatgtggacaccatgctgatcatgcagaggctggaggccgagcggcgggcccggcagacagccatgcctgccatctctgtgctggacctgctgcaggatgaggagcggcggcggcagcagcagctggaggagatgaggaagcgggaggctgaagatcgggcccggcaggaggaggagcggcggcggcaggaggaggagaggaccaagagagatgctgaggagaaggtgatggtgctgtag

SEQ ID NO: 160645 - DNA, 5475 bp, Artificial Sequence
  Description of Artificial Sequence: Synthetic coding sequence
atgtctgctgggggcagagatgaggagaggaggaagctggccgacatcatccaccactggaatgccaaccggctggacctgtttgagatcagccagcccacagaggacctggagttccacggcgtgatgaggttctacttccaggacaaggccgccggcaactttgccaccaagtgcatccgggtgagcagcacagccaccacccaggacgtcatcgagaccctggccgagaagttccggccagacatgaggatgctgagcagccccaagtacagcctgtatgaggtgcacgtgtctggagagcggcggctggacattgatgagaagcccctggtggtgcagctgaactggaacaaggatgaccgggagggccgctttgtgctgaagaatgaaaatgatgccatcccccccaagaaggcccagagcaatggacctgagaagcaggagaaggagggcgtcatccagaacttcaagaggaccctgagcaagaaggagaagaaggagaagaagaagcgggagaaggaggccctgcggcaggccagtgacaaggatgaccggcccttccagggagaagatgtggagaacagccggctggccgctgaggtgtacaaggacatgcctgagaccagcttcaccaggaccatcagcaaccctgaggtggtgatgaagagaagacggcagcagaagctggagaagaggatgcaggagttccgcagcagtgatggccgcccagacagcggcggcaccctgcgcatctatgctgacagcctgaagcccaacatcccctacaagaccatcctgctgagcaccacagatcctgctgactttgctgtggccgaggccctggagaagtatggcctggagaaggagaaccccaaggactactgcatcgcccgggtgatgctgcccccaggggcccagcacagtgatgagaagggggccaaggagatcatcctggatgatgatgaatgtcccctgcagatcttccgggagtggcccagcgacaagggcatcctggtgttccagctgaagagaagacctccagaccacatccccaagaagaccaagaagcacctggagggcaagacccccaagggcaaggagcgggcagatggcagcggctacggcagcaccctgcccccagagaagctgccctacctggtggagctgagccctggaagaagaaaccactttgcctactacaactaccacacctatgaagatggcagtgacagccgggacaagcccaagctgtaccgcctgcagctgtctgtgacagaggtgggcacagagaagctggatgacaacagcatccagctgtttggacctggcatccagccccaccactgtgacctgaccaacatggatggagtggtgacagtgacccccaggtccatggatgctgagacctacgtggagggccagaggatcagcgagaccaccatgctgcagagcggcatgaaggtgcagtttggagccagccacgtgttcaagtttgtggaccccagccaggaccacgccctggccaagaggtctgtggatggcggcctgatggtgaagggccccaggcacaagccaggcatcgtgcaggagaccacctttgacctgggcggggacatccacagcggcacagccctgcccaccagcaagagcaccacccggctggacagcgacagagtgagcagcgccagcagcacagctgagcggggcatggtgaagcccatgatccgggtggagcagcagcctgactaccgccggcaggagagcaggacccaggatgccagcggccctgagctgatcctgcctgccagcattgagttccgggagagcagcgaggacagcttcctgagcgccatcatcaactacaccaacagcagcacagtgcacttcaagctgagccccacctacgtgctgtacatggcctgccgctacgtgctgagcaaccagtacagaccagacatcagccccacagagaggacccacaaggtgattgctgtggtgaacaagatggtgtccatgatggagggcgtcatccagaagcagaagaacattgctggggccctggccttctggatggccaatgccagcgagctgctgaacttcatcaagcaggaccgggacctgagccgcatcaccctggatgcccaggatgtgctggcccacctggtgcagatggccttcaagtacctggtgcactgcctgcagagcgagctgaacaactacatgcctgccttcctggatgatcctgaggagaacagcctgcagaggcccaagattgatgatgtgctgcacaccctgactggagccatgagcctgctgcggcgctgccgggtgaatgctgccctgaccatccagctgttcagccagctgttccacttcatcaacatgtggctgttcaaccggctggtgacagatcctgacagcggcctgtgcagccactactggggcgccatcatccggcagcagctgggccacatcgaggcctgggccgagaagcagggcctggagctggccgctgactgccacctgagccgcatcgtgcaggccaccaccctgctgaccatggacaagtatgccccagatgacatccccaacatcaacagcacctgcttcaagctgaacagcctgcagctgcaggccctgctgcagaactaccactgtgccccagatgagcccttcatccccacagacctgattgaaaatgtggtgacagtggctgaaaatacagcagatgagctggcccggagtgatggccgggaggtgcagctggaggaggaccctgacctgcagctgcccttcctgctgcctgaagatggctacagctgtgatgtggtgaggaacatccccaacggcctgcaggagttcctggaccccctgtgccagaggggcttctgccgcctcatcccccacaccaggagccctggcacctggaccatctactttgaaggagctgactatgagagccacctgctgagagaaaatacagagctggccatccccctgaggaaggagcctgagatcatcaccgtgaccctgaagaagcagaatggcatgggcctgagcatcgtggccgccaagggggccggccaggacaagctgggcatctacgtgaagtctgtggtgaagggcggcgctgctgatgtggatggccgcctggccgccggggaccagctgctgtctgtggatggccgcagcctggtgggcctgagccaggagagagctgctgagctgatgaccaggaccagctctgtggtgaccctggaggtggccaagcagggcgccatctaccacggcctggccaccctgctgaaccagcccagccccatgatgcagaggatcagtgaccggcggggcagcggcaagccccggcccaagtctgagggctttgagctgtacaacaacagcacccagaatggcagccctgagagcccccagctgccctgggccgagtacagcgagcccaagaagctgcctggagatgaccggctgatgaagaacagagctgaccacaggagcagccccaacgtggccaaccagccccccagccctgggggcaagagcgcctatgccagcggcaccacagccaagatcacctctgtgtccacaggcaacctgtgcacagaggagcagaccccaccacccaggcctgaggcctaccccatccccacccagacctacacccgggagtacttcaccttccctgccagcaagagccaggacaggatggccccaccccagaaccagtggcccaactatgaggagaagccccacatgcacacagacagcaaccacagcagcatcgccatccagagggtgaccaggagccaggaggagctgcgggaggacaaggcctaccagctggagcggcaccgcatcgaggccgccatggacaggaagagtgacagcgacatgtggatcaaccagagcagcagcctggacagcagcaccagcagccaggagcacctgaaccacagcagcaagtctgtgaccccagccagcaccctgaccaagagcggccctggccgctggaagaccccagctgccatcccagccacccctgtggccgtgtcccagcccatcagaacagacctgcccccacctcctcctcctcctcctgtgcactacgccggggactttgatggcatgtccatggacctgcccctgcccccacctccttctgccaaccagatcggcctgcccagcgcccaggtggccgctgctgagaggaggaagcgggaggagcaccagcgctggtatgagaaggagaaggcccggctggaggaggagcgggagaggaagaggcgggagcaggagaggaagctgggccagatgaggacccagagcctgaacccagcccccttcagccccctgacagcccagcagatgaagccagagaagcccagcaccctgcagaggccccaggagaccgtcatccgggagctgcagccccagcagcagcccaggaccatcgagcggcgggacctgcagtacatcaccgtgtccaaggaggagctgagcagcggggacagcctgagcccagacccctggaagagagatgccaaggagaagctggagaagcagcagcagatgcacatcgtggacatgctgagcaaggagatccaggagctgcagagcaagccagacagatctgctgaggagagtgaccggctgaggaagctgatgctggagtggcagttccagaagaggctgcaggagagcaagcagaaggatgaagatgatgaggaggaggaggatgatgatgtggacaccatgctgatcatgcagaggctggaggccgagcggcgggcccggctgcaggatgaggagcggcggcggcagcagcagctggaggagatgaggaagcgggaggctgaagatcgggcccggcaggaggaggagcggcggcggcaggaggaggagaggaccaagagagatgctgaggagaagaggcggcaggaggagggctactacagccggctggaggccgagcggcggcggcagcatgatgaagctgcccggcggctgctggagcctgaggcccctggcctgtgccggccccccctgccccgggactatgagccccccagccccagccctgcccctggggcccctcctcctccaccccagagaaatgccagctacctgaagacccaggtgctgagcccagacagcctcttcaccgccaagtttgtggcctacaatgaggaggaggaggaggaggactgcagcctggccggccccaacagctacccaggcagcactggagctgctgtgggcgcccatgatgcctgcagagatgccaaggagaagaggagcaagagccaggatgctgacagccctggcagcagcggggcccctgagaacctgaccttcaaggagcggcagaggctcttcagccagggccaggatgtgagcaacaaggtgaaggccagcaggaagctgacagagctggagaatgagctgaacaccaagtag

SEQ ID NO: 160646 - DNA, 4956 bp, Artificial Sequence
  Description of Artificial Sequence: Synthetic coding sequence
atgtctgctgggggcagagatgaggagaggaggaagctggccgacatcatccaccactggaatgccaaccggctggacctgtttgagatcagccagcccacagaggacctggagttccacggcgtgatgaggttctacttccaggacaaggccgccggcaactttgccaccaagtgcatccgggtgagcagcacagccaccacccaggacgtcatcgagaccctggccgagaagttccggccagacatgaggatgctgagcagccccaagtacagcctgtatgaggtgcacgtgtctggagagcggcggctggacattgatgagaagcccctggtggtgcagctgaactggaacaaggatgaccgggagggccgctttgtgctgaagaatgaaaatgatgccatcccccccaagaaggcccagagcaatggacctgagaagcaggagaaggagggcgtcatccagaacttcaagaggaccctgagcaagaaggagaagaaggagaagaagaagcgggagaaggaggccctgcggcaggccagtgacaaggatgaccggcccttccagggagaagatgtggagaacagccggctggccgctgaggtgtacaaggacatgcctgagaccagcttcaccaggaccatcagcaaccctgaggtggtgatgaagagaagacggcagcagaagctggagaagaggatgcaggagttccgcagcagtgatggccgcccagacagcggcggcaccctgcgcatctatgctgacagcctgaagcccaacatcccctacaagaccatcctgctgagcaccacagatcctgctgactttgctgtggccgaggccctggagaagtatggcctggagaaggagaaccccaaggactactgcatcgcccgggtgatgctgcccccaggggcccagcacagtgatgagaagggggccaaggagatcatcctggatgatgatgaatgtcccctgcagatcttccgggagtggcccagcgacaagggcatcctggtgttccagctgaagagaagacctccagaccacatccccaagaagaccaagaagcacctggagggcaagacccccaagggcaaggagcgggcagatggcagcggctacggcagcaccctgcccccagagaagctgccctacctggtggagctgagccctggaagaagaaaccactttgcctactacaactaccacacctatgaagatggcagtgacagccgggacaagcccaagctgtaccgcctgcagctgtctgtgacagaggtgggcacagagaagctggatgacaacagcatccagctgtttggacctggcatccagccccaccactgtgacctgaccaacatggatggagtggtgacagtgacccccaggtccatggatgctgagacctacgtggagggccagaggatcagcgagaccaccatgctgcagagcggcatgaaggtgcagtttggagccagccacgtgttcaagtttgtggaccccagccaggaccacgccctggccaagaggtctgtggatggcggcctgatggtgaagggccccaggcacaagccaggcatcgtgcaggagaccacctttgacctgggcggggacatccacagcggcacagccctgcccaccagcaagagcaccacccggctggacagcgacagagtgagcagcgccagcagcacagctgagcggggcatggtgaagcccatgatccgggtggagcagcagcctgactaccgccggcaggagagcaggacccaggatgccagcggccctgagctgatcctgcctgccagcattgagttccgggagagcagcgaggacagcttcctgagcgccatcatcaactacaccaacagcagcacagtgcacttcaagctgagccccacctacgtgctgtacatggcctgccgctacgtgctgagcaaccagtacagaccagacatcagccccacagagaggacccacaaggtgattgctgtggtgaacaagatggtgtccatgatggagggcgtcatccagaagcagaagaacattgctggggccctggccttctggatggccaatgccagcgagctgctgaacttcatcaagcaggaccgggacctgagccgcatcaccctggatgcccaggatgtgctggcccacctggtgcagatggccttcaagtacctggtgcactgcctgcagagcgagctgaacaactacatgcctgccttcctggatgatcctgaggagaacagcctgcagaggcccaagattgatgatgtgctgcacaccctgactggagccatgagcctgctgcggcgctgccgggtgaatgctgccctgaccatccagctgttcagccagctgttccacttcatcaacatgtggctgttcaaccggctggtgacagatcctgacagcggcctgtgcagccactactggggcgccatcatccggcagcagctgggccacatcgaggcctgggccgagaagcagggcctggagctggccgctgactgccacctgagccgcatcgtgcaggccaccaccctgctgaccatggacaagtatgccccagatgacatccccaacatcaacagcacctgcttcaagctgaacagcctgcagctgcaggccctgctgcagaactaccactgtgccccagatgagcccttcatccccacagacctgattgaaaatgtggtgacagtggctgaaaatacagcagatgagctggcccggagtgatggccgggaggtgcagctggaggaggaccctgacctgcagctgcccttcctgctgcctgaagatggctacagctgtgatgtggtgaggaacatccccaacggcctgcaggagttcctggaccccctgtgccagaggggcttctgccgcctcatcccccacaccaggagccctggcacctggaccatctactttgaaggagctgactatgagagccacctgctgagagaaaatacagagctggcccagcccctgaggaaggagcctgagatcatcaccgtgaccctgaagaagcagaatggcatgggcctgagcatcgtggccgccaagggggccggccaggacaagctgggcatctacgtgaagtctgtggtgaagggcggcgctgctgatgtggatggccgcctggccgccggggaccagctgctgtctgtggatggccgcagcctggtgggcctgagccaggagagagctgctgagctgatgaccaggaccagctctgtggtgaccctggaggtggccaagcagggcgccatctaccacggcctggccaccctgctgaaccagcccagccccatgatgcagaggatcagtgaccggcggggcagcggcaagccccggcccaagtctgagggctttgagctgtacaacaacagcacccagaatggcagccctgagagcccccagctgccctgggccgagtacagcgagcccaagaagctgcctggagatgaccggctgatgaagaacagagctgaccacaggagcagccccaacgtggccaaccagccccccagccctgggggcaagagcgcctatgccagcggcaccacagccaagatcacctctgtgtccacaggcaacctgtgcacagaggagcagaccccaccacccaggcctgaggcctaccccatccccacccagacctacacccgggagtacttcaccttccctgccagcaagagccaggacaggatggccccaccccagaaccagtggcccaactatgaggagaagccccacatgcacacagacagcaaccacagcagcatcgccatccagagggtgaccaggagccaggaggagctgcgggaggacaaggcctaccagctggagcggcaccgcatcgaggccgccatggacaggaagagtgacagcgacatgtggatcaaccagagcagcagcctggacagcagcaccagcagccaggagcacctgaaccacagcagcaagtctgtgaccccagccagcaccctgaccaagagcggccctggccgctggaagaccccagctgccatcccagccacccctgtggccgtgtcccagcccatcagaacagacctgcccccacctcctcctcctcctcctgtgcactacgccggggactttgatggcatgtccatggacctgcccctgcccccacctccttctgccaaccagatcggcctgcccagcgcccaggtggccgctgctgagaggaggaagcgggaggagcaccagcgctggtatgagaaggagaaggcccggctggaggaggagcgggagaggaagaggcgggagcaggagaggaagctgggccagatgaggacccagagcctgaacccagcccccttcagccccctgacagcccagcagatgaagccagagaagcccagcaccctgcagaggccccaggagaccgtcatccgggagctgcagccccagcagcagcccaggaccatcgagcggcgggacctgcagtacatcaccgtgtccaaggaggagctgagcagcggggacagcctgagcccagacccctggaagagagatgccaaggagaagctggagaagcagcagcagatgcacatcgtggacatgctgagcaaggagatccaggagctgcagagcaagccagacagatctgctgaggagagtgaccggctgaggaagctgatgctggagtggcagttccagaagaggctgcaggagagcaagcagaaggatgaagatgatgaggaggaggaggatgatgatgtggacaccatgctgatcatgcagaggctggaggccgagcggcgggccagagatgaggagcggcggcggcagcagcagctggaggagatgaggaagcgggaggctgaagatcgggcccggcaggaggaggagcggcggcggcaggaggaggagaggaccaagagagatgctgaggagaaggtgatggtgctgtag

SEQ ID NO: 160647 - DNA, 5232 bp, Artificial Sequence
  Description of Artificial Sequence: Synthetic coding sequence
atgtctgctgggggcagagatgaggagaggaggaagctggccgacatcatccaccactggaatgccaaccggctggacctgtttgagatcagccagcccacagaggacctggagttccacggcgtgatgaggttctacttccaggacaaggccgccggcaactttgccaccaagtgcatccgggtgagcagcacagccaccacccaggacgtcatcgagaccctggccgagaagttccggccagacatgaggatgctgagcagccccaagtacagcctgtatgaggtgcacgtgtctggagagcggcggctggacattgatgagaagcccctggtggtgcagctgaactggaacaaggatgaccgggagggccgctttgtgctgaagaatgaaaatgatgccatcccccccaaggcccagagcaatggacctgagaagcaggagaaggagggcgtcatccagaacttcaagaggaccctgagcaagaaggagaagaaggagaagaagaagcgggagaaggaggccctgcggcaggccagtgacaaggatgaccggcccttccagggagaagatgtggagaacagccggctggccgctgaggtgtacaaggacatgcctgagaccagcttcaccaggaccatcagcaaccctgaggtggtgatgaagagaagacggcagcagaagctggagaagaggatgcaggagttccgcagcagtgatggccgcccagattctgggggcaccctgcgcatctatgctgacagcctgaagcccaacatcccctacaagaccatcctgctgagcaccacagatcctgctgactttgctgtggccgaggccctggagaagtatggcctggagaaggagaaccccaaggactactgcatcgcccgggtgatgctgcccccaggggcccagcacagtgatgagaagggggccaaggagatcatcctggatgatgatgagtgccccctgcagatcttccgggagtggcccagcgacaagggcatcctggtgttccagctgaagaggcggcccccagaccacatccccaagaagaccaagaagcacctggagggcaagacccccaagggcaaggagcgggcagatggcagcggctacggcagcaccctgcccccagagaagctgccctacctggtggagctgagcccagatggcagtgacagccgggacaagcccaagctgtaccgcctgcagctgtctgtgacagaggtgggcacagagaagctggatgacaacagcatccagctgtttggacctggcatccagccccaccactgtgacctgaccaacatggatggagtggtgacagtgacccccaggtccatggatgctgagacctacgtggagggccagaggatcagcgagaccaccatgctgcagagcggcatgaaggtgcagtttggagccagccacgtgttcaagtttgtggaccccagccaggaccacgccctggccaagaggtctgtggatggcggcctgatggtgaagggccccaggcacaagccaggcatcgtgcaggagaccacctttgacctgggcggggacatccacagcggcacagccctgcccaccagcaagagcaccacccggctggacagcgacagagtgagcagcgccagcagcacagctgagcggggcatggtgaagcccatgatccgggtggagcagcagcctgactaccgccggcaggagagcaggacccaggatgccagcggccctgagctgatcctgcctgccagcattgagttccgggagagcagcgaggacagcttcctgagcgccatcatcaactacaccaacagcagcacagtgcacttcaagctgagccccacctacgtgctgtacatggcctgccgctacgtgctgagcaaccagtacagaccagacatcagccccacagagaggacccacaaggtgattgctgtggtgaacaagatggtgtccatgatggagggcgtcatccagaagcagaagaacattgctggggccctggccttctggatggccaatgccagcgagctgctgaacttcatcaagcaggaccgggacctgagccgcatcaccctggatgcccaggatgtgctggcccacctggtgcagatggccttcaagtacctggtgcactgcctgcagagcgagctgaacaactacatgcctgccttcctggatgatcctgaggagaacagcctgcagaggcccaagattgatgatgtgctgcacaccctgactggagccatgagcctgctgcggcgctgccgggtgaatgctgccctgaccatccagctgttcagccagctgttccacttcatcaacatgtggctgttcaaccggctggtgacagatcctgacagcggcctgtgcagccactactggggcgccatcatccggcagcagctgggccacatcgaggcctgggccgagaagcagggcctggagctggccgctgactgccacctgagccgcatcgtgcaggccaccaccctgctgaccatggacaagtatgccccagatgacatccccaacatcaacagcacctgcttcaagctgaacagcctgcagctgcaggccctgctgcagaactaccactgtgccccagatgagcccttcatccccacagacctgattgaaaatgtggtgacagtggctgaaaatacagcagatgagctggcccggagtgatggccgggaggtgcagctggaggaggaccctgacctgcagctgcccttcctgctgcctgaagatggctacagctgtgatgtggtgaggaacatccccaacggcctgcaggagttcctggaccccctgtgccagaggggcttctgccgcctcatcccccacaccaggagccctggcacctggaccatctactttgaaggagctgactatgagagccacctgctgagagaaaatacagagctggccatccccctgaggaaggagcctgagatcatcaccgtgaccctgaagaagcagaatggcatgggcctgagcatcgtggccgccaagggggccggccaggacaagctgggcatctacgtgaagtctgtggtgaagggcggcgctgctgatgatggccgcctggccgccggggaccagctgctgtctgtggatggccgcagcctggtgggcctgagccaggagagagctgctgagctgatgaccaggaccagctctgtggtgaccctggaggtggccaagcagggcgccatctaccacggcctggccaccctgctgaaccagcccagccccatgatgcagaggatcagtgacagaagaggcagcggcaagccccggcccaagtctgagggctttgagctgtacaacaacagcacccagaatggcagccctgagagcccccagctgccctgggccgagtacagcgagcccaagaagctgcctggagatgaccggctgatgaagaacagagctgaccacaggagcagccccaacgtggccaaccagccccccagccctgggggcaagagcgcctatgccagcggcaccacagccaagatcacctctgtgtccactggaaacctgtgcacagaggagcagaccccaccacccaggcctgaggcctaccccatccccacccagacctacacccgggagtacttcaccttccctgccagcaagagccaggacaggatggccccaccccagaaccagtggcccaactatgaggagaagccccacatgcacacagacagcaaccacagcagcatcgccatccagagggtgaccaggagccaggaggagctgcgggaggacaaggcctaccagctggagcggcacagaattgaagctgccatggacaggaagagtgacagcgacatgtggatcaaccagagcagcagcctggacagcagcaccagcagccaggagcacctgaaccacagcagcaagtctgtgaccccagccagcaccctgaccaagagcggccctggccgctggaagaccccagctgccatcccagccacccctgtggccgtgtcccagcccatcagaacagacctgcccccacctcctcctcctcctcctgtgcactacgccggggactttgatggcatgtccatggacctgcccctgcccccaccacccagcgccaaccagatcggcctgcccagcgcccaggtggccgctgctgagaggaggaagcgggaggagcaccagcgctggtatgagaaggagaaggcccggctggaggaggagcgggagaggaagagaagagagcaggagaggaagctgggccagatgaggacccagagcctgaacccagcccccttcagccccctgacagcccagcagatgaagccagagaagcccagcaccctgcagaggccccaggagaccgtcatccgggagctgcagccccagcagcagcccaggaccattgaaagaagagacctgcagtacatcaccgtgtccaaggaggagctgagcagcggggacagcctgagcccagacccctggaagagagatgccaaggagaagctggagaagcagcagcagatgcacatcgtggacatgctgagcaaggagatccaggagctgcagagcaagccagacagatctgctgaggagagtgaccggctgaggaagctgatgctggagtggcagttccagaagaggctgcaggagagcaagcagaaggatgaagatgatgaggaggaggaggatgatgatgtggacaccatgctgatcatgcagaggctggaggccgagcggcgggcccggctgcaggatgaggagcggcggcggcagcagcagctggaggagatgaggaagcgggaggccgaggaccgggcccggcaggaggaggagcggcggcggcaggaggaggagaggaccaagagagatgctgaggagaagaggcggcaggaggagggctactacagccggctggaggccgagcggcggcggcagcatgatgaggccgcccggcggctgctggagcctgaggcccctggccccaacagctacccaggcagcactggagctgctgtgggcgcccatgatgcctgcagagatgccaaggagaagaggagcaagagccaggatgctgacagccctggcagcagcggggcccctgagaacctgaccttcaaggagcggcagaggctcttcagccagggccaggatgtgagcaacaaggtgaaggccagcaggaagctgacagagctggagaatgagctgaacaccaagtag

SEQ ID NO: 160648 - DNA, 5475 bp, Artificial Sequence
  Description of Artificial Sequence: Synthetic coding sequence
atgtctgctgggggcagagatgaggagaggaggaagctggccgacatcatccaccactggaatgccaaccggctggacctgtttgagatcagccagcccacagaggacctggagttccacggcgtgatgaggttctacttccaggacaaggccgccggcaactttgccaccaagtgcatccgggtgagcagcacagccaccacccaggacgtcatcgagaccctggccgagaagttccggccagacatgaggatgctgagcagccccaagtacagcctgtatgaggtgcacgtgtctggagagcggcggctggacattgatgagaagcccctggtggtgcagctgaactggaacaaggatgaccgggagggccgctttgtgctgaagaatgaaaatgatgccatcccccccaagaaggcccagagcaatggacctgagaagcaggagaaggagggcgtcatccagaacttcaagaggaccctgagcaagaaggagaagaaggagaagaagaagcgggagaaggaggccctgcggcaggccagtgacaaggatgaccggcccttccagggagaagatgtggagaacagccggctggccgctgaggtgtacaaggacatgcctgagaccagcttcaccaggaccatcagcaaccctgaggtggtgatgaagagaagacggcagcagaagctggagaagaggatgcaggagttccgcagcagtgatggccgcccagacagcggcggcaccctgcgcatctatgctgacagcctgaagcccaacatcccctacaagaccatcctgctgagcaccacagatcctgctgactttgctgtggccgaggccctggagaagtatggcctggagaaggagaaccccaaggactactgcatcgcccgggtgatgctgcccccaggggcccagcacagtgatgagaagggggccaaggagatcatcctggatgatgatgaatgtcccctgcagatcttccgggagtggcccagcgacaagggcatcctggtgttccagctgaagagaagacctccagaccacatccccaagaagaccaagaagcacctggagggcaagacccccaagggcaaggagcgggcagatggcagcggctacggcagcaccctgcccccagagaagctgccctacctggtggagctgagccctggaagaagaaaccactttgcctactacaactaccacacctatgaagatggcagtgacagccgggacaagcccaagctgtaccgcctgcagctgtctgtgacagaggtgggcacagagaagctggatgacaacagcatccagctgtttggacctggcatccagccccaccactgtgacctgaccaacatggatggagtggtgacagtgacccccaggtccatggatgctgagacctacgtggagggccagaggatcagcgagaccaccatgctgcagagcggcatgaaggtgcagtttggagccagccacgtgttcaagtttgtggaccccagccaggaccacgccctggccaagaggtctgtggatggcggcctgatggtgaagggccccaggcacaagccaggcatcgtgcaggagaccacctttgacctgggcggggacatccacagcggcacagccctgcccaccagcaagagcaccacccggctggacagcgacagagtgagcagcgccagcagcacagctgagcggggcatggtgaagcccatgatccgggtggagcagcagcctgactaccgccggcaggagagcaggacccaggatgccagcggccctgagctgatcctgcctgccagcattgagttccgggagagcagcgaggacagcttcctgagcgccatcatcaactacaccaacagcagcacagtgcacttcaagctgagccccacctacgtgctgtacatggcctgccgctacgtgctgagcaaccagtacagaccagacatcagccccacagagaggacccacaaggtgattgctgtggtgaacaagatggtgtccatgatggagggcgtcatccagaagcagaagaacattgctggggccctggccttctggatggccaatgccagcgagctgctgaacttcatcaagcaggaccgggacctgagccgcatcaccctggatgcccaggatgtgctggcccacctggtgcagatggccttcaagtacctggtgcactgcctgcagagcgagctgaacaactacatgcctgccttcctggatgatcctgaggagaacagcctgcagaggcccaagattgatgatgtgctgcacaccctgactggagccatgagcctgctgcggcgctgccgggtgaatgctgccctgaccatccagctgttcagccagctgttccacttcatcaacatgtggctgttcaaccggctggtgacagatcctgacagcggcctgtgcagccactactggggcgccatcatccggcagcagctgggccacatcgaggcctgggccgagaagcagggcctggagctggccgctgactgccacctgagccgcatcgtgcaggccaccaccctgctgaccatggacaagtatgccccagatgacatccccaacatcaacagcacctgcttcaagctgaacagcctgcagctgcaggccctgctgcagaactaccactgtgccccagatgagcccttcatccccacagacctgattgaaaatgtggtgacagtggctgaaaatacagcagatgagctggcccggagtgatggccgggaggtgcagctggaggaggaccctgacctgcagctgcccttcctgctgcctgaagatggctacagctgtgatgtggtgaggaacatccccaacggcctgcaggagttcctggaccccctgtgccagaggggcttctgccgcctcatcccccacaccaggagccctggcacctggaccatctactttgaaggagctgactatgagagccacctgctgagagaaaatacagagctggcccagcccctgaggaaggagcctgagatcatcaccgtgaccctgaagaagcagaatggcatgggcctgagcatcgtggccgccaagggggccggccaggacaagctgggcatctacgtgaagtctgtggtgaagggcggcgctgctgatgtggatggccgcctggccgccggggaccagctgctgtctgtggatggccgcagcctggtgggcctgagccaggagagagctgctgagctgatgaccaggaccagctctgtggtgaccctggaggtggccaagcagggcgccatctaccacggcctggccaccctgctgaaccagcccagccccatgatgcagaggatcagtgaccggcggggcagcggcaagccccggcccaagtctgagggctttgagctgtacaacaacagcacccagaatggcagccctgagagcccccagctgccctgggccgagtacagcgagcccaagaagctgcctggagatgaccggctgatgaagaacagagctgaccacaggagcagccccaacgtggccaaccagccccccagccctgggggcaagagcgcctatgccagcggcaccacagccaagatcacctctgtgtccacaggcaacctgtgcacagaggagcagaccccaccacccaggcctgaggcctaccccatccccacccagacctacacccgggagtacttcaccttccctgccagcaagagccaggacaggatggccccaccccagaaccagtggcccaactatgaggagaagccccacatgcacacagacagcaaccacagcagcatcgccatccagagggtgaccaggagccaggaggagctgcgggaggacaaggcctaccagctggagcggcaccgcatcgaggccgccatggacaggaagagtgacagcgacatgtggatcaaccagagcagcagcctggacagcagcaccagcagccaggagcacctgaaccacagcagcaagtctgtgaccccagccagcaccctgaccaagagcggccctggccgctggaagaccccagctgccatcccagccacccctgtggccgtgtcccagcccatcagaacagacctgcccccacctcctcctcctcctcctgtgcactacgccggggactttgatggcatgtccatggacctgcccctgcccccacctccttctgccaaccagatcggcctgcccagcgcccaggtggccgctgctgagaggaggaagcgggaggagcaccagcgctggtatgagaaggagaaggcccggctggaggaggagcgggagaggaagaggcgggagcaggagaggaagctgggccagatgaggacccagagcctgaacccagcccccttcagccccctgacagcccagcagatgaagccagagaagcccagcaccctgcagaggccccaggagaccgtcatccgggagctgcagccccagcagcagcccaggaccatcgagcggcgggacctgcagtacatcaccgtgtccaaggaggagctgagcagcggggacagcctgagcccagacccctggaagagagatgccaaggagaagctggagaagcagcagcagatgcacatcgtggacatgctgagcaaggagatccaggagctgcagagcaagccagacagatctgctgaggagagtgaccggctgaggaagctgatgctggagtggcagttccagaagaggctgcaggagagcaagcagaaggatgaagatgatgaggaggaggaggatgatgatgtggacaccatgctgatcatgcagaggctggaggccgagcggcgggcccggctgcaggatgaggagcggcggcggcagcagcagctggaggagatgaggaagcgggaggctgaagatcgggcccggcaggaggaggagcggcggcggcaggaggaggagaggaccaagagagatgctgaggagaagaggcggcaggaggagggctactacagccggctggaggccgagcggcggcggcagcatgatgaagctgcccggcggctgctggagcctgaggcccctggcctgtgccggccccccctgccccgggactatgagccccccagccccagccctgcccctggggcccctcctcctccaccccagagaaatgccagctacctgaagacccaggtgctgagcccagacagcctcttcaccgccaagtttgtggcctacaatgaggaggaggaggaggaggactgcagcctggccggccccaacagctacccaggcagcactggagctgctgtgggcgcccatgatgcctgcagagatgccaaggagaagaggagcaagagccaggatgctgacagccctggcagcagcggggcccctgagaacctgaccttcaaggagcggcagaggctcttcagccagggccaggatgtgagcaacaaggtgaaggccagcaggaagctgacagagctggagaatgagctgaacaccaagtag

SEQ ID NO: 160649 - DNA, 3282 bp, Artificial Sequence
  Description of Artificial Sequence: Synthetic coding sequence
atgaaggagatggtgggcggctgctgcgtgtgcagtgatgagcggggctgggccgagaaccccctggtgtactgtgatggccacgcctgcagcgtggtggtgcaccaggcctgctatggaattgtgcaggtgcccaccggcccctggttctgcaggaaatgtgagagccaggagcgggccgcccgggtgcgctgtgagctgtgcccccacaaggatggagccctgaagaggacagacaatggaggctgggcccacgtggtgtgtgccctgtacatccctgaggtgcagtttgccaacgtgctgaccatggagcccatcgtgctgcagtatgtgccccatgaccgcttcaacaagacctgctacatctgtgaggagcagggccgggagagcaaggccgccagcggggcctgcatgacctgcaacagacatggctgccggcaggccttccacgtgacctgtgcccagatggccggcctgctgtgtgaggaggaggtgctggaggtggacaacgtgaagtactgcggctactgcaagtaccacttcagcaagatgaagaccagccgccacagcagcggcggcggcggcggcggggccggcggcggcggcggctccatgggcggcggcggcagcggcttcatcagcggccgccgcagccgcagcgccagccccagcacccagcaggagaagcaccccacccaccacgagcggggccagaagaagagcaggaaggacaaggagcggctgaagcagaagcacaagaagaggcctgagagccccccatccatcctgaccccacctgtggtgcccacagctgacaaggtgagcagcagcgccagcagcagcagccaccacgaggccagcacccaggagaccagcgagagcagccgggagagcaagggcaagaagagcagcagccacagcctgagccacaagggcaagaagctgagcagtggaaaaggagtgtcctccttcaccagcgccagcagcagcagcagcagcagcagcagcagcagcggcggccccttccagcctgctgtgagcagcctgcagagcagcccagacttcagcgccttccccaagctggagcagcctgaggaggacaagtacagcaagcccacagccccagcccccagcgccccacccagccccagcgcccctgagccccccaaggctgacctgtttgagcagaaggtggtgttttctggcttcggccccatcatgaggttcagcaccaccaccagcagcagcggccgggcccgggcccccagccctggggactacaagagcccccacgtgactggaagtggggccagcgctggcacccacaagaggatgcctgccctgagcgccacccctgtgcctgcagatgagaccccagagaccggcctgaaggagaagaagcacaaggccagcaagaggagccgccacggccctggccggcccaagggcagcaggaacaaggagggcaccggcggccctgctgcccccagcctgcccagcgcccagctggccggcttcaccgccacagctgccagccccttcagcggcggcagcctggtgagcagcggcctgggcggcctgagcagcaggaccttcggccccagcggcagcctgcccagcctgagcctggagagccccctgctgggcgccggcatctacaccagcaacaaggaccccatcagccacagcggcggcatgctgcgggctgtgtgcagcacccccctgagcagcagcctgctgggccccccaggcaccagcgccctgccccggctgagccgcagccccttcaccagcaccctgcccagcagcagcgccagcatcagcaccacccaggtgttcagcctggccggcagcaccttcagcctgcccagcacccacatcttcggcacccccatgggcgctgtgaaccccctgctgagccaggccgagagcagccacacagagccagacctggaggactgcagcttccgctgccggggcaccagcccccaggagagcctgagctccatgagccccatcagcagcctgcctgccctgtttgaccagacagccagcgccccctgtggcggcggccagctggaccctgctgcccctggcaccaccaacatggagcagctgctggagaagcagggagatggagaggccggcgtgaacatcgtggagatgctgaaggccctgcacgccctgcagaaggagaaccagaggctgcaggagcagatcctgagcctgacagccaagaaggagcggctgcagatcctgaatgtgcagctgtctgtgcccttccctgccctgcctgctgccctgcctgctgccaacggccctgtgcccggcccctacggcctgcccccccaggccggcagcagtgacagcctgagcaccagcaagagccccccaggcaagagcagcctgggcctggacaacagcctgagcaccagcagcgaggacccccacagcggctgccccagccgcagcagcagcagcctgtccttccacagcaccccaccacccctgcccctgctgcagcagagccctgccaccctgcccctggccctgcccggggccccagcccccctgcccccccagccccagaatggcctgggccgggcccctggagctgctggcctgggcgccatgcccatggccgagggcctgctgggcggcctggccggcagcggcggcctgcccctgaatggcctgctgggcggcctgaatggagctgctgcccccaacccagccagcctgagccaggccggcggggcccccaccctgcagctgcccggctgcctgaacagcctgacagagcagcagaggcacctgctgcagcagcaggagcagcagctgcagcagctgcagcagctgctggccagcccccagctgaccccagagcaccagacagtggtgtaccagatgatccagcagatccagcagaagcgggagctgcagaggctgcagatggccggcggcagccagctgcccatggccagcctgctggccggcagcagcacccccctgctgtctgctggcaccccaggcctgctgcccacagccagcgccccacccctgctgcctgctggggccctggtggcccccagcctgggcaacaacaccagcctgatggctgctgctgctgctgctgctgctgtggccgctgctgggggcccccctgtgctgacagcccagaccaaccccttcctgagcctgagcggggctgagggcagcggcggcggccccaagggcggcacagctgacaagggggccagcgccaaccaggagaagggctag

SEQ ID NO: 160650 - DNA, 978 bp, Artificial Sequence
  Description of Artificial Sequence: Synthetic coding sequence
atgaaggagatggtgggcggctgctgcgtgtgcagtgatgagcggggctgggccgagaaccccctggtgtactgtgatggccacgcctgcagcgtggtggtgcaccaggcctgctatggaattgtgcaggtgcccaccggcccctggttctgcaggaaatgtgagagccaggagcgggccgcccgggtgcgctgtgagctgtgcccccacaaggatggagccctgaagaggacagacaatggaggctgggcccacgtggtgtgtgccctgtacatccctgaggtgcagtttgccaacgtgctgaccatggagcccatcgtgctgcagtatgtgccccatgaccgcttcaacaagacctgctacatctgtgaggagcagggccgggagagcaaggccgccagcggggcctgcatgacctgcaacagacatggctgccggcaggccttccacgtgacctgtgcccagatggccggcctgctgtgtgaggaggaggtgctggaggtggacaacgtgaagtactgcggctactgcaagtaccacttcagcaagatgaagaccagccgccacagcagcggcggcggcggcggcggggccggcggcggcggcggctccatgggcggcggcggcagcggcttcatcagcggccgccgcagccgcagcgccagccccagcacccagcaggagaagcaccccacccaccacgagcggggccagaagaagagcaggaaggacaaggagcggctgaagcagaagcacaagaagaggcctgagagccccccatccatcctgaccccacctgtggtgcccacagctgacaagccccggcggggccaccagagccccaccaaccacggcatcggcagcctgggctgctgcctgcctgacacccccatctgcctgtgcccagagggcctgagccctggcctgctgtctgctgagagcggcggccgccacagcggcctgctgagcaagttctag

SEQ ID NO: 160651 - DNA, 16614 bp, Artificial Sequence
  Description of Artificial Sequence: Synthetic coding sequence
atggacagccagaagctggccggggaggacaaggacagcgagcctgctgctgatggccctgctgccagcgaggaccccagcgccacagaaagtgacctgcccaacccccacgtgggggaggtgtctgtgctgagcagcggcagcccccggctgcaggagaccccccaggactgcagcggcggccctgtgcggcgctgtgccctgtgcaactgtggggagcccagcctgcacggccagcgggagctgcggagatttgagctgccctttgactggccccgctgccctgtggtgtccccaggcggcagccctggccccaatgaggccgtgctgcccagcgaggacctgagccagatcggcttccctgagggcctgaccccagcccacctgggggagcccggcggcagctgctgggcccaccactggtgtgccgcctggagcgctggggtgtggggccaggagggccctgagctgtgtggggtggacaaggccatcttcagcggcatcagccagcgctgcagccactgcacccggctgggcgccagcatcccctgccgcagccctggctgcccccggctgtaccacttcccctgtgccacagccagcggcagcttcctgtccatgaagaccctgcagctgctgtgcccagagcacagcgagggcgccgcctacctggaggaggcccgctgtgctgtgtgtgagggccctggagagctgtgtgacctcttcttctgcaccagctgtggccaccactaccacggggcctgcctggacacagccctgacagccaggaagagagctggctggcagtgcccagagtgcaaggtgtgccaggcctgcaggaagccaggaaatgacagcaagatgctggtgtgtgagacctgtgacaagggctaccacaccttctgcctgaagccacccatggaggagctgcctgcccacagctggaagtgcaaggcctgccgggtgtgccgggcctgtggggccggcagcgctgagctgaaccccaacagcgagtggtttgagaactacagcctgtgccaccgctgccacaaggcccagggcggccagaccatccgctctgtggccgagcagcacacccctgtgtgcagccgcttcagccccccagagcccggggacacccccacagatgagccagatgccctgtatgtggcctgccagggccagcccaagggcggccacgtgacctccatgcagcccaaggagcccggccccctgcagtgtgaggccaagcccctgggcaaggccggcgtgcagctggagccccagctggaggcccccctgaatgaggagatgcccctgctgcccccacctgaggagagccccctgagccccccacctgaggagagccccaccagccccccacctgaggccagccggctgagccccccacctgaggagctgcctgccagccccctgcctgaggccctgcacctgagccggcccctggaggagagccccctgagccccccacctgaggagagccccctgagccccccacctgagagcagccccttcagccccctggaggagagccccctgagccccccagaggagagcccccccagccctgccctggagacccccctgagccccccacctgaggccagccccctgagccccccatttgaggagagccccctgagccccccacctgaggagctgcccaccagccccccacctgaggccagccggctgagccccccacctgaggagagccccatgagccccccacctgaggagagccccatgagccccccacctgaggccagccgcctcttccccccatttgaggagagccccctgagccccccacctgaggagagccccctgagccccccacctgaggccagccggctgagccccccacctgaggacagccccatgagccccccacctgaggagagccccatgagccccccacctgaggtgtcccggctgagccccctgcctgtggtgtcccggctgagccccccacctgaggagagccccctgagccccccacctgaggagagccccaccagccccccacctgaggccagccggctgagccccccacctgaggacagccccaccagccccccacctgaggacagccctgccagccccccacctgaggacagcctgatgagcctgcccctggaggagagccccctgctgcccctgcctgaggagccccagctgtgccccaggtctgagggcccccacctgagccccaggcctgaggagccccacctgagccccaggcctgaggagccccacctgagcccccaggccgaggagccccacctgagcccccagcctgaggagccctgcctgtgtgctgtgcctgaggagccccacctgagcccccaggccgagggcccccacctgagcccccagcctgaggagctgcacctgagcccccagacagaggagccccacctgagccctgtgcctgaggagccctgcctgagcccccagcctgaggagagccacctgagcccccagagcgaggagccctgcctgagccccaggcctgaggagagccacctgagccctgagctggagaagccacccctgagccccaggcctgagaagcccccagaggagcccggccagtgcccagcccctgaggagctgcccctcttccccccacctggagagcccagcctgagccccctgctgggggagcccgccctgtctgagcctggagagccccccctgagccccctgcctgaggagctgcccctgagccccagcggggagcccagcctgagcccccagctgatgcccccagaccccctgcccccacccctgagccccatcatcacagctgctgcccccccagccctgagccccctgggggagctggagtacccctttggagccaagggggacagcgaccctgagagccccctggccgcccccatcctggagacccccatcagccccccacctgaggccaactgcacagatcctgagcctgtgccccccatgatcctgccccccagccctggcagccctgtgggccctgccagccccatcctgatggagcccctgcccccccagtgcagccccctgctgcagcacagcctggtgccccagaacagcccccccagccagtgcagccccccagccctgcccctgtctgtgcccagccccctgagccccatcggcaaggtggtgggcgtgtctgatgaggccgagctgcacgagatggagacagagaaggtgtctgagcctgagtgcccagccctggagcccagcgccaccagccccctgcccagccccatgggagacctgagctgcccagcccccagccctgccccagccctggatgacttcagcggcctgggggaggacacagcccccctggatggcattgatgcccctggcagccagcctgagcccggccagaccccaggcagcctggccagcgagctgaagggcagccctgtgctgctggaccctgaggagctggcccctgtgacccccatggaggtgtacccagagtgcaagcagacagctggccagggcagcccctgtgaggagcaggaggagccccgggcccctgtggcccccaccccacccaccctcatcaagagtgacatcgtgaatgagatcagcaacctgagccagggagatgccagcgccagcttccctggcagcgagcccctgctgggcagcccagaccctgagggcggcggcagcctgtccatggagctgggcgtgtccacagatgtgtccccagccagagatgagggcagcctgcggctgtgcacagacagcctgcctgagacagatgacagcctgctgtgtgatgctggaacagccatcagcggcggcaaggccgagggggagaagggcagaagaagaagcagccctgcccggagccgcatcaagcagggccgcagcagcagcttccctggaagaagaagaccccggggcggggcccatggaggccggggccggggccgggcccggctgaagagcacagccagcagcattgagaccctggtggtggccgacatcgacagcagccccagcaaggaggaggaggaggaggatgatgacaccatgcagaacacagtggtgctcttcagcaacacagacaagtttgtgctgatgcaggacatgtgtgtggtgtgtggcagctttggccgcggggctgagggccacctgctggcctgcagccagtgcagccagtgctaccacccctactgtgtgaacagcaagatcaccaaggtgatgctgctgaagggctggaggtgtgtggagtgcatcgtgtgtgaggtgtgtggccaggccagtgaccccagccggctgctgctgtgtgatgactgtgacatctcctaccacacctactgcctggacccccccctgctgactgtgcccaagggcggctggaagtgcaagtggtgtgtgtcctgcatgcagtgtggggccgccagccctggcttccactgtgagtggcagaacagctacacccactgcggcccctgtgccagcctggtgacctgccccatctgccacgccccctacgtggaggaggacctgctgatccagtgccgccactgtgagcgctggatgcacgccggctgtgagagcctcttcacagaagatgatgtggagcaggccgcagatgagggctttgactgtgtgtcctgccagccctacgtggtgaagcctgtggcccctgtggcccctcctgagctggtgcccatgaaggtgaaggagcctgagccccagtacttccgctttgaaggagtgtggctgacagaaacaggcatggccctgctgaggaacctgaccatgagccccctgcacaagaggcggcagaggcggggccgcctgggcctgcctggagaggccggcctggagggcagcgagcccagtgatgccctgggcccagatgacaagaaggatggagacctggacacagatgagctgctgaagggggagggcggcgtggagcacatggagtgtgagatcaagctggagggccctgtgtccccagatgtggagcccgggaaggaggagacagaggagagcaagaagaggaagaggaagccctaccggcccggcatcggcggcttcatggtgcggcagaggaagagccacaccaggaccaagaagggccctgctgcccaggccgaggtgctgtctggagatggccagccagatgaggtgatcccagctgacctgcctgctgagggcgctgtggagcagagcctggccgagggagatgagaagaagaagcagcagaggcggggcaggaagaagagcaagctggaggacatgtttcctgcctacctgcaggaggccttcttcggcaaggagctgctggacctgagcaggaaggccctgtttgctgtgggcgtgggccggcccagctttggcctgggcacccccaaggccaagggagatggcggcagcgagaggaaggagctgcccaccagccagaagggagatgatggccctgacattgctgatgaggagagccggggcctggagggcaaggctgacaccccaggcccagaagatggcggcgtgaaggccagccctgtgcccagcgaccctgagaagccaggcaccccaggagagggcatgctgagcagtgacctggaccgcatcagcacagaggagctgcccaagatggagagcaaggacctgcagcagctgttcaaggatgtgctgggcagcgagcgggagcagcacctgggctgcggcaccccaggcctggagggcagcaggacccccctgcagaggcccttcctgcagggcggcctgcccctgggcaacctgcccagcagcagccccatggacagctacccaggcctgtgccagagccccttcctggacagccgggagcggggcggcttcttcagccctgagcccggggagccagacagcccctggacaggcagcggcggcaccacccccagcacccccaccacccccaccacagaaggagaaggagatggcctgagctacaaccagaggagcctgcagcgctgggagaaggatgaggagctgggccagctgagcaccatcagccctgtgctgtatgccaacatcaacttccccaacctgaagcaggactacccagactggagcagccgctgcaagcagatcatgaagctgtggaggaaggtgcctgctgctgacaaggccccctacctgcagaaggccaaggacaacagagctgcccaccgcatcaacaaggtgcagaagcaggccgagagccagatcaacaagcagaccaaggtgggggacatcgccaggaagacagacaggcctgccctgcacctgcgcatccccccccagcccggggccctgggcagccccccacctgctgctgcccccaccatcttcatcggcagccccaccaccccagctggcctgagcaccagcgcagatggcttcctgaagcccccagctggctctgtgcccggccctgacagccctggagagctgttcctgaagctgcccccccaggtgcctgcccaggtgcccagccaggaccccttcggcctggccccagcctaccccctggagccccgcttccccacagccccacccacctacccaccctaccccagccccactggagccccagcccagccccccatgctgggcgccagcagcaggcctggggccggccagcctggagagttccacaccaccccacctggcacccccaggcaccagcccagcaccccagaccccttcctgaagccccgctgccccagcctggacaacctggccgtgcctgagagccctggggtgggcggcggcaaggccagcgagcccctgctgagccccccaccatttggagagagcaggaaggccctggaggtgaagaaggaggagctgggcgccagcagccccagctatggcccccccaacctgggctttgtggacagccccagcagcggcacccacctgggcggcctggagctgaagaccccagatgtgttcaaggcccccctgaccccccgggccagccaggtggagccccagagccctggcctgggcctgcggccccaggagcccccaccagcccaggccctggcccccagcccccccagccacccagacatcttccggcccggcagctacacagacccctatgcccagccccccctgaccccccggccccagcccccacctcctgagagctgctgtgccctgcccccaagaagcctgcccagcgaccccttcagccgggtgcctgccagcccccagagccagagcagcagccagagccccctgaccccccggcccctgtctgctgaggccttctgccccagccctgtgaccccccgcttccagagcccagacccctacagcaggcctcccagccggccccagagccgggacccctttgcccccctgcacaagccaccccggccccagcccccagaggtggccttcaaggccggcagcctggcccacaccagcctgggcgccggcggcttccctgctgccctgcctgctggccctgctggggagctgcacgccaaggtgcccagcggccagccccccaactttgtgcgcagccctggcaccggggcctttgtgggcacccccagccccatgaggttcaccttcccccaggccgtgggggagcccagcctgaagccccctgtgccccagcccggcctgcccccaccccacggcatcaacagccacttcggccctggccccaccctgggcaagccccagagcaccaactacacagtggccaccggcaacttccaccccagcggcagccccctgggccccagcagcggcagcactggagagagctatggcctgagccccctgcggccccccagcgtgctgcccccaccagccccagatggcagcctgccctacctgagccacggggccagccagaggagcggcatcaccagccctgtggagaagcgggaggaccccggcaccggcatgggcagcagcctggccacagctgagctgcccggcacccaggaccccggcatgagcggcctgagccagacagagctggagaagcagaggcagaggcagaggctgcgggagctgctgatccggcagcagatccagaggaacaccctgcggcaggagaaggagacagctgctgctgctgctggagctgtgggccccccaggctcctggggcgctgagcccagcagccctgcctttgagcagctgagccggggccagaccccatttgctggcacccaggacaagagcagcctggtgggcctgccccccagcaagctgagcggccccatcctgggccctggcagcttccccagtgatgaccggctgagcaggcctcctcctccagccacccccagctccatggatgtgaacagccggcagctggtgggcggcagccaggccttctaccagagggccccctacccaggcagcctgcccctgcagcagcagcagcagcagctgtggcagcagcagcaggccacagctgccacctccatgagatttgccatgtctgcccgcttccccagcaccccaggccctgagctgggccggcaggccctgggcagccccctggccggcatcagcacccggctgcccggccctggagagcctgtgcccggccctgctggccctgcccagttcatcgagctgcggcacaacgtgcagaagggcctgggccctgggggcacccccttccctggccagggccccccccagaggccccgcttctaccctgtgtctgaggacccccaccggctggcccctgagggcctgcggggcctggccgtgtctggcctgcccccccagaagcccagcgcccccccagcccctgagctgaacaacagcctgcaccccaccccccacaccaagggccccaccctgcccaccggcctggagctggtgaacagaccacccagcagcacagagctgggccggcccaaccccctggccctggaggccggcaagctgccctgtgaagatcctgagctggatgatgactttgatgcccacaaggccctggaggatgatgaggagctggcccacctgggcctgggcgtggatgtggccaagggagatgatgagctgggcaccctggagaacctggagaccaatgacccccacctggatgacctgctgaatggagatgaatttgacctgctggcctacacagatcctgagctggacacaggagacaagaaggacatcttcaatgagcacctgcggctggtggagagcgccaatgagaaggccgagcgggaggccctgctgcggggcgtggagcccggccccctgggccctgaggagcggcccccacctgctgctgatgccagcgagccccggctggcctctgtgctgcctgaggtgaagcccaaggtggaggagggcggccgccaccccagcccctgccagttcaccatcgccacccccaaggtggagcccgccccagctgccaacagcctgggcctgggcctgaagccaggccagagcatgatgggcagccgggacaccaggatgggcaccggccccttcagcagcagcggccacacagctgagaaggccagctttggagccaccggcggccccccagcccacctgctgacccccagccccctgagcggccctgggggcagcagcctgctggagaagtttgagctggagagcggggccctgaccctgcccggcggccctgctgccagcggagatgagctggacaagatggagagcagcctggtggccagcgagctgcccctgctgattgaggacctgctggagcacgagaagaaggagctgcagaagaagcagcagctgagcgcccagctgcagcctgcccagcagcagcagcagcagcagcagcagcacagcctgctgagcgcccctggccctgcccaggccatgagcctgccccatgagggcagcagccccagcctggccggcagccagcagcagctgagcctgggcctggccggggcccggcagcccggcctgccccagcccctgatgcccacccagcccccagcccacgccctgcagcagaggctggcccccagcatggccatggtgagcaaccagggccacatgctgagcggccagcacggcggccaggccggcctggtgccccagcagagcagccagcctgtgctgagccagaagcccatgggcaccatgccacccagcatgtgcatgaagccccagcagctggccatgcagcagcagctggccaacagcttcttcccagacacagacctggacaagtttgctgctgaggacatcatcgaccccatcgccaaggccaagatggtggccctgaagggcatcaagaaggtgatggcccagggcagcattggagtggcccctggcatgaaccggcagcaggtgtccctgctggcccagaggctgagcggcggccccagcagtgacctgcagaaccacgtggccgccggcagcggccaggagaggtctgctggggaccccagccagccccggcccaacccccccacctttgcccagggcgtcatcaatgaagctgaccagaggcagtatgaggagtggctgttccacacccagcagctgctgcagatgcagctgaaggtgctggaggagcagatcggcgtgcacaggaagagcaggaaggccctgtgtgccaagcagaggacagccaagaaggccggccgggagttccctgaggctgatgctgagaagctgaagctggtgacagagcagcagagcaagatccagaagcagctggaccaggtgaggaagcagcagaaggagcacaccaacctgatggccgagtacagaaacaagcagcagcagcagcagcagcagcagcagcagcagcagcagcagcacagcgctgtgctggccctgagccccagccagagcccccggctgctgaccaagctgcccggccagctgctgcccggccacggcctgcagcccccccagggccccccaggcggccaggccggcggcctgcggctgaccccaggcggcatggccctgcccggccagcccggcggccccttcctgaacacagccctggcccagcagcagcagcagcagcacagcggcggggccggcagcctggccggccccagcggcggcttcttccctggcaacctggccctgcggagcctgggccctgacagccggctgctgcaggagcggcagctgcagctgcagcagcagaggatgcagctggcccagaagctgcagcagcagcagcagcagcagcagcagcagcagcacctgctgggccaggtggccatccagcagcagcagcagcagggccctggggtgcagaccaaccaggccctgggccccaagccccagggcctgatgccacccagcagccaccagggcctgctggtgcagcagctgagcccccagcccccccagggcccccagggcatgctgggccctgcccaggtggccgtgctgcagcagcagcaccctggggccctgggcccccagggcccccaccggcaggtgctgatgacccagagccgggtgctgagcagcccccagctggcccagcagggccagggcctgatgggccaccggctggtgacagcccagcagcagcagcagcagcagcagcaccagcagcagggctccatggccggcctgagccacctgcagcagagcctgatgagccacagcggccagcccaagctgagcgcccagcccatgggcagcctgcagcagctgcagcagcagcagcagctgcagcagcagcagcagctgcagcagcagcagcagcagcagctgcagcagcagcagcagctgcagcagcagcagctgcagcagcagcagcagcagcagcagctgcagcagcagcagcagcagcagctgcagcagcagcagcagcagctgcagcagcagcagcagcagcagcagcagcagttccagcagcagcagcagcagcagcagatgggcctgctgaaccagagcaggaccctgctgagcccccagcagcagcagcagcagcaggtggccctgggccctggcatgcctgccaagcccctgcagcacttcagcagccctggggccctgggccccaccctgctgctgaccgggaaggagcagaacacagtggaccctgctgtgtcctctgaggccacagagggccccagcacccaccagggcggccccctggccatcggcaccaccccagagagcatggccacagagcccggggaggtgaagcccagcctgagcggggacagccagctgctgctggtgcagccccagccccagccccagcccagcagcctgcagctgcagccccccctgcggctgcccggccagcagcagcagcaggtgtccctgctgcacacagctgggggcggcagccacggccagctgggcagcggcagcagcagcgaggccagctctgtgccccacctgctggcccagcccagcgtgtccctgggggaccagcccggctccatgacccagaacctgctgggcccccagcagcccatgctggagcggcccatgcagaacaacacaggcccccagccccccaagccaggccctgtgctgcagagcggccagggcctgcccggggtgggcatcatgcccaccgtgggccagctgcgggcccagctgcagggcgtgctggccaagaacccccagctgcggcacctgagcccccagcagcagcagcagctgcaggccctgctgatgcagaggcagctgcagcagagccaggccgtgcggcagaccccaccctaccaggagcccggcacccagaccagccccctgcagggcctgctgggctgccagccccagctgggcggcttccctggcccccagacaggccccctgcaggagctgggcgccggcccccggccccagggccccccccggctgcctgcccctcctggggccctgagcacaggccctgtgctgggccctgtgcaccccaccccaccacccagcagcccccaggagcccaagaggcccagccagctgcccagccccagcagccagctgcccacagaggcccagctgccccccacccaccctggcacccccaagccccagggccccaccctggagcccccacctggccgggtgtccccagctgctgcccagctggccgacaccctcttcagcaagggcctgggcccctgggaccccccagacaacctggccgagacccagaagccagagcagagcagcctggtgcccggccacctggaccaggtgaatggccaggtggtgcctgaggccagccagctgagcatcaagcaggagccccgggaggagccctgtgccctgggcgcccagagcgtgaagcgggaggccaacggggagcccatcggggcccctggcaccagcaaccacctgctgctggccggccccaggtctgaggccggccacctgctgctgcagaagctgctgcgggccaagaatgtgcagctgagcacaggccggggcagcgagggcctgcgggcagagatcaatggccacatcgacagcaagctggccggcctggagcagaagctgcagggcacccccagcaacaaggaggatgctgctgccaggaagcccctgacccccaagcccaagagggtgcagaaggccagtgaccggctggtgagcagcaggaagaagctgaggaaggaggatggagtgcgggccagcgaggccctgctgaagcagctgaagcaggagctgagcctgctgcccctgacagagcccgccatcacagccaacttcagcctgtttgccccctttggaagtggctgccctgtgaatggccagagccagctgcggggggcctttggaagtggggccctgcccaccggccctgactactacagccagctgctgaccaagaacaacctgagcaacccccccaccccacccagcagcctgccccccaccccacctccttctgtgcagcagaagatggtgaatggagtgaccccatctgaggagctgggggagcaccccaaggatgctgccagcgcccgggacagcgagcgggccctgcgggacaccagcgaggtgaagagcctggacctgctggccgccctgcccaccccaccccacaaccagacagaagatgtgaggatggagagtgatgaagattctgacagcccagacagcatcgtgcctgccagcagccctgagagcatcctgggggaggaggccccccgcttcccccacctgggcagcggccgctgggagcaggaggaccgggccctgagccctgtgatccccctcatcccccgggccagcatccctgtgtttcctgacaccaagccctacggggccctgggcctggaggtgcctgggaagctgcctgtgaccacctgggagaagggcaagggcagcgaggtgtctgtgatgctgactgtgtctgctgctgctgccaagaacctgaatggagtgatggtggccgtggccgagctgctgtccatgaagatccccaacagctatgaggtgctcttccctgagagccctgcccgggccggcacagagcccaagaagggggaggccgagggccctgggggcaaggagaagggcctggagggcaagagcccagacaccggccctgactggctgaagcagtttgatgctgtgctgcccggctacaccctgaagagccagctggacatcctgagcctgctgaagcaggagagccctgcccctgagccccccacccagcacagctacacctacaacgtgagcaacctggatgtgcggcagctgagcgcccctcctcctgaggagcccagccccccacccagccccctggcccccagccctgccagccccccaacagagcccctggtggagctgcccacagagcccctggccgagccccctgtgcccagccccctgcccctggccagcagccctgagagcgcccggcccaagccccgggcccggcccccagaggagggggaggacagccggcccccccggctgaagaagtggaagggcgtgcgctggaagaggctgcggctgctgctgaccatccagaagggcagcggccggcaggaggatgagcgggaggtggccgagttcatggagcagctgggcacagccctgcggccagacaaggtgccccgggacatgaggcgctgctgcttctgccacgaggagggagatggagccacagatggccctgcccggctgctgaacctggacctggacctgtgggtgcacctgaactgtgccctgtggagcacagaggtgtatgagacccagggcggggccctgatgaatgtggaggtggccctgcaccggggcctgctgaccaagtgcagcctgtgccagaggactggagccaccagcagctgcaacaggatgcgctgccccaacgtgtaccactttgcctgtgccatccgggccaagtgcatgttcttcaaggacaagaccatgctgtgccccatgcacaagatcaagggcccctgtgagcaggagctgagcagctttgctgtgttcagaagagtgtacatcgagagagatgaggtgaagcagatcgccagcatcatccagagaggagagcggctgcacatgttccgggtgggcggcctggtgttccacgccatcggccagctgctgccccaccagatggctgacttccacagcgccacagccctgtaccctgtgggctatgaggccacccgcatctactggagcctgcggaccaacaacagacgctgctgctaccgctgcagcatcggggagaacaacggccggcctgagtttgtgatcaaggtgattgagcagggcctggaggacctggtgttcacagatgccagcccccaggccgtgtggaaccgcatcatcgagcctgtggccgccatgaggaaggaggccgacatgctgcggctcttccctgagtacctgaagggggaggagctgtttggcctgactgtgcatgctgtgctgagaattgctgagagcctgcccggggtggagagctgccagaactacctgttccgctatggccgccaccccctgatggagctgcccctgatgatcaaccccaccggctgtgcccggtctgagcccaagatcctgacccactacaagaggccccacaccctgaacagcacctccatgagcaaggcctaccagagcaccttcaccggggagaccaacaccccctacagcaagcagtttgtgcacagcaagagcagccagtacagaaggctgaggacagagtggaagaacaacgtgtacctggcccggagccgcatccagggcctgggcctgtatgctgccaaggacctggagaagcacaccatggtgattgagtacatcggcaccatcatcagaaatgaggtggccaacagaagagagaagatctatgaggagcagaacagaggcatctacatgttccgcatcaacaatgaacatgtgattgatgccaccctgaccggcggccctgcccgctacatcaaccacagctgtgcccccaactgtgtggccgaggtggtgacctttgacaaggaggacaagatcatcatcatcagcagccgccgcatccccaagggggaggagctgacctatgactaccagtttgattttgaagatgaccagcacaagatcccctgccactgtggggcctggaactgcaggaagtggatgaactag

SEQ ID NO: 160652 - DNA, 441 bp, Artificial Sequence
  Description of Artificial Sequence: Synthetic coding sequence
atggacagccagaagctggccggggaggacaaggacagcgagcctgctgctgatggccctgctgccagcgaggaccccagcgccacagaaagtgacctgcccaacccccacgtgggggaggtgtctgtgctgagcagcggcagcccccggctgcaggagaccccccaggactgcagcggcggccctgtgcggcgctgtgccctgtgcaactgtggggagcccagcctgcacggccagcgggagctgcggagatttgagctgccctttgactggccccgctgccctgtggtgtccccaggcggcagccctggccccaatgaggccgtgctgcccagcgaggacctgagccagatcggcttccctgagggcctgaccccagcccacctgggggagcccggcggcagctgctgggcccaccactggtgtgccgcctggagctag

SEQ ID NO: 160653 - DNA, 14736 bp, Artificial Sequence
  Description of Artificial Sequence: Synthetic coding sequence
atgagcagcgaggaggacaagtctgtggagcagccccagcccccacctcctcctcctgaggagcccggggccccagcccccagccctgctgctgctgacaagaggccccggggccggcccaggaaggatggagccagccccttccagagggccaggaagaagcccaggagccggggcaagacagctgtggaggatgaggacagcatggatggcctggagaccacagaaacagagaccatcgtggagacagagatcaaggagcagagcgctgaggaggatgctgaggccgaggtggacaacagcaagcagctgatccccaccctgcagaggtctgtgtctgaggagagcgccaacagcctggtgtctgtgggcgtggaggccaagatcagcgagcagctgtgtgccttctgctactgtggggagaagagcagcctgggccagggcgacctgaagcagttccgcatcaccccaggcttcatcctgccctggaggaaccagcccagcaacaagaaggacattgatgacaacagcaatggcacctatgagaagatgcagaacagcgcccccaggaagcagaggggccagaggaaggagaggagcccccagcagaacatcgtgtcctgtgtgtctgtgtccacccagacagccagtgatgaccaggccggcaagctgtgggatgagctgagcctggtgggcctgcctgatgccatcgacatccaggccctgtttgacagcacaggcacctgctgggcccaccaccgctgtgtggagtggagcctgggcgtgtgccagatggaggagcccctgctggtgaatgtggacaaggctgtggtgtctggcagcacagagcgctgtgccttctgcaagcacctgggcgccaccatcaagtgctgtgaggagaagtgcacccagatgtaccactacccctgtgccgccggggccggcaccttccaggacttcagccacatcttcctgctgtgcccagagcacatcgaccaggcccctgagaggagcaaggaggatgccaactgtgctgtgtgtgacagccctggggacctgctggaccagttcttctgcaccacctgtggccagcactaccacggcatgtgcctggacattgctgtgacccccctgaagagagctggctggcagtgcccagagtgcaaggtgtgccagaactgcaagcagagcggggaggacagcaagatgctggtgtgtgacacctgtgacaagggctaccacaccttctgcctgcagcctgtgatgaagtctgtgcccaccaacggctggaagtgcaagaactgccgcatctgcattgaatgtggcaccaggagcagcagccagtggcaccacaactgcctgatctgtgacaactgctaccagcagcaggacaacctgtgccccttctgtgggaagtgctaccaccctgagctgcagaaggacatgctgcactgcaacatgtgcaagcgctgggtgcacctggagtgtgacaagcccacagaccacgagctggacacccagctgaaggaggagtacatctgcatgtactgcaagcacctgggcgctgagatggaccggctgcagcctggagaggaggtggagattgctgagctgaccacagactacaacaatgagatggaggtggagggccctgaggaccagatggtgttcagcgagcaggccgccaacaaggatgtgaatggccaggagagcaccccaggcatcgtgcctgatgctgtgcaggtgcacacagaggagcagcagaagagccaccccagcgagagcctggacacagacagcctgctgattgctgtgagcagccagcacacagtgaacacagagctggagaagcagatcagcaatgaggtggacagcgaggacctgaagatgagcagcgaggtgaagcacatctgtggggaggaccagatcgaggacaagatggaggtgacagaaaatattgaggtggtgacccaccagatcaccgtgcagcaggagcagctgcagctgctggaggagcctgagaccgtggtgtcccgggaggagagccggccccccaagctggtgatggagagcgtgaccctgcccctggagaccctggtgagcccccatgaggagagcatcagcctgtgcccagaggagcagctggtgattgagcggctgcagggcgagaaggagcagaaggagaacagcgagctgagcacaggcctgatggattctgagatgacccccaccatcgagggctgtgtgaaggatgtgtcctaccagggcggcaagagcatcaagctgagcagcgagacagagagcagcttcagcagcagcgctgacatcagcaaggcagatgtgagcagcagccccacccccagcagtgacctgcccagccatgacatgctgcacaactaccccagcgccctgagcagcagcgctggcaacatcatgcccaccacctacatctctgtgacccccaagattggcatgggcaagccagccatcaccaagaggaagttcagccctggccggcccaggagcaagcagggcgcctggagcacccacaacacagtgtccccacccagctggagcccagacatcagcgagggccgggagatcttcaagccccggcagctgcccggcagcgccatctggagcatcaaggtgggccggggcagcggcttccctgggaagaggcggcccagaggagctggcctgagcggccggggcggccggggccgcagcaagctgaagagcggcatcggggctgtggtgctgcccggggtgtccacagctgacatcagcagcaacaaggatgatgaagaaaattccatgcacaacacagtggtgctcttcagcagcagtgacaagttcaccctgaaccaggacatgtgtgtggtgtgtggcagctttggccagggcgctgagggccgcctgctggcctgcagccagtgtggccagtgctaccacccctactgtgtgtccatcaagatcaccaaggtggtgctgagcaagggctggcgctgcctggagtgcaccgtgtgtgaggcctgtgggaaggccacagatcctggccgcctgctgctgtgtgatgactgtgacatctcctaccacacctactgcctggacccccccctgcagacagtgcccaagggcggctggaagtgcaagtggtgtgtgtggtgccgccactgtggggccaccagcgctggcctgcgctgtgagtggcagaacaactacacccagtgtgccccctgtgccagcctgagcagctgccctgtgtgctacagaaactaccgggaggaggacctgatcctgcagtgccggcagtgtgaccgctggatgcatgctgtgtgccagaacctgaacacagaggaggaggtggagaatgtggccgacattggatttgactgcagcatgtgccggccctacatgcctgccagcaatgtgcccagcagtgactgctgtgagagcagcctggtggcccagatcgtgaccaaggtgaaggagctggacccccccaagacctacacccaggatggagtgtgcctgacagagagcggcatgacccagctgcagagcctgactgtgacagtgcccaggaggaagaggagcaagcccaagctgaagctgaagatcatcaaccagaacagcgtggccgtgctgcagaccccaccagacatccagagcgagcacagcagagatggagagatggatgacagccgggagggggagctgatggactgtgatggcaagtctgagagcagccctgagcgggaggccgtggatgatgagaccaagggcgtggagggcacagatggagtgaagaagaggaagaggaagccctaccggcccggcatcggcggcttcatggtgcggcagaggagcaggacaggccagggcaagaccaagaggagcgtcatcaggaaggacagcagcggcagcatcagcgagcagctgccctgcagagatgatggctggagcgagcagctgcctgacaccctggtggatgagagcgtgtctgtgacagagagcacagagaagatcaagaagcgctacaggaagaggaagaacaagctggaggagaccttccctgcctacctgcaggaggccttcttcggcaaggacctgctggacaccagccggcagagcaagatcagcctggacaacctgtctgaagatggagcccagctgctgtacaagaccaacatgaacacaggcttcctggaccccagcctggaccccctgctgagcagcagcagcgcccccaccaagagcggcacccacggccctgcagatgaccccctggccgacatcagcgaggtgctgaacacagatgatgacatcctgggcatcatcagtgatgacctggccaagtctgtggaccacagcgacatcggccctgtgacagatgaccccagcagcctgccccagcccaacgtgaaccagagcagccggcccctgtctgaggagcagctggatggcatcctgagccctgagctggacaagatggtgacagatggagccatcctgggcaagctgtacaagatccctgagctgggcggcaaggatgtggaggacctcttcaccgctgtgctgagccctgccaacacccagcccacccccctgccccagcccccaccacccacccagctgctgcccatccacaaccaggatgccttcagcaggatgcccctgatgaatggcctcatcggcagcagcccccacctgccccacaacagcctgcccccaggcagcggcctgggcaccttcagcgccatcgcccagagcagctacccagatgcccgggacaagaacagcgccttcaaccccatggccagtgaccccaacaacagctggaccagcagcgcccccaccgtggagggagaaaatgacaccatgagcaatgcccagaggagcaccctgaagtgggagaaggaggaggccctgggggagatggccaccgtggcccctgtgctgtacaccaacatcaacttccccaacctgaaggaggagttcccagactggaccaccagggtgaagcagatcgccaagctgtggaggaaggccagcagccaggagcgggccccctacgtgcagaaggcccgggacaacagagctgccctgcgcatcaacaaggtgcagatgagcaatgacagcatgaagaggcagcagcagcaggacagcattgaccccagcagcagaattgattctgagctgttcaaggaccccctgaagcagcgggagagcgagcacgagcaggagtggaagttccggcagcagatgaggcagaagagcaagcagcaggccaagattgaggccacccagaagctggagcaggtgaagaatgagcagcagcagcagcagcagcagcagtttggcagccagcacctgctggtgcagagcggcagtgacacccccagcagcggcatccagagccccctgaccccccagcctggaaatggaaacatgagccctgcccagagcttccacaaggagctgttcaccaagcagccccccagcacccccaccagcaccagcagtgatgatgtgtttgtgaagccccaggcccctcctcctcctccagcccccagccgcatccccatccaggacagcctgagccaggcccagaccagccagccccccagcccccaggtgttcagccctggcagcagcaacagcaggcctcccagccccatggacccctatgccaagatggtgggcacccccaggcctcctcctgtgggccacagcttcagcagaagaaattctgctgcccctgtggagaactgcacccccctgagctctgtgtcccggcccctgcagatgaatgagaccacagccaaccggcccagccctgtgcgggacctgtgcagcagcagcaccaccaacaatgacccctatgccaagcccccagacacccccaggcctgtgatgacagaccagttccccaagagcctgggcctgagccgcagccctgtggtgtctgagcagacagccaagggccccatcgctgctggcaccagtgaccacttcaccaagcccagccccagggcagatgtgttccagaggcagaggatcccagacagctatgcccggcccctgctgaccccagcccccctggacagcggccctggccccttcaagacccccatgcagcccccacccagcagccaggacccctacggctctgtgtcccaggccagccggcggctgtctgtggacccctatgaaagacctgccctgaccccccggcccatcgacaacttcagccacaaccagagcaatgacccctacagccagccccccctgaccccccaccctgctgtgaatgaaagctttgcccaccccagccgggccttcagccagcccggcaccatcagccggcccaccagccaggacccctacagccagcccccaggcacccccaggcctgtggtggacagctacagccagagcagcggcacagcccggagcaacacagacccctacagccagcccccaggcaccccccggcccaccaccgtggacccctacagccagcagccccagaccccccggcccagcacccagacagacctgtttgtgacccctgtgaccaaccagaggcacagcgacccctatgcccaccccccaggcaccccccggcccggcatctctgtgccctacagccagcccccagccaccccccggccccgcatcagcgagggcttcaccaggagctccatgaccaggcctgtgctgatgcccaaccaggaccccttcctgcaggccgcccagaacagaggccctgccctgcccggccccctggtgcggcccccagacacctgcagccagaccccccggcccccaggccctggcctgagtgacaccttcagccgggtgagccccagcgctgcccgggacccctatgaccagagccccatgacccccaggagccagagcgacagctttggcaccagccagacagcccatgatgtggccgaccagccccggcccggcagcgagggcagcttctgtgccagcagcaacagccccatgcacagccagggccagcagttcagcggcgtgtcccagctgcccggccctgtgcccaccagcggcgtgacagacacccagaacacagtgaacatggcccaggccgacacagagaagctgcggcagaggcagaagctgcgggagatcatcctgcagcagcagcagcagaagaagattgctggccggcaggagaagggcagccaggacagccctgctgtgccccaccctggccccctgcagcactggcagccagaaaatgtgaaccaggccttcaccaggcctcctccaccctacccaggcaacatccgcagccctgtggccccacccctgggccccaggtatgctgtgttccccaaggaccagaggggcccctaccccccagatgtggcctccatgggcatgaggccccacggcttccgcttcggcttccctgggggcagccacggcaccatgcccagccaggagcgcttcctggtgcccccccagcagatccagggcagcggcgtgagcccccagctgcggcgctctgtgtctgtggacatgccccggcccctgaacaacagccagatgaacaaccctgtgggcctgccccagcacttcagcccccagagcctgcctgtgcagcagcacaacatcctgggccaggcctacatcgagctgcggcaccgggccccagatggccggcagaggctgcccttcagcgcccctcctggctctgtggtggaggccagcagcaacctgcggcacggcaacttcatccccaggccagacttccctggccccaggcacacagaccccatgagaagaccaccccagggcctgcccaaccagctgcctgtgcacccagacctggagcaggtgccccccagccagcaggagcagggccacagcgtgcacagcagctccatggtgatgaggaccctgaaccaccccctgggcggggagttcagcgaggcccccctgagcacctctgtgcccagcgagaccaccagtgacaacctgcagatcaccacccagcccagtgatggcctggaggagaagctggacagtgatgaccccagcgtgaaggagctggatgtgaaggacctggagggcgtggaggtgaaggacctggatgatgaggacctggagaacctgaacctggacacagaagatggcaaggtggtggagctggacaccctggacaacctggagaccaatgaccccaacctggatgacctgctgcggtctggagaatttgacatcatcgcctacacagatcctgagctggacatgggagacaagaagtccatgtttaatgaggagctggacctgcccattgatgacaagctggacaaccagtgtgtgtctgtggagcccaagaagaaggagcaggagaacaagaccctggtgctgagtgacaagcacagcccccagaagaagagcacagtgaccaatgaggtgaagacagaggtgctgagccccaacagcaaggtggagagcaaatgtgaaacagagaagaatgatgagaacaaggacaacgtggacaccccctgcagccaggccagcgcccacagcgacctgaatgatggagagaagaccagcctgcacccctgtgaccctgacctgtttgagaagaggaccaaccgggagacagctggccccagcgccaacgtcatccaggccagcacccagctgcctgcccaggacgtcatcaacagctgtggcatcaccggcagcacccctgtgctgagcagcctgctggccaatgagaagagtgacaacagcgacatccggcccagcggcagccccccaccacccaccctgcctgccagccccagcaaccacgtgagcagcctgccccccttcatcgcccctcctggccgggtgctggacaatgccatgaacagcaatgtgacagtggtgtcccgggtgaaccacgtgttcagccagggcgtgcaggtgaaccctggcctcatccctggccagagcacagtgaaccacagcctgggcaccgggaagccagccacccagacaggcccccagaccagccagagcggcaccagctccatgagcggcccccagcagctgatgatcccccagaccctggcccagcagaaccgggagcggcccctgctgctggaggagcagcccctgctgctgcaggacctgctggaccaggagcggcaggagcagcagcagcagaggcagatgcaggccatgatccggcagaggtctgagcccttcttccccaacatcgactttgatgccatcacagaccccatcatgaaggccaagatggtggccctgaagggcatcaacaaggtgatggcccagaacaacctgggcatgccacccatggtgatgagccgcttccccttcatgggccaggtggtgacaggcacccagaacagcgagggccagaacctgggcccccaggccatcccccaggacggcagcatcacccaccagatcagccggcccaacccccccaactttggacctggctttgtgaatgacagccagaggaagcagtatgaggagtggctgcaggagacccagcagctgctgcagatgcagcagaagtacctggaggagcagatcggggcccacaggaagagcaagaaggccctgagcgccaagcagaggacagccaagaaggccggccgggagttcccagaagaagatgctgagcagctgaagcacgtgacagagcagcagagcatggtgcagaagcagctggagcagatcaggaagcagcagaaggagcacgccgagctgattgaggactaccgcatcaagcagcagcagcagtgtgccatggccccacccaccatgatgcccagcgtgcagccccagcccccactcatccctggggccaccccacccaccatgagccagcccaccttccccatggtgccccagcagctgcagcaccagcagcacaccaccgtcatcagcggccacaccagccctgtgaggatgcccagcctgcccggctggcagcccaacagcgccccagcccacctgcccctgaaccccccacgcatccagccccccatcgcccagctgcccatcaagacctgcaccccagcccctggcaccgtgtccaatgccaacccccagagcggccccccaccccgggtggagtttgatgacaacaaccccttcagcgagagcttccaggagcgggagaggaaggagcggctgcgggagcagcaggagcggcagaggatccagctgatgcaggaggtggaccggcagagggccctgcagcagaggatggagatggagcagcacggcatggtgggcagcgagatcagcagcagcaggacctctgtgtcccagatccccttctacagcagtgacctgccctgtgacttcatgcagcccctgggccccctgcagcagagcccccagcaccagcagcagatgggccaggtgctgcagcagcagaacatccagcagggcagcatcaacagccccagcacccagaccttcatgcagaccaatgaaagacggcaggtgggcccccccagctttgtgcctgacagccccagcatccctgtgggcagccccaacttcagctctgtgaagcagggccacggcaacctgagcggcaccagcttccagcagagccctgtgcggcccagcttcaccccagccctgcctgctgcccctcctgtggccaacagcagcctgccctgtggccaggacagcaccatcacccacggccacagctacccaggcagcacccagagcctcatccagctgtacagcgacatcatccctgaggagaagggcaagaagaagaggaccaggaagaagaagagagatgatgatgctgagagcaccaaggcccccagcaccccccacagcgacatcacagccccacccaccccaggcatcagcgagaccaccagcaccccagctgtgtccacccccagcgagctgccccagcaggccgaccaggagagcgtggagcctgtgggccccagcacccccaacatggctgctggccagctgtgcacagagctggagaacaagctgcccaacagcgacttcagccaggccacccccaaccagcagacctacgccaacagcgaggtggacaagctgtccatggagaccccagccaagacagaggagatcaagctggagaaggccgagacagagagctgccccggccaggaggagcccaagctggaggagcagaatggcagcaaggtggagggcaatgctgtggcctgccctgtgtcctctgcccagagccccccccacagcgctggggccccagctgccaagggggacagcggaaatgagctgctgaagcacctgctgaagaacaagaagagcagcagcctgctgaaccagaagccagagggcagcatctgcagtgaagatgactgcaccaaggacaacaagctggtggagaagcagaacccagctgagggcctgcagaccctgggcgcccagatgcagggcggcttcggctgcggcaaccagctgcccaagacagatggcggcagcgagaccaagaagcagaggagcaagaggacccagaggactggagagaaggccgcccccaggagcaagaagaggaagaaggatgaggaggagaagcaggccatgtacagcagcacagacaccttcacccacctgaagcagcagaacaacctgagcaacccccccaccccaccagccagcctgccccccaccccaccacccatggcctgccagaagatggccaacggctttgccaccacagaggagctggccggcaaggccggcgtgctggtgtcccatgaggtgaccaagaccctgggccccaagcccttccagctgcccttccggccccaggatgacctgctggcccgggccctggcccagggccccaagacagtggatgtgcctgccagcctgcccaccccaccccacaacaaccaggaggagctgcgcatccaggaccactgtggggaccgggacaccccagacagctttgtgcccagcagcagccctgagagcgtggtgggcgtggaggtgagccgctacccagacctgagcctggtgaaggaggagcccccagagcctgtgcccagccccatcatccccatcctgcccagcacagctgggaagagcagcgagagcagaagaaatgacatcaagacagagcccggcaccctgtactttgccagccccttcggccccagccccaacggccccaggagcggcctcatctctgtggccatcaccctgcaccccacagctgctgagaacatcagctctgtggtggccgccttcagtgacctgctgcacgtgcgcatccccaacagctatgaggtgtcctctgccccagatgtgcccagcatgggcctggtgagcagccaccgcatcaaccctggcctggagtaccggcagcacctgctgctgcggggccccccacctggcagcgccaaccccccccggctggtgagcagctaccgcctgaagcagcccaacgtgcccttcccccccaccagcaatggcctgagcggctacaaggacagcagccatggaattgctgagagcgctgccctgcggccccagtggtgctgccactgcaaggtggtgatcctgggcagcggcgtgaggaagagcttcaaggacctgaccctgctgaacaaggacagccgggagagcaccaagagggtggagaaggacatcgtgttctgcagcaacaactgcttcatcctgtacagcagcacagcccaggccaagaacagcgagaacaaggagagcatccccagcctgccccagagccccatgagggagacccccagcaaggccttccaccagtacagcaacaacatcagcaccctggatgtgcactgcctgccccagctgcctgagaaggccagccccccagccagcccccccatcgccttccccccagcctttgaagctgcccaggtggaggccaagccagatgagctgaaggtgacagtgaagctgaagccccggctgcgggctgtgcatggaggctttgaggactgccggcccctgaacaagaagtggaggggcatgaagtggaagaagtggagcatccacatcgtcatccccaagggcaccttcaagccaccctgtgaagatgaaattgatgagttcctgaagaagctgggcaccagcctgaagccagaccctgtgcccaaggactacaggaagtgctgcttctgccacgaggagggagatggcctgacagatggccctgcccggctgctgaacctggacctggacctgtgggtgcacctgaactgtgccctgtggagcacagaggtgtatgagacccaggccggggccctgatcaacgtggagctggccctgcggcggggcctgcagatgaagtgtgtgttctgccacaagacaggagccaccagcggctgccaccgcttccgctgcaccaacatctaccacttcacctgtgccatcaaggcccagtgcatgttcttcaaggacaagaccatgctgtgccccatgcacaagcccaagggcatccacgagcaggagctgagctactttgctgtgttcagaagagtgtatgtgcagagagatgaggtgcggcagatcgccagcatcgtgcagagaggagagcgggaccacaccttccgggtgggcagcctcatcttccacaccatcggccagctgctgccccagcagatgcaggccttccacagccccaaggccctcttccctgtgggctatgaggccagccggctgtactggagcaccaggtatgccaacagacgctgccgctacctgtgcagcattgaggagaaggatggccggcctgtgtttgtgatcagaattgtggagcagggccacgaggacctggtgctgagtgacatcagccccaagggcgtgtgggacaagatcctggagcctgtggcctgtgtgaggaagaagtctgagatgctgcagctgtttcctgcctacctgaagggggaggacctgtttggcctgactgtgtctgctgtggccagaattgctgagagcctgcccggggtggaggcctgtgagaactacaccttccgctatggaagaaaccccctgatggagctgcccctggccgtgaaccccaccggctgtgcccggtctgagcccaagatgtctgcccacgtgaagagatttgtgctgcggccccacaccctgaacagcaccagcaccagcaagagcttccagagcacagtgactggagagctgaatgccccctacagcaagcagtttgtgcacagcaagagcagccagtacaggaagatgaagacagagtggaagagcaatgtgtacctggcccggagccgcatccagggcctgggcctgtatgctgcccgggacatcgagaagcacaccatggtgattgagtacatcggcaccatcatcagaaatgaggtggccaacaggaaggagaagctgtatgagagccagaacagaggagtgtacatgttcaggatggacaatgaccacgtgattgatgccaccctgaccggcggccctgcccgctacatcaaccacagctgtgcccccaactgtgtggccgaggtggtgacctttgagcggggccacaagatcatcatcagcagcagccgccgcatccagaagggggaggagctgtgctatgactacaagtttgattttgaagatgaccagcacaagatcccctgccactgtggggctgtgaactgcaggaagtggatgaactag

SEQ ID NO: 160654 - DNA, 14907 bp, Artificial Sequence
  Description of Artificial Sequence: Synthetic coding sequence
atgagcagcgaggaggacaagtctgtggagcagccccagcccccacctcctcctcctgaggagcccggggccccagcccccagccctgctgctgctgacaagaggccccggggccggcccaggaaggatggagccagccccttccagagggccaggaagaagcccaggagccggggcaagacagctgtggaggatgaggacagcatggatggcctggagaccacagaaacagagaccatcgtggagacagagatcaaggagcagagcgctgaggaggatgctgaggccgaggtggacaacagcaagcagctgatccccaccctgcagaggtctgtgtctgaggagagcgccaacagcctggtgtctgtgggcgtggaggccaagatcagcgagcagctgtgtgccttctgctactgtggggagaagagcagcctgggccagggcgacctgaagcagttccgcatcaccccaggcttcatcctgccctggaggaaccagcccagcaacaagaaggacattgatgacaacagcaatggcacctatgagaagatgcagaacagcgcccccaggaagcagaggggccagaggaaggagaggagcccccagcagaacatcgtgtcctgtgtgtctgtgtccacccagacagccagtgatgaccaggccggcaagctgtgggatgagctgagcctggtgggcctgcctgatgccatcgacatccaggccctgtttgacagcacaggcacctgctgggcccaccaccgctgtgtggagtggagcctgggcgtgtgccagatggaggagcccctgctggtgaatgtggacaaggctgtggtgtctggcagcacagagcgctgtgccttctgcaagcacctgggcgccaccatcaagtgctgtgaggagaagtgcacccagatgtaccactacccctgtgccgccggggccggcaccttccaggacttcagccacatcttcctgctgtgcccagagcacatcgaccaggcccctgagaggagcaaggaggatgccaactgtgctgtgtgtgacagccctggggacctgctggaccagttcttctgcaccacctgtggccagcactaccacggcatgtgcctggacattgctgtgacccccctgaagagagctggctggcagtgcccagagtgcaaggtgtgccagaactgcaagcagagcggggaggacagcaagatgctggtgtgtgacacctgtgacaagggctaccacaccttctgcctgcagcctgtgatgaagtctgtgcccaccaacggctggaagtgcaagaactgccgcatctgcattgaatgtggcaccaggagcagcagccagtggcaccacaactgcctgatctgtgacaactgctaccagcagcaggacaacctgtgccccttctgtgggaagtgctaccaccctgagctgcagaaggacatgctgcactgcaacatgtgcaagcgctgggtgcacctggagtgtgacaagcccacagaccacgagctggacacccagctgaaggaggagtacatctgcatgtactgcaagcacctgggcgctgagatggaccggctgcagcctggagaggaggtggagattgctgagctgaccacagactacaacaatgagatggaggtggagggccctgaggaccagatggtgttcagcgagcaggccgccaacaaggatgtgaatggccaggagagcaccccaggcatcgtgcctgatgctgtgcaggtgcacacagaggagcagcagaagagccaccccagcgagagcctggacacagacagcctgctgattgctgtgagcagccagcacacagtgaacacagagctggagaagcagatcagcaatgaggtggacagcgaggacctgaagatgagcagcgaggtgaagcacatctgtggggaggaccagatcgaggacaagatggaggtgacagaaaatattgaggtggtgacccaccagatcaccgtgcagcaggagcagctgcagctgctggaggagcctgagaccgtggtgtcccgggaggagagccggccccccaagctggtgatggagagcgtgaccctgcccctggagaccctggtgagcccccatgaggagagcatcagcctgtgcccagaggagcagctggtgattgagcggctgcagggcgagaaggagcagaaggagaacagcgagctgagcacaggcctgatggattctgagatgacccccaccatcgagggctgtgtgaaggatgtgtcctaccagggcggcaagagcatcaagctgagcagcgagacagagagcagcttcagcagcagcgctgacatcagcaaggcagatgtgagcagcagccccacccccagcagtgacctgcccagccatgacatgctgcacaactaccccagcgccctgagcagcagcgctggcaacatcatgcccaccacctacatctctgtgacccccaagattggcatgggcaagccagccatcaccaagaggaagttcagccctggccggcccaggagcaagcagggcgcctggagcacccacaacacagtgtccccacccagctggagcccagacatcagcgagggccgggagatcttcaagccccggcagctgcccggcagcgccatctggagcatcaaggtgggccggggcagcggcttccctgggaagaggcggcccagaggagctggcctgagcggccggggcggccggggccgcagcaagctgaagagcggcatcggggctgtggtgctgcccggggtgtccacagctgacatcagcagcaacaaggatgatgaagaaaattccatgcacaacacagtggtgctcttcagcagcagtgacaagttcaccctgaaccaggacatgtgtgtggtgtgtggcagctttggccagggcgctgagggccgcctgctggcctgcagccagtgtggccagtgctaccacccctactgtgtgtccatcaagatcaccaaggtggtgctgagcaagggctggcgctgcctggagtgcaccgtgtgtgaggcctgtgggaaggccacagatcctggccgcctgctgctgtgtgatgactgtgacatctcctaccacacctactgcctggacccccccctgcagacagtgcccaagggcggctggaagtgcaagtggtgtgtgtggtgccgccactgtggggccaccagcgctggcctgcgctgtgagtggcagaacaactacacccagtgtgccccctgtgccagcctgagcagctgccctgtgtgctacagaaactaccgggaggaggacctgatcctgcagtgccggcagtgtgaccgctggatgcatgctgtgtgccagaacctgaacacagaggaggaggtggagaatgtggccgacattggatttgactgcagcatgtgccggccctacatgcctgccagcaatgtgcccagcagtgactgctgtgagagcagcctggtggcccagatcgtgaccaaggtgaaggagctggacccccccaagacctacacccaggatggagtgtgcctgacagagagcggcatgacccagctgcagagcctgactgtgacagtgcccaggaggaagaggagcaagcccaagctgaagctgaagatcatcaaccagaacagcgtggccgtgctgcagaccccaccagacatccagagcgagcacagcagagatggagagatggatgacagccgggagggggagctgatggactgtgatggcaagtctgagagcagccctgagcgggaggccgtggatgatgagaccaagggcgtggagggcacagatggagtgaagaagaggaagaggaagccctaccggcccggcatcggcggcttcatggtgcggcagaggagcaggacaggccagggcaagaccaagaggagcgtcatcaggaaggacagcagcggcagcatcagcgagcagctgccctgcagagatgatggctggagcgagcagctgcctgacaccctggtggatgagagcgtgtctgtgacagagagcacagagaagatcaagaagcgctacaggaagaggaagaacaagctggaggagaccttccctgcctacctgcaggaggccttcttcggcaaggacctgctggacaccagccggcagagcaagatcagcctggacaacctgtctgaagatggagcccagctgctgtacaagaccaacatgaacacaggcttcctggaccccagcctggaccccctgctgagcagcagcagcgcccccaccaagagcggcacccacggccctgcagatgaccccctggccgacatcagcgaggtgctgaacacagatgatgacatcctgggcatcatcagtgatgacctggccaagtctgtggaccacagcgacatcggccctgtgacagatgaccccagcagcctgccccagcccaacgtgaaccagagcagccggcccctgtctgaggagcagctggatggcatcctgagccctgagctggacaagatggtgacagatggagccatcctgggcaagctgtacaagatccctgagctgggcggcaaggatgtggaggacctcttcaccgctgtgctgagccctgccaacacccagcccacccccctgccccagcccccaccacccacccagctgctgcccatccacaaccaggatgccttcagcaggatgcccctgatgaatggcctcatcggcagcagcccccacctgccccacaacagcctgcccccaggcagcggcctgggcaccttcagcgccatcgcccagagcagctacccagatgcccgggacaagaacagcgccttcaaccccatggccagtgaccccaacaacagctggaccagcagcgcccccaccgtggagggagaaaatgacaccatgagcaatgcccagaggagcaccctgaagtgggagaaggaggaggccctgggggagatggccaccgtggcccctgtgctgtacaccaacatcaacttccccaacctgaaggaggagttcccagactggaccaccagggtgaagcagatcgccaagctgtggaggaaggccagcagccaggagcgggccccctacgtgcagaaggcccgggacaacagagctgccctgcgcatcaacaaggtgcagatgagcaatgacagcatgaagaggcagcagcagcaggacagcattgaccccagcagcagaattgattctgagctgttcaaggaccccctgaagcagcgggagagcgagcacgagcaggagtggaagttccggcagcagatgaggcagaagagcaagcagcaggccaagattgaggccacccagaagctggagcaggtgaagaatgagcagcagcagcagcagcagcagcagtttggcagccagcacctgctggtgcagagcggcagtgacacccccagcagcggcatccagagccccctgaccccccagcctggaaatggaaacatgagccctgcccagagcttccacaaggagctgttcaccaagcagccccccagcacccccaccagcaccagcagtgatgatgtgtttgtgaagccccaggcccctcctcctcctccagcccccagccgcatccccatccaggacagcctgagccaggcccagaccagccagccccccagcccccaggtgttcagccctggcagcagcaacagcaggcctcccagccccatggacccctatgccaagatggtgggcacccccaggcctcctcctgtgggccacagcttcagcagaagaaattctgctgcccctgtggagaactgcacccccctgagctctgtgtcccggcccctgcagatgaatgagaccacagccaaccggcccagccctgtgcgggacctgtgcagcagcagcaccaccaacaatgacccctatgccaagcccccagacacccccaggcctgtgatgacagaccagttccccaagagcctgggcctgagccgcagccctgtggtgtctgagcagacagccaagggccccatcgctgctggcaccagtgaccacttcaccaagcccagccccagggcagatgtgttccagaggcagaggatcccagacagctatgcccggcccctgctgaccccagcccccctggacagcggccctggccccttcaagacccccatgcagcccccacccagcagccaggacccctacggctctgtgtcccaggccagccggcggctgtctgtggacccctatgaaagacctgccctgaccccccggcccatcgacaacttcagccacaaccagagcaatgacccctacagccagccccccctgaccccccaccctgctgtgaatgaaagctttgcccaccccagccgggccttcagccagcccggcaccatcagccggcccaccagccaggacccctacagccagcccccaggcacccccaggcctgtggtggacagctacagccagagcagcggcacagcccggagcaacacagacccctacagccagcccccaggcaccccccggcccaccaccgtggacccctacagccagcagccccagaccccccggcccagcacccagacagacctgtttgtgacccctgtgaccaaccagaggcacagcgacccctatgcccaccccccaggcaccccccggcccggcatctctgtgccctacagccagcccccagccaccccccggccccgcatcagcgagggcttcaccaggagctccatgaccaggcctgtgctgatgcccaaccaggaccccttcctgcaggccgcccagaacagaggccctgccctgcccggccccctggtgcggcccccagacacctgcagccagaccccccggcccccaggccctggcctgagtgacaccttcagccgggtgagccccagcgctgcccgggacccctatgaccagagccccatgacccccaggagccagagcgacagctttggcaccagccagacagcccatgatgtggccgaccagccccggcccggcagcgagggcagcttctgtgccagcagcaacagccccatgcacagccagggccagcagttcagcggcgtgtcccagctgcccggccctgtgcccaccagcggcgtgacagacacccagaacacagtgaacatggcccaggccgacacagagaagctgcggcagaggcagaagctgcgggagatcatcctgcagcagcagcagcagaagaagattgctggccggcaggagaagggcagccaggacagccctgctgtgccccaccctggccccctgcagcactggcagccagaaaatgtgaaccaggccttcaccaggcctcctccaccctacccaggcaacatccgcagccctgtggccccacccctgggccccaggtatgctgtgttccccaaggaccagaggggcccctaccccccagatgtggcctccatgggcatgaggccccacggcttccgcttcggcttccctgggggcagccacggcaccatgcccagccaggagcgcttcctggtgcccccccagcagatccagggcagcggcgtgagcccccagctgcggcgctctgtgtctgtggacatgccccggcccctgaacaacagccagatgaacaaccctgtgggcctgccccagcacttcagcccccagagcctgcctgtgcagcagcacaacatcctgggccaggcctacatcgagctgcggcaccgggccccagatggccggcagaggctgcccttcagcgcccctcctggctctgtggtggaggccagcagcaacctgcggcacggcaacttcatccccaggccagacttccctggccccaggcacacagaccccatgagaagaccaccccagggcctgcccaaccagctgcctgtgcacccagacctggagcaggtgccccccagccagcaggagcagggccacagcgtgcacagcagctccatggtgatgaggaccctgaaccaccccctgggcggggagttcagcgaggcccccctgagcacctctgtgcccagcgagaccaccagtgacaacctgcagatcaccacccagcccagtgatggcctggaggagaagctggacagtgatgaccccagcgtgaaggagctggatgtgaaggacctggagggcgtggaggtgaaggacctggatgatgaggacctggagaacctgaacctggacacagaagatggcaaggtggtggagctggacaccctggacaacctggagaccaatgaccccaacctggatgacctgctgcggtctggagaatttgacatcatcgcctacacagatcctgagctggacatgggagacaagaagtccatgtttaatgaggagctggacctgcccattgatgacaagctggacaaccagtgtgtgtctgtggagcccaagaagaaggagcaggagaacaagaccctggtgctgagtgacaagcacagcccccagaagaagagcacagtgaccaatgaggtgaagacagaggtgctgagccccaacagcaaggtggagagcaaatgtgaaacagagaagaatgatgagaacaaggacaacgtggacaccccctgcagccaggccagcgcccacagcgacctgaatgatggagagaagaccagcctgcacccctgtgaccctgacctgtttgagaagaggaccaaccgggagacagctggccccagcgccaacgtcatccaggccagcacccagctgcctgcccaggacgtcatcaacagctgtggcatcaccggcagcacccctgtgctgagcagcctgctggccaatgagaagagtgacaacagcgacatccggcccagcggcagccccccaccacccaccctgcctgccagccccagcaaccacgtgagcagcctgccccccttcatcgcccctcctggccgggtgctggacaatgccatgaacagcaatgtgacagtggtgtcccgggtgaaccacgtgttcagccagggcgtgcaggtgaaccctggcctcatccctggccagagcacagtgaaccacagcctgggcaccgggaagccagccacccagacaggcccccagaccagccagagcggcaccagctccatgagcggcccccagcagctgatgatcccccagaccctggcccagcagaaccgggagcggcccctgctgctggaggagcagcccctgctgctgcaggacctgctggaccaggagcggcaggagcagcagcagcagaggcagatgcaggccatgatccggcagaggtctgagcccttcttccccaacatcgactttgatgccatcacagaccccatcatgaaggccaagatggtggccctgaagggcatcaacaaggtgatggcccagaacaacctgggcatgccacccatggtgatgagccgcttccccttcatgggccaggtggtgacaggcacccagaacagcgagggccagaacctgggcccccaggccatcccccaggacggcagcatcacccaccagatcagccggcccaacccccccaactttggacctggctttgtgaatgacagccagaggaagcagtatgaggagtggctgcaggagacccagcagctgctgcagatgcagcagaagtacctggaggagcagatcggggcccacaggaagagcaagaaggccctgagcgccaagcagaggacagccaagaaggccggccgggagttcccagaagaagatgctgagcagctgaagcacgtgacagagcagcagagcatggtgcagaagcagctggagcagatcaggaagcagcagaaggagcacgccgagctgattgaggactaccgcatcaagcagcagcagcagtgtgccatggccccacccaccatgatgcccagcgtgcagccccagcccccactcatccctggggccaccccacccaccatgagccagcccaccttccccatggtgccccagcagctgcagcaccagcagcacaccaccgtcatcagcggccacaccagccctgtgaggatgcccagcctgcccggctggcagcccaacagcgccccagcccacctgcccctgaaccccccacgcatccagccccccatcgcccagctgcccatcaagacctgcaccccagcccctggcaccgtgtccaatgccaacccccagagcggccccccaccccgggtggagtttgatgacaacaaccccttcagcgagagcttccaggagcgggagaggaaggagcggctgcgggagcagcaggagcggcagaggatccagctgatgcaggaggtggaccggcagagggccctgcagcagaggatggagatggagcagcacggcatggtgggcagcgagatcagcagcagcaggacctctgtgtcccagatccccttctacagcagtgacctgccctgtgacttcatgcagcccctgggccccctgcagcagagcccccagcaccagcagcagatgggccaggtgctgcagcagcagaacatccagcagggcagcatcaacagccccagcacccagaccttcatgcagaccaatgaaagacggcaggtgggcccccccagctttgtgcctgacagccccagcatccctgtgggcagccccaacttcagctctgtgaagcagggccacggcaacctgagcggcaccagcttccagcagagccctgtgcggcccagcttcaccccagccctgcctgctgcccctcctgtggccaacagcagcctgccctgtggccaggacagcaccatcacccacggccacagctacccaggcagcacccagagcctcatccagctgtacagcgacatcatccctgaggagaagggcaagaagaagaggaccaggaagaagaagagagatgatgatgctgagagcaccaaggcccccagcaccccccacagcgacatcacagccccacccaccccaggcatcagcgagaccaccagcaccccagctgtgtccacccccagcgagctgccccagcaggccgaccaggagagcgtggagcctgtgggccccagcacccccaacatggctgctggccagctgtgcacagagctggagaacaagctgcccaacagcgacttcagccaggccacccccaaccagcagacctacgccaacagcgaggtggacaagctgtccatggagaccccagccaagacagaggagatcaagctggagaaggccgagacagagagctgccccggccaggaggagcccaagctggaggagcagaatggcagcaaggtggagggcaatgctgtggcctgccctgtgtcctctgcccagagccccccccacagcgctggggccccagctgccaagggggacagcggaaatgagctgctgaagcacctgctgaagaacaagaagagcagcagcctgctgaaccagaagccagagggcagcatctgcagtgaagatgactgcaccaaggacaacaagctggtggagaagcagaacccagctgagggcctgcagaccctgggcgcccagatgcagggcggcttcggctgcggcaaccagctgcccaagacagatggcggcagcgagaccaagaagcagaggagcaagaggacccagaggactggagagaaggccgcccccaggagcaagaagaggaagaaggatgaggaggagaagcaggccatgtacagcagcacagacaccttcacccacctgaagcaggtgcggcagctgagcctgctgcccctgatggagcccatcatcggcgtgaactttgcccacttcctgccctacggcagcggccagttcaacagcggcaaccggctgctgggcacctttggaagtgccaccctggagggcgtgtctgactactacagccagctgatctacaagcagaacaacctgagcaacccccccaccccaccagccagcctgccccccaccccaccacccatggcctgccagaagatggccaatggatttgccaccacagaggagctggccggcaaggccggcgtgctggtgtcccatgaggtgaccaagaccctgggccccaagcccttccagctgcccttccggccccaggatgacctgctggcccgggccctggcccagggccccaagacagtggatgtgcctgccagcctgcccaccccaccccacaacaaccaggaggagctgcgcatccaggaccactgtggggaccgggacaccccagacagctttgtgcccagcagcagccctgagagcgtggtgggcgtggaggtgagccgctacccagacctgagcctggtgaaggaggagcccccagagcctgtgcccagccccatcatccccatcctgcccagcacagctgggaagagcagcgagagcagaagaaatgacatcaagacagagcccggcaccctgtactttgccagccccttcggccccagccccaacggccccaggagcggcctcatctctgtggccatcaccctgcaccccacagctgctgagaacatcagctctgtggtggccgccttcagtgacctgctgcacgtgcgcatccccaacagctatgaggtgagcagcgccccagatgtgcccagcatgggcctggtgagcagccaccgcatcaaccctggcctggagtaccggcagcacctgctgctgcggggccccccacctggcagcgccaaccccccccggctggtgtcctcctaccgcctgaagcagcccaacgtgcccttcccccccaccagcaatggcctgagcggctacaaggacagcagccacggcattgctgagagcgctgccctgcggccccagtggtgctgccactgcaaggtggtgatcctgggcagcggcgtgaggaagagcttcaaggacctgaccctgctgaacaaggacagccgggagagcaccaagagggtggagaaggacatcgtgttctgcagcaacaactgcttcatcctgtacagcagcacagcccaggccaagaacagcgagaacaaggagagcatccccagcctgccccagagccccatgagggagacccccagcaaggccttccaccagtacagcaacaacatcagcaccctggatgtgcactgcctgccccagctgcctgagaaggccagccccccagccagcccccccatcgccttccccccagcctttgaggccgcccaggtggaggccaagccagatgagctgaaggtgacagtgaagctgaagccccggctgcgggctgtgcacggcggctttgaggactgccggcccctgaacaagaagtggaggggcatgaagtggaagaagtggagcatccacatcgtcatccccaagggcaccttcaagccaccctgtgaagatgaaattgatgagttcctgaagaagctgggcaccagcctgaagccagaccctgtgcccaaggactacaggaagtgctgcttctgccacgaggagggagatggcctgacagatggccctgcccggctgctgaacctggacctggacctgtgggtgcacctgaactgtgccctgtggagcacagaggtgtatgagacccaggccggggccctgatcaacgtggagctggccctgcggcggggcctgcagatgaagtgtgtgttctgccacaagacaggagccaccagcggctgccaccgcttccgctgcaccaacatctaccacttcacctgtgccatcaaggcccagtgcatgttcttcaaggacaagaccatgctgtgccccatgcacaagcccaagggcatccacgagcaggagctgagctactttgctgtgttccggcgggtgtatgtgcagagagatgaggtgcggcagatcgccagcatcgtgcagagaggagagcgggaccacaccttccgggtgggcagcctcatcttccacaccatcggccagctgctgccccagcagatgcaggccttccacagccccaaggccctcttccctgtgggctatgaggccagccggctgtactggagcaccaggtatgccaacagacgctgccgctacctgtgcagcattgaggagaaggatggccggcctgtgtttgtgatccgcatcgtggagcagggccacgaggacctggtgctgagtgacatcagccccaagggcgtgtgggacaagatcctggagcctgtggcctgtgtgaggaagaagtctgagatgctgcagctgtttcctgcctacctgaagggggaggacctgtttggcctgactgtgtctgctgtggccagaattgctgagagcctgcccggggtggaggcctgtgagaactacaccttccgctatggcaggaaccccctgatggagctgcccctggccgtgaaccccaccggctgtgcccggtctgagcccaagatgtctgcccacgtgaagagatttgtgctgcggccccacaccctgaacagcaccagcaccagcaagagcttccagagcacagtgactggagagctgaatgccccctacagcaagcagtttgtgcacagcaagagcagccagtacaggaagatgaagacagagtggaagagcaatgtgtacctggcccggagccgcatccagggcctgggcctgtatgctgcccgggacatcgagaagcacaccatggtgattgagtacatcggcaccatcatcagaaatgaggtggccaacaggaaggagaagctgtatgagagccagaacagaggagtgtacatgttcaggatggacaatgaccacgtgattgatgccaccctgactggaggccctgcccgctacatcaaccacagctgtgcccccaactgtgtggccgaggtggtgacctttgagcggggccacaagatcatcatcagcagcagccgccgcatccagaagggggaggagctgtgctatgactacaagtttgattttgaagatgaccagcacaagatcccctgccactgtggggctgtgaactgcaggaagtggatgaactag

SEQ ID NO: 160655 - DNA, 4575 bp, Artificial Sequence
  Description of Artificial Sequence: Synthetic coding sequence
ctgatgcaggaggtggaccggcagagggccctgcagcagaggatggagatggagcagcacggcatggtgggcagcgagatcagcagcagcaggacctctgtgtcccagatccccttctacagcagtgacctgccctgtgacttcatgcagcccctgggccccctgcagcagagcccccagcaccagcagcagatgggccaggtgctgcagcagcagaacatccagcagggcagcatcaacagccccagcacccagaccttcatgcagaccaatgaaagacggcaggtgggcccccccagctttgtgcctgacagccccagcatccctgtgggcagccccaacttcagctctgtgaagcagggccacggcaacctgagcggcaccagcttccagcagagccctgtgcggcccagcttcaccccagccctgcctgctgcccctcctgtggccaacagcagcctgccctgtggccaggacagcaccatcacccacggccacagctacccaggcagcacccagagcctcatccagctgtacagcgacatcatccctgaggagaagggcaagaagaagaggaccaggaagaagaagagagatgatgatgctgagagcaccaaggcccccagcaccccccacagcgacatcacagccccacccaccccaggcatcagcgagaccaccagcaccccagctgtgtccacccccagcgagctgccccagcaggccgaccaggagagcgtggagcctgtgggccccagcacccccaacatggctgctggccagctgtgcacagagctggagaacaagctgcccaacagcgacttcagccaggccacccccaaccagcagacctacgccaacagcgaggtggacaagctgtccatggagaccccagccaagacagaggagatcaagctggagaaggccgagacagagagctgccccggccaggaggagcccaagctggaggagcagaatggcagcaaggtggagggcaatgctgtggcctgccctgtgtcctctgcccagagccccccccacagcgctggggccccagctgccaagggggacagcggaaatgagctgctgaagcacctgctgaagaacaagaagagcagcagcctgctgaaccagaagccagagggcagcatctgcagtgaagatgactgcaccaaggacaacaagctggtggagaagcagaacccagctgagggcctgcagaccctgggcgcccagatgcagggcggcttcggctgcggcaaccagctgcccaagacagatggcggcagcgagaccaagaagcagaggagcaagaggacccagaggactggagagaaggccgcccccaggagcaagaagaggaagaaggatgaggaggagaagcaggccatgtacagcagcacagacaccttcacccacctgaagcagcagctgagcctgctgcccctgatggagcccatcatcggcgtgaactttgcccacttcctgccctacggcagcggccagttcaacagcggcaaccggctgctgggcacctttggaagtgccaccctggagggcgtgtctgactactacagccagctgatctacaagaagatggccaatggatttgccaccacagaggagctggccggcaaggccggcgtgctggtgtcccatgaggtgaccaagaccctgggccccaagcccttccagctgcccttccggccccaggatgacctgctggcccgggccctggcccagggccccaagacagtggatgtgcctgccagcctgcccaccccaccccacaacaaccaggaggagctgcgcatccaggaccactgtggggaccgggacaccccagacagctttgtgcccagcagcagccctgagagcgtggtgggcgtggaggtgagccgctacccagacctgagcctggtgaaggaggagcccccagagcctgtgcccagccccatcatccccatcctgcccagcacagctgggaagagcagcgagagcagaagaaatgacatcaagacagagcccggcaccctgtactttgccagccccttcggccccagccccaacggccccaggagcggcctcatctctgtggccatcaccctgcaccccacagctgctgagaacatcagctctgtggtggccgccttcagtgacctgctgcacgtgcgcatccccaacagctatgaggtgagcagcgccccagatgtgcccagcatgggcctggtgagcagccaccgcatcaaccctggcctggagtaccggcagcacctgctgctgcggggccccccacctggcagcgccaaccccccccggctggtgtcctcctaccgcctgaagcagcccaacgtgcccttcccccccaccagcaatggcctgagcggctacaaggacagcagccacggcattgctgagagcgctgccctgcggccccagtggtgctgccactgcaaggtggtgatcctgggcagcggcgtgaggaagagcttcaaggacctgaccctgctgaacaaggacagccgggagagcaccaagagggtggagaaggacatcgtgttctgcagcaacaactgcttcatcctgtacagcagcacagcccaggccaagaacagcgagaacaaggagagcatccccagcctgccccagagccccatgagggagacccccagcaaggccttccaccagtacagcaacaacatcagcaccctggatgtgcactgcctgccccagctgcctgagaaggccagccccccagccagcccccccatcgccttccccccagcctttgaggccgcccaggtggaggccaagccagatgagctgaaggtgacagtgaagctgaagccccggctgcgggctgtgcacggcggctttgaggactgccggcccctgaacaagaagtggaggggcatgaagtggaagaagtggagcatccacatcgtcatccccaagggcaccttcaagccaccctgtgaagatgaaattgatgagttcctgaagaagctgggcaccagcctgaagccagaccctgtgcccaaggactacaggaagtgctgcttctgccacgaggagggagatggcctgacagatggccctgcccggctgctgaacctggacctggacctgtgggtgcacctgaactgtgccctgtggagcacagaggtgtatgagacccaggccggggccctgatcaacgtggagctggccctgcggcggggcctgcagatgaagtgtgtgttctgccacaagacaggagccaccagcggctgccaccgcttccgctgcaccaacatctaccacttcacctgtgccatcaaggcccagtgcatgttcttcaaggacaagaccatgctgtgccccatgcacaagcccaagggcatccacgagcaggagctgagctactttgctgtgttccggcgggtgtatgtgcagagagatgaggtgcggcagatcgccagcatcgtgcagagaggagagcgggaccacaccttccgggtgggcagcctcatcttccacaccatcggccagctgctgccccagcagatgcaggccttccacagccccaaggccctcttccctgtgggctatgaggccagccggctgtactggagcaccaggtatgccaacagacgctgccgctacctgtgcagcattgaggagaaggatggccggcctgtgtttgtgatccgcatcgtggagcagggccacgaggacctggtgctgagtgacatcagccccaagggcgtgtgggacaagatcctggagcctgtggcctgtgtgaggaagaagtctgagatgctgcagctgtttcctgcctacctgaagggggaggacctgtttggcctgactgtgtctgctgtggccagaattgctgagagcctgcccggggtggaggcctgtgagaactacaccttccgctatggcaggaaccccctgatggagctgcccctggccgtgaaccccaccggctgtgcccggtctgagcccaagatgtctgcccacgtgaagaggccccacaccctgaacagcaccagcaccagcaagagcttccagagcacagtgactggagagctgaatgccccctacagcaagcagtttgtgcacagcaagagcagccagtacaggaagatgaagacagagtggaagagcaatgtgtacctggcccggagccgcatccagggcctgggcctgtatgctgcccgggacatcgagaagcacaccatggtgattgagtacatcggcaccatcatcagaaatgaggtggccaacaggaaggagaagctgtatgagagccagaacagaggagtgtacatgttcaggatggacaatgaccacgtgattgatgccaccctgactggaggccctgcccgctacatcaaccacagctgtgcccccaactgtgtggccgaggtggtgacctttgagcggggccacaagatcatcatcagcagcagccgccgcatccagaagggggaggagctgtgctatgactacaagtttgattttgaagatgaccagcacaagatcccctgccactgtggggctgtgaactgcaggaagtggatgaactag

SEQ ID NO: 160656 - DNA, 351 bp, Artificial Sequence
  Description of Artificial Sequence: Synthetic coding sequence
atggtgattgagtacatcggcaccatcatcagaaatgaggtggccaacaggaaggagaagctgtatgagagccagaacagaggagtgtacatgttcaggatggacaatgaccacgtgattgatgccaccctgactggaggccctgcccgctacatcaaccacagctgtgcccccaactgtgtggccgaggtggtgacctttgagcggggccacaagatcatcatcagcagcagccgccgcatccagaagggggaggagctgtgctatgactacaagtttgattttgaagatgaccagcacaagatcccctgccactgtggggctgtgaactgcaggaagtggatgaactag

SEQ ID NO: 160657 - DNA, 5577 bp, Artificial Sequence
  Description of Artificial Sequence: Synthetic coding sequence
atgagcatcgtcatccccctgggcgtggacacagctgagaccagctacctggagatggctgctggcagcgagcctgagagcgtggaggccagccctgtggtggtggagaagagcaacagctacccccaccagctgtacaccagcagcagccaccacagccacagctacatcggcctgccctatgctgaccacaactacggggcccggcccccacccaccccaccagccagccccccaccttctgtgctgatcagcaagaatgaggtgggcatcttcaccacccccaactttgatgagaccagcagcgccaccaccatcagcaccagtgaagatggcagctatggaacagatgtgacccgctgcatctgtggcttcacccatgatgatggctacatgatctgctgtgacaagtgcagcgtgtggcagcacatcgactgcatgggcatcgaccggcagcacatcccagacacctacctgtgtgagcgctgccagcccaggaacctggacaaggagagagctgtgctgctgcagaggaggaagcgggagaacatgtctgatggagacaccagcgccacagagagcggagatgaggtgcctgtggagctgtacacagccttccagcacacccccaccagcatcaccctgacagccagccgggtgtccaaggtgaatgacaagaggaggaagaagtctggagagaaggagcagcacatcagcaagtgcaagaaggccttccgggagggcagcaggaagagcagccgggtgaagggcagcgcccctgagattgaccccagcagtgatggcagcaactttggctgggagaccaagatcaaggcctggatggacagatatgaggaggccaacaacaaccagtacagcgagggcgtgcagcgggaggcccagagaattgccctgcggctgggcaatggaaatgacaagaaggagatgaacaagagtgacctgaacaccaacaacctgctcttcaagccccctgtggagagccacatccagaagaacaagaagatcctgaagagcgccaaggacctgcccccagatgccctgatcatcgagtaccggggcaagttcatgctgcgggagcagtttgaggccaacggctacttcttcaagaggccctacccctttgtgctcttctacagcaagttccacggcctggagatgtgtgtggatgcccggacctttggaaatgaggcccgcttcatccgccgcagctgcaccccaaatgctgaggtgagacatgagatccaggacggcaccatccacctgtacatctacagcatccacagcatccccaagggcacagagatcaccatcgcctttgattttgattatggcaactgcaagtacaaggtggactgtgcctgcctgaaggagaacccagaatgtcctgtgctgaagaggagcagcgagagcatggagaacatcaacagcggctatgagaccaggaggaagaagggcaagaaggacaaggacatcagcaaggagaaggacacccagaaccagaacatcaccctggactgtgagggcaccaccaacaagatgaagagccctgagaccaagcagaggaagctgagccccctgcggctgtctgtgagcaacaaccaggagccagacttcattgatgacatcgaggagaagacccccatcagcaatgaggtggagatggagagcgaggagcagattgctgagaggaagaggaagatgacccgggaggagaggaagatggaggccatcctgcaggcctttgcccggctggagaagcgggagaagagaagagagcaggccctggagcgcatcagcacagccaagacagaggtgaagacagagtgcaaggacacccagatcgtgtctgatgctgaggtgatccaggagcaggccaaggaggagaatgccagcaagcccaccccagccaaggtgaacagaaccaagcagaggaagagcttcagccgcagcaggacccacatcggccagcagaggcggcggcacaggacagtgtccatgtgcagcgacatccagcccagcagcccagacatcgaggtgaccagccagcagaatgacatcgagaacacagtgctgaccatcgagcctgagacagaaacagccctggccgagatcatcacagaaacagaggtgcctgccctgaacaagtgccccaccaagtaccccaagaccaagaagcacctggtgaatgagtggctgtctgagaagaatgagaagacaggcaagcccagtgatggcctgtctgagcggcccctgcgcatcaccacagatcctgaggtgctggccacccagctgaacagcctgcccggcctgacctacagcccccacgtgtacagcacccccaagcactacatccgcttcaccagccccttcctgtctgagaagagaagaaggaaggagcccacagagaacatcagcggcagctgcaagaagcgctggctgaagcaggccctggaggaggagaacagcgccatcctgcaccgcttcaacagcccctgccaggagaggagccgcagccctgctgtgaatggagagaacaagagccccctgctgctgaatgacagctgcagcctgcctgacctgaccacccccctgaagaagaggcgcttctaccagctgctggacagcgtgtacagcgagaccagcacccccacccccagcccctatgccacccccacccacacagacatcacccccatggaccccagctttgccaccccaccccgcatcaagagtgatgatgagacctgcagaaatggctacaagcccatctacagccctgtgacccctgtgaccccaggcaccccaggcaacaccatgcactttgagaacatcagcagccctgagagcagccctgagatcaagaggaggacctacagccaggagggctatgacaggagcagcaccatgctgaccctgggccccttcaggaacagcaacctgacagagctgggcctgcaggagatcaagaccatcggctacaccagccccaggagcaggacagaggtgaaccggcagtgccctggagagaaggagcctgtgtctgacctgcagctgggcctggatgctgtggagcccacagccctgcacaagaccctggagaccccagcccatgacagagctgagcccaacagccagctggacagcacccacagcggccggggcaccatgtacagctcctgggtgaagagcccagacagaactggagtgaacttctctgtgaacagcaacctgcgggacctgacccccagccaccagctggaggtgggcggcggcttccgcatcagcgagagcaagtgcctgatgcaggatgacacccggggcatgttcatggagaccaccgtcttctgcaccagtgaagatggcctggtgtctggctttggaagaacagtgaatgacaacctgattgatggcaactgcaccccccagaaccccccccagaagaagaaggtgtccctgctggagtacaggaagaggcagcgggaggccaggaagagcggcagcaagacagagaacttccccctcatctctgtgagcccccacgccagcggcagcctgagcaacaatggagatggctgtgccagcagcaatgacaatggagagcaggtggaccacacagccagcctgcccctgcccaccccagccaccgtgtacaatgccaccagcgaggagaccagcaacaactgccctgtgaaggatgccacagccagcgagaagaatgaacctgaggtgcagtggacagccagcacctctgtggagcaggtgcgggagaggagctaccagagggccctgctgctgagtgaccacaggaaggacaaggacagcggcggggagagcccctgtgtgtcctgcagccccagccacgtgcagagcagccccagcagccacagcaaccacatcccccagctgcaggccaagggccctgtgcccagcttcagcgagctgatggaggaccctgaccctgagaaccctgagcccaccaccaccaatgaatgtcccagcccagacaccagccagaacacctgcaagagcccccccaagatgagcaagccaggcagccctggcagcgtcatcccagcccaggcccacggcaagatcttcaccaagccagacccccagtgggacagcacagtgtctgccagcgaggccgagaatggagtgcacctgaagacagagctgcagcagaagcagctgagcaacaacaaccaggccctgagcaagaaccaccccccccagacccacgtgaggaacagcagcgagcagctgagccagaagctgcccagcgtgcccaccaagctgcactgcccccccagcccccacctggagaacccccccaagagcagcaccccccacacccctgtgcagcacggctacctgagccccaagccacccagccagcagctgggcagcccctaccggccccaccacagccagagcccccaggtgggcaccccccagcgggagccccagaggaacttctacccagctgcccagaacctgcctgccaacacccagcaggccaccagcggcaccctcttcacccagacccccagcggccagagcagcgccacctacagccagttcaaccagcagagcctgaacagcacagcccctcctcctcctcctcctcctccacccagcagcagctactaccagaaccagcagcccagcgccaacttccagaactacaaccagctgaagggcagcctgagccagcagaccgtcttcaccagcggccccaaccaggccctgcccggcaccaccagccagcagacagtgcccggccaccacgtgaccccaggccacttcctgcccagccagaaccccaccatccaccaccagacagctgctgctgtggtgcccccacctcctcctcctcctccagcccctggcccccacctggtgcagcagcccaacagccaccagcagcacagcgtggcccacgtggtgggccctgtgcatgctgtgaccccaggcagccacatccacagccagacagctggccaccacctgcccccacctcctcctcctcctggccctgccccccaccaccaccccccaccccaccccagcacaggcctgcagggcctgcaggcccagcaccagcacgtggtgaacagcgcccctcctcctcctcctcctcctccacccagctctgtgctggccagcggccaccacaccaccagcgcccaggccctgcaccaccccccccaccagggccccccactcttccccagcagcgcccaccccaccgtgcccccctaccccagccaggccacccaccacaccaccctgggccctggcccccagcaccagcccagcggcaccggcccccactgccccctgcctgtgacaggcccccacctgcagccccagggccccaacagcatccccacccccacagccagcggcttctgcccccaccctggctctgtggccctgccccacggcgtgcagggcccccagcaggccagccctgtgcccggccagatccccatccaccgggcccaggtgccccccaccttccagaacaactaccacggcagcggctggcactag

SEQ ID NO: 160658 - DNA, 5577 bp, Artificial Sequence; identical to SEQ ID NO: 160657
  Description of Artificial Sequence: Synthetic coding sequence

SEQ ID NO: 160659 - DNA, 5451 bp, Artificial Sequence
  Description of Artificial Sequence: Synthetic coding sequence
atgagcatcgtcatccccctgggcgtggacacagctgagaccagctacctggagatggctgctggcagcgagcctgagagcgtggaggccagccctgtggtggtggagaagagcaacagctacccccaccagctgtacaccagcagcagccaccacagccacagctacatcggcctgccctatgctgaccacaactacggggcccggcccccacccaccccaccagccagccccccaccttctgtgctgatcagcaagaatgaggtgggcatcttcaccacccccaactttgatgagaccagcagcgccaccaccatcagcaccagtgaagatggcagctatggaacagatgtgacccgctgcatctgtggcttcacccatgatgatggctacatgatctgctgtgacaagtgcagcgtgtggcagcacatcgactgcatgggcatcgaccggcagcacatcccagacacctacctgtgtgagcgctgccagcccaggaacctggacaaggagagagctgtgctgctgcagaggaggaagcgggagaacatgtctgatggagacaccagcgccacagagagcggagatgaggtgcctgtggagctgtacacagccttccagcacacccccaccagcatcaccctgacagccagccgggtgtccaaggtgaatgacaagaggaggaagaagtctggagagaaggagcagcacatcagcaagtgcaagaaggccttccgggagggcagcaggaagagcagccgggtgaagggcagcgcccctgagattgaccccagcagtgatggcagcaactttggctgggagaccaagatcaaggcctggatggacagatatgaggaggccaacaacaaccagtacagcgagggcgtgcagcgggaggcccagagaattgccctgcggctgggcaatggaaatgacaagaaggagatgaacaagagtgacctgaacaccaacaacctgctcttcaagccccctgtggagagccacatccagaagaacaagaagatcctgaagagcgccaaggacctgcccccagatgccctgatcatcgagtaccggggcaagttcatgctgcgggagcagtttgaggccaacggctacttcttcaagaggccctacccctttgtgctcttctacagcaagttccacggcctggagatgtgtgtggatgcccggacctttggaaatgaggcccgcttcatccgccgcagctgcaccccaaatgctgaggtgagacatgagatccaggacggcaccatccacctgtacatctacagcatccacagcatccccaagggcacagagatcaccatcgcctttgattttgattatggcaactgcaagtacaaggtggactgtgcctgcctgaaggagaacccagaatgtcctgtgctgaagaggagcagcgagagcatggagaacatcaacagcggctatgagaccaggaggaagaagggcaagaaggacaaggacatcagcaaggagaaggacacccagaaccagaacatcaccctggactgtgagggcaccaccaacaagatgaagagccctgagaccaagcagaggaagctgagccccctgcggctgtctgtgagcaacaaccaggagccagacttcattgatgacatcgaggagaagacccccatcagcaatgaggtggagatggagagcgaggagcagattgctgagaggaagaggaagatgacccgggaggagaggaagatggaggccatcctgcaggcctttgcccggctggagaagcgggagaagagaagagagcaggccctggagcgcatcagcacagccaagacagaggtgaagacagagtgcaaggacacccagatcgtgtctgatgctgaggtgatccaggagcaggccaaggaggagaatgccagcaagcccaccccagccaaggtgaacagaaccaagcagaggaagagcttcagccgcagcaggacccacatcggccagcagaggcggcggcacaggacagtgtccatgtgcagcgacatccagcccagcagcccagacatcgaggtgaccagccagcagaatgacatcgagaacacagtgctgaccatcgagcctgagacagaaacagccctggccgagatcatcacagaaacagaggtgcctgccctgaacaagtgccccaccaagtaccccaagaccaagaagcacctggtgaatgagtggctgtctgagaagaatgagaagacaggcaagcccagtgatggcctgtctgagcggcccctgcgcatcaccacagatcctgaggtgctggccacccagctgaacagcctgcccggcctgacctacagcccccacgtgtacagcacccccaagcactacatccgcttcaccagccccttcctgtctgagaagagaagaaggaaggagcccacagagaacatcagcggcagctgcaagaagcgctggctgaagcaggccctggaggaggagaacagcgccatcctgcaccgcttcaacagcccctgccaggagaggagccgcagccctgctgtgaatggagagaacaagagccccctgctgctgaatgacagctgcagcctgcctgacctgaccacccccctgaagaagaggcgcttctaccagctgctggacagcgtgtacagcgagaccagcacccccacccccagcccctatgccacccccacccacacagacatcacccccatggaccccagctttgccaccccaccccgcatcaagagtgatgatgagacctgcagaaatggctacaagcccatctacagccctgtgacccctgtgaccccaggcaccccaggcaacaccatgcactttgagaacatcagcagccctgagagcagccctgagatcaagaggaggacctacagccaggagggctatgacaggagcagcaccatgctgaccctgggccccttcaggaacagcaacctgacagagctgggcctgcaggagatcaagaccatcggctacaccagccccaggagcaggacagaggtgaaccggcagtgccctggagagaaggagcctgtgtctgacctgcagctgggcctggatgctgtggagcccacagccctgcacaagaccctggagaccccagcccatgacagagctgagcccaacagccagctggacagcacccacagcggccggggcaccatgtacagctcctgggtgaagagcccagacagaactggagtgaacttctctgtgaacagcaacctgcgggacctgacccccagccaccagctggaggtgggcggcggcttccgcatcagcgagagcaagtgcctgatgcaggatgacacccggggcatgttcatggagaccaccgtcttctgcaccagtgaagatggcctggtgtctggctttggaagaacagtgaatgacaacctgattgatggcaactgcaccccccagaaccccccccagaagaagaaggtgtccctgctggagtacaggaagaggcagcgggaggccaggaagagcggcagcaagacagagaacttccccctcatctctgtgagcccccacgccagcggcagcctgagcaacaatggagatggctgtgccagcagcaatgacaatggagagcaggtggaccacacagccagcctgcccctgcccaccccagccaccgtgtacaatgccaccagcgaggagaccagcaacaactgccctgtgaaggatgccacagccagcgagaagaatgaacctgaggtgcagtggacagccagcacctctgtggagcaggtgcgggagaggagctaccagagggccctgctgctgagtgaccacaggaaggacaaggacagcgaccctgaccctgagaaccctgagcccaccaccaccaatgaatgtcccagcccagacaccagccagaacacctgcaagagcccccccaagatgagcaagccaggcagccctggcagcgtcatcccagcccaggcccacggcaagatcttcaccaagccagacccccagtgggacagcacagtgtctgccagcgaggccgagaatggagtgcacctgaagacagagctgcagcagaagcagctgagcaacaacaaccaggccctgagcaagaaccaccccccccagacccacgtgaggaacagcagcgagcagctgagccagaagctgcccagcgtgcccaccaagctgcactgcccccccagcccccacctggagaacccccccaagagcagcaccccccacacccctgtgcagcacggctacctgagccccaagccacccagccagcagctgggcagcccctaccggccccaccacagccagagcccccaggtgggcaccccccagcgggagccccagaggaacttctacccagctgcccagaacctgcctgccaacacccagcaggccaccagcggcaccctcttcacccagacccccagcggccagagcagcgccacctacagccagttcaaccagcagagcctgaacagcacagcccctcctcctcctcctcctcctccacccagcagcagctactaccagaaccagcagcccagcgccaacttccagaactacaaccagctgaagggcagcctgagccagcagaccgtcttcaccagcggccccaaccaggccctgcccggcaccaccagccagcagacagtgcccggccaccacgtgaccccaggccacttcctgcccagccagaaccccaccatccaccaccagacagctgctgctgtggtgcccccacctcctcctcctcctccagcccctggcccccacctggtgcagcagcccaacagccaccagcagcacagcgtggcccacgtggtgggccctgtgcatgctgtgaccccaggcagccacatccacagccagacagctggccaccacctgcccccacctcctcctcctcctggccctgccccccaccaccaccccccaccccaccccagcacaggcctgcagggcctgcaggcccagcaccagcacgtggtgaacagcgcccctcctcctcctcctcctcctccacccagctctgtgctggccagcggccaccacaccaccagcgcccaggccctgcaccaccccccccaccagggccccccactcttccccagcagcgcccaccccaccgtgcccccctaccccagccaggccacccaccacaccaccctgggccctggcccccagcaccagcccagcggcaccggcccccactgccccctgcctgtgacaggcccccacctgcagccccagggccccaacagcatccccacccccacagccagcggcttctgcccccaccctggctctgtggccctgccccacggcgtgcagggcccccagcaggccagccctgtgcccggccagatccccatccaccgggcccaggtgccccccaccttccagaacaactaccacggcagcggctggcactag

SEQ ID NO: 160660 - DNA, 1770 bp, Artificial Sequence
  Description of Artificial Sequence: Synthetic coding sequence
atgcactttgagaacatcagcagccctgagagcagccctgagatcaagaggaggacctacagccaggagggctatgacaggagcagcaccatgctgaccctgggccccttcaggaacagcaacctgacagagctgggcctgcaggagatcaagaccatcggctacaccagccccaggagcaggacagaggtgaaccggcagtgccctggagagaaggagcctgtgtctgacctgcagctgggcctggatgctgtggagcccacagccctgcacaagaccctggagaccccagcccatgacagagctgagcccaacagccagctggacagcacccacagcggccggggcaccatgtacagctcctgggtgaagagcccagacagaactggagtgaacttctctgtgaacagcaacctgcgggacctgacccccagccaccagctggaggtgggcggcggcttccgcatcagcgagagcaagtgcctgatgcaggatgacacccggggcatgttcatggagaccaccgtcttctgcaccagtgaagatggcctggtgtctggcttcggccgcacagtgaatgacaacctgattgatggcaactgcaccccccagaaccccccccagaagaagaaggtgtccctgctggagtacaggaagaggcagcgggaggccaggaagagcggcagcaagacagagaacttccccctcatctctgtgagcccccacgccagcggcagcctgagcaacaatggagatggctgtgccagcagcaatgacaacggggagcaggtggaccacacagccagcctgcccctgcccaccccagccaccgtgtacaatgccaccagcgaggagaccagcaacaactgccctgtgaaggatgccacagccagcgagaagaatgaacctgaggtgcagtggacagccagcacctctgtggagcaggtgcgggagaggagctaccagagggccctgctgctgagtgaccacaggaaggacaaggacagcggcggggagagcccctgtgtgtcctgcagccccagccacgtgcagagcagccccagcagccacagcaaccacatcccccagctgcaggccaagggccctgtgcccagcttcagcgagctgatggaggaccctgaccctgaaaatcctgagcccaccaccaccaatgaatgtcccagcccagacaccagccagaacacctgcaagagcccccccaagatgagcaagccaggcagccctggcagcgtcatcccagcccaggcccacggcaagatcttcaccaagccagacccccagtgggacagcacagtgtctgccagcgaggctgaaaatggagtgcacctgaagacagagctgcagcagaagcagctgagcaacaacaaccaggccctgagcaagaaccaccccccccagacccacgtgaggaacagcagcgagcagctgagccagaagctgcccagcgtgcccaccaagctgcactgcccccccagcccccacctggagaacccccccaagagcagcaccccccacacccctgtgcagcacggctacctgagccccaagccacccagccagcagctgggcagcccctaccggccccaccacagccagagcccccaggtgggcaccccccagcgggagccccagaggaacttctacccagctgcccagaacctgcctgccaacacccagcaggccaccagcggcaccctcttcacccagaccccatctggccagagcagcgccacctacacccagaggtag

SEQ ID NO: 160661 - DNA, 5337 bp, Artificial Sequence
  Description of Artificial Sequence: Synthetic coding sequence
atgagcatcgtcatccccctgggcgtggacacagctgagaccagctacctggagatggctgctggcagcgagcctgagagcgtggaggccagccctgtggtggtggagaagagcaacagctacccccaccagctgtacaccagcagcagccaccacagccacagctacatcggcctgccctatgctgaccacaactacggggcccggcccccacccaccccaccagccagccccccaccttctgtgctgatcagcaagaatgaggtgggcatcttcaccacccccaactttgatgagaccagcagcgccaccaccatcagcaccagtgaagatggcagctatggaacagatgtgacccgctgcatctgtggcttcacccatgatgatggctacatgatctgctgtgacaagtgcagcgtgtggcagcacatcgactgcatgggcatcgaccggcagcacatcccagacacctacctgtgtgagcgctgccagcccaggaacctggacaaggagagagctgtgctgctgcagaggaggaagcgggagaacatgtctgatggagacaccagcgccacagagagcggagatgaggtgcctgtggagctgtacacagccttccagcacacccccaccagcatcaccctgacagccagccgggtgtccaaggtgaatgacaagaggaggaagaagtctggagagaaggagcagcacatcagcaagtgcaagaaggccttccgggagggcagcaggaagagcagccgggtgaagggcagcgcccctgagattgaccccagcagtgatggcagcaactttggctgggagaccaagatcaaggcctggatggacagatatgaggaggccaacaacaaccagtacagcgagggcgtgcagcgggaggcccagagaattgccctgcggctgggcaatggaaatgacaagaaggagatgaacaagagtgacctgaacaccaacaacctgctcttcaagccccctgtggagagccacatccagaagaacaagaagatcctgaagagcgccaaggacctgcccccagatgccctgatcatcgagtaccggggcaagttcatgctgcgggagcagtttgaggccaacggctacttcttcaagaggccctacccctttgtgctcttctacagcaagttccacggcctggagatgtgtgtggatgcccggacctttggaaatgaggcccgcttcatccgccgcagctgcaccccaaatgctgaggtgagacatgagatccaggacggcaccatccacctgtacatctacagcatccacagcatccccaagggcacagagatcaccatcgcctttgattttgattatggcaactgcaagtacaaggtggactgtgcctgcctgaaggagaacccagaatgtcctgtgctgaagaggagcagcgagagcatggagaacatcaacagcggctatgagaccaggaggaagaagggcaagaagacccgggaggagaggaagatggaggccatcctgcaggcctttgcccggctggagaagcgggagaagagaagagagcaggccctggagcgcatcagcacagccaagacagaggtgaagacagagtgcaaggacacccagatcgtgtctgatgctgaggtgatccaggagcaggccaaggaggagaatgccagcaagcccaccccagccaaggtgaacagaaccaagcagaggaagagcttcagccgcagcaggacccacatcggccagcagaggcggcggcacaggacagtgtccatgtgcagcgacatccagcccagcagcccagacatcgaggtgaccagccagcagaatgacatcgagaacacagtgctgaccatcgagcctgagacagaaacagccctggccgagatcatcacagaaacagaggtgcctgccctgaacaagtgccccaccaagtaccccaagaccaagaagcacctggtgaatgagtggctgtctgagaagaatgagaagacaggcaagcccagtgatggcctgtctgagcggcccctgcgcatcaccacagatcctgaggtgctggccacccagctgaacagcctgcccggcctgacctacagcccccacgtgtacagcacccccaagcactacatccgcttcaccagccccttcctgtctgagaagagaagaaggaaggagcccacagagaacatcagcggcagctgcaagaagcgctggctgaagcaggccctggaggaggagaacagcgccatcctgcaccgcttcaacagcccctgccaggagaggagccgcagccctgctgtgaatggagagaacaagagccccctgctgctgaatgacagctgcagcctgcctgacctgaccacccccctgaagaagaggcgcttctaccagctgctggacagcgtgtacagcgagaccagcacccccacccccagcccctatgccacccccacccacacagacatcacccccatggaccccagctttgccaccccaccccgcatcaagagtgatgatgagacctgcagaaatggctacaagcccatctacagccctgtgacccctgtgaccccaggcaccccaggcaacaccatgcactttgagaacatcagcagccctgagagcagccctgagatcaagaggaggacctacagccaggagggctatgacaggagcagcaccatgctgaccctgggccccttcaggaacagcaacctgacagagctgggcctgcaggagatcaagaccatcggctacaccagccccaggagcaggacagaggtgaaccggcagtgccctggagagaaggagcctgtgtctgacctgcagctgggcctggatgctgtggagcccacagccctgcacaagaccctggagaccccagcccatgacagagctgagcccaacagccagctggacagcacccacagcggccggggcaccatgtacagctcctgggtgaagagcccagacagaactggagtgaacttctctgtgaacagcaacctgcgggacctgacccccagccaccagctggaggtgggcggcggcttccgcatcagcgagagcaagtgcctgatgcaggatgacacccggggcatgttcatggagaccaccgtcttctgcaccagtgaagatggcctggtgtctggctttggaagaacagtgaatgacaacctgattgatggcaactgcaccccccagaaccccccccagaagaagaaggtgtccctgctggagtacaggaagaggcagcgggaggccaggaagagcggcagcaagacagagaacttccccctcatctctgtgagcccccacgccagcggcagcctgagcaacaatggagatggctgtgccagcagcaatgacaatggagagcaggtggaccacacagccagcctgcccctgcccaccccagccaccgtgtacaatgccaccagcgaggagaccagcaacaactgccctgtgaaggatgccacagccagcgagaagaatgaacctgaggtgcagtggacagccagcacctctgtggagcaggtgcgggagaggagctaccagagggccctgctgctgagtgaccacaggaaggacaaggacagcggcggggagagcccctgtgtgtcctgcagccccagccacgtgcagagcagccccagcagccacagcaaccacatcccccagctgcaggccaagggccctgtgcccagcttcagcgagctgatggaggaccctgaccctgagaaccctgagcccaccaccaccaatgaatgtcccagcccagacaccagccagaacacctgcaagagcccccccaagatgagcaagccaggcagccctggcagcgtcatcccagcccaggcccacggcaagatcttcaccaagccagacccccagtgggacagcacagtgtctgccagcgaggccgagaatggagtgcacctgaagacagagctgcagcagaagcagctgagcaacaacaaccaggccctgagcaagaaccaccccccccagacccacgtgaggaacagcagcgagcagctgagccagaagctgcccagcgtgcccaccaagctgcactgcccccccagcccccacctggagaacccccccaagagcagcaccccccacacccctgtgcagcacggctacctgagccccaagccacccagccagcagctgggcagcccctaccggccccaccacagccagagcccccaggtgggcaccccccagcgggagccccagaggaacttctacccagctgcccagaacctgcctgccaacacccagcaggccaccagcggcaccctcttcacccagacccccagcggccagagcagcgccacctacagccagttcaaccagcagagcctgaacagcacagcccctcctcctcctcctcctcctccacccagcagcagctactaccagaaccagcagcccagcgccaacttccagaactacaaccagctgaagggcagcctgagccagcagaccgtcttcaccagcggccccaaccaggccctgcccggcaccaccagccagcagacagtgcccggccaccacgtgaccccaggccacttcctgcccagccagaaccccaccatccaccaccagacagctgctgctgtggtgcccccacctcctcctcctcctccagcccctggcccccacctggtgcagcagcccaacagccaccagcagcacagcgtggcccacgtggtgggccctgtgcatgctgtgaccccaggcagccacatccacagccagacagctggccaccacctgcccccacctcctcctcctcctggccctgccccccaccaccaccccccaccccaccccagcacaggcctgcagggcctgcaggcccagcaccagcacgtggtgaacagcgcccctcctcctcctcctcctcctccacccagctctgtgctggccagcggccaccacaccaccagcgcccaggccctgcaccaccccccccaccagggccccccactcttccccagcagcgcccaccccaccgtgcccccctaccccagccaggccacccaccacaccaccctgggccctggcccccagcaccagcccagcggcaccggcccccactgccccctgcctgtgacaggcccccacctgcagccccagggccccaacagcatccccacccccacagccagcggcttctgcccccaccctggctctgtggccctgccccacggcgtgcagggcccccagcaggccagccctgtgcccggccagatccccatccaccgggcccaggtgccccccaccttccagaacaactaccacggcagcggctggcactag

SEQ ID NO: 160662 - DNA, 4962 bp, Artificial Sequence
  Description of Artificial Sequence: Synthetic coding sequence
atgagcatcgtcatccccctgggcgtggacacagctgagaccagctacctggagatggctgctggcagcgagcctgagagcgtggaggccagccctgtggtggtggagaagagcaacagctacccccaccagctgtacaccagcagcagccaccacagccacagctacatcggcctgccctatgctgaccacaactacggggcccggcccccacccaccccaccagccagccccccaccttctgtgctgatcagcaagaatgaggtgggcatcttcaccacccccaactttgatgagaccagcagcgccaccaccatcagcaccagtgaagatggcagctatggaacagatgtgacccgctgcatctgtggcttcacccatgatgatggctacatgatctgctgtgacaagtgcagcgtgtggcagcacatcgactgcatgggcatcgaccggcagcacatcccagacacctacctgtgtgagcgctgccagcccaggaacctggacaaggagagagctgtgctgctgcagaggaggaagcgggagaacatgtctgatggagacaccagcgccacagagagcggagatgaggtgcctgtggagctgtacacagccttccagcacacccccaccagcatcaccctgacagccagccgggtgtccaaggtgaatgacaagaggaggaagaagtctggagagaaggagcagcacatcagcaagtgcaagaaggccttccgggagggcagcaggaagagcagccgggtgaagggcagcgcccctgagattgaccccagcagtgatggcagcaactttggctgggagaccaagatcaaggcctggatggacagatatgaggaggccaacaacaaccagtacagcgagggcgtgcagcgggaggcccagagaattgccctgcggctgggcaatggaaatgacaagaaggagatgaacaagagtgacctgaacaccaacaacctgctcttcaagccccctgtggagagccacatccagaagaacaagaagatcctgaagagcgccaaggacctgcccccagatgccctgatcatcgagtaccggggcaagttcatgctgcgggagcagtttgaggccaacggctacttcttcaagaggccctacccctttgtgctcttctacagcaagttccacggcctggagatgtgtgtggatgcccggacctttggaaatgaggcccgcttcatccgccgcagctgcaccccaaatgctgaggtgagacatgagatccaggacggcaccatccacctgtacatctacagcatccacagcatccccaagggcacagagatcaccatcgcctttgattttgattatggcaactgcaagtacaaggtggactgtgcctgcctgaaggagaacccagaatgtcctgtgctgaagaggagcagcgagagcatggagaacatcaacagcggctatgagaccaggaggaagaagggcaagaaggacaaggacatcagcaaggagaaggacacccagaaccagaacatcaccctggactgtgagggcaccaccaacaagatgaagagccctgagaccaagcagaggaagctgagccccctgcggctgtctgtgagcaacaaccaggagccagacttcattgatgacatcgaggagaagacccccatcagcaatgaggtggagatggagagcgaggagcagattgctgagaggaagaggaagatgacccgggaggagaggaagatggaggccatcctgcaggcctttgcccggctggagaagcgggagaagagaagagagcaggccctggagcgcatcagcacagccaagacagaggtgaagacagagtgcaaggacacccagatcgtgtctgatgctgaggtgatccaggagcaggccaaggaggagaatgccagcaagcccaccccagccaaggtgaacagaaccaagcagaggaagagcttcagccgcagcaggacccacatcggccagcagaggcggcggcacaggacagtgtccatgtgcagcgacatccagcccagcagcccagacatcgaggtgaccagccagcagaatgacatcgagaacacagtgctgaccatcgagcctgagacagaaacagccctggccgagatcatcacagaaacagaggtgcctgccctgaacaagtgccccaccaagtaccccaagaccaagaagcacctggtgaatgagtggctgtctgagaagaatgagaagacaggcaagcccagtgatggcctgtctgagcggcccctgcgcatcaccacagatcctgaggtgctggccacccagctgaacagcctgcccggcctgacctacagcccccacgtgtacagcacccccaagcactacatccgcttcaccagccccttcctgtctgagaagagaagaaggaaggagcccacagagaacatcagcggcagctgcaagaagcgctggctgaagcaggccctggaggaggagaacagcgccatcctgcaccgcttcaacagcccctgccaggagaggagccgcagccctgctgtgaatggagagaacaagagccccctgctgctgaatgacagctgcagcctgcctgacctgaccacccccctgaagaagaggcgcttctaccagctgctggacagcgtgtacagcgagaccagcacccccacccccagcccctatgccacccccacccacacagacatcacccccatggaccccagctttgccaccccaccccgcatcaagagtgatgatgagacctgcagaaatggctacaagcccatctacagccctgtgacccctgtgaccccaggcaccccaggcaacaccatgcactttgagaacatcagcagccctgagagcagccctgagatcaagaggaggacctacagccaggagggctatgacaggagcagcaccatgctgaccctgggccccttcaggaacagcaacctgacagagctgggcctgcaggagatcaagaccatcggctacaccagccccaggagcaggacagaggtgaaccggcagtgccctggagagaaggagcctgtgtctgacctgcagctgggcctggatgctgtggagcccacagccctgcacaagaccctggagaccccagcccatgacagagctgagcccaacagccagctggacagcacccacagcggccggggcaccatgtacagctcctgggtgaagagcccagacagaactggagtgaacttctctgtgaacagcaacctgcgggacctgacccccagccaccagctggaggtgggcggcggcttccgcatcagcgagagcaagtgcctgatgcaggatgacacccggggcatgttcatggagaccaccgtcttctgcaccagtgaagatggcctggtgtctggctttggaagaacagtgaatgacaacctgattgatggcaactgcaccccccagaaccccccccagaagaagaaggtgtccctgctggagtacaggaagaggcagcgggaggccaggaagagcggcagcaagacagagaacttccccctcatctctgtgagcccccacgccagcggcagcctgagcaacaatggagatggctgtgccagcagcaatgacaatggagagcaggtggaccacacagccagcctgcccctgcccaccccagccaccgtgtacaatgccaccagcgaggagaccagcaacaactgccctgtgaaggatgccacagccagcgagaagaatgaacctgaggtgcagtggacagccagcacctctgtggagcaggtgcgggagaggagctaccagagggccctgctgctgagtgaccacaggaaggacaaggacagcggcggggagagcccctgtgtgtcctgcagccccagccacgtgcagagcagccccagcagccacagcaaccacatcccccagctgcaggccaagggccctgtgcccagcttcagcgagctgatggaggaccctgaccctgagaaccctgagcccaccaccaccaatgaatgtcccagcccagacaccagccagaacacctgcaagagcccccccaagatgagcaagccaggcagccctggcagcgtcatcccagcccaggcccacggcaagatcttcaccaagccagacccccagtgggacagcacagtgtctgccagcgaggccgagaatggagtgcacctgaagacagagctgcagcagaagcagctgagcaacaacaaccaggccctgagcaagaaccaccccccccagacccacgtgaggaacagcagcgagcagctgagccagaagctgcccagcgtgcccaccaagctgcactgcccccccagcccccacctggagaacccccccaagagcagcaccccccacacccctgtgcagcacggctacctgagccccaagccacccagccagcagctgggcagcccctaccggccccaccacagccagagcccccaggtgggcaccccccagcgggagccccagaggaacttctacccagctgcccagaacctgcctgtgttctggctgctgggcatcatcccccaccagctgaagccctacaccacccacctgatcaaggacctgcacttcttcctgcgggtgctgatccagctgtaccaccgcatcccccacaagctgcacatcatccccctgtgggaccgggaccccagcaccagcctgctggagcagggccacatcgtgcactacctgagccaggtgctgatcagcagccccaaggaccagaccgtcttccagcacctgctgctgcagggctctgtgctgatcctggccctgtggccctgccacatgggcttcaaggacctgagccgccacctgcagtgcctggaccgcttccagttcacagagcaccgctgccaccagcacttcaagaccatcaccatgggccagggcggcatcaagatggacagcaagaacatcttcctgaatgtgctgtag

SEQ ID NO: 160663 - DNA, 378 bp, Artificial Sequence
  Description of Artificial Sequence: Synthetic coding sequence
tgaggaagcctgagcaacaatggagatggctgtgccagcagcaatgacaatggagagcaggtggaccacacagccagcctgcccctgcccaccccagccaccgtgtacaatgccaccagcgaggagaccagcaacaactgccctgtgaaggatgccacagccagcgagaagaatgaacctgaggtgcagtggacagccagcacctctgtggagcaggtgcgggagaggagctaccagagggccctgctgctgagtgaccacaggaaggacaaggacagcgaccctgaccctgagaaccctgagcccaccaccaccaatgaatgtcccagcccagacaccagccagaacacctgcaagagcccccccaagatgtcctag

SEQ ID NO: 160664 - DNA, 216 bp, Artificial Sequence
  Description of Artificial Sequence: Synthetic coding sequence
atgagcatcgtcatccccctgggcgtggacacagctgagaccagctacctggagatggctgctggcagcgagcctgagagcgtggaggccagccctgtggtggtggagaagagcaacagctacccccaccagctgtacaccagcagcagccaccacagccacagctacatcggcctgccctatgctgaccacaactacggggcccggcccccatag

SEQ ID NO: 160665 - DNA, 1830 bp, Artificial Sequence
  Description of Artificial Sequence: Synthetic coding sequence
atgagcatcgtcatccccctgggcgtggacacagctgagaccagctacctggagatggctgctggcagcgagcctgagagcgtggaggccagccctgtggtggtggagaagagcaacagctacccccaccagctgtacaccagcagcagccaccacagccacagctacatcggcctgccctatgctgaccacaactacggggcccggcccccacccaccccaccagccagccccccaccttctgtgctgatcagcaagaatgaggtgggcatcttcaccacccccaactttgatgagaccagcagcgccaccaccatcagcaccagtgaagatggcagctatggaacagatgtgacccgctgcatctgtggcttcacccatgatgatggctacatgatctgctgtgacaagtgcagcgtgtggcagcacatcgactgcatgggcatcgaccggcagcacatcccagacacctacctgtgtgagcgctgccagcccaggaacctggacaaggagagagctgtgctgctgcagaggaggaagcgggagaacatgtctgatggagacaccagcgccacagagagcggagatgaggtgcctgtggagctgtacacagccttccagcacacccccaccagcatcaccctgacagccagccgggtgtccaaggtgaatgacaagaggaggaagaagtctggagagaaggagcagcacatcagcaagtgcaagaaggccttccgggagggcagcaggaagagcagccgggtgaagggcagcgcccctgagattgaccccagcagtgatggcagcaactttggctgggagaccaagatcaaggcctggatggacagatatgaggaggccaacaacaaccagtacagcgagggcgtgcagcgggaggcccagagaattgccctgcggctgggcaatggaaatgacaagaaggagatgaacaagagtgacctgaacaccaacaacctgctcttcaagccccctgtggagagccacatccagaagaacaagaagatcctgaagagcgccaaggacctgcccccagatgccctgatcatcgagtaccggggcaagttcatgctgcgggagcagtttgaggccaacggctacttcttcaagaggccctacccctttgtgctcttctacagcaagttccacggcctggagatgtgtgtggatgcccggacctttggaaatgaggcccgcttcatccgccgcagctgcaccccaaatgctgaggtgagacatgagatccaggacggcaccatccacctgtacatctacagcatccacagcatccccaagggcacagagatcaccatcgcctttgattttgattatggcaactgcaagtacaaggtggactgtgcctgcctgaaggagaacccagaatgtcctgtgctgaagaggagcagcgagagcatggagaacatcaacagcggctatgagaccaggaggaagaagggcaagaaggacaaggacatcagcaaggagaaggacacccagaaccagaacatcaccctggactgtgagggcaccaccaacaagatgaagagccctgagaccaagcagaggaagctgagccccctgcggctgtctgtgagcaacaaccaggagccagacttcattgatgacatcgaggagaagacccccatcagcaatgaggtggagatggagagcgaggagcagattgctgagaggaagaggaagatggtgtcctgggaggccagcagcctgggcctggtgacagctgccctgcacatggtgattgtggccgccttcacctgggccttcaccctcttctttgaggtgtctgagtag

SEQ ID NO: 160666 - DNA, 693 bp, Artificial Sequence
  Description of Artificial Sequence: Synthetic coding sequence
atgagcatcgtcatccccctgggcgtggacacagctgagaccagctacctggagatggctgctggcagcgagcctgagagcgtggaggccagccctgtggtggtggagaagagcaacagctacccccaccagctgtacaccagcagcagccaccacagccacagctacatcggcctgccctatgctgaccacaactacggggcccggcccccacccaccccaccagccagccccccaccttctgtgctgatcagcaagaatgaggtgggcatcttcaccacccccaactttgatgagaccagcagcgccaccaccatcagcaccagtgaagatggcagctatggaacagatgtgacccgctgcatctgtggcttcacccatgatgatggctacatgatctgctgtgacaagtgcagcgtgtggcagcacatcgactgcatgggcatcgaccggcagcacatcccagacacctacctgtgtgagcgctgccagcccaggaacctggacaaggagagagctgtgctgctgcagaggaggaagcgggagaacatgtctgatggagacaccagcgccacagagagcggagatgaggtgcctgtggagctgtacacagccttccagcacacccccaccagcatcaccctgacagccagccgggtgtccaaggtgaatgacaagaggaggaagaagtag

SEQ ID NO: 160667 - DNA, 1362 bp, Artificial Sequence
  Description of Artificial Sequence: Synthetic coding sequence
atggtgctggtgctgagtgacaccagcgccagccccccaccttctgtgctgatcagcaagaatgaggtgggcatcttcaccacccccaactttgatgagaccagcagcgccaccaccatcagcaccagtgaagatggcagctatggaacagatgtgacccgctgcatctgtggcttcacccatgatgatggctacatgatctgctgtgacaagtgcagcgtgtggcagcacatcgactgcatgggcatcgaccggcagcacatcccagacacctacctgtgtgagcgctgccagcccaggaacctggacaaggagagagctgtgctgctgcagaggaggaagcgggagaacatgtctgatggagacaccagcgccacagagagcggagatgaggtgcctgtggagctgtacacagccttccagcacacccccaccagcatcaccctgacagccagccgggtgtccaaggtgaatgacaagaggaggaagaagtctggagagaaggagcagcacatcagcaagtgcaagaaggccttccgggagggcagcaggaagagcagccgggtgaagggcagcgcccctgagattgaccccagcagtgatggcagcaactttggctgggagaccaagatcaaggcctggatggacagatatgaggaggccaacaacaaccagtacagcgagggcgtgcagcgggaggcccagagaattgccctgcggctgggcaatggaaatgacaagaaggagatgaacaagagtgacctgaacaccaacaacctgctcttcaagccccctgtggagagccacatccagaagaacaagaagatcctgaagagcgccaaggacctgcccccagatgccctgatcatcgagtaccggggcaagttcatgctgcgggagcagtttgaggccaacggctacttcttcaagaggccctacccctttgtgctcttctacagcaagttccacggcctggagatgtgtgtggatgcccggacctttggaaatgaggcccgcttcatccgccgcagctgcaccccaaatgctgaggtgagacatgagatccaggacggcaccatccacctgtacatctacagcatccacagcatccccaagggcacagagatcaccatcgcctttgattttgattatggcaactgcaagtacaaggtggactgtgcctgcctgaaggagaacccagaatgtcctgtgctgaagaggagcagcgagagcatggagaacatcaacagcggctatgagaccaggaggaagaagggcaagaagaccaagatcttccagaagaagaagatccacaagatccgcatcctgctgtggatcgtgaaggagcggcccaccaagtag

SEQ ID NO: 160668 - DNA, 969 bp, Artificial Sequence
  Description of Artificial Sequence: Synthetic coding sequence
atgcctgtgacagtgaccaggaccaccatcaccaccaccaccaccagcagcagcggcctgggcagccccatgattgtgggcagcccccgggccctgacccagcccctgggcctgctgcggctgctgcagctggtgtccacctgtgtggccttcagcctggtggcctctgtgggcgcctggacaggctccatgggcaactggagcatgttcacctggtgcttctgcttctctgtgaccctcatcatcctgattgtggagctgtgtggcctgcaggcccgcttccccctgtcctggaggaacttccccatcacctttgcctgctatgctgccctcttctgcctgagcgccagcatcatctaccccaccacctacgtgcagttcctgagccacggccgcagccgggaccacgccatcgccgccaccttcttcagctgcatcgcctgtgtggcctatgccacagaggtggcctggacccgggcccggcctggagagatcaccggctacatggccaccgtgcccggcctgctgaaggtgctggagacctttgtggcctgcatcatctttgccttcatcagtgaccccaacctgtaccagcaccagcctgccctggagtggtgtgtggccgtgtatgccatctgcttcatcctggccgccatcgccatcctgctgaacctgggagaatgtaccaacgtgctgcccatccccttccccagcttcctgagcggcctggccctgctgtctgtgctgctgtatgccacagccctggtgctgtggcccctgtaccagtttgatgagaagtatggaggccagccccggcgcagcagagatgtgtcctgcagccgcagccacgcctactacgtgtgtgcctgggaccggcggctggccgtggccatcctgacagccatcaacctgctggcctacgtggccgacctggtgcacagcgcccacctggtgtttgtgaaggtgtag

SEQ ID NO: 160669 - DNA, 969 bp, Artificial Sequence; identical to SEQ ID NO: 160668
  Description of Artificial Sequence: Synthetic coding sequence

SEQ ID NO: 160670 - DNA, 969 bp, Artificial Sequence; identical to SEQ ID NO: 160668
  Description of Artificial Sequence: Synthetic coding sequence

SEQ ID NO: 160671 - DNA, 969 bp, Artificial Sequence; identical to SEQ ID NO: 160668
  Description of Artificial Sequence: Synthetic coding sequence

SEQ ID NO: 160672 - DNA, 969 bp, Artificial Sequence; identical to SEQ ID NO: 160668
  Description of Artificial Sequence: Synthetic coding sequence

SEQ ID NO: 160673 - DNA, 444 bp, Artificial Sequence
  Description of Artificial Sequence: Synthetic coding sequence
atgcctgtgacagtgaccaggaccaccatcaccaccaccaccaccagcagcagcggcctgggcagccccatgattgtgggcagcccccgggccctgacccagcccctgggcctgctgcggctgctgcagctggtgtccacctgtgtggccttcagcctggtggcctctgtgggcgcctggacaggctccatgggcaactggagcatgttcacctggtgcttctgcttctctgtgaccctcatcatcctgattgtggagctgtgtggcctgcaggcccgcttccccctgtcctggaggaacttccccatcacctttgcctgctatgctgccctcttctgcctgagcgccagcatcatctaccccaccacctacgtgcagttcctgagccacggccgcagccgggaccacgccatcgccgccaccttcttcagctgcatcgcctag

SEQ ID NO: 160674 - DNA, 858 bp, Artificial Sequence
  Description of Artificial Sequence: Synthetic coding sequence
atgcctgtgacagtgaccaggaccaccatcaccaccaccaccaccagcagcagcggcctgggcagccccatgattgtgggcagcccccgggccctgacccagcccctgggcctgctgcggctgctgcagctggtgtccacctgtgtggccttcagcctggtggcctctgtgggcgcctggacaggctccatgggcaactggagcatgttcacctggtgcttctgcttctctgtgaccctcatcatcctgattgtggagctgtgtggcctgcaggcccgcttccccctgtcctggaggaacttccccatcaccttcttcagctgcatcgcctgtgtggcctatgccacagaggtggcctggacccgggcccggcctggagagatcaccggctacatggccaccgtgcccggcctgctgaaggtgctggagacctttgtggcctgcatcatctttgccttcatcagtgaccccaacctgtaccagcaccagcctgccctggagtggtgtgtggccgtgtatgccatctgcttcatcctggccgccatcgccatcctgctgaacctgggggagtgcaccaacgtgctgcccatccccttccccagcttcctgagcggcctggccctgctgtctgtgctgctgtatgccacagccctggtgctgtggcccctgtaccagtttgatgagaagtatggaggccagcccaggaggagcagagatgtgtcctgcagccgcagccacgcctactacgtgtgtgcctgggaccggcggctggccgtggccatcctgacagccatcaacctgctggcctacgtggccgacctggtgcacagcgcccacctggtgtttgtgaaggtgtag

SEQ ID NO: 160675 - DNA, 729 bp, Artificial Sequence
  Description of Artificial Sequence: Synthetic coding sequence
atgcctgtgacagtgaccaggaccaccatcaccaccaccaccaccagcagcagcggcctgggcagccccatgattgtgggcagcccccgggccctgacccagcccctgggcctgctgcggctgctgcagctggtgtccacctgtgtggccttcagcctggtggcctctgtgggcgcctggacaggctccatgggcaactggagcatgttcacctggtgcttctgcttctctgtgaccctcatcatcctgattgtggagctgtgtggcctgcaggcccgcttccccctgtcctggaggaacttccccatcacctttgcctgctatgctgccctcttctgcctgagcgccagcatcatctaccccaccacctacgtgcagttcctgagccacggccgcagccgggaccacgccatcgccgccaccttcttcagctgcatcgcctgtgtggcctatgccacagaggtggcctggacccgggcccggcctggagagatcaccggctacatggccaccgtgcccggcctgctgaaggtgctggagacctttgtggcctgcatcatctttgccttcatcagtgaccccaacctgtaccagcaccagcctgccctggagtggtgtgtggccgtgtatgccatctgcttcatcctggccgccatcgccatcctgctgaacctgggagaatgtaccaacgtgctgcccatccccttccccagcttcctgtctggatag

SEQ ID NO: 160676 - DNA, 780 bp, Artificial Sequence
  Description of Artificial Sequence: Synthetic coding sequence
atgcctgtgacagtgaccaggaccaccatcaccaccaccaccaccagcagcagcggcctgggcagccccatgattgtgggcagcccccgggccctgacccagcccctgggcctgctgcggctgctgcagctggtgtccacctgtgtggccttcagcctggtggcctctgtgggcgcctggacaggctccatgggcaactggagcatgttcacctggtgcttctgcttctctgtgaccctcatcatcctgattgtggagctgtgtggcctgcaggcccgcttccccctgtcctggaggaacttccccatcacctttgcctgctatgctgccctcttctgcctgagcgccagcatcatctaccccaccacctacgtgcagttcctgagccacggccgcagccgggaccacgccatcgccgccaccttcttcagctgcatcgcctgtgtggcctatgccacagaggtggcctggacccgggcccggcctggagagatcaccggctacatggccaccgtgcccggcctgctgaaggtgctggagacctttgtggcctgcatcatctttgccttcatcagtgaccccaacctgtaccagcaccagcctgccctggagtggtgtgtggccgtgtatgccatctgcttcatcctggccgccatcgccatcctgctgaacctgggagaatgtaccaacgtgctgcccatccccttccccagcttcctgagcggcctggccctgctgtctgtgctgctgtatgccacagccctggtgctgtggccctag

SEQ ID NO: 160677 - DNA, 567 bp, Artificial Sequence
  Description of Artificial Sequence: Synthetic coding sequence
atgcctgtgacagtgaccaggaccaccatcaccaccaccaccaccagcagcagcggcctgggcagccccatgattgtgggcagcccccgggccctgacccagcccctgggcctgctgcggctgctgcagctggtgtccacctgtgtggccttcagcctggtggcctctgtgggcgcctggacaggctccatgggcaactggagcatgttcacctggtgcttctgcttctctgtgaccctcatcatcctgattgtggagctgtgtggcctgcaggcccgcttccccctgtcctggaggaacttccccatcacctttgcctgctatgctgccctcttctgcctgagcgccagcatcatctaccccaccacctacgtgcagttcctgagccacggccgcagccgggaccacgccatcgccgccaccttcttcagctgcatcgcctgtgtggcctatgccacagaggtggcctggacccgggcccggcctggagagatcaccggctacatggccaccgtgcccggcctgctgaaggtgctggagacctttgtggcctgcatcatcttctag

SEQ ID NO: 160678 - DNA, 942 bp, Artificial Sequence
  Description of Artificial Sequence: Synthetic coding sequence
atggccctgcgcatctgtgtgacctacaccccagccctgcccatcggcctgtgcacccgctgctgcctgtgcctggagcagagccccagctggtgccactgcctgcggggcgtgtccttcctgaccttccacctgcaccagagcgtgcccctgggggaccgggacagcctgctgatgttcacccggcaggccggccactttgtggagggcagcaaggccggccgcagccggggccgcctgtgcctgagccaggccctgcgggtggccgtgcggggggcctttgtgtccctgtggtttgctgctggagctggggaccgggagaggaacaagggggacaagggggcccagacaggagctggcctgagccaggaggccgaggatgtggatgtgtcccgggcccggcgggtgacagatgccccccagggcaccctgtgtggcactggaaacagaaacagcggcagccagagcgcccgggtggtgggcgtggcccacctgggggaggccttccgggtgggcgtggagcaggccatcagcagctgcccagaggaggtgcacggccgccacggcctgtccatggagatcatgtgggccaggatggatgtggccctgcggagccctggccggggcctgctggccggggccggggccctgtgcatgaccctggccgagagcagctgcccagactatgagcggggcagaagagcctgcctgaccctgcaccgccaccccaccccccactgcagcacctggggcctgcccctgcgggtggccggctcctggctgactgtggtgacagtggaggccctgggcggctggaggatgggcgtgagaagaacaggccaggtgggccccaccatgcaccccccacctgtgtctggggccagccccctgctgctgcaccacctgctgctgctgctgctgatcatcatcctgacctgctag

SEQ ID NO: 160679 - DNA, 942 bp, Artificial Sequence; identical to SEQ ID NO: 160678
  Description of Artificial Sequence: Synthetic coding sequence

SEQ ID NO: 160680 - DNA, 279 bp, Artificial Sequence
  Description of Artificial Sequence: Synthetic coding sequence
atgcaggtgtccacagctgccctggccgtgctgctgtgcaccatggccctgtgcaaccagttcagcgccagcctggccgctgacacccccacagcctgctgcttctcctacaccagccggcagatcccccagaacttcatcgctgactactttgagaccagcagccagtgcagcaagccaggagtcatcttcctgaccaagaggagccggcaggtgtgtgccgaccccagcgaggagtgggtgcagaagtatgtgtctgacctggagctgagcgcctag

SEQ ID NO: 160681 - DNA, 2334 bp, Artificial Sequence
  Description of Artificial Sequence: Synthetic coding sequence
atgggcgtgcccttcttcagcagcctgcgctgcatggtggacctgggcccctgctgggccggcggcctgacagctgagatgaagctgctgctggccctggccggcctgctggccatcctggccaccccccagcccagcgagggcgccgccccagctgtgctgggggaggtggacaccagcctggtgctgagctccatggaggaggccaagcagctggtggacaaggcctacaaggagcggcgggagagcatcaagcagaggctgcggagcggcagcgccagccccatggagctgctgagctacttcaagcagcctgtggccgccaccaggacagctgtgcgggctgctgactacctgcacgtggccctggacctgctggagaggaagctgcggagcctgtggaggcggcccttcaacgtgacagatgtgctgaccccagcccagctgaatgtgctgagcaagagcagcggctgtgcctaccaggatgtgggcgtgacctgcccagagcaggacaagtaccgcaccatcaccggcatgtgcaacaacagatgtggctggctgggcgtggccgccggcaccggcctgcgggaggccagcaggaccccccaggccagccgctgccagaggcctgtgctgccctgcagaagaagccccaccctgggcgccagcaacagagcctttgtgcgctggctgcctgcagaatatgaagatggcttcagcctgccctacggctggaccccaggagtgaagagaaatggcttccctgtggccctggcccgggctgtgtccaatgagatcgtgcgcttccccacagaccagctgaccccagaccaggagaggagcctgatgttcatgcagtggggccagctgctggaccatgacctggacttcaccccagagcctgctgcccgggccagctttgtgactggagtgaactgtgagaccagctgtgtgcagcagcccccctgcttccccctgaagatccccccaaatgacccccgcatcaagaaccaggccgactgcatccccttcttccgcagctgcccagcctgccccggcagcaacatcaccatccggaaccagatcaatgccctgaccagctttgtggatgcctccatggtgtatggcagcgaggagcccctggccaggaacctgaggaacatgagcaaccagctgggcctgctggccgtgaaccagcgcttccaggacaatggccgggccctgctgccctttgacaacctgcatgatgacccctgcctgctgaccaacagaagtgcccgcatcccctgcttcctggccggggacaccaggagcagcgagatgcctgagctgacctccatgcacaccctgctgctgcgggagcacaaccggctggccacagagctgaagagcctgaacccccgctgggatggagagcggctgtaccaggaggccaggaagatcgtgggcgccatggtgcagatcatcacctacagagactacctgcccctggtgctgggccccacagccatgaggaagtacctgcccacctaccgcagctacaatgattctgtggacccccgcatcgccaacgtgttcaccaatgccttccgctatggccacaccctcatccagcccttcatgttccggctggacaaccgctaccagcccatggagcccaacccccgggtgcccctgagcagggtcttctttgcctcctggagggtggtgctggagggcggcatcgaccccatcctgcggggcctgatggccaccccagccaagctgaaccggcagaaccagattgctgtggatgagatccgggagcggctgtttgagcaggtgatgagaattggcctggacctgcctgccctgaacatgcagaggagccgggaccacggcctgcccggctacaatgcctggaggcgcttctgtggcctgccccagcctgagaccgtgggccagctgggcaccgtgctgaggaacctgaagctggccaggaagctgatggagcagtatggcacccccaacaacatcgacatctggatgggcggcgtgtctgagcccctgaagaggaagggccgggtgggccccctgctggcctgcatcatcggcacccagttcaggaagctgagagatggagaccgcttctggtgggagaatgaaggagtcttctccatgcagcagaggcaggccctggcccagatcagcctgccccgcatcatctgtgacaacacaggcatcaccaccgtgtccaagaacaacatcttcatgagcaacagctacccccgggactttgtgaactgcagcaccctgcctgccctgaacctggcctcctggagggaggccagctag

SEQ ID NO: 160682 - DNA, 1542 bp, Artificial Sequence
  Description of Artificial Sequence: Synthetic coding sequence
atgcccagctgggccctcttcatggtgaccagctgcctgctgctggccccccagaacctggcccaggtgagcagccaggatgtgtccctgctggccagtgacagcgagcccctgaagtgcttcagcaggacctttgaggacctgacctgcttctgggatgaggaggaggccgcccccagcggcacctaccagctgctgtatgcctacccccgggagaagccccgggcctgccccctgagcagccagagcatgccccacttcggcaccaggtatgtgtgccagttcccagaccaggaggaggtgcggctcttcttccccctgcacctgtgggtgaagaatgtgttcctgaaccagaccaggacccagagggtgctgtttgtggacagcgtgggcctgcctgcccctccttccatcatcaaggccatgggcggcagccagcctggagagctgcagatctcctgggaggagcccgcccctgagatcagtgacttcctgcgctatgagctgcgctatggcccccgggaccccaagaacagcacaggccccaccgtcatccagctgattgccacagagacctgctgcccagccctgcagaggccccacagcgccagcgccctggaccagagcccctgtgcccagcccaccatgccctggcaggacggccccaagcagaccagccccagccgggaggccagcgccctgacagctgagggcggcagctgcctgatcagcggcctgcagcccggcaacagctactggctgcagctgcggtctgagccagatggcatcagcctgggcggctcctggggctcctggagcctgcctgtgacagtggacctgcctggagatgctgtggccctgggcctgcagtgcttcaccctggacctgaagaatgtgacctgccagtggcagcagcaggaccacgccagcagccagggcttcttctaccacagccgggcccgctgctgcccccgggaccgctaccccatctgggagaactgtgaggaggaggagaagaccaaccctggcctgcagaccccccagttcagccgctgccacttcaagagcagaaatgacagcatcatccacatcctggtggaggtgaccacagcccctggcaccgtgcacagctacctgggcagccccttctggatccaccaggccgtgcggctgcccacccccaacctgcactggagggagatcagcagcggccacctggagctggagtggcagcaccccagctcctgggccgcccaggagacctgctaccagctgcgctacaccggggagggccaccaggactggaaggtgctggagccccccctgggcgcccggggcggcaccctggagctgcggcccaggagccgctaccgcctgcagctgcgggcccggctgaatggccccacctaccagggcccctggagctcctggagcgaccccaccagggtggagacagccacagaaacagcctggatcagcctggtgacagccctgcacctggtgctgggcctgtctgctgtgctgggcctgctgctgctgtag

SEQ ID NO: 160683 - DNA, 1908 bp, Artificial Sequence
  Description of Artificial Sequence: Synthetic coding sequence
atgcccagctgggccctcttcatggtgaccagctgcctgctgctggccccccagaacctggcccaggtgagcagccaggatgtgtccctgctggccagtgacagcgagcccctgaagtgcttcagcaggacctttgaggacctgacctgcttctgggatgaggaggaggccgcccccagcggcacctaccagctgctgtatgcctacccccgggagaagccccgggcctgccccctgagcagccagagcatgccccacttcggcaccaggtatgtgtgccagttcccagaccaggaggaggtgcggctcttcttccccctgcacctgtgggtgaagaatgtgttcctgaaccagaccaggacccagagggtgctgtttgtggacagcgtgggcctgcctgcccctccttccatcatcaaggccatgggcggcagccagcctggagagctgcagatctcctgggaggagcccgcccctgagatcagtgacttcctgcgctatgagctgcgctatggcccccgggaccccaagaacagcacaggccccaccgtcatccagctgattgccacagagacctgctgcccagccctgcagaggccccacagcgccagcgccctggaccagagcccctgtgcccagcccaccatgccctggcaggacggccccaagcagaccagccccagccgggaggccagcgccctgacagctgagggcggcagctgcctgatcagcggcctgcagcccggcaacagctactggctgcagctgcggtctgagccagatggcatcagcctgggcggctcctggggctcctggagcctgcctgtgacagtggacctgcctggagatgctgtggccctgggcctgcagtgcttcaccctggacctgaagaatgtgacctgccagtggcagcagcaggaccacgccagcagccagggcttcttctaccacagccgggcccgctgctgcccccgggaccgctaccccatctgggagaactgtgaggaggaggagaagaccaaccctggcctgcagaccccccagttcagccgctgccacttcaagagcagaaatgacagcatcatccacatcctggtggaggtgaccacagcccctggcaccgtgcacagctacctgggcagccccttctggatccaccaggccgtgcggctgcccacccccaacctgcactggagggagatcagcagcggccacctggagctggagtggcagcaccccagctcctgggccgcccaggagacctgctaccagctgcgctacaccggggagggccaccaggactggaaggtgctggagccccccctgggcgcccggggcggcaccctggagctgcggcccaggagccgctaccgcctgcagctgcgggcccggctgaatggccccacctaccagggcccctggagctcctggagcgaccccaccagggtggagacagccacagaaacagcctggatcagcctggtgacagccctgcacctggtgctgggcctgtctgctgtgctgggcctgctgctgctgcgctggcagtttcctgcccactaccgccgcctgcggcatgccctgtggcccagcctgcctgacctgcaccgggtgctgggccagtacctgcgggacacagctgccctgagcccccccaaggccaccgtgtctgacacctgtgaggaggtggagcccagcctgctggagatcctgcccaagagcagcgagaggacccccctgcccctgtgcagcagccaggcccagatggactaccgccgcctgcagcccagctgcctgggcaccatgcccctgtctgtgtgcccccccatggccgagagcggcagctgctgcaccacccacatcgccaaccacagctacctgcccctgagctactggcagcagccctag

SEQ ID NO: 160684 - DNA, 1650 bp, Artificial Sequence
  Description of Artificial Sequence: Synthetic coding sequence
atgcccagctgggccctcttcatggtgaccagctgcctgctgctggccccccagaacctggcccaggtgagcagccaggatgtgtccctgctggccagtgacagcgagcccctgaagtgcttcagcaggacctttgaggacctgacctgcttctgggatgaggaggaggccgcccccagcggcacctaccagctgctgtatgcctacccccgggagaagccccgggcctgccccctgagcagccagagcatgccccacttcggcaccaggtatgtgtgccagttcccagaccaggaggaggtgcggctcttcttccccctgcacctgtgggtgaagaatgtgttcctgaaccagaccaggacccagagggtgctgtttgtggacagcgtgggcctgcctgcccctccttccatcatcaaggccatgggcggcagccagcctggagagctgcagatctcctgggaggagcccgcccctgagatcagtgacttcctgcgctatgagctgcgctatggcccccgggaccccaagaacagcacaggccccaccgtcatccagctgattgccacagagacctgctgcccagccctgcagaggccccacagcgccagcgccctggaccagagcccctgtgcccagcccaccatgccctggcaggacggccccaagcagaccagccccagccgggaggccagcgccctgacagctgagggcggcagctgcctgatcagcggcctgcagcccggcaacagctactggctgcagctgcggtctgagccagatggcatcagcctgggcggctcctggggctcctggagcctgcctgtgacagtggacctgcctggagatgctgtggccctgggcctgcagtgcttcaccctggacctgaagaatgtgacctgccagtggcagcagcaggaccacgccagcagccagggcttcttctaccacagccgggcccgctgctgcccccgggaccgctaccccatctgggagaactgtgaggaggaggagaagaccaaccctggcctgcagaccccccagttcagccgctgccacttcaagagcagaaatgacagcatcatccacatcctggtggaggtgaccacagcccctggcaccgtgcacagctacctgggcagccccttctggatccaccaggccgtgcggctgcccacccccaacctgcactggagggagatcagcagcggccacctggagctggagtggcagcaccccagctcctgggccgcccaggagacctgctaccagctgcgctacaccggggagggccaccaggactggaaggtgctggagccccccctgggcgcccggggcggcaccctggagctgcggcccaggagccgctaccgcctgcagctgcgggcccggctgaatggccccacctaccagggcccctggagctcctggagcgaccccaccagggtggagacagccacagaaacagcctggatcagcctggtgacagccctgcacctggtgctgggcctgtctgctgtgctgggcctgctgctgctgcgctggcagtttcctgcccactaccgctaccggccccggcaggccggggactggcgctggacccgctggagccggcggcctgtgaacagacacagctggtttgccctgtag

SEQ ID NO: 160685 - DNA, 2817 bp, Artificial Sequence
  Description of Artificial Sequence: Synthetic coding sequence
atgaccctgctgggcagcgagcacagcctgctgatccgcagcaagttccgctctgtgctgcagctgcggctgcagcagaggaggacccaggagcagctggccaaccagggcatcatcccccccctgaagaggcctgctgagttccacgagcagaggaagcacctggacagcgacaaggccaagaacagcctgaagaggaaggccaggaaccgctgcaacagcgctgacctggtgaacatgcacatcctgcaggccagcacagctgagaggagcatccccacagcccagatgaagctgaagagggcccggctggctgatgacctgaatgagaagatcgccctgcggcccggccccctggagctggtggagaagaacatcctgcctgtggacagcgctgtgaaggaggccatcaagggcaaccaggtgtccttcagcaagagcacagatgcctttgcctttgaggaggacagcagcagtgatggcctgagcccagaccagaccaggtctgaggacccccagaacagcgctggcagccccccagatgccaaggccagtgacacccccagcacaggcagcctgggcaccaaccaggacctggccagcggctctgaaaatgacagaaatgacagcgccagccagcccagccaccagagtgatgctgggaagcagggcctgggcccccccagcacccccatcgctgtgcacgccgctgtgaagagcaagagcctgggggacagcaagaacagacacaagaagcccaaggaccccaagcccaaggtgaagaagctgaagtaccaccagtacatccccccagaccagaaggccgagaagagccccccacccatggacagcgcctatgcccggctgctgcagcagcagcagctgttcctgcagctgcagatcctgagccagcagcagcagcagcagcagcaccgcttctcctacctgggcatgcaccaggcccagctgaaggagcccaatgagcagatggtgaggaaccccaacagcagcagcacccccctgagcaacacccccctgagccctgtgaagaacagcttcagcggccagacaggagtgtcctccttcaagccaggccccctgccccccaacctggatgacctgaaggtgtctgagctgcggcagcagctgcgcatccggggcctgcctgtgtctggcaccaagacagccctgatggaccggctgcggcccttccaggactgcagcggcaaccctgtgcccaactttggagacatcaccaccgtgaccttccctgtgacccccaacaccctgcccaactaccagagcagcagcagcaccagcgccctgagcaatggcttctaccacttcggcagcaccagcagcagcccccccatcagccctgccagcagtgacctgtctgtggccggcagcctgcctgacaccttcaatgatgccagccccagctttggcctgcaccccagccctgtgcacgtgtgcacagaggagagcctgatgagcagcctgaatggaggctctgtgcccagcgagctggatggcctggacagcgagaaggacaagatgctggtggagaagcagaaggtgatcaatgagctgacctggaagctgcagcaggagcagaggcaggtggaggagctgaggatgcagctgcagaagcagaagaggaacaactgcagcgagaagaagcccctgcccttcctggccgccagcatcaagcaggaggaggccgtgagcagctgcccctttgccagccaggtgcctgtgaagaggcagagcagcagcagcgagtgccaccccccagcctgtgaggccgcccagctgcagcccctgggcaatgcccactgtgtggagagcagtgaccagaccaacgtgctgagcagcaccttcctgagcccccagtgcagcccccagcacagccccctgggcgctgtgaagagcccccagcacatcagcctgccccccagccccaacaacccccacttcctgcccagcagcagcggggcccagggcgagggccaccgggtgagcagccccatcagcagccaggtgtgcacagcccagatggccggcctgcacagcagtgacaaggtgggccccaagttcagcatccccagccccaccttcagcaagagcagcagcgccatcagcgaggtgacccagccccccagctatgaagatgctgtgaagcagcagatgaccaggagccagcagatggatgagctgctggatgtgctgattgaaagtggagagatgccagcagatgcccgggaggaccacagctgcctgcagaaggtgcccaagatccccaggagcagccgcagccccacagctgtgctgaccaagcccagcgccagctttgagcaggccagcagcggcagccagatcccctttgacccctatgccacagacagtgatgagcacctggaggtgctgctgaacagccagagccccctgggcaagatgtctgatgtgaccctgctgaagattggcagcgaggagccccactttgatggcatcatggatggcttcagcggcaaggctgctgaggacctcttcaatgcccacgagatcctgcccggccccctgagccccatgcagacccagttcagccccagctctgtggacagcaatggcctgcagctgtccttcacagagagcccctgggagaccatggagtggctggacctgaccccacccaacagcaccccaggcttcagcgccctgaccaccagcagccccagcatcttcaacatcgacttcctggatgtgacagacctgaacctgaacagctccatggacctgcacctgcagcagtggtag

SEQ ID NO: 160686 - DNA, 1989 bp, Artificial Sequence
  Description of Artificial Sequence: Synthetic coding sequence
atggattctgcctatgcccggctgctgcagcagcagcagctgttcctgcagctgcagatcctgagccagcagcagcagcagcagcagcaccgcttctcctacctgggcatgcaccaggcccagctgaaggagcccaatgagcagatggtgaggaaccccaacagcagcagcacccccctgagcaacacccccctgagccctgtgaagaacagcttcagcggccagacaggagtgagcagcttcaagccaggccccctgccccccaacctggatgacctgaaggtgtctgagctgcggcagcagctgcgcatccggggcctgcctgtgtctggcaccaagacagccctgatggaccggctgcggcccttccaggactgcagcggcaaccctgtgcccaactttggagacatcaccaccgtgaccttccctgtgacccccaacaccctgcccaactaccagagcagcagcagcaccagcgccctgagcaatggcttctaccacttcggcagcaccagcagcagcccccccatcagccctgccagcagtgacctgtctgtggccggcagcctgcctgacaccttcaatgatgccagccccagctttggcctgcaccccagccctgtgcacgtgtgcacagaggagagcctgatgagcagcctgaatggaggctctgtgcccagcgagctggatggcctggacagcgagaaggacaagatgctggtggagaagcagaaggtgatcaatgagctgacctggaagctgcagcaggagcagaggcaggtggaggagctgaggatgcagctgcagaagcagaagaggaacaactgcagcgagaagaagcccctgcccttcctggccgccagcatcaagcaggaggaggccgtgagcagctgcccctttgccagccaggtgcctgtgaagaggcagagcagcagcagcgagtgccaccccccagcctgtgaggccgcccagctgcagcccctgggcaatgcccactgtgtggagagcagtgaccagaccaacgtgctgagcagcaccttcctgagcccccagtgcagcccccagcacagccccctgggcgctgtgaagagcccccagcacatcagcctgccccccagccccaacaacccccacttcctgcccagcagcagcggggcccagggcgagggccaccgggtgagcagccccatcagcagccaggtgtgcacagcccagaacagcggggcccatgatggccacccccccagcttcagcccccacagcagcagcctgcacccccccttcagcggggcccaggccgacagcagccatggagctgggggcaacccctgccccaagagcccctgtgtgcagcagaagcagatgaccaggagccagcagatggatgagctgctggatgtgctgattgaaagtggagagatgccagcagatgcccgggaggaccacagctgcctgcagaaggtgcccaagatccccaggagcagccgcagccccacagctgtgctgaccaagcccagcgccagctttgagcaggccagcagcggcagccagatcccctttgacccctatgccacagacagtgatgagcacctggaggtgctgctgaacagccagagccccctgggcaagatgtctgatgtgaccctgctgaagattggcagcgaggagccccactttgatggcatcatggatggcttcagcggcaaggctgctgaggacctcttcaatgcccacgagatcctgcccggccccctgagccccatgcagacccagttcagccccagctctgtggacagcaatggcctgcagctgtccttcacagagagcccctgggagaccatggagtggctggacctgaccccacccaacagcaccccaggcttcagcgccctgaccaccagcagccccagcatcttcaacatcgacttcctggatgtgacagacctgaacctgaacagctccatggacctgcacctgcagcagtggtag

SEQ ID NO: 160687 - DNA, 2055 bp, Artificial Sequence
  Description of Artificial Sequence: Synthetic coding sequence
atgaagctgaagagggcccggctggctgatgacctgaatgagaagatcgccctgcggcccggccccctggagctggtggagaagaacatcctgcctgtggacagcgctgtgaaggaggccatcaagggcaaccaggtgtccttcagcaagagcacagatgcctttgcctttgaggaggacagcagcagtgatggcctgagcccagaccagaccaggtctgaggacccccagaacagcgctggcagccccccagatgccaaggccagtgacacccccagcacaggcagcctgggcaccaaccaggacctggccagcggctctgaaaatgacagaaatgacagcgccagccagcccagccaccagagtgatgctgggaagcagggcctgggcccccccagcacccccatcgctgtgcacgccgctgtgaagagcaagagcctgggggacagcaagaacagacacaagaagcccaaggaccccaagcccaaggtgaagaagctgaagtaccaccagtacatccccccagaccagaaggccgagaagagccccccacccatggacagcgcctatgcccggctgctgcagcagcagcagctgttcctgcagctgcagatcctgagccagcagcagcagcagcagcagcaccgcttctcctacctgggcatgcaccaggcccagctgaaggagcccaatgagcagatggtgaggaaccccaacagcagcagcacccccctgagcaacacccccctgagccctgtgaagaacagcttcagcggccagacaggagtgtcctccttcaagccaggccccctgccccccaacctggatgacctgaaggtgtctgagctgcggcagcagctgcgcatccggggcctgcctgtgtctggcaccaagacagccctgatggaccggctgcggcccttccaggactgcagcggcaaccctgtgcccaactttggagacatcaccaccgtgaccttccctgtgacccccaacaccctgcccaactaccagagcagcagcagcaccagcgccctgagcaatggcttctaccacttcggcagcaccagcagcagcccccccatcagccctgccagcagtgacctgtctgtggccggcagcctgcctgacaccttcaatgatgccagccccagctttggcctgcaccccagccctgtgcacgtgtgcacagaggagagcctgatgagcagcctgaatggaggctctgtgcccagcgagctggatggcctggacagcgagaaggacaagatgctggtggagaagcagaaggtgatcaatgagctgacctggaagctgcagcaggagcagaggcaggtggaggagctgaggatgcagctgcagaagcagaagaggaacaactgcagcgagaagaagcccctgcccttcctggccgccagcatcaagcaggaggaggccgtgagcagctgcccctttgccagccaggtgcctgtgaagaggcagagcagcagcagcgagtgccaccccccagcctgtgaggccgcccagctgcagcccctgggcaatgcccactgtgtggagagcagtgaccagaccaacgtgctgagcagcaccttcctgagcccccagtgcagcccccagcacagccccctgggcgctgtgaagagcccccagcacatcagcctgccccccagccccaacaacccccacttcctgcccagcagcagcggggcccagggcgagggccaccgggtgagcagccccatcagcagccaggtgtgcacagcccagaacagcggggcccatgatggccaccccccatccttcagcccccacagcagcagcctgcacccccccttcagcggggcccaggccgacagcagccacggggccggcggcaacccctgccccaagagcccctgtgtgcagcagaagatggccggcctgcacagcagtgacaaggtgggccccaagttcagcatccccagccccaccttcagcaagagcagcagcgccatcagcgaggtgacccagccccccagctatgaagatgctgtgaagcaggtgaccatgtag

SEQ ID NO: 160688 - DNA, 2961 bp, Artificial Sequence
  Description of Artificial Sequence: Synthetic coding sequence
atgaccctgctgggcagcgagcacagcctgctgatccgcagcaagttccgctctgtgctgcagctgcggctgcagcagaggaggacccaggagcagctggccaaccagggcatcatcccccccctgaagaggcctgctgagttccacgagcagaggaagcacctggacagcgacaaggccaagaacagcctgaagaggaaggccaggaaccgctgcaacagcgctgacctggtgaacatgcacatcctgcaggccagcacagctgagaggagcatccccacagcccagatgaagctgaagagggcccggctggctgatgacctgaatgagaagatcgccctgcggcccggccccctggagctggtggagaagaacatcctgcctgtggacagcgctgtgaaggaggccatcaagggcaaccaggtgtccttcagcaagagcacagatgcctttgcctttgaggaggacagcagcagtgatggcctgagcccagaccagaccaggtctgaggacccccagaacagcgctggcagccccccagatgccaaggccagtgacacccccagcacaggcagcctgggcaccaaccaggacctggccagcggctctgaaaatgacagaaatgacagcgccagccagcccagccaccagagtgatgctgggaagcagggcctgggcccccccagcacccccatcgctgtgcacgccgctgtgaagagcaagagcctgggggacagcaagaacagacacaagaagcccaaggaccccaagcccaaggtgaagaagctgaagtaccaccagtacatccccccagaccagaaggccgagaagagccccccacccatggacagcgcctatgcccggctgctgcagcagcagcagctgttcctgcagctgcagatcctgagccagcagcagcagcagcagcagcaccgcttctcctacctgggcatgcaccaggcccagctgaaggagcccaatgagcagatggtgaggaaccccaacagcagcagcacccccctgagcaacacccccctgagccctgtgaagaacagcttcagcggccagacaggagtgtcctccttcaagccaggccccctgccccccaacctggatgacctgaaggtgtctgagctgcggcagcagctgcgcatccggggcctgcctgtgtctggcaccaagacagccctgatggaccggctgcggcccttccaggactgcagcggcaaccctgtgcccaactttggagacatcaccaccgtgaccttccctgtgacccccaacaccctgcccaactaccagagcagcagcagcaccagcgccctgagcaatggcttctaccacttcggcagcaccagcagcagcccccccatcagccctgccagcagtgacctgtctgtggccggcagcctgcctgacaccttcaatgatgccagccccagctttggcctgcaccccagccctgtgcacgtgtgcacagaggagagcctgatgagcagcctgaatggaggctctgtgcccagcgagctggatggcctggacagcgagaaggacaagatgctggtggagaagcagaaggtgatcaatgagctgacctggaagctgcagcaggagcagaggcaggtggaggagctgaggatgcagctgcagaagcagaagaggaacaactgcagcgagaagaagcccctgcccttcctggccgccagcatcaagcaggaggaggccgtgagcagctgcccctttgccagccaggtgcctgtgaagaggcagagcagcagcagcgagtgccaccccccagcctgtgaggccgcccagctgcagcccctgggcaatgcccactgtgtggagagcagtgaccagaccaacgtgctgagcagcaccttcctgagcccccagtgcagcccccagcacagccccctgggcgctgtgaagagcccccagcacatcagcctgccccccagccccaacaacccccacttcctgcccagcagcagcggggcccagggcgagggccaccgggtgagcagccccatcagcagccaggtgtgcacagcccagaacagcggggcccatgatggccaccccccatccttcagcccccacagcagcagcctgcacccccccttcagcggggcccaggccgacagcagccacggggccggcggcaacccctgccccaagagcccctgtgtgcagcagaagatggccggcctgcacagcagtgacaaggtgggccccaagttcagcatccccagccccaccttcagcaagagcagcagcgccatcagcgaggtgacccagccccccagctatgaagatgctgtgaagcagcagatgaccaggagccagcagatggatgagctgctggatgtgctgattgaaagtggagagatgccagcagatgcccgggaggaccacagctgcctgcagaaggtgcccaagatccccaggagcagccgcagccccacagctgtgctgaccaagcccagcgccagctttgagcaggccagcagcggcagccagatcccctttgacccctatgccacagacagtgatgagcacctggaggtgctgctgaacagccagagccccctgggcaagatgtctgatgtgaccctgctgaagattggcagcgaggagccccactttgatggcatcatggatggcttcagcggcaaggctgctgaggacctcttcaatgcccacgagatcctgcccggccccctgagccccatgcagacccagttcagccccagctctgtggacagcaatggcctgcagctgtccttcacagagagcccctgggagaccatggagtggctggacctgaccccacccaacagcaccccaggcttcagcgccctgaccaccagcagccccagcatcttcaacatcgacttcctggatgtgacagacctgaacctgaacagctccatggacctgcacctgcagcagtggtag

SEQ ID NO: 160689 - DNA, 1947 bp, Artificial Sequence
  Description of Artificial Sequence: Synthetic coding sequence
ttcctgcagctgcagatcctgagccagcagcagcagcagcagcagcaccgcttctcctacctgggcatgcaccaggcccagctgaaggagcccaatgagcagatggtgaggaaccccaacagcagcagcacccccctgagcaacacccccctgagccctgtgaagaacagcttcagcggccagacaggagtgagcagcttcaagccaggccccctgccccccaacctggatgacctgaaggtgtctgagctgcggcagcagctgcgcatccggggcctgcctgtgtctggcaccaagacagccctgatggaccggctgcggcccttccaggactgcagcggcaaccctgtgcccaactttggagacatcaccaccgtgaccttccctgtgacccccaacaccctgcccaactaccagagcagcagcagcaccagcgccctgagcaatggcttctaccacttcggcagcaccagcagcagcccccccatcagccctgccagcagtgacctgtctgtggccggcagcctgcctgacaccttcaatgatgccagccccagctttggcctgcaccccagccctgtgcacgtgtgcacagaggagagcctgatgagcagcctgaatggaggctctgtgcccagcgagctggatggcctggacagcgagaaggacaagatgctggtggagaagcagaaggtgatcaatgagctgacctggaagctgcagcaggagcagaggcaggtggaggagctgaggatgcagctgcagaagcagaagaggaacaactgcagcgagaagaagcccctgcccttcctggccgccagcatcaagcaggaggaggccgtgagcagctgcccctttgccagccaggtgcctgtgaagaggcagagcagcagcagcgagtgccaccccccagcctgtgaggccgcccagctgcagcccctgggcaatgcccactgtgtggagagcagtgaccagaccaacgtgctgagcagcaccttcctgagcccccagtgcagcccccagcacagccccctgggcgctgtgaagagcccccagcacatcagcctgccccccagccccaacaacccccacttcctgcccagcagcagcggggcccagggcgagggccaccgggtgagcagccccatcagcagccaggtgtgcacagcccagaacagcggggcccatgatggccacccccccagcttcagcccccacagcagcagcctgcacccccccttcagcggggcccaggccgacagcagccatggagctgggggcaacccctgccccaagagcccctgtgtgcagcagaagcagatgaccaggagccagcagatggatgagctgctggatgtgctgattgaaagtggagagatgccagcagatgcccgggaggaccacagctgcctgcagaaggtgcccaagatccccaggagcagccgcagccccacagctgtgctgaccaagcccagcgccagctttgagcaggccagcagcggcagccagatcccctttgacccctatgccacagacagtgatgagcacctggaggtgctgctgaacagccagagccccctgggcaagatgtctgatgtgaccctgctgaagattggcagcgaggagccccactttgatggcatcatggatggcttcagcggcaaggctgctgaggacctcttcaatgcccacgagatcctgcccggccccctgagccccatgcagacccagttcagccccagctctgtggacagcaatggcctgcagctgtccttcacagagagcccctgggagaccatggagtggctggacctgaccccacccaacagcaccccaggcttcagcgccctgaccaccagcagccccagcatcttcaacatcgacttcctggatgtgacagacctgaacctgaacagctccatggacctgcacctgcagcagtggtag

SEQ ID NO: 160690 - DNA, 1515 bp, Artificial Sequence
  Description of Artificial Sequence: Synthetic coding sequence
atgaggttcttctgtgcccgctgctgcagctttggacctgagatgcctgctgtgcagctgctgctgctggcctgcctggtgtgggatgtgggcgccaggacagcccagctgaggaaggccaatgaccagagcggccgctgccagtacaccttctctgtggccagccccaatgaaagcagctgcccagagcagagccaggccatgtctgtcatccacaacctgcagagggacagcagcacccagaggctggacctggaggccaccaaggcccggctgagcagcctggagagcctgctgcaccagctgaccctggaccaggccgcccggccccaggagacccaggagggcctgcagcgggagctgggcaccctgcggcgggagcgggaccagctggagacccagacccgggagctggagacagcctacagcaacctgctgcgggacaagtctgtgctggaggaggagaagaagaggctgcggcaggagaatgaaaacctggcccggcggctggagagcagcagccaggaggtggcccggctgcggcggggccagtgcccccagacccgggacacagcccgggctgtgcccccaggcagccgggaggtgtccacctggaacctggacaccctggccttccaggagctgaagtctgagctgacagaggtgcctgccagccgcatcctgaaggagagccccagcggctacctgcggagcggggagggggacaccggctgtggggagctggtgtgggtgggggagcccctgaccctgaggacagctgagaccatcaccgggaagtatggagtgtggatgagggaccccaagcccacctacccctacacccaggagaccacctggagaattgacacagtgggcacagatgtgcggcaggtgtttgaatatgacctgatcagccagttcatgcagggctaccccagcaaggtgcacatcctgccccggcccctggagagcactggagctgtggtgtacagcggcagcctgtacttccagggcgctgagagcaggacagtcatccgctatgagctgaacacagaaacagtgaaggccgagaaggagatccctggagctggctaccacggccagttcccctacagctggggcggctacacagacatcgacctggccgtggatgaggccggcctgtgggtgatctacagcacagatgaggccaagggggccatcgtgctgagcaagctgaaccctgagaacctggagctggagcagacctgggagaccaacatcaggaagcagagcgtggccaatgccttcatcatctgtggcaccctgtacacagtgtcctcctacaccagcgcagatgccaccgtgaactttgcctatgacacaggaacaggcatcagcaagaccctgaccatccccttcaagaaccgctacaagtacagctccatgattgactacaaccccctggagaagaagctgtttgcctgggacaacctgaacatggtgacctatgacatcaagctgagcaagatgtag

SEQ ID NO: 160691 - DNA, 1374 bp, Artificial Sequence
  Description of Artificial Sequence: Synthetic coding sequence
atgaggttcttctgtgcccgctgctgcagctttggacctgagatgcctgctgtgcagctgctgctgctggcctgcctggtgtgggatgtgggcgccaggacagcccagctgaggaaggccaatgaccagagcggccgctgccagtacaccttctctgtggccagccccaatgaaagcagctgcccagagcagagccaggccatgtctgtcatccacaacctgcagagggacagcagcacccagaggctggacctggaggccaccaaggcccggctgagcagcctggagagcctgctgcgggacaagtctgtgctggaggaggagaagaagaggctgcggcaggagaatgaaaacctggcccggcggctggagagcagcagccaggaggtggcccggctgcggcggggccagtgcccccagacccgggacacagcccgggctgtgcccccaggcagccgggaggtgtccacctggaacctggacaccctggccttccaggagctgaagtctgagctgacagaggtgcctgccagccgcatcctgaaggagagccccagcggctacctgcggtctggagagggggacaccggctgtggggagctggtgtgggtgggggagcccctgaccctgaggacagctgagaccatcaccgggaagtatggagtgtggatgagggaccccaagcccacctacccctacacccaggagaccacctggagaattgacacagtgggcacagatgtgcggcaggtgtttgaatatgacctgatcagccagttcatgcagggctaccccagcaaggtgcacatcctgccccggcccctggagagcactggagctgtggtgtacagcggcagcctgtacttccagggcgctgagagcaggacagtcatccgctatgagctgaacacagagaccgtgaaggccgagaaggagatccctggggccggctaccacggccagttcccctacagctggggcggctacacagacatcgacctggccgtggatgaagctggcctgtgggtgatctacagcacagatgaggccaagggggccatcgtgctgagcaagctgaaccctgagaacctggagctggagcagacctgggagaccaacatcaggaagcagagcgtggccaatgccttcatcatctgtggcaccctgtacacagtgagcagctacaccagcgcagatgccaccgtgaactttgcctatgacaccggcaccggcatcagcaagaccctgaccatccccttcaagaaccgctacaagtacagctccatgattgactacaaccccctggagaagaagctgtttgcctgggacaacctgaacatggtgacctatgacatcaagctgagcaagatgtag

SEQ ID NO: 160692 - DNA, 1314 bp, Artificial Sequence
  Description of Artificial Sequence: Synthetic coding sequence
atgtctgtcatccacaacctgcagagggacagcagcacccagaggctggacctggaggccaccaaggcccggctgagcagcctggagagcctgctgcaccagctgaccctggaccaggccgcccggccccaggagacccaggagggcctgcagcgggagctgggcaccctgcggcgggagcgggaccagctggagacccagacccgggagctggagacagcctacagcaacctgctgcgggacaagtctgtgctggaggaggagaagaagaggctgcggcaggagaatgaaaacctggcccggcggctggagagcagcagccaggaggtggcccggctgcggcggggccagtgcccccagacccgggacacagcccgggctgtgcccccaggcagccgggaggtgtccacctggaacctggacaccctggccttccaggagctgaagtctgagctgacagaggtgcctgccagccgcatcctgaaggagagccccagcggctacctgcggtctggagagggggacaccggctgtggggagctggtgtgggtgggggagcccctgaccctgaggacagctgagaccatcaccgggaagtatggagtgtggatgagggaccccaagcccacctacccctacacccaggagaccacctggagaattgacacagtgggcacagatgtgcggcaggtgtttgaatatgacctgatcagccagttcatgcagggctaccccagcaaggtgcacatcctgccccggcccctggagagcactggagctgtggtgtacagcggcagcctgtacttccagggcgctgagagcaggacagtcatccgctatgagctgaacacagagaccgtgaaggccgagaaggagatccctggggccggctaccacggccagttcccctacagctggggcggctacacagacatcgacctggccgtggatgaagctggcctgtgggtgatctacagcacagatgaggccaagggggccatcgtgctgagcaagctgaaccctgagaacctggagctggagcagacctgggagaccaacatcaggaagcagagcgtggccaatgccttcatcatctgtggcaccctgtacacagtgagcagctacaccagcgcagatgccaccgtgaactttgcctatgacaccggcaccggcatcagcaagaccctgaccatccccttcaagaaccgctacaagtacagctccatgattgactacaaccccctggagaagaagctgtttgcctgggacaacctgaacatggtgacctatgacatcaagctgagcaagatgtag

SEQ ID NO: 160693 - DNA, 1035 bp, Artificial Sequence
  Description of Artificial Sequence: Synthetic coding sequence
atgaggttcttctgtgcccgctgctgcagctttggacctgagatgcctgctgtgcagctgctgctgctggcctgcctggtgtgggatgtgggcgccaggacagcccagctgaggaaggccaatgaccagagcggccgctgccagtacaccttctctgtggccagccccaatgaaagcagctgcccagagcagagccaggccatgtctgtcatccacaacctgcagagggacagcagcacccagaggctggacctggaggccaccaaggcccggctgagcagcctggagagcctgctgcaccagctgaccctggaccaggccgcccggccccaggagacccaggagggcctgcagcgggagctgggcaccctgcggcgggagcgggaccagctggagacccagacccgggagctggagacagcctacagcaacctgctgcgggacaagtctgtgctggaggaggagaagaagaggctgcggcaggagaatgaaaacctggcccggcggctggagagcagcagccaggaggtggcccggctgcggcggggccagtgcccccagacccgggacacagcccgggctgtgcccccaggcagccgggaggtgtccacctggaacctggacaccctggccttccaggagctgaagtctgagctgacagaggtgcctgccagccgcatcctgaaggagagccccagcggctacctgcggagcggggagggggacaccggctgtggggagctggtgtgggtgggggagcccctgaccctgaggacagctgagaccatcaccgggaagtatggagtgtggatgagggaccccaagcccacctacccctacacccaggagaccacctggagaattgacacagtgggcacagatgtgcggcaggtgtttgaatatgacctgatcagccagttcatgcagggctaccccagcaaggtgcacatcctgccccggcccctggagagcactggagctgtggtgtacagcggcagcctgtacttccgggccctgagccctgagctgtcctag

SEQ ID NO: 160694 - DNA, 1521 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcagcaacaagctgttccagtatgccagcacagacatggacaaggtgctgctgaagtacacagagtacaatgagccccatgagagcaggaccaacagcgacatcgtggagaccctgaggaagaagggcctgaatggctgtgagagcccagatgctgatgactactttgagcacagccccctgtctgaggaccgcttcagcaagctgaatgaagacagcgacttcatcttcaagaggggccccccaggcctgcccccccagaacttctccatgtctgtgacagtgcctgtgaccagccccaatgccctgagctacaccaaccctggcagcagcctggtgagccccagcctggccgccagcagcaccctgacagacagctccatgctgagccccccccagaccaccctgcacagaaatgtgtcccctggggccccccagaggcctcccagcactggaaatgccggcggcatgctgagcaccacagacctgactgtgcccaacggggccggcagcagccctgtgggcaatggatttgtgaacagccgggccagccccaacctgattggagccaccggggccaacagcctgggcaaggtgatgcccaccaagagccccccacctcctgggggcggcaacctgggcatgaacagcaggaagccagacctgcgggtggtgatcccccccagcagcaagggcatgatgccacccctgtacctgaagaggcagctgaacaccaacaacacccagaggatcagcagcagccaggccacccagcccctggccacccctgtggtgtctgtgaccacccccagcctgcccccccagggcctggtgtacagcgccatgcccacagcctacaacacagactacagcctgaccagcgctgacctgagcgccctgcagggcttcaacagccctggcatgctgagcctgggccaggtgtctgcctggcagcagcaccacctgggccaggccgccctgagcagcctggtggccggcggccagctgagccagggcagcaacctgagcatcaacaccaaccagaacatcagcatcaagtctgagcccatcagccccccccgggacaggatgacccccagcggcttccagcagcagcagcagcagcagcagcagcagcagcccccacctccaccccagccccagccccagcccccccagccccagccccggcaggagatgggccgcagccctgtggacagcctgagcagcagcagcagcagctatgatggcagtgaccgggaggaccccaggggggacttccacagccccatcgtgctgggccggccccccaacacagaagatcgggagagccccagcgtgaagaggatgaggatggatgcctgggtgacctag

SEQ ID NO: 160695 - DNA, 1500 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcagcaacaagctgttccagtatgccagcacagacatggacaaggtgctgctgaagtacacagagtacaatgagccccatgagagcaggaccaacagcgacatcgtggaggccctgaacaagaaggagcaccggggctgtgacagcccagaccctgacaccagctatgtgctgaccccccacacagaggagaagtacaagaagatcaatgaggagtttgacaacatgatgaggaaccacaagatcgcccctggcctgcccccccagaacttctccatgtctgtgacagtgcctgtgaccagccccaatgccctgagctacaccaaccctggcagcagcctggtgagccccagcctggccgccagcagcaccctgacagacagctccatgctgagccccccccagaccaccctgcacagaaatgtgtcccctggggccccccagaggcctcccagcactggaaatgccggcggcatgctgagcaccacagacctgactgtgcccaacggggccggcagcagccctgtgggcaatggatttgtgaacagccgggccagccccaacctgattggagccaccggggccaacagcctgggcaaggtgatgcccaccaagagccccccacctcctgggggcggcaacctgggcatgaacagcaggaagccagacctgcgggtggtgatcccccccagcagcaagggcatgatgccacccctgaacacccagaggatcagcagcagccaggccacccagcccctggccacccctgtggtgtctgtgaccacccccagcctgcccccccagggcctggtgtacagcgccatgcccacagcctacaacacagactacagcctgaccagcgctgacctgagcgccctgcagggcttcaacagccctggcatgctgagcctgggccaggtgtctgcctggcagcagcaccacctgggccaggccgccctgagcagcctggtggccggcggccagctgagccagggcagcaacctgagcatcaacaccaaccagaacatcagcatcaagtctgagcccatcagccccccccgggacaggatgaccccatctggcttccagcagcagcagcagcagcagcagcagcagcagcccccacctccaccccagccccagccccagcccccccagccccagccccggcaggagatgggccgcagccctgtggacagcctgagcagcagcagcagcagctatgatggcagtgaccgggaggaccccaggggggacttccacagccccatcgtgctgggccggccccccaacacagaggaccgggagagccccagcgtgaagaggatgaggatggatgcctgggtgacctag

SEQ ID NO: 160696 - DNA, 1290 bp, Artificial Sequence
  Description of Artificial Sequence: Synthetic coding sequence
atgggcaggaagaagatccagatcacccgcatcatggatgaaagaaaccggcagaccctgaggaagaagggcctgaatggctgtgagagcccagatgctgatgactactttgagcacagccccctgtctgaggaccgcttcagcaagctgaatgaagacagcgacttcatcttcaagaggggccccccaggcctgcccccccagaacttctccatgtctgtgacagtgcctgtgaccagccccaatgccctgagctacaccaaccctggcagcagcctggtgagccccagcctggccgccagcagcaccctgacagacagctccatgctgagccccccccagaccaccctgcacagaaatgtgtcccctggggccccccagaggcctcccagcactggaaatgccggcggcatgctgagcaccacagacctgactgtgcccaacggggccggcagcagccctgtgggcaatggatttgtgaacagccgggccagccccaacctgattggagccaccggggccaacagcctgggcaaggtgatgcccaccaagagccccccacctcctgggggcggcaacctgggcatgaacagcaggaagccagacctgcgggtggtgatcccccccagcagcaagggcatgatgccacccctgaacacccagaggatcagcagcagccaggccacccagcccctggccacccctgtggtgtctgtgaccacccccagcctgcccccccagggcctggtgtacagcgccatgcccacagcctacaacacagactacagcctgaccagcgctgacctgagcgccctgcagggcttcaacagccctggcatgctgagcctgggccaggtgtctgcctggcagcagcaccacctgggccaggccgccctgagcagcctggtggccggcggccagctgagccagggcagcaacctgagcatcaacaccaaccagaacatcagcatcaagtctgagcccatcagccccccccgggacaggatgaccccatctggcttccagcagcagcagcagcagcagcagcagcagcagcccccacctccaccccagccccagccccagcccccccagccccagccccggcaggagatgggccgcagccctgtggacagcctgagcagcagcagcagcagctatgatggcagtgaccgggaggaccccaggggggacttccacagccccatcgtgctgggccggccccccaacacagaggaccgggagagccccagcgtgaagaggatgaggatggatgcctgggtgacctag

SEQ ID NO: 160697 - DNA, 1494 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcagcaacaagctgttccagtatgccagcacagacatggacaaggtgctgctgaagtacacagagtacaatgagccccatgagagcaggaccaacagcgacatcgtggagaccctgaggaagaagggcctgaatggctgtgagagcccagatgctgatgactactttgagcacagccccctgtctgaggaccgcttcagcaagctgaatgaagacagcgacttcatcttcaagaggggccccccaggcctgcccccccagaacttctccatgtctgtgacagtgcctgtgaccagccccaatgccctgagctacaccaaccctggcagcagcctggtgagccccagcctggccgccagcagcaccctgacagacagctccatgctgagccccccccagaccaccctgcacagaaatgtgtcccctggggccccccagaggcctcccagcactggaaatgccggcggcatgctgagcaccacagacctgactgtgcccaacggggccggcagcagccctgtgggcaatggatttgtgaacagccgggccagccccaacctgattggagccaccggggccaacagcctgggcaaggtgatgcccaccaagagccccccacctcctgggggcggcaacctgggcatgaacagcaggaagccagacctgcgggtggtgatcccccccagcagcaagggcatgatgccacccctgaacacccagaggatcagcagcagccaggccacccagcccctggccacccctgtggtgtctgtgaccacccccagcctgcccccccagggcctggtgtacagcgccatgcccacagcctacaacacagactacagcctgaccagcgctgacctgagcgccctgcagggcttcaacagccctggcatgctgagcctgggccaggtgtctgcctggcagcagcaccacctgggccaggccgccctgagcagcctggtggccggcggccagctgagccagggcagcaacctgagcatcaacaccaaccagaacatcagcatcaagtctgagcccatcagccccccccgggacaggatgaccccatctggcttccagcagcagcagcagcagcagcagcagcagcagcccccacctccaccccagccccagccccagcccccccagccccagccccggcaggagatgggccgcagccctgtggacagcctgagcagcagcagcagcagctatgatggcagtgaccgggaggaccccaggggggacttccacagccccatcgtgctgggccggccccccaacacagaggaccgggagagccccagcgtgaagaggatgaggatggatgcctgggtgacctag

SEQ ID NO: 160698 - DNA, 1494 bp, Artificial Sequence; identical to SEQ ID NO: 160697
  Description of Artificial Sequence: Synthetic coding sequence

SEQ ID NO: 160699 - DNA, 1518 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcagcaacaagctgttccagtatgccagcacagacatggacaaggtgctgctgaagtacacagagtacaatgagccccatgagagcaggaccaacagcgacatcgtggagaccctgaggaagaagggcctgaatggctgtgagagcccagatgctgatgactactttgagcacagccccctgtctgaggaccgcttcagcaagctgaatgaagacagcgacttcatcttcaagaggggccccccaggcctgcccccccagaacttctccatgtctgtgacagtgcctgtgaccagccccaatgccctgagctacaccaaccctggcagcagcctggtgagccccagcctggccgccagcagcaccctgacagacagctccatgctgagccccccccagaccaccctgcacagaaatgtgtcccctggggccccccagaggcctcccagcactggaaatgccggcggcatgctgagcaccacagacctgactgtgcccaacggggccggcagcagccctgtgggcaatggatttgtgaacagccgggccagccccaacctgattggagccaccggggccaacagcctgggcaaggtgatgcccaccaagagccccccacctcctgggggcggcaacctgggcatgaacagcaggaagccagacctgcgggtggtgatcccccccagcagcaagggcatgatgccacccctgtctgaggaggaggagctggagctgaacacccagaggatcagcagcagccaggccacccagcccctggccacccctgtggtgtctgtgaccacccccagcctgcccccccagggcctggtgtacagcgccatgcccacagcctacaacacagactacagcctgaccagcgctgacctgagcgccctgcagggcttcaacagccctggcatgctgagcctgggccaggtgtctgcctggcagcagcaccacctgggccaggccgccctgagcagcctggtggccggcggccagctgagccagggcagcaacctgagcatcaacaccaaccagaacatcagcatcaagtctgagcccatcagccccccccgggacaggatgaccccatctggcttccagcagcagcagcagcagcagcagcagcagcagcccccacctccaccccagccccagccccagcccccccagccccagccccggcaggagatgggccgcagccctgtggacagcctgagcagcagcagcagcagctatgatggcagtgaccgggaggaccccaggggggacttccacagccccatcgtgctgggccggccccccaacacagaggaccgggagagccccagcgtgaagaggatgaggatggatgcctgggtgacctag

SEQ ID NO: 160700 - DNA, 117 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtag

SEQ ID NO: 160701 - DNA, 1314 bp, Artificial Sequence
  Description of Artificial Sequence: Synthetic coding sequence
atgggcaggaagaagatccagatcacccgcatcatggatgaaagaaaccggcagaccctgaggaagaagggcctgaatggctgtgagagcccagatgctgatgactactttgagcacagccccctgtctgaggaccgcttcagcaagctgaatgaagacagcgacttcatcttcaagaggggccccccaggcctgcccccccagaacttctccatgtctgtgacagtgcctgtgaccagccccaatgccctgagctacaccaaccctggcagcagcctggtgagccccagcctggccgccagcagcaccctgacagacagctccatgctgagccccccccagaccaccctgcacagaaatgtgtcccctggggccccccagaggcctcccagcactggaaatgccggcggcatgctgagcaccacagacctgactgtgcccaacggggccggcagcagccctgtgggcaatggatttgtgaacagccgggccagccccaacctgattggagccaccggggccaacagcctgggcaaggtgatgcccaccaagagccccccacctcctgggggcggcaacctgggcatgaacagcaggaagccagacctgcgggtggtgatcccccccagcagcaagggcatgatgccacccctgtctgaggaggaggagctggagctgaacacccagaggatcagcagcagccaggccacccagcccctggccacccctgtggtgtctgtgaccacccccagcctgcccccccagggcctggtgtacagcgccatgcccacagcctacaacacagactacagcctgaccagcgctgacctgagcgccctgcagggcttcaacagccctggcatgctgagcctgggccaggtgtctgcctggcagcagcaccacctgggccaggccgccctgagcagcctggtggccggcggccagctgagccagggcagcaacctgagcatcaacaccaaccagaacatcagcatcaagtctgagcccatcagccccccccgggacaggatgaccccatctggcttccagcagcagcagcagcagcagcagcagcagcagcccccacctccaccccagccccagccccagcccccccagccccagccccggcaggagatgggccgcagccctgtggacagcctgagcagcagcagcagcagctatgatggcagtgaccgggaggaccccaggggggacttccacagccccatcgtgctgggccggccccccaacacagaggaccgggagagccccagcgtgaagaggatgaggatggatgcctgggtgacctag

SEQ ID NO: 160702 - DNA, 234 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcagcaacaagctgttccagtatgccagcacagacatggacaaggtgctgctgaagtacacagagtacaatgagccccatgaatag

SEQ ID NO: 160703 - DNA, 258 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcagcaacaagctgttccagtatgccagcacagacatggacaaggtgctgctgaagtacacagagtacaatgagccccatgagagcaggaccaacagcgacatcgtgtag

SEQ ID NO: 160704 - DNA, 1107 bp, Artificial Sequence
  Description of Artificial Sequence: Synthetic coding sequence
atgggcaggaagaagatccagatcagccgcatcctggaccagaggaaccggcaggtgaccttcaccaagaggaagtttggcctgatgaagaaggcctatgagctgtctgtgctgtgtgactgtgaaattgccctgatcatcttcaacagcgccaacagactcttccagtatgccagcacagacatggacagagtgctgctgaagtacacagagtacagcgagccccatgagagcaggaccaacacagacatcctggagaccctgaagaggcggggcatcggcctggatggccctgagctggagccagatgagggccctgaggagcctggagagaagttccggcggctggccggggagggcggggaccctgccctgccccggccccggctgtacccagctgccccagccatgcccagcccagatgtggtgtatggagccctgcccccacctggctgtgaccccagcggcctgggggaggccctgcctgcccagagccggcccagccccttccggcctgctgcccccaaggccggccccccaggcctggtgcaccccctcttcagccccagccacctgaccagcaagaccccaccacccctgtacctgcccacagagggcagaagaagtgacctgcccggcggcctggccggcccccggggcggcctgaacaccagccgcagcctgtacagcggcctgcagaacccctgcagcacagccaccccaggcccccccctgggcagcttccccttcctgcccggcggccccccagaatatggcctgggggaccccccacctcctcctggcctgctgcagccccccaccctggccccctggcagcccagcagaggagatggccccccagctgtgagcagccagcccagcggcggccgcagcctgggggaggagggcccccccaccaggggggccagcccccccaccccacctgtgtccatcaagtctgagcggctgagccctgcccctgggggccctggggacttccccaagaccttcccctaccccctgctgctggcccggagcctggccgagcccctgcggcccggccctgccctgcggcggctgcccctggctgatggctggcccaggtag

SEQ ID NO: 160705 - DNA, 894 bp, Artificial Sequence
  Description of Artificial Sequence: Synthetic coding sequence
atgggcaggaagaagatccagatcagccgcatcctggaccagaggaaccggcaggtgaccttcaccaagaggaagtttggcctgatgaagaaggcctatgagctgtctgtgctgtgtgactgtgaaattgccctgatcatcttcaacagcgccaacagactcttccagtatgccagcacagacatggacagagtgctgctgaagtacacagagtacagcgagccccatgagagcaggaccaacacagacatcctggaggtgccccagaccctgaagagaagaggcatcggcctggatggccctgagctggagccagatgagggccctgaggagcccggggagaagttccggcggctggccggggagggcggggaccctgccctgccccggccccggctgtacccagctgccccagccatgcccagcccagatgtggtgtatggagccctgcccccacctggctgtgaccccagcggcctgggggaggccctgcctgcccagagccggcccagccccttccggcctgctgcccccaaggccggccccccaggcctggtgcaccccctcttcagccccagccacctgaccagcaagaccccaccacccctgtacctgcccacagagggccgccgcagtgacctgcccggcggcctggccggcccccggggcggcctgaacaccagccgcagcctgtacagcggcctgcagaacccctgcagcacagccaccccaggcccccccctgggcagcttccccttcctgcccggcggccccccagaatatggcctgggggaccccccacctcctcctggcctgctgcagccccccaccctggccccctggcagcccagcagaggagatggccccccagctgtgagcagccagcccaggtag

SEQ ID NO: 160706 - DNA, 1107 bp, Artificial Sequence; identical to SEQ ID NO: 160704
  Description of Artificial Sequence: Synthetic coding sequence

SEQ ID NO: 160707 - DNA, 1098 bp, Artificial Sequence
  Description of Artificial Sequence: Synthetic coding sequence
atgggcaggaagaagatccagatcagccgcatcctggaccagaggaaccggcaggtgaccttcaccaagaggaagtttggcctgatgaagaaggcctatgagctgtctgtgctgtgtgactgtgaaattgccctgatcatcttcaacagcgccaacagactcttccagtatgccagcacagacatggacagagtgctgctgaagtacacagagtacagcgagccccatgagagcaggaccaacacagacatcctggagaccctgaagaggcggggcatcggcctggatggccctgagctggagccagatgagggccctgaggagcctggagagaagttccggcggctggccggggagggcggggaccctgccctgccccggccccggctgtacccagctgccccagccatgcccagcccagatgtggtgtatggagccctgcccccacctggctgtgaccccagcggcctgggggaggccctgcctgcccagagccggcccagccccttccggcctgctgcccccaaggccggccccccaggcctggtgcaccccctcttcagccccagccacctgaccagcaagaccccaccacccctgtacctgcccacagagggcagaagaagtgacctgcccggcggcctggccggcccccggggcggcctgaacaccagccgcagcctgtacagcggcctgcagaacccctgcagcacagccaccccaggcccccccctgggcagcttccccttcctgcccggcggcccccctgtgggcgctgaggcctgggcccggcgggtgccccagcctgctgccccaccccggcggcccccccagagcgccagcagcctgagcgccagcctgcggcccccaggggccccagccaccttcctgcggcccagccccatcccctgcagcagccctggcccctggcagagcctgtgtggcctgggccccccctgtgccggctgcccctggcccacagctggccctggccgccgcagccctgggggcaccagccctgagaggagccctggaacagcccgggcccggggggaccccaccagcctgcaggccagcagcgagaagacccagcagtag

SEQ ID NO: 160708 - DNA, 1392 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcaccaacaagctgttccagtatgccagcacagacatggacaaggtgctgctgaagtacacagagtacaatgagccccatgagagcaggaccaacagcgacatcgtggaggccctgaacaagaaggagaacaagggctgtgagagcccagaccctgacagcagctatgccctgacccccaggacagaggagaagtacaagaagatcaatgaggagtttgacaacatgatcaagagccacaagatcccagctgtgcccccacccaactttgagatgcctgtgtccatccctgtgagcagccacaacagcctggtgtacagcaaccctgtgagcagcctgggcaaccccaacctgctgcccctggcccaccccagcctgcagagaaattccatgagccctggggtgacccaccggccccccagcgctggcaacacaggaggcctgatgggcggggacctgaccagcggggccggcaccagcgctggaaatggctacggcaaccccaggaacagccctggcctgctggtgtccccaggcaacctgaacaagaacatgcaggccaagagccccccacccatgaacctgggcatgaacaacaggaagccagacctgcgggtgctgatccccccaggcagcaagaacaccatgcccagcgtgaaccagaggatcaacaacagccagagcgcccagagcctggccacccctgtggtgtctgtggccacccccaccctgcccggccagggcatgggcggctaccccagcgccatcagcaccacctatggaacagagtacagcctgagcagcgctgacctgagcagcctgagcggcttcaacacagccagcgccctgcacctgggctctgtgacaggctggcagcagcagcacctgcacaacatgcctccttctgccctgagccagctgggcgcctgcaccagcacccacctgagccagagcagcaacctgagcctgcccagcacccagagcctgaacatcaagtctgagcctgtgtccccaccccgggacaggaccaccacccccagccgctacccccagcacaccaggcatgaggccggccgcagccctgtggacagcctgagcagctgcagcagcagctatgatggcagtgaccgggaggaccacagaaatgagttccacagccccatcggcctgacccggcccagcccagatgagcgggagagccccagcgtgaagaggatgaggctgtctgagggctgggccacctag

SEQ ID NO: 160709 - DNA, 1422 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcaccaacaagctgttccagtatgccagcacagacatggacaaggtgctgctgaagtacacagagtacaatgagccccatgagagcaggaccaacagcgacatcgtggagaccctgaggaagaagggcctgaatggctgtgacagcccagaccctgatgctgatgacagcgtgggccacagccctgagagcgaggacaagtacaggaagatcaatgaagacatcgacctgatgatcagccggcagaggctgtgtgctgtgcccccacccaactttgagatgcctgtgtccatccctgtgagcagccacaacagcctggtgtacagcaaccctgtgagcagcctgggcaaccccaacctgctgcccctggcccaccccagcctgcagagaaattccatgagccctggggtgacccaccggccccccagcgctggcaacacaggaggcctgatgggcggggacctgaccagcggggccggcaccagcgctggaaatggctacggcaaccccaggaacagccctggcctgctggtgtccccaggcaacctgaacaagaacatgcaggccaagagccccccacccatgaacctgggcatgaacaacaggaagccagacctgcgggtgctgatccccccaggcagcaagaacaccatgcccagcgtgtctgaagatgtggacctgctgctgaaccagaggatcaacaacagccagagcgcccagagcctggccacccctgtggtgtctgtggccacccccaccctgcccggccagggcatgggcggctaccccagcgccatcagcaccacctatggaacagagtacagcctgagcagcgctgacctgagcagcctgagcggcttcaacacagccagcgccctgcacctgggctctgtgacaggctggcagcagcagcacctgcacaacatgcctccttctgccctgagccagctgggcgcctgcaccagcacccacctgagccagagcagcaacctgagcctgcccagcacccagagcctgaacatcaagtctgagcctgtgtccccaccccgggacaggaccaccacccccagccgctacccccagcacaccaggcatgaggccggccgcagccctgtggacagcctgagcagctgcagcagcagctatgatggcagtgaccgggaggaccacagaaatgagttccacagccccatcggcctgacccggcccagcccagatgagcgggagagccccagcgtgaagaggatgaggctgtctgagggctgggccacctag

SEQ ID NO: 160710 - DNA, 297 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcaccaacaagctgttccagtatgccagcacagacatggacaaggtgctgctgaagtacacagagtacaatgagccccatgagagcaggaccaacagcgacatcgtggagaccctgaggaagaagggcctgaatggctgtgacagctag

SEQ ID NO: 160711 - DNA, 390 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcaccaacaagctgttccagtatgccagcacagacatggacaaggtgctgctgaagtacacagagtacaatgagccccatgagagcaggaccaacagcgacatcgtggagaccctgaggaagaagggcctgaatggctgtgacagcccagaccctgatgctgatgacagcgtgggccacagccctgagagcgaggacaagtacaggaagatcaatgaagacatcgacctgatgatctcctag

SEQ ID NO: 160712 - DNA, 264 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcaccaacaagctgttccagtatgccagcacagacatggacaaggtgctgctgaagtacacagagtacaatgagccccatgagagcaggaccaacagcgacatcgtggagacctag

SEQ ID NO: 160713 - DNA, 1422 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcaccaacaagctgttccagtatgccagcacagacatggacaaggtgctgctgaagtacacagagtacaatgagccccatgagagcaggaccaacagcgacatcgtggagaccctgaggaagaagggcctgaatggctgtgacagcccagaccctgatgctgatgacagcgtgggccacagccctgagagcgaggacaagtacaggaagatcaatgaagacatcgacctgatgatcagccggcagaggctgtgtgctgtgcccccacccaactttgagatgcctgtgtccatccctgtgagcagccacaacagcctggtgtacagcaaccctgtgagcagcctgggcaaccccaacctgctgcccctggcccaccccagcctgcagagaaattccatgagccctggggtgacccaccggccccccagcgctggcaacacaggaggcctgatgggcggggacctgaccagcggggccggcaccagcgctggaaatggctacggcaaccccaggaacagccctggcctgctggtgtccccaggcaacctgaacaagaacatgcaggccaagagccccccacccatgaacctgggcatgaacaacaggaagccagacctgcgggtgctgatccccccaggcagcaagaacaccatgcccagcgtggtgatccagaactacatcctgaagaaccagaggatcaacaacagccagagcgcccagagcctggccacccctgtggtgtctgtggccacccccaccctgcccggccagggcatgggcggctaccccagcgccatcagcaccacctatggaacagagtacagcctgagcagcgctgacctgagcagcctgagcggcttcaacacagccagcgccctgcacctgggctctgtgacaggctggcagcagcagcacctgcacaacatgcctccttctgccctgagccagctgggcgcctgcaccagcacccacctgagccagagcagcaacctgagcctgcccagcacccagagcctgaacatcaagtctgagcctgtgtccccaccccgggacaggaccaccacccccagccgctacccccagcacaccaggcatgaggccggccgcagccctgtggacagcctgagcagctgcagcagcagctatgatggcagtgaccgggaggaccacagaaatgagttccacagccccatcggcctgacccggcccagcccagatgagcgggagagccccagcgtgaagaggatgaggctgtctgagggctgggccacctag

SEQ ID NO: 160714 - DNA, 684 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcaccaacaagctgttccagtatgccagcacagacatggacaaggtgctgctgaagtacacagagtacaatgagccccatgagagcaggaccaacagcgacatcgtggaggccctgaacaagaaggagaacaagggctgtgagagcccagaccctgacagcagctatgccctgacccccaggacagaggagaagtacaagaagatcaatgaggagtttgacaacatgatcaagagccacaagatcccagctgtgcccccacccaactttgagatgcctgtgtccatccctgtgagcagccacaacagcctggtgtacagcaaccctgtgagcagcctgggcaaccccaacctgctgcccctggcccaccccagcctgcagagaaattccatgagccctggggtgacccaccggccccccagcgctggcaacacaggaggcctgatgggcggggacctgaccagcggggccggcaccagcgctggaaatggctacggcaaccccaggaacagccctggcctgctggtgagcccctag

SEQ ID NO: 160715 - DNA, 363 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcaccaacaagctgttccagtatgccagcacagacatggacaaggtgctgctgaagtacacagagtacaatgagccccatgagagcaggaccaacagcgacatcgtggaggccctgaacaagaaggagaacaagggctgtgagagcccagaccctgacagcagctatgccctgacccccaggacagaggagaagtacaagaagatcaatgaatag

SEQ ID NO: 160716 - DNA, 381 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcaccaacaagctgttccagtatgccagcacagacatggacaaggtgctgctgaagtacacagagtacaatgagccccatgagagcaggaccaacagcgacatcgtggagaccctgaggaagaagggcctgaatggctgtgacagcccagaccctgatgctgatgacagcgtgggccacagccctgagagcgaggacaagtacaggaagatcaatgaagacatcgacctgtag

SEQ ID NO: 160717 - DNA, 87 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgtag

SEQ ID NO: 160718 - DNA, 1398 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcaccaacaagctgttccagtatgccagcacagacatggacaaggtgctgctgaagtacacagagtacaatgagccccatgagagcaggaccaacagcgacatcgtggagaccctgaggaagaagggcctgaatggctgtgacagcccagaccctgatgctgatgacagcgtgggccacagccctgagagcgaggacaagtacaggaagatcaatgaagacatcgacctgatgatcagccggcagaggctgtgtgctgtgcccccacccaactttgagatgcctgtgtccatccctgtgagcagccacaacagcctggtgtacagcaaccctgtgagcagcctgggcaaccccaacctgctgcccctggcccaccccagcctgcagagaaattccatgagccctggggtgacccaccggccccccagcgctggcaacacaggaggcctgatgggcggggacctgaccagcggggccggcaccagcgctggaaatggctacggcaaccccaggaacagccctggcctgctggtgtccccaggcaacctgaacaagaacatgcaggccaagagccccccacccatgaacctgggcatgaacaacaggaagccagacctgcgggtgctgatccccccaggcagcaagaacaccatgcccagcgtgaaccagaggatcaacaacagccagagcgcccagagcctggccacccctgtggtgtctgtggccacccccaccctgcccggccagggcatgggcggctaccccagcgccatcagcaccacctatggaacagagtacagcctgagcagcgctgacctgagcagcctgagcggcttcaacacagccagcgccctgcacctgggctctgtgacaggctggcagcagcagcacctgcacaacatgcctccttctgccctgagccagctgggcgcctgcaccagcacccacctgagccagagcagcaacctgagcctgcccagcacccagagcctgaacatcaagtctgagcctgtgtccccaccccgggacaggaccaccacccccagccgctacccccagcacaccaggcatgaggccggccgcagccctgtggacagcctgagcagctgcagcagcagctatgatggcagtgaccgggaggaccacagaaatgagttccacagccccatcggcctgacccggcccagcccagatgagcgggagagccccagcgtgaagaggatgaggctgtctgagggctgggccacctag

SEQ ID NO: 160719 - DNA, 729 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcaccaacaagctgttccagtatgccagcacagacatggacaaggtgctgctgaagtacacagagtacaatgagccccatgagagcaggaccaacagcgacatcgtggaggccctgaacaagaaggagaacaagggctgtgagagcccagaccctgacagcagctatgccctgacccccaggacagaggagaagtacaagaagatcaatgaggagtttgacaacatgatcaagagccacaagatcccagctgtgcccccacccaactttgagatgcctgtgtccatccctgtgagcagccacaacagcctggtgtacagcaaccctgtgagcagcctgggcaaccccaacctgctgcccctggcccaccccagcctgcagagaaattccatgagccctggggtgacccaccggccccccagcgctggcaacacaggaggcctgatgggcggggacctgaccagcggggccggcaccagcgctggaaatggctacggcaaccccaggaacagccctggcctgctggtgtccccaggcaacctgaacaagaacatgcaggccaagagccccccacccatgtag

SEQ ID NO: 160720 - DNA, 1326 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcaccaacaagctgttccagtatgccagcacagacatggacaaggtgctgctgaagtacacagagtacaatgagccccatgagagcaggaccaacagcgacatcgtggagaccctgaggaagaagggcctgaatggctgtgacagcccagaccctgatgctgatgacagcgtgggccacagccctgagagcgaggacaagtacaggaagatcaatgaagacatcgacctgatgatcagccggcagaggctgtgtgctgtgcccccacccaactttgagatgcctgtgtccatccctgtgagcagccacaacagcctggtgtacagcaaccctgtgagcagcctgggcaaccccaacctgctgcccctggcccaccccagcctgcagagaaattccatgagccctggggtgacccaccggccccccagcgctggcaacacaggaggcctgatgggcggggacctgaccagcggggccggcaccagcgctggaaatggctacggcaaccccaggaacagccctggcctgctggtgtccccaggcaacctgaacaagaacatgcaggccaagagccccccacccatgaacctgggcatgaacaacaggaagccagacctgcgggtgctgatccccccaggcagcaagaacaccatgcccagcgtgtctgaagatgtggacctgctgctgaaccagaggatcaacaacagccagagcgcccagagcctggccacccctgtggtgtctgtggccacccccaccctgcccggccagggcatgggcggctaccccagcgccatcagcaccacctatggaacagagtacagcctgagcagcgctgacctgagcagcctgagcggcttcaacacagccagcgccctgcacctgggctctgtgacaggctggcagcagcagcacctgcacaacatgcctccttctgccctgagccagctgggggacaggaccaccacccccagccgctacccccagcacaccaggcatgaggccggccgcagccctgtggacagcctgagcagctgcagcagcagctatgatggcagtgaccgggaggaccacagaaatgagttccacagccccatcggcctgacccggcccagcccagatgagcgggagagccccagcgtgaagaggatgaggctgtctgagggctgggccacctag

SEQ ID NO: 160721 - DNA, 1422 bp, Artificial Sequence; identical to SEQ ID NO: 160709
  Description of Artificial Sequence: Synthetic coding sequence

SEQ ID NO: 160722 - DNA, 1254 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcaccaacaagctgttccagtatgccagcacagacatggacaaggtgctgctgaagtacacagagtacaatgagccccatgagagcaggaccaacagcgacatcgtggaggccgtgcccccacccaactttgagatgcctgtgtccatccctgtgagcagccacaacagcctggtgtacagcaaccctgtgagcagcctgggcaaccccaacctgctgcccctggcccaccccagcctgcagagaaattccatgagccctggggtgacccaccggccccccagcgctggcaacacaggaggcctgatgggcggggacctgaccagcggggccggcaccagcgctggaaatggctacggcaaccccaggaacagccctggcctgctggtgtccccaggcaacctgaacaagaacatgcaggccaagagccccccacccatgaacctgggcatgaacaacaggaagccagacctgcgggtgctgatccccccaggcagcaagaacaccatgcccagcgtgaaccagaggatcaacaacagccagagcgcccagagcctggccacccctgtggtgtctgtggccacccccaccctgcccggccagggcatgggcggctaccccagcgccatcagcaccacctatggaacagagtacagcctgagcagcgctgacctgagcagcctgagcggcttcaacacagccagcgccctgcacctgggctctgtgacaggctggcagcagcagcacctgcacaacatgcctccttctgccctgagccagctgggcgcctgcaccagcacccacctgagccagagcagcaacctgagcctgcccagcacccagagcctgaacatcaagtctgagcctgtgtccccaccccgggacaggaccaccacccccagccgctacccccagcacaccaggcatgaggccggccgcagccctgtggacagcctgagcagctgcagcagcagctatgatggcagtgaccgggaggaccacagaaatgagttccacagccccatcggcctgacccggcccagcccagatgagcgggagagccccagcgtgaagaggatgaggctgtctgagggctgggccacctag

SEQ ID NO: 160723 - DNA, 1452 bp, Artificial Sequence
  Description of Artificial Sequence: Synthetic coding sequence
atgggcaggaagaagatccagatcacccgcatcatggatgaaagaaaccggcaggtgaccttcaccaagaggaagtttggcctgatgaagaaggcctatgagctgtctgtgctgtgtgactgtgaaattgccctgatcatcttcaacagcaccaacaagctgttccagtatgccagcacagacatggacaaggtgctgctgaagtacacagagtacaatgagccccatgagagcaggaccaacagcgacatcgtggagaccctgaggaagaagggcctgaatggctgtgacagcccagaccctgatgctgatgacagcgccctgaacaagaaggagaacaagggctgtgagagcccagaccctgacagcagctatgccctgacccccaggacagaggagaagtacaagaagatcaatgaggagtttgacaacatgatcaagagccacaagatcccagctgtgcccccacccaactttgagatgcctgtgtccatccctgtgagcagccacaacagcctggtgtacagcaaccctgtgagcagcctgggcaaccccaacctgctgcccctggcccaccccagcctgcagagaaattccatgagccctggggtgacccaccggccccccagcgctggcaacacaggaggcctgatgggcggggacctgaccagcggggccggcaccagcgctggaaatggctacggcaaccccaggaacagccctggcctgctggtgtccccaggcaacctgaacaagaacatgcaggccaagagccccccacccatgaacctgggcatgaacaacaggaagccagacctgcgggtgctgatccccccaggcagcaagaacaccatgcccagcgtgaaccagaggatcaacaacagccagagcgcccagagcctggccacccctgtggtgtctgtggccacccccaccctgcccggccagggcatgggcggctaccccagcgccatcagcaccacctatggaacagagtacagcctgagcagcgctgacctgagcagcctgagcggcttcaacacagccagcgccctgcacctgggctctgtgacaggctggcagcagcagcacctgcacaacatgcctccttctgccctgagccagctgggcgcctgcaccagcacccacctgagccagagcagcaacctgagcctgcccagcacccagagcctgaacatcaagtctgagcctgtgtccccaccccgggacaggaccaccacccccagccgctacccccagcacaccaggcatgaggccggccgcagccctgtggacagcctgagcagctgcagcagcagctatgatggcagtgaccgggaggaccacagaaatgagttccacagccccatcggcctgacccggcccagcccagatgagcgggagagccccagcgtgaagaggatgaggctgtctgagggctgggccacctag

SEQ ID NO: 160724 - DNA, 1563 bp, Artificial Sequence
  Description of Artificial Sequence: Synthetic coding sequence
atgggcaggaagaagatccagatccagaggatcacagatgaaagaaaccggcaggtgaccttcaccaagaggaagtttggcctgatgaagaaggcctatgagctgtctgtgctgtgtgactgtgaaattgccctgatcatcttcaaccacagcaacaagctgttccagtatgccagcacagacatggacaaggtgctgctgaagtacacagagtacaatgagccccatgagagcaggaccaatgctgacatcatcgaggccctgcacaagaagcaccgggagtgtgagagccctgaggtggatgaggtgtttgccctgaccccccagacagaggagaagtacaagaagattgatgaggagtttgacaagatgatgcagagctaccgcctggccagcacagtgcctgcccccaactttgccatgcctgtgacagtgcctgtgagcaaccagagcagcctgcagttcagcaaccccagcggcagcctggtgacccccagcctggtgaccagcagcctgacagacccccggctgctgagcccccagcagcctgccctgcagagaaattctgtgtccccaggcctgccccagaggcctgccagcgctggggccatgctgggcggggacctgaacagcgccaatggagcctgccccagccctgtgggcaatggctacgtgtctgcccgggccagccctggcctgctgcctgtggccaacggcaacagcctgaacaaggtgatcccagccaagagccccccaccacccacccacagcacccagctgggcgcccccagcaggaagccagacctgcgggtcatcaccagccaggccggcaagggcctgatgcaccacctgacagaggaccacctggacctgaacaatgcccagaggctgggcgtgtcccagagcacccacagcctgaccacccctgtggtgtctgtggccacccccagcctgctgagccagggcctgcccttcagctccatgcccacagcctacaacacagactaccagctgaccagcgctgagctgagcagcctgcctgccttcagcagccctgggggcctgagcctgggcaatgtgacagcctggcagcagccccagcagccccagcagccccagcagccccagcccccccagcagcagcccccccagccccagcagccccagccccagcagccccagcagccccagcagcccccccagcagcagagccacctggtgcctgtgtccctgagcaacctgatccctggcagccccctgccccacgtgggcgccgccctgactgtgaccacccacccccacatcagcatcaagtctgagcctgtgagccccagccgggagaggagccctgcccctcctcctcctgctgtgtttcctgctgcccggcctgagcctggagatggcctgagcagccctgctgggggcagctatgaaacaggagacagagatgatggccgcggggactttggccccaccctgggcctgctgcggcctgcccctgagcctgaggccgagggcagcgctgtgaagaggatgaggctggacacctggaccctgaagtag

SEQ ID NO: 160725 - DNA, 1566 bp, Artificial Sequence
  Description of Artificial Sequence: Synthetic coding sequence
atgggcaggaagaagatccagatccagaggatcacagatgaaagaaaccggcaggtgaccttcaccaagaggaagtttggcctgatgaagaaggcctatgagctgtctgtgctgtgtgactgtgaaattgccctgatcatcttcaaccacagcaacaagctgttccagtatgccagcacagacatggacaaggtgctgctgaagtacacagagtacaatgagccccatgagagcaggaccaatgctgacatcatcgagaccctgaggaagaagggcttcaacggctgtgacagccctgagccagatggagaggacagcctggagcagagccccctgctggaggacaagtaccgccgggccagcgaggagctggatggcctcttcagaagatatggcagcacagtgcctgcccccaactttgccatgcctgtgacagtgcctgtgagcaaccagagcagcctgcagttcagcaaccccagcggcagcctggtgacccccagcctggtgaccagcagcctgacagacccccggctgctgagcccccagcagcctgccctgcagaggaacagcgtgtccccaggcctgccccagaggcctgccagcgctggggccatgctgggcggggacctgaacagcgccaacggggcctgccccagccctgtgggcaatggctacgtgtctgcccgggccagccctggcctgctgcctgtggccaatggaaacagcctgaacaaggtgatcccagccaagagccccccaccacccacccacagcacccagctgggcgcccccagcaggaagccagacctgcgggtcatcaccagccaggccggcaagggcctgatgcaccacctgacagaggaccacctggacctgaacaatgcccagaggctgggcgtgtcccagagcacccacagcctgaccacccctgtggtgtctgtggccacccccagcctgctgagccagggcctgcccttcagctccatgcccacagcctacaacacagactaccagctgaccagcgctgagctgagcagcctgcctgccttcagcagccctgggggcctgagcctgggcaatgtgacagcctggcagcagccccagcagccccagcagccccagcagccccagcccccccagcagcagcccccccagccccagcagccccagccccagcagccccagcagccccagcagcccccccagcagcagagccacctggtgcctgtgtccctgagcaacctgatccctggcagccccctgccccacgtgggcgccgccctgactgtgaccacccacccccacatcagcatcaagtctgagcctgtgagccccagccgggagaggagccctgcccctcctcctcctgctgtgtttcctgctgcccggcctgagcctggagatggcctgagcagccctgctgggggcagctatgagaccggggacagagatgatggccgcggggactttggccccaccctgggcctgctgcggcctgcccctgagcctgaggccgagggcagcgctgtgaagaggatgaggctggacacctggaccctgaagtag

SEQ ID NO: 160726 - DNA, 1428 bp, Artificial Sequence
  Description of Artificial Sequence: Synthetic coding sequence
atgggcaggaagaagatccagatccagaggatcacagatgaaagaaaccggcaggtgaccttcaccaagaggaagtttggcctgatgaagaaggcctatgagctgtctgtgctgtgtgactgtgaaattgccctgatcatcttcaaccacagcaacaagctgttccagtatgccagcacagacatggacaaggtgctgctgaagtacacagagtacaatgagccccatgagagcaggaccaatgctgacatcatcgagagcacagtgcctgcccccaactttgccatgcctgtgacagtgcctgtgagcaaccagagcagcctgcagttcagcaaccccagcggcagcctggtgacccccagcctggtgaccagcagcctgacagacccccggctgctgagcccccagcagcctgccctgcagaggaacagcgtgtccccaggcctgccccagaggcctgccagcgctggggccatgctgggcggggacctgaacagcgccaacggggcctgccccagccctgtgggcaatggctacgtgtctgcccgggccagccctggcctgctgcctgtggccaatggaaacagcctgaacaaggtgatcccagccaagagccccccaccacccacccacagcacccagctgggcgcccccagcaggaagccagacctgcgggtcatcaccagccaggccggcaagggcctgatgcaccacctgacagaggaccacctggacctgaacaatgcccagaggctgggcgtgtcccagagcacccacagcctgaccacccctgtggtgtctgtggccacccccagcctgctgagccagggcctgcccttcagctccatgcccacagcctacaacacagactaccagctgaccagcgctgagctgagcagcctgcctgccttcagcagccctgggggcctgagcctgggcaatgtgacagcctggcagcagccccagcagccccagcagccccagcagccccagcccccccagcagcagcccccccagccccagcagccccagccccagcagccccagcagccccagcagcccccccagcagcagagccacctggtgcctgtgtccctgagcaacctgatccctggcagccccctgccccacgtgggcgccgccctgactgtgaccacccacccccacatcagcatcaagtctgagcctgtgagccccagccgggagaggagccctgcccctcctcctcctgctgtgtttcctgctgcccggcctgagcctggagatggcctgagcagccctgctgggggcagctatgagaccggggacagagatgatggccgcggggactttggccccaccctgggcctgctgcggcctgcccctgagcctgaggccgagggcagcgctgtgaagaggatgaggctggacacctggaccctgaagtag

SEQ ID NO: 160727 - DNA, 1545 bp, Artificial Sequence
  Description of Artificial Sequence: Synthetic coding sequence
atgggcaggaagaagatccagatccagaggatcacagatgaaagaaaccggcaggtgaccttcaccaagaggaagtttggcctgatgaagaaggcctatgagctgtctgtgctgtgtgactgtgaaattgccctgatcatcttcaaccacagcaacaagctgttccagtatgccagcacagacatggacaaggtgctgctgaagtacacagagtacaatgagccccatgagagcaggaccaatgctgacatcatcgagaccctgaggaagaagggcttcaacggctgtgacagccctgagccagatggagaggacagcctggagcagagccccctgctggaggacaagtaccgccgggccagcgaggagctggatggcctcttcagaagatatggcagcacagtgcctgcccccaactttgccatgcctgtgacagtgcctgtgagcaaccagagcagcctgcagttcagcaaccccagcggcagcctggtgacccccagcctggtgaccagcagcctgacagacccccggctgctgagcccccagcagcctgccctgcagaggaacagcgtgtccccaggcctgccccagaggcctgccagcgctggggccatgctgggcggggacctgaacagcgccaacggggcctgccccagccctgtgggcaatggctacgtgtctgcccgggccagccctggcctgctgcctgtggccaatggaaacagcctgaacaaggtgatcccagccaagagccccccaccacccacccacagcacccagctgggcgcccccagcaggaagccagacctgcgggtcatcaccagccaggccggcaagggcctgatgcaccacctgaacaatgcccagaggctgggcgtgtcccagagcacccacagcctgaccacccctgtggtgtctgtggccacccccagcctgctgagccagggcctgcccttcagctccatgcccacagcctacaacacagactaccagctgaccagcgctgagctgagcagcctgcctgccttcagcagccctgggggcctgagcctgggcaatgtgacagcctggcagcagccccagcagccccagcagccccagcagccccagcccccccagcagcagcccccccagccccagcagccccagccccagcagccccagcagccccagcagcccccccagcagcagagccacctggtgcctgtgtccctgagcaacctgatccctggcagccccctgccccacgtgggcgccgccctgactgtgaccacccacccccacatcagcatcaagtctgagcctgtgagccccagccgggagaggagccctgcccctcctcctcctgctgtgtttcctgctgcccggcctgagcctggagatggcctgagcagccctgctgggggcagctatgaaacaggagacagagatgatggccgcggggactttggccccaccctgggcctgctgcggcctgcccctgagcctgaggccgagggcagcgctgtgaagaggatgaggctggacacctggaccctgaagtag

SEQ ID NO: 160728 - DNA, 1545 bp, Artificial Sequence; identical to SEQ ID NO: 160727
  Description of Artificial Sequence: Synthetic coding sequence

SEQ ID NO: 160729 - DNA, 1533 bp, Artificial Sequence
  Description of Artificial Sequence: Synthetic coding sequence
atgggcaggaagaagatccagatccagaggatcacagatgaaagaaaccggcaggtgaccttcaccaagaggaagtttggcctgatgaagaaggcctatgagctgtctgtgctgtgtgactgtgaaattgccctgatcatcttcaaccacagcaacaagctgttccagtatgccagcacagacatggacaaggtgctgctgaagtacacagagtacaatgagccccatgagagcaggaccaatgctgacatcatcgaggccctgcacaagaagcaccgggagtgtgagagccctgaggtggatgaggtgtttgccctgaccccccagacagaggagaagtacaagaagattgatgaggagtttgacaagatgatgcagagctaccgcctggccagcacagtgcctgcccccaactttgccatgcctgtgacagtgcctgtgagcaaccagagcagcctgcagttcagcaaccccagcggcagcctggtgacccccagcctggtgaccagcagcctgacagacccccggctgctgagcccccagcagcctgccctgcagagaaattctgtgtccccaggcctgccccagaggcctgccagcgctggggccatgctgggcggggacctgaacagcgccaatggagcctgccccagccctgtgggcaatggctacgtgtctgcccgggccagccctggcctgctgcctgtggccaacggcaacagcctgaacaaggtgatcccagccaagagccccccaccacccacccacagcacccagctgggcgcccccagcaggaagccagacctgcgggtcatcaccagccaggccggcaagggcctgatgcaccacctgaacaatgcccagaggctgggcgtgtcccagagcacccacagcctgaccacccctgtggtgtctgtggccacccccagcctgctgagccagggcctgcccttcagctccatgcccacagcctacaacacagactaccagctgaccagcgctgagctgagcagcctgcctgccttcagcagccctgggggcctgagcctgggcaatgtgacagcctggcagcagccccagcagccccagcagccccagcagccccagcccccccagcagcagcccccccagccccagcagccccagccccagcagccccagcagccccagcagcccccccagcagcagagccacctggtgcctgtgtccctgagcaacctgatccctggcagccccctgccccacgtgggcgccgccctgactgtgaccacccacccccacatcagcatcaagtctgagcctgtgagccccagccgggagaggagccctgcccctcctcctcctgctgtgtttcctgctgcccggcctgagcctggagatggcctgagcagccctgctgggggcagctatgagaccggggacagagatgatggccgcggggactttggccccaccctgggcctgctgcggcctgcccctgagcctgaggccgagggcagcgctgtgaagaggatgaggctggacacctggtag

SEQ ID NO: 160730 - DNA, 420 bp, Artificial Sequence
  Description of Artificial Sequence: Synthetic coding sequence
atgggcaggaagaagatccagatccagaggatcacagatgaaagaaaccggcaggtgaccttcaccaagaggaagtttggcctgatgaagaaggcctatgagctgtctgtgctgtgtgactgtgaaattgccctgatcatcttcaaccacagcaacaagctgttccagtatgccagcacagacatggacaaggtgctgctgaagtacacagagtacaatgagccccatgagagcaggaccaatgctgacatcatcgagaccctgaggaagaagggcttcaacggctgtgacagccctgagccagatggagaggacagcctggagcagagccccctgctggaggacaagtaccgccgggccagcgaggagctggatggcctcttcagaagatatggaggcccctgctggggcgtgacctag

SEQ ID NO: 160731 - DNA, 1410 bp, Artificial Sequence
  Description of Artificial Sequence: Synthetic coding sequence
atggccgaggagcgggagcctgagctgtacctgaagtggaagcactgtgagaccccaggagtgaagaccctgtgcaacctgaagcactgtgagaccccaggagtgaagaccctgtgcaacctgaagaagctgctgaaccggctgcagaaggaccaccgggaggatgtgtacctgtacatcagcggccacctgaaccccaacaagctgtaccagcccccagagaccatcctgcagcactggcccaatgcccaccggcccaagggggagcgggccagcgaggtgggggagcccccagctgggaaggtggccaggatgaaggaggccctggcccacttcaccatccacacagccctggtgcccagcgaggcccaggacacccccctcttccgctacctgaacccccaggccagcctgagccacaccagcgaggaggacttcctgcctgtggaggccgtgcgggagggcaaggaggagaagaagggcggccccccaggccggggccccccaggctggaggagaagagaggagctgcggctgcctgacctgaaggtgctgtgctaccaggaggccggcagccggggcacccgggacagacaccactacgtgagcagctacctggccggggccaccagcgctgaccgctacaggatgttcctgcgcttccagaaggaggtgctggccaagcaggacctgctgaagaatgacttcaccggcagcaaggctgctgctggccacgagaggaagctgcagcaggagctgcagaagatctgcacctgcagcccccagcagttcaaccggctgcacgtgtttgggaaggtgtttgaggacatctgcaacagcagcctcatctttggagacctgctgaagaaggtgaaggatgaatatgagctgtacatggccaccctgctggagagccagcctgctgcccagtatgaggccctgctggcccagctgaaggccctgggccagaggcctgtgaagacagctgacatggacctggcccgggaggagctgaggatgctggtgacagccaccaaggccgccctggagcagaatgaccggctgcggtctgagctggagatggaggtggccctgctgcagagcgccaaggagaggtctgagagcagcgagaagcacatcattgatgaaaatcggctgaccctgacagagaaggtggagaagaagagatgtgagatcctgagcaagtgggatgagatccaggccctggagaaggagatcaagaccaccctggtgcacacaggcatcagtgacatcacagaaaatcgcatcaagagcattgaacatgaggccatccagctggagacagagaacatgatcctgaagaagaagatcaagggccccctggagatctaccagggcatctgcaagatccggggcaacagaagatag

SEQ ID NO: 160732 - DNA, 741 bp, Artificial Sequence
  Description of Artificial Sequence: Synthetic coding sequence
atgtaccaggtgtctggccagaggcccagcggctgtgatgccccctacggggcccccagcgctgcccctggccctgcccagaccctgagcctgctgcccggcctggaggtggtgacaggcagcacccaccctgctgaggccgcccctgaggagggcagcctggaggaggccgccacccccatgccccagggcaatggacctggcatcccccagggcctggacagcacagacctggatgtgcccacagaggccgtgacctgccagccccagggcaaccccctgggctgcacccccctgctgcccaatgacagcggccaccccagcgagctgggcggcacccggcgggctggaaatggagccctgggcggccccaaggcccacaggaagctgcagacccaccccagcctggccagccagggcagcaagaagagcaagagcagcagcaagagcaccaccagccagatccccctgcaggcccaggaggactgctgcgtgcactgcatcctgagctgcctcttctgtgagttcctgaccctgtgcaacatcgtgctggactgtgccacctgtggcagctgcagcagcgaggacagctgcctgtgctgctgctgctgcggcagcggggagtgtgccgactgtgacctgccctgtgacctggactgtggcatcctggatgcctgctgtgagagcgctgactgcctggagatctgcatggagtgctgcggcctgtgcttcagcagctag

SEQ ID NO: 160733 - DNA, 696 bp, Artificial Sequence
  Description of Artificial Sequence: Synthetic coding sequence
atgtaccaggtgtctggccagaggcccagcggctgtgatgccccctacggggcccccagcgctgcccctggccctgcccagaccctgagcctgctgcccggcctggaggtggtgacaggcagcacccaccctgctgaggccgcccctgaggagggcagcctggaggaggccgccacccccatgccccagggcaatggacctggcatcccccagggcctggacagcacagacctggatgtgcccacagaggccgtgacctgccagccccagggcaaccccctgggctgcacccccctgctgcccaatgacagcggccaccccagcgagctgggcggcacccggcgggctggaaatggagccctgggcggccccaaggcccacaggaagctgcagacccaccccagcctggccagccagggcagcaagaagagcaagagcagcagcaagagcaccaccagccagatccccctgcaggcccaggaggactgctgcgtgcactgcatcctgagctgcctcttctgtgagttcctgaccctgtgcaacatcgtgctggactgtgccacctgtggcagctgcagcagcgaggacagctgcctgtgctgctgctgctgcggcagcggggagtgtgccgactgtgacctgccctgtgacctggactgtggcatcctggatgcctgctgtgagagcgctgactag

SEQ ID NO: 160734 - DNA, 642 bp, Artificial Sequence
  Description of Artificial Sequence: Synthetic coding sequence
atgtaccaggtgtctggccagaggcccagcggctgtgatgccccctacggggcccccagcgctgcccctggccctgcccagaccctgagcctgctgcccggcctggaggtggtgacaggcagcacccaccctgctgaggccgcccctgaggagggcagcctggaggaggccgccacccccatgccccagggcaatggacctggcatcccccagggcctggacagcacagacctggatgtgcccacagaggccgtgacctgccagccccagggcaaccccctgggctgcacccccctgctgcccaatgacagcggccaccccagcgagctgggcggcacccggcgggctggaaatggagccctgggcggccccaaggcccacaggaagctgcagacccaccccagcctggccagccagggcagcaagaagagcaagagcagcagcaagagcaccaccagccagatccccctgcaggcccaggaggactgctgcgtgcactgcatcctgagctgcctcttctgtgagttcctgaccctgtgcaacatcgtgctggactgtgccacctgtggcagctgcagcagcgaggacagctgcctgtgctgctgctgctgcggcagcggggagtgtgccgactgtgactag

SEQ ID NO: 160735 - DNA, 297 bp, Artificial Sequence
  Description of Artificial Sequence: Synthetic coding sequence
atgtaccaggtgtctggccagaggcccagcggctgtgatgccccctacggggcccccagcgctgcccctggccctgcccagaccctgagcctgctgcccggcctggaggtggtgacaggcagcacccaccctgctgaggccgcccctgaggagggcagcctggaggaggccgccacccccatgccccagggcaatggacctggcatcccccagggcctggacagcacagacctggatgtgcccacagaggccgtgacctgccagccccagggcaaccccctgggctgcaccccctag

SEQ ID NO: 160736 - DNA, 387 bp, Artificial Sequence
  Description of Artificial Sequence: Synthetic coding sequence
atgtaccaggtgtctggccagaggcccagcggctgtgatgccccctacggggcccccagcgctgcccctggccctgcccagaccctgagcctgctgcccggcctggaggtggtgacaggcagcacccaccctgctgaggccgcccctgaggagggcagcctggaggaggccgccacccccatgccccagggcaatggacctggcatcccccagggcctggacagcacagacctggatgtgcccacagaggccgtgacctgccagccccagggcaaccccctgggctgcacccccctgctgcccaatgacagcggccaccccagcgagctgggcggcacccggcgggctggaaatggagccctgggcggccccaaggcccacaggtag

SEQ ID NO: 160737 - DNA, 741 bp, Artificial Sequence; identical to SEQ ID NO: 160732
  Description of Artificial Sequence: Synthetic coding sequence

SEQ ID NO: 160738 - DNA, 729 bp, Artificial Sequence
  Description of Artificial Sequence: Synthetic coding sequence
atgatgatggacctgtttgagaccggcagctacttcttctacctggatggagaaaatgtgaccctgcagcccctggaggtggccgagggcagccccctgtacccaggcagtgatggcaccctgagcccctgccaggaccagatgcctcctgaggccggcagtgacagcagtggagaggagcacgtgctggcccctcctggcctgcagcccccccactgccccggccagtgcctgatctgggcctgcaagacctgcaagaggaagagcgcccccacagacaggaggaaggccgccaccctgcgggagcggcggcggctgaagaagatcaatgaggcctttgaggccctgaagagaagaacagtggccaaccccaaccagaggctgcccaaggtggagatcctgcggagcgccatctcctacatcgagcggctgcaggacctgctgcaccggctggaccagcaggagaagatgcaggagctgggcgtggaccccttctcctaccggcccaagcaggagaacctggagggcgctgacttcctgcggacctgcagcagccagtggcccagcgtgtctgaccacagccggggcctggtgatcacagccaaggagggcggggccagcattgacagcagcgccagcagcagcctgcgctgcctgagcagcatcgtggacagcatcagcagcgaggagaggaagctgccctgtgtggaggaggtggtggagaagtag

SEQ ID NO: 160739 - DNA, 1527 bp, Artificial Sequence
  Description of Artificial Sequence: Synthetic coding sequence
atgacccagaccctgaagtatgccagcagggtcttccaccgggtgcgctgggcccctgagctgggcgccagcctgggctaccgggagtaccacagcgcccggcgcagcctggccgacatccctggccccagcacccccagcttcctggccgagctgttctgcaagggcggcctgagccggctgcacgagctgcaggtgcagggcgccgcccacttcggccctgtgtggctggccagctttggcaccgtgaggacagtgtatgtggccgccccagccctggtggaggagctgctgcggcaggagggccccaggcctgagcgctgcagcttcagcccctggacagagcaccggcgctgccggcagagggcctgtggcctgctgacagctgagggggaggagtggcagaggctgcggagcctgctggcccccctgctgctgcggccccaggccgccgcccgctatgccggcaccctgaacaacgtggtgtgtgacctggtgcggcggctgcggcggcagaggggccggggcactggacctccagccctggtgagagatgtggccggggagttctacaagtttggcctggagggcattgctgctgtgctgctgggcagccggctgggctgcctggaggcccaggtgcccccagacacagagaccttcatccgggctgtgggctctgtgtttgtgtccaccctgctgaccatggccatgccccactggctgcggcacctggtgcccggcccctggggccgcctgtgccgggactgggaccagatgtttgcctttgcccagagacatgtggagcggcgggaggccgaggccgccatgagaaatggaggccagcctgagaaggacctggagagcggggcccacctgacccacttcctgttccgggaggagctgcctgcccagagcatcctgggcaatgtgacagagctgctgctggccggcgtggacacagtgagcaacaccctgtcctgggccctgtatgagctgagccgccaccctgaggtgcagacagccctgcacagcgagatcacagctgccctgagccctggcagcagcgcctaccccagcgccaccgtgctgagccagctgcccctgctgaaggctgtggtgaaggaggtgctgcggctgtaccctgtggtgcccggcaacagccgggtgcctgacaaggacatccacgtgggggactacatcatccccaagaacaccctggtgaccctgtgccactacgccaccagccgggaccctgcccagtttcctgagcccaacagcttccggcctgcccgctggctgggggagggccccaccccccacccctttgccagcctgcccttcggctttgggaagaggagctgcatgggccggcggctggccgagctggagctgcagatggccctggcccagatcctgacccactttgaggtgcagcctgagcccggggccgcccctgtgcggcccaagaccaggacagtgctggtgcctgagaggagcatcaacctgcagttcctggacagatag

SEQ ID NO: 160740 - DNA, 675 bp, Artificial Sequence
  Description of Artificial Sequence: Synthetic coding sequence
atggagctgtatgagaccagcccctacttctaccaggagccccgcttctatgatggagagaactacctgcctgtgcacctgcagggctttgagcccccaggctatgaaagaacagagctgaccctgagccctgaggcccctggccccctggaggacaagggcctgggcaccccagagcactgccccggccagtgcctgccctgggcctgcaaggtgtgcaagaggaagtctgtgtctgtggacagaagaagagctgccaccctgcgggagaagaggcggctgaagaaggtgaatgaggcctttgaggccctgaagaggagcaccctgctgaaccccaaccagaggctgcccaaggtggagatcctgcggagcgccatccagtacatcgagcggctgcaggccctgctgagcagcctgaaccaggaggagcgggacctgcgctaccggggcggcggcggcccccagcccggggtgcccagtgaatgtagcagccacagcgccagctgcagccctgagtggggcagcgccctggagttcagcgccaaccctggggaccacctgctgacagctgaccccacagatgcccacaacctgcacagcctgaccagcatcgtggacagcatcaccgtggaggatgtgtctgtggccttcccagatgagaccatgcccaactag

SEQ ID NO: 160741 - DNA, 465 bp, Artificial Sequence
  Description of Artificial Sequence: Synthetic coding sequence
atgggcctgagtgatggagagtggcagctggtgctgaatgtgtggggcaaggtggaggccgacatccctggccacggccaggaggtgctgatccgcctcttcaagggccaccctgagaccctggagaagtttgacaagttcaagcacctgaagtcagaagatgagatgaaggccagcgaggacctgaagaagcatggagccaccgtgctgacagccctgggcggcatcctgaagaagaagggccaccatgaagctgagatcaagcccctggcccagagccacgccaccaagcacaagatccctgtgaagtacctggagttcatcagcgagtgcatcatccaggtgctgcagagcaagcaccctggggactttggagcagatgcccagggcgccatgaacaaggccctggagctgttcaggaaggacatggccagcaactacaaggagctgggcttccagggctag

SEQ ID NO: 160742 - DNA, 465 bp, Artificial Sequence; identical to SEQ ID NO: 160741
  Description of Artificial Sequence: Synthetic coding sequence

SEQ ID NO: 160743 - DNA, 465 bp, Artificial Sequence; identical to SEQ ID NO: 160741
  Description of Artificial Sequence: Synthetic coding sequence

SEQ ID NO: 160744 - DNA, 465 bp, Artificial Sequence; identical to SEQ ID NO: 160741
  Description of Artificial Sequence: Synthetic coding sequence

SEQ ID NO: 160745 - DNA, 234 bp, Artificial Sequence
  Description of Artificial Sequence: Synthetic coding sequence
atgggcctgagtgatggagagtggcagctggtgctgaatgtgtggggcaaggtggaggccgacatccctggccacggccaggaggtgctgatccgcctcttcaagggccaccctgagaccctggagaagtttgacaagttcaagcacctgaagtcagaagatgagatgaaggccagcgaggacctgaagaagcatggagccaccgtgctgacagccctgggcggcatcctgtag

SEQ ID NO: 160746 - DNA, 432 bp, Artificial Sequence
  Description of Artificial Sequence: Synthetic coding sequence
atgggcctgagtgatggagagtggcagctggtgctgaatgtgtggggcaaggtggaggccgacatccctggccacggccaggaggtgctgatccgcctcttcaagggccaccctgagaccctggagaagtttgacaagttcaagcacctgaagtcagaagatgagatgaaggccagcgaggacctgaagaagcatggagccaccgtgctgacagccctgggcggcatcctgaagaagaagggccaccatgaagctgagatcaagcccctggcccagagccacgccaccaagcacaagatccctgtgaagtacctggagttcatcagcgagtgcatcatccaggtgctgcagagcaagcaccctggggactttggagcagatgcccagggcgccatgaacaaggccctggagctgttcaggaaggacatgtag

SEQ ID NO: 160747 - DNA, 321 bp, Artificial Sequence
  Description of Artificial Sequence: Synthetic coding sequence
atgggcctgagtgatggagagtggcagctggtgctgaatgtgtggggcaaggtggaggccgacatccctggccacggccaggaggtgctgatccgcctcttcaagggccaccctgagaccctggagaagtttgacaagttcaagcacctgaagtcagaagatgagatgaaggccagcgaggacctgaagaagcatggagccaccgtgctgacagccctgggcggcatcctgaagaagaagggccaccatgaagctgagatcaagcccctggcccagagccacgccaccaagcacaagatccctgtgaagtacctggagtag

SEQ ID NO: 160748 - DNA, 321 bp, Artificial Sequence; identical to SEQ ID NO: 160747
  Description of Artificial Sequence: Synthetic coding sequence

SEQ ID NO: 160749 - DNA, 411 bp, Artificial Sequence
  Description of Artificial Sequence: Synthetic coding sequence
atggctgtgggcgctgagcggctgggggaggtgctgatccgcctcttcaagggccaccctgagaccctggagaagtttgacaagttcaagcacctgaagtcagaagatgagatgaaggccagcgaggacctgaagaagcatggagccaccgtgctgacagccctgggcggcatcctgaagaagaagggccaccatgaagctgagatcaagcccctggcccagagccacgccaccaagcacaagatccctgtgaagtacctggagttcatcagcgagtgcatcatccaggtgctgcagagcaagcaccctggggactttggagcagatgcccagggcgccatgaacaaggccctggagctgttcaggaaggacatggccagcaactacaaggagctgggcttccagggctag

SEQ ID NO: 160750 - DNA, 4398 bp, Artificial Sequence
  Description of Artificial Sequence: Synthetic coding sequence
atgagcctggtgacagtgcccttctaccagaagaggcaccgccactttgaccagagctacagaaacatccagacccgctacctgctggatgaatatgccagcaagaagagggccagcacccaggccagcagccagaagagcctgagccagaggagcagcagccagagggccagcagccagaccagcctgggcggcaccatctgccgggtgtgtgccaagagggtgtccacccaggaggatgaggagcaggagaacagaagccgctaccagagcctggtggccgcctacggggaggccaagaggcagcgcttcctgtctgagctggcccacctggaggaggatgtgcacctggcccggagccaggcccgggacaagctggacaagtatgccatccagcagatgatggaggacaagctggcctgggagcggcacacctttgaggagcgcatcagccgggcccctgagatcctggtgcggctgcggagccacacagtgtgggagaggatgtctgtgaagctgtgcttcaccgtgcagggcttccccacccctgtggtgcagtggtacaaggatggcagcctcatctgccaggccgctgagcccgggaagtacagaattgagagcaactatggagtgcacaccctggagatcaacagagctgactttgatgacacagccacctacagcgctgtggccaccaatgcccacggccaggtgtccaccaatgctgctgtggtggtgcggcgcttcagaggagatgaggagcccttccgctctgtgggcctgcccatcggcctgcccctgagctccatgatcccctacacccactttgatgtgcagttcctggagaagtttggagtgaccttcagaagagaaggagagaccgtgaccctgaagtgcaccatgctggtgaccccagacctgaagagggtgcagcccagggctgagtggtacagagatgatgtgctgctgaaggagagcaagtggaccaagatgttctttggagagggccaggccagcctgtccttcagccacctgcacaaggatgatgagggcctgtacaccctgagaattgtgtccagaggaggagtgtctgaccacagcgccttcctgtttgtgagagatgctgaccccctggtgactggagcccctggggcccccatggacctgcagtgccatgatgccaacagagattatgtgattgtgacctggaagccacccaacaccaccacagagagccctgtgatgggctactttgtggacagatgtgaggtgggcaccaacaactgggtgcagtgcaatgatgcccctgtgaagatctgcaagtaccctgtgacaggcctgtttgagggccgcagctacatcttccgggtgcgggctgtgaacagcgctggcatcagccggcccagccgggtgtctgatgctgtggccgccctggaccccctggacctgcggcggctgcaggccgtgcacctggagggggagaaggagatcgccatctaccaggatgacctggagggagatgcccaggtgcccggccccccaactggagtgcacgccagcgagatcagcaggaactacgtggtgctgtcctgggagccccccaccccccggggcaaggaccccctgatgtacttcatcgagaagtctgtggtgggcagcggctcctggcagagggtgaatgcccagacagctgtgcgcagccccaggtatgctgtgtttgacctgatggagggcaagagctatgtgttccgggtgctgagcgccaacagacatggcctgtctgagcccagcgagatcaccagccccatccaggcccaggatgtgacagtggtgcccagcgcccctggccgggtgctggccagcaggaacaccaagacctctgtggtggtgcagtgggaccggcccaagcatgaggaggacctgctgggctactacgtggactgctgcgtggccggcaccaacctgtgggagccctgcaaccacaagcccatcggctacaacagatttgtggtgcacggcctgaccaccggggagcagtacatcttccgggtgaaggctgtgaatgctgtgggcatgtctgagaacagccaggagagtgatgtgatcaaggtgcaggccgccctgactgtgcccagccacccctacggcatcaccctgctgaactgtgatggccacagcatgaccctgggctggaaggtgcccaagttcagcggcggcagccccatcctgggctactacctggacaagcgggaggtgcaccacaagaactggcatgaggtgaacagcagccccagcaagcccaccatcctgactgtggatggcctgacagagggcagcctgtatgagttcaagattgctgctgtgaacctggccggcattggagagcccagcgaccccagcgagcacttcaagtgtgaggcctggaccatgcctgagcccggccctgcctatgacctgaccttctgtgaggtgcgggacaccagcctggtgatgctgtggaaggcccctgtgtacagcggcagcagccctgtgtctggctactttgtggacttccgggaggaggatgctggggagtggatcaccgtgaaccagaccaccacagccaaccgctacctgaaggtgtctgacctgcagcagggcaagacctacgtgttccgggtgcgggctgtgaatgccaatggagtgggcaagcccagcgacaccagcgagcctgtgctggtggaggcccggcccggcaccaaggagatctctgctggggtggatgagcagggcaacatctacctgggctttgactgccaggagatgacagatgccagccagttcacctggtgcaagagctatgaggagatcagtgatgatgagcgcttcaagattgagaccgtgggggaccacagcaagctgtacctgaagaacccagacaaggaggacctgggcacctacagcgtgtctgtgtctgacacagatggagtgagcagcagctttgtgctggaccctgaggagctggagcggctgatggccctgagcaatgagatcaagaaccccaccatccccctgaagtctgagctggcctatgagatctttgataaaggccgggtgcgcttctggctgcaggccgagcacctgagcccagatgccagctaccgcttcatcatcaatgaccgggaggtgtctgattctgagatccaccgcatcaagtgtgacaaggccaccggcatcatcgagatggtgatggaccgcttcagcattgaaaatgaaggcacctacacagtgcagatccatgatggcaaggccaagagccagagcagcctggtgctgattggagatgccttcaagacagtgctggaggaggccgagttccagaggaaggagttcctgaggaagcagggcccccactttgctgagtacctgcactgggatgtgacagaagaatgtgaggtgcggctggtgtgcaaggtggccaacaccaagaaggagaccgtcttcaagtggctgaaggatgatgtgctgtatgaaacagagaccctgcccaacctggagcggggcatctgtgagctgctgatccccaagctgagcaagaaggaccatggagagtacaaggccaccctgaaggatgaccggggccaggatgtgtccatcctggagattgctgggaaggtgtatgatgacatgatcctggccatgagccgggtgtgtgggaagagcgccagccccctgaaggtgctgtgcaccccagagggcatccggctgcagtgcttcatgaagtacttcacagatgagatgaaggtgaactggtgccacaaggatgccaagatcagcagcagcgagcacatgagaattggaggcagcgaggagatggcctggctgcagatctgtgagcccacagagaaggacaagggcaagtacacctttgagatctttgatggcaaggacaaccaccagaggagcctggacctgagcggccaggcctttgatgaggcctttgctgagttccagcagttcaaggccgccgcctttgctgagaagaacagaggccgcctgattggaggcctgcctgatgtggtgaccatcatggagggcaagaccctgaacctgacctgcaccgtgtttggaaatccagaccctgaggtgatctggttcaagaatgaccaggacatccagctgtctgagcacttctctgtgaaggtggagcaggccaagtatgtgtccatgaccatcaagggcgtgaccagtgaagattctgggaagtacagcatcaacatcaagaacaagtatggaggagagaagattgatgtgacagtgtctgtgtacaagcacggggagaagatcccagacatggccccaccccagcaggccaagcccaagctgatcccagccagcgccagcgctgctggccagtag

SEQ ID NO: 160751 - DNA, 3420 bp, Artificial Sequence
  Description of Artificial Sequence: Synthetic coding sequence
atgcctgagcccaccaagaaggaggatgaggaggaggtgtccccaccttctgccctgcccccagactggaccctggtggagaccccacctggagaggagcaggccaagcagaatgccaacagccagctgagcatcctcttcatcgagaagccccagggcggcaccgtgaaggtgggggaggacatcaccttcatcgccaaggtgaaggccgaggacctgctgaggaagcccaccatcaagtggttcaagggcaagtggatggacctggccagcaaggccggcaagcacctgcagctgaaggagacctttgagcggcacagccgggtgtacacctttgagatgcagatcatcaaggccaaggacaactttgctggcaactaccgctgtgaggtgacctacaaggacaagtttgacagctgcagctttgacctggaggtgcatgagagcacaggcaccacccccaacatcgacatccgcagcgccttcaagaggtctggagagggccaggaggatgctggggagctggacttcagcggcctgctgaagagaagagaggtgaagcagcaggaggaggagccccaggtggatgtgtgggagctgctgaagaatgccaagcccagtgaatatgagaagatcgccttccagtatggcatcacagacctgcggggcatgctgaagaggctgaagaggatgaggcgggaggagaagaagtctgctgcctttgccaagatcctggaccctgcctaccaggtggacaagggcggccgggtgcgctttgtggtggagctggccgaccccaagctggaggtgaagtggtacaagaatggccaggagatccggcccagcaccaagtacatctttgagcacaagggctgccagaggatcctcttcatcaacaactgccagatgacagatgattctgagtactacgtgacagctggagatgagaagtgcagcacagagctgtttgtgcgggagccccccatcatggtgaccaagcagctggaggacaccacagcctactgtggggagcgggtggagctggagtgtgaggtgtctgaagatgatgccaacgtgaagtggttcaagaatggagaggagatcatccctggccccaagagccgctaccgcatccgggtggagggcaagaagcacatcctgatcattgaaggagccaccaaggcagatgctgctgagtacagcgtgatgaccactggaggccagagcagcgccaagctgtctgtggacctgaagcccctgaagatcctgacccccctgacagaccagacagtgaacctgggcaaggagatctgcctgaagtgtgagatcagcgagaacatccctgggaagtggaccaagaatggcctgcctgtgcaggagagtgaccggctgaaggtggtgcacaagggccgcatccacaagctggtgattgccaatgccctgacagaagatgaaggagactatgtgtttgccccagatgcctacaacgtgaccctgcctgccaaggtgcacgtgattgacccccccaagatcatcctggatggcctggatgctgacaacacagtgacagtgattgctggcaacaagctgcggctggagatccccatctctggagagcccccacccaaggccatgtggagcagaggagacaaggccatcatggagggcagcggccgcatcagaacagagagctacccagacagcagcaccctggtgattgatattgctgagagagatgattctggagtgtaccacatcaacctgaagaatgaggccggggaggcccacgccagcatcaaggtgaaggtggtggacttcccagacccccctgtggcccccaccgtgacagaggtgggagatgactggtgcatcatgaactgggagcccccagcctatgatggcggcagccccatcctgggctacttcattgaaaggaagaagaagcagagcagccgctggatgaggctgaactttgacctgtgcaaggagaccacctttgagcccaagaagatgattgagggcgtggcctatgaggtgcgcatctttgctgtgaatgccatcggcatcagcaagcccagcatgcccagccggccctttgtgcccctggccgtgaccagcccccccaccctgctgactgtggacagcgtgacagacaccaccgtgaccatgcgctggaggcccccagaccacatcggggccgccggcctggatggctacgtgctggagtactgctttgagggcacagaggactggatcgtggccaacaaggacctgattgacaagaccaagttcaccatcaccggcctgcccacagatgccaagatctttgtgcgggtgaaggctgtgaatgctgctggggccagcgagcccaagtactacagccagcccatcctggtgaaggagatcatcgagccccccaagatccgcatccccaggcacctgaagcagacctacatccggcgggtgggggaggccgtgaacctggtgatccccttccagggcaagcccaggcctgagctgacctggaagaaggatggagctgagattgacaagaaccagatcaacatcagaaattctgaaacagacaccatcatcttcatcaggaaggccgagaggagccacagcggcaagtatgacctgcaggtgaaggtggacaagtttgtggagacagccagcattgacatccagatcatcgacaggcctggccccccccagatcgtgaagattgaagatgtgtggggagaaaatgtggccctgacctggaccccacccaaggatgatggaaatgctgccatcaccggctacaccatccagaaggctgacaagaagtccatggagtggttcaccgtgattgagcactaccacaggaccagcgccaccatcacagagctggtgattggaaatgagtactacttccgggtcttcagcgagaacatgtgtggcctgtctgaagatgccaccatgaccaaggagagcgctgtgattgccagagatggcaagatctacaagaaccctgtgtatgaggactttgacttcagcgaggcccccatgttcacccagcccctggtgaacacctacgccatcgccggctacaatgccaccctgaactgcagcgtgcggggcaaccccaagcccaagatcacctggatgaagaacaaggtggccatcgtggatgacccccgctacaggatgttcagcaaccagggcgtgtgcaccctggagatcaggaagcccagcccctatgatggcggcacctactgctgcaaggctgtgaatgacctgggcaccgtggagattgagtgcaagctggaggtgaagggcggcctgtccttctgccgcctgctgctgcagggcgtgccccccaacatcatcgacagctacctgcgggacctgcacagcagcaaccctgaggagtactag

SEQ ID NO: 160752 - DNA, 3522 bp, Artificial Sequence
  Description of Artificial Sequence: Synthetic coding sequence
atgcctgagcccaccaagaaggaggagaatgaggtgcctgccccagcccctcctcctgaggagcccagcaaggagaaggaggccggcaccaccccagccaaggactggaccctggtggagaccccacctggagaggagcaggccaagcagaatgccaacagccagctgagcatcctcttcatcgagaagccccagggcggcaccgtgaaggtgggggaggacatcaccttcatcgccaaggtgaaggccgaggacctgctgaggaagcccaccatcaagtggttcaagggcaagtggatggacctggccagcaaggccggcaagcacctgcagctgaaggagacctttgagcggcacagccgggtgtacacctttgagatgcagatcatcaaggccaaggacaactttgctggcaactaccgctgtgaggtgacctacaaggacaagtttgacagctgcagctttgacctggaggtgcatgagagcacaggcaccacccccaacatcgacatccgcagcgccttcaagaggtctggagagggccaggaggatgctggggagctggacttcagcggcctgctgaagaggcgggaggtgaagcagcaggaggaggagccccaggtggatgtgtgggagctgctgaagaatgccaagcccagtgaatatgagaagatcgccttccagtatggcatcacagacctgcggggcatgctgaagaggctgaagaggatgagaagagaggagaagaagtctgctgcctttgccaagatcctggaccctgcctaccaggtggacaagggcggccgggtgcgctttgtggtggagctggccgaccccaagctggaggtgaagtggtacaagaatggccaggagatccggcccagcaccaagtacatctttgagcacaagggctgccagaggatcctcttcatcaacaactgccagatgacagatgacagcgagtactacgtgacagctggagatgagaagtgcagcacagagctgtttgtgcgggagccccccatcatggtgaccaagcagctggaggacaccacagcctactgtggggagcgggtggagctggagtgtgaggtgtctgaagatgatgccaacgtgaagtggttcaagaatggagaggagatcatccctggccccaagagccgctaccgcatccgggtggagggcaagaagcacatcctgatcatcgagggcgccaccaaggcagatgctgctgagtacagcgtgatgaccaccggcggccagagcagcgccaagctgtctgtggacctgaagcccctgaagatcctgacccccctgacagaccagacagtgaacctgggcaaggagatctgcctgaagtgtgagatcagcgagaacatccctgggaagtggaccaagaatggcctgcctgtgcaggagagtgaccggctgaaggtggtgcacaagggccgcatccacaagctggtgattgccaatgccctgacagaagatgaaggagactatgtgtttgccccagatgcctacaacgtgaccctgcctgccaaggtgcacgtgattgatcctcccaagatcatcctggatggcctggatgctgacaacacagtgacagtgattgctggcaacaagctgcggctggagatccccatcagcggggagcccccacccaaggccatgtggagcagaggagacaaggccatcatggagggcagcggccgcatcagaacagagagctacccagacagcagcaccctggtgattgatattgctgagagagatgacagcggcgtgtaccacatcaacctgaagaatgaagctggggaggcccacgccagcatcaaggtgaaggtggtggacttcccagacccccctgtggcccccaccgtgacagaggtgggagatgactggtgcatcatgaactgggagcccccagcctatgatggcggcagccccatcctgggctacttcatcgagaggaagaagaagcagagcagccgctggatgaggctgaactttgacctgtgcaaggagaccacctttgagcccaagaagatgattgaaggagtggcctatgaggtgcgcatctttgctgtgaatgccatcggcatcagcaagcccagcatgcccagccggccctttgtgcccctggccgtgaccagcccccccaccctgctgactgtggacagcgtgacagacaccaccgtgaccatgcgctggaggcccccagaccacatcggggctgctggcctggatggctacgtgctggagtactgctttgagggcagcaccagcgccaagcagagtgatgaaaatggagaggccgcctatgacctgcctgctgaggactggatcgtggccaacaaggacctgattgacaagaccaagttcaccatcaccggcctgcccacagatgccaagatctttgtgcgggtgaaggctgtgaatgctgctggggccagcgagcccaagtactacagccagcccatcctggtgaaggagatcatcgagccccccaagatccgcatccccaggcacctgaagcagacctacatcagaagagtgggggaggccgtgaacctggtgatccccttccagggcaagcccaggcctgagctgacctggaagaaggatggagctgagattgacaagaaccagatcaacatccggaacagcgagacagacaccatcatcttcatcaggaaggccgagaggagccacagcggcaagtatgacctgcaggtgaaggtggacaagtttgtggagacagccagcattgacatccagatcatcgaccggcccggccccccccagatcgtgaagattgaagatgtgtggggagaaaatgtggccctgacctggaccccacccaaggatgatggaaatgctgccatcaccggctacaccatccagaaggctgacaagaagtccatggagtggttcaccgtcatcgagcactaccacaggaccagcgccaccatcacagagctggtgattggaaatgagtactacttccgggtcttcagcgagaacatgtgtggcctgtctgaagatgccaccatgaccaaggagagcgctgtgattgccagagatggcaagatctacaagaaccctgtgtatgaagattttgacttcagcgaggcccccatgttcacccagcccctggtgaacacctacgccatcgccggctacaatgccaccctgaactgcagcgtgcggggcaaccccaagcccaagatcacctggatgaagaacaaggtggccatcgtggatgacccccgctacaggatgttcagcaaccagggcgtgtgcaccctggagatcaggaagcccagcccctatgatggcggcacctactgctgcaaggctgtgaatgacctgggcaccgtggagattgagtgcaagctggaggtgaaggtgatctaccagggcgtgaacaccccaggccagcctgtgttcctggagggccagcagcaggtgggcagccccagcgctgacagcagctgcaaggcctacctgcagacctag

SEQ ID NO: 160753 - DNA, 3384 bp, Artificial Sequence
  Description of Artificial Sequence: Synthetic coding sequence
atgcctgagcccaccaagaaggaggagaatgaggtgcctgccccagcccctcctcctgaggagcccagcaaggagaaggaggccggcaccaccccagccaaggactggaccctggtggagaccccacctggagaggagcaggccaagcagaatgccaacagccagctgagcatcctcttcatcgagaagccccagggcggcaccgtgaaggtgggggaggacatcaccttcatcgccaaggtgaaggccgaggacctgctgaggaagcccaccatcaagtggttcaagggcaagtggatggacctggccagcaaggccggcaagcacctgcagctgaaggagacctttgagcggcacagccgggtgtacacctttgagatgcagatcatcaaggccaaggacaactttgctggcaactaccgctgtgaggtgacctacaaggacaagtttgacagctgcagctttgacctggaggtgcatgagagcacaggcaccacccccaacatcgacatccgcagcgccttcaagagaagagaggtgaagcagcaggaggaggagccccaggtggatgtgtgggagctgctgaagaatgccaagcccagtgaatatgagaagatcgccttccagtatggcatcacagacctgcggggcatgctgaagaggctgaagaggatgaggcgggaggagaagaagtctgctgcctttgccaagatcctggaccctgcctaccaggtggacaagggcggccgggtgcgctttgtggtggagctggccgaccccaagctggaggtgaagtggtacaagaatggccaggagatccggcccagcaccaagtacatctttgagcacaagggctgccagaggatcctcttcatcaacaactgccagatgacagatgattctgagtactacgtgacagctggagatgagaagtgcagcacagagctgtttgtgcgggagccccccatcatggtgaccaagcagctggaggacaccacagcctactgtggggagcgggtggagctggagtgtgaggtgtctgaagatgatgccaacgtgaagtggttcaagaatggagaggagatcatccctggccccaagagccgctaccgcatccgggtggagggcaagaagcacatcctgatcattgaaggagccaccaaggcagatgctgctgagtacagcgtgatgaccactggaggccagagcagcgccaagctgtctgtggacctgaagcccctgaagatcctgacccccctgacagaccagacagtgaacctgggcaaggagatctgcctgaagtgtgagatcagcgagaacatccctgggaagtggaccaagaatggcctgcctgtgcaggagagtgaccggctgaaggtggtgcacaagggccgcatccacaagctggtgattgccaatgccctgacagaagatgaaggagactatgtgtttgccccagatgcctacaacgtgaccctgcctgccaaggtgcacgtgattgacccccccaagatcatcctggatggcctggatgctgacaacacagtgacagtgattgctggcaacaagctgcggctggagatccccatctctggagagcccccacccaaggccatgtggagcagaggagacaaggccatcatggagggcagcggccgcatcagaacagagagctacccagacagcagcaccctggtgattgatattgctgagagagatgattctggagtgtaccacatcaacctgaagaatgaggccggggaggcccacgccagcatcaaggtgaaggtggtggacttcccagacccccctgtggcccccaccgtgacagaggtgggagatgactggtgcatcatgaactgggagcccccagcctatgatggcggcagccccatcctgggctacttcattgaaaggaagaagaagcagagcagccgctggatgaggctgaactttgacctgtgcaaggagaccacctttgagcccaagaagatgattgagggcgtggcctatgaggtgcgcatctttgctgtgaatgccatcggcatcagcaagcccagcatgcccagccggccctttgtgcccctggccgtgaccagcccccccaccctgctgactgtggacagcgtgacagacaccaccgtgaccatgcgctggaggcccccagaccacatcggggccgccggcctggatggctacgtgctggagtactgctttgagggcacagaggactggatcgtggccaacaaggacctgattgacaagaccaagttcaccatcaccggcctgcccacagatgccaagatctttgtgcgggtgaaggctgtgaatgctgctggggccagcgagcccaagtactacagccagcccatcctggtgaaggagatcatcgagccccccaagatccgcatccccaggcacctgaagcagacctacatccggcgggtgggggaggccgtgaacctggtgatccccttccagggcaagcccaggcctgagctgacctggaagaaggatggagctgagattgacaagaaccagatcaacatcagaaattctgaaacagacaccatcatcttcatcaggaaggccgagaggagccacagcggcaagtatgacctgcaggtgaaggtggacaagtttgtggagacagccagcattgacatccagatcatcgacaggcctggccccccccagatcgtgaagattgaagatgtgtggggagaaaatgtggccctgacctggaccccacccaaggatgatggaaatgctgccatcaccggctacaccatccagaaggctgacaagaagtccatggagtggttcaccgtgattgagcactaccacaggaccagcgccaccatcacagagctggtgattggaaatgagtactacttccgggtcttcagcgagaacatgtgtggcctgtctgaagatgccaccatgaccaaggagagcgctgtgattgccagagatggcaagatctacaagaaccctgtgtatgaggactttgacttcagcgaggcccccatgttcacccagcccctggtgaacacctacgccatcgccggctacaatgccaccctgaactgcagcgtgcggggcaaccccaagcccaagatcacctggatgaagaacaaggtggccatcgtggatgacccccgctacaggatgttcagcaaccagggcgtgtgcaccctggagatcaggaagcccagcccctatgatggcggcacctactgctgcaaggctgtgaatgacctgggcaccgtggagattgagtgcaagctggaggtgaaggtgatctaccagggcgtgaacaccccaggccagcccgtcttcctggagggccagcagcagagcctgcacaacaaggacttctag

SEQ ID NO: 160754 - DNA, 3363 bp, Artificial Sequence
  Description of Artificial Sequence: Synthetic coding sequence
atgcctgagcccaccaagaaggaggactggaccctggtggagaccccacctggagaggagcaggccaagcagaatgccaacagccagctgagcatcctcttcatcgagaagccccagggcggcaccgtgaaggtgggggaggacatcaccttcatcgccaaggtgaaggccgaggacctgctgaggaagcccaccatcaagtggttcaagggcaagtggatggacctggccagcaaggccggcaagcacctgcagctgaaggagacctttgagcggcacagccgggtgtacacctttgagatgcagatcatcaaggccaaggacaactttgctggcaactaccgctgtgaggtgacctacaaggacaagtttgacagctgcagctttgacctggaggtgcatgagagcacaggcaccacccccaacatcgacatccgcagcgccttcaagaggtctggagagggccaggaggatgctggggagctggacttcagcggcctgctgaagaggcgggaggtgaagcagcaggaggaggagccccaggtggatgtgtgggagctgctgaagaatgccaagcccagtgaatatgagaagatcgccttccagtatggcatcacagacctgcggggcatgctgaagaggctgaagaggatgagaagagaggagaagaagtctgctgcctttgccaagatcctggaccctgcctaccaggtggacaagggcggccgggtgcgctttgtggtggagctggccgaccccaagctggaggtgaagtggtacaagaatggccaggagatccggcccagcaccaagtacatctttgagcacaagggctgccagaggatcctcttcatcaacaactgccagatgacagatgacagcgagtactacgtgacagctggagatgagaagtgcagcacagagctgtttgtgcgggagccccccatcatggtgaccaagcagctggaggacaccacagcctactgtggggagcgggtggagctggagtgtgaggtgtctgaagatgatgccaacgtgaagtggttcaagaatggagaggagatcatccctggccccaagagccgctaccgcatccgggtggagggcaagaagcacatcctgatcatcgagggcgccaccaaggcagatgctgctgagtacagcgtgatgaccaccggcggccagagcagcgccaagctgtctgtggacctgaagcccctgaagatcctgacccccctgacagaccagacagtgaacctgggcaaggagatctgcctgaagtgtgagatcagcgagaacatccctgggaagtggaccaagaatggcctgcctgtgcaggagagtgaccggctgaaggtggtgcacaagggccgcatccacaagctggtgattgccaatgccctgacagaagatgaaggagactatgtgtttgccccagatgcctacaacgtgaccctgcctgccaaggtgcacgtgattgatcctcccaagatcatcctggatggcctggatgctgacaacacagtgacagtgattgctggcaacaagctgcggctggagatccccatcagcggggagcccccacccaaggccatgtggagcagaggagacaaggccatcatggagggcagcggccgcatcagaacagagagctacccagacagcagcaccctggtgattgatattgctgagagagatgacagcggcgtgtaccacatcaacctgaagaatgaagctggggaggcccacgccagcatcaaggtgaaggtggtggacttcccagacccccctgtggcccccaccgtgacagaggtgggagatgactggtgcatcatgaactgggagcccccagcctatgatggcggcagccccatcctgggctacttcatcgagaggaagaagaagcagagcagccgctggatgaggctgaactttgacctgtgcaaggagaccacctttgagcccaagaagatgattgaaggagtggcctatgaggtgcgcatctttgctgtgaatgccatcggcatcagcaagcccagcatgcccagccggccctttgtgcccctggccgtgaccagcccccccaccctgctgactgtggacagcgtgacagacaccaccgtgaccatgcgctggaggcccccagaccacatcggggctgctggcctggatggctacgtgctggagtactgctttgagggcacagaggactggatcgtggccaacaaggacctgattgacaagaccaagttcaccatcaccggcctgcccacagatgccaagatctttgtgcgggtgaaggctgtgaatgctgctggggccagcgagcccaagtactacagccagcccatcctggtgaaggagatcatcgagccccccaagatccgcatccccaggcacctgaagcagacctacatcagaagagtgggggaggccgtgaacctggtgatccccttccagggcaagcccaggcctgagctgacctggaagaaggatggagctgagattgacaagaaccagatcaacatccggaacagcgagacagacaccatcatcttcatcaggaaggccgagaggagccacagcggcaagtatgacctgcaggtgaaggtggacaagtttgtggagacagccagcattgacatccagatcatcgaccggcccggccccccccagatcgtgaagattgaagatgtgtggggagaaaatgtggccctgacctggaccccacccaaggatgatggaaatgctgccatcaccggctacaccatccagaaggctgacaagaagtccatggagtggttcaccgtcatcgagcactaccacaggaccagcgccaccatcacagagctggtgattggaaatgagtactacttccgggtcttcagcgagaacatgtgtggcctgtctgaagatgccaccatgaccaaggagagcgctgtgattgccagagatggcaagatctacaagaaccctgtgtatgaagattttgacttcagcgaggcccccatgttcacccagcccctggtgaacacctacgccatcgccggctacaatgccaccctgaactgcagcgtgcggggcaaccccaagcccaagatcacctggatgaagaacaaggtggccatcgtggatgacccccgctacaggatgttcagcaaccagggcgtgtgcaccctggagatcaggaagcccagcccctatgatggcggcacctactgctgcaaggctgtgaatgacctgggcaccgtggagattgagtgcaagctggaggtgaaggtgatctaccagggcgtgaacaccccaggccagcctgtgttcctggagggccagcagcagagcctgcacaacaaggacttctag

SEQ ID NO: 160755 - DNA, 3399 bp, Artificial Sequence
  Description of Artificial Sequence: Synthetic coding sequence
atgcctgagcccaccaagaaggaggagaatgaggtgcctgccccagcccctcctcctgaggactggaccctggtggagaccccacctggagaggagcaggccaagcagaatgccaacagccagctgagcatcctcttcatcgagaagccccagggcggcaccgtgaaggtgggggaggacatcaccttcatcgccaaggtgaaggccgaggacctgctgaggaagcccaccatcaagtggttcaagggcaagtggatggacctggccagcaaggccggcaagcacctgcagctgaaggagacctttgagcggcacagccgggtgtacacctttgagatgcagatcatcaaggccaaggacaactttgctggcaactaccgctgtgaggtgacctacaaggacaagtttgacagctgcagctttgacctggaggtgcatgagagcacaggcaccacccccaacatcgacatccgcagcgccttcaagaggtctggagagggccaggaggatgctggggagctggacttcagcggcctgctgaagaggcgggaggtgaagcagcaggaggaggagccccaggtggatgtgtgggagctgctgaagaatgccaagcccagtgaatatgagaagatcgccttccagtatggcatcacagacctgcggggcatgctgaagaggctgaagaggatgagaagagaggagaagaagtctgctgcctttgccaagatcctggaccctgcctaccaggtggacaagggcggccgggtgcgctttgtggtggagctggccgaccccaagctggaggtgaagtggtacaagaatggccaggagatccggcccagcaccaagtacatctttgagcacaagggctgccagaggatcctcttcatcaacaactgccagatgacagatgacagcgagtactacgtgacagctggagatgagaagtgcagcacagagctgtttgtgcgggagccccccatcatggtgaccaagcagctggaggacaccacagcctactgtggggagcgggtggagctggagtgtgaggtgtctgaagatgatgccaacgtgaagtggttcaagaatggagaggagatcatccctggccccaagagccgctaccgcatccgggtggagggcaagaagcacatcctgatcatcgagggcgccaccaaggcagatgctgctgagtacagcgtgatgaccaccggcggccagagcagcgccaagctgtctgtggacctgaagcccctgaagatcctgacccccctgacagaccagacagtgaacctgggcaaggagatctgcctgaagtgtgagatcagcgagaacatccctgggaagtggaccaagaatggcctgcctgtgcaggagagtgaccggctgaaggtggtgcacaagggccgcatccacaagctggtgattgccaatgccctgacagaagatgaaggagactatgtgtttgccccagatgcctacaacgtgaccctgcctgccaaggtgcacgtgattgatcctcccaagatcatcctggatggcctggatgctgacaacacagtgacagtgattgctggcaacaagctgcggctggagatccccatcagcggggagcccccacccaaggccatgtggagcagaggagacaaggccatcatggagggcagcggccgcatcagaacagagagctacccagacagcagcaccctggtgattgatattgctgagagagatgacagcggcgtgtaccacatcaacctgaagaatgaagctggggaggcccacgccagcatcaaggtgaaggtggtggacttcccagacccccctgtggcccccaccgtgacagaggtgggagatgactggtgcatcatgaactgggagcccccagcctatgatggcggcagccccatcctgggctacttcatcgagaggaagaagaagcagagcagccgctggatgaggctgaactttgacctgtgcaaggagaccacctttgagcccaagaagatgattgaaggagtggcctatgaggtgcgcatctttgctgtgaatgccatcggcatcagcaagcccagcatgcccagccggccctttgtgcccctggccgtgaccagcccccccaccctgctgactgtggacagcgtgacagacaccaccgtgaccatgcgctggaggcccccagaccacatcggggctgctggcctggatggctacgtgctggagtactgctttgagggcacagaggactggatcgtggccaacaaggacctgattgacaagaccaagttcaccatcaccggcctgcccacagatgccaagatctttgtgcgggtgaaggctgtgaatgctgctggggccagcgagcccaagtactacagccagcccatcctggtgaaggagatcatcgagccccccaagatccgcatccccaggcacctgaagcagacctacatcagaagagtgggggaggccgtgaacctggtgatccccttccagggcaagcccaggcctgagctgacctggaagaaggatggagctgagattgacaagaaccagatcaacatccggaacagcgagacagacaccatcatcttcatcaggaaggccgagaggagccacagcggcaagtatgacctgcaggtgaaggtggacaagtttgtggagacagccagcattgacatccagatcatcgaccggcccggccccccccagatcgtgaagattgaagatgtgtggggagaaaatgtggccctgacctggaccccacccaaggatgatggaaatgctgccatcaccggctacaccatccagaaggctgacaagaagtccatggagtggttcaccgtcatcgagcactaccacaggaccagcgccaccatcacagagctggtgattggaaatgagtactacttccgggtcttcagcgagaacatgtgtggcctgtctgaagatgccaccatgaccaaggagagcgctgtgattgccagagatggcaagatctacaagaaccctgtgtatgaagattttgacttcagcgaggcccccatgttcacccagcccctggtgaacacctacgccatcgccggctacaatgccaccctgaactgcagcgtgcggggcaaccccaagcccaagatcacctggatgaagaacaaggtggccatcgtggatgacccccgctacaggatgttcagcaaccagggcgtgtgcaccctggagatcaggaagcccagcccctatgatggcggcacctactgctgcaaggctgtgaatgacctgggcaccgtggagattgagtgcaagctggaggtgaaggtgatctaccagggcgtgaacaccccaggccagcctgtgttcctggagggccagcagcagagcctgcacaacaaggacttctag

SEQ ID NO: 160756 - DNA, 3822 bp, Artificial Sequence
  Description of Artificial Sequence: Synthetic coding sequence
atgcctgagcccgggaagaagcctgtgtctgccttcagcaagaagcccaggtctgtggaggtggccgccggcagccctgctgtgtttgaagctgagacagagcgggccggcgtgaaggtgcgctggcagagaggaggcagtgacatcagcgccagcaacaagtatggcctggccacagagggcaccaggcacaccctgactgtgcgggaggtgggccctgctgaccagggcagctatgctgtgattgctggcagcagcaaggtgaagtttgacctgaaggtgattgaagctgagaaggccgagcccatgctggccccagccccagccccagctgaggccaccggggcccctggagaggccccagccccagctgctgagctgggggagagcgcccccagccccaagggcagcagcagcgctgccctgaatggccccacccctggggccccagatgaccccatcggcctgtttgtgatgaggccccaggatggagaggtgacagtgggcggcagcatcaccttcagcgcccgggtggccggggccagcctgctgaagccccctgtggtgaagtggttcaagggcaagtgggtggacctgagcagcaaggtgggccagcacctgcagctgcatgacagctatgaccgggccagcaaggtgtacctgtttgagctgcacatcacagatgcccagcctgccttcaccggcagctaccgctgtgaggtgtccaccaaggacaagtttgactgcagcaacttcaacctgactgtgcatgaggccatgggcaccggggacctggacctgctgagcgccttccggaggaccagcctggccggcggcggccgccgcatcagtgacagccatgaggacaccggcatcctggacttcagcagcctgctgaagaagagcagcagcttccgcaccccccgggacagcaagctggaggccccagcagaagaagatgtgtgggagatcctgcggcaggcccctccttctgaatatgagcgcatcgccttccagtatggagtgacagacctgcggggcatgctgaagaggctgaagggcatgagaagagatgagaagaagagcacagccttccagaagaagctggagcccgcctaccaggtgtccaagggccacaagatccggctgactgtggagctggccgaccatgatgctgaggtgaagtggctgaagaatggccaggagatccagatgagcggccgctacatctttgagagcatcggggccaagaggaccctgaccatcagccagtgcagcctggctgatgatgctgcctaccagtgtgtggtgggcggggagaagtgcagcacagagctgtttgtgaaggagccccctgtgctgatcacccggcccctggaggaccagctggtgatggtgggccagagggtggagtttgaatgtgaggtgtctgaggagggcgcccaggtgaagtggctgaaggatggagtggagctgacccgggaggagaccttcaagtaccgcttcaagaaggatggccagaggcaccacctgatcatcaatgaggccatgctggaggatgctggccactacgccctgtgcaccagcggcggccaggccctggccgagctgattgtgcaggagaagaagctggaggtgtaccagagcattgctgacctgatggtgggcgccaaggaccaggccgtgttcaagtgtgaggtgtctgatgaaaatgtgcggggcgtgtggctgaagaatggcaaggagctggtgcctgacagccgcatcaaggtgagccacatcggccgggtgcacaagctgaccattgatgatgtgaccccagcagatgaagctgactacagctttgtgcctgagggctttgcctgcaacctgagcgccaagctgcacttcatggaggtgaagattgactttgtgccccggcaggagccccccaagatccacctggactgccccggccgcatcccagacaccatcgtggtggtggccggcaacaagctgcggctggatgtgcccatcagcggggaccctgcccccaccgtcatctggcagaaggccatcacccagggcaacaaggccccagcccggcctgccccagatgcccctgaggacaccggggacagtgatgagtgggtgtttgacaagaagctgctgtgtgaaacagagggccgggtgcgggtggagaccaccaaggacaggagcatcttcaccgtggagggcgctgagaaggaggatgagggcgtgtacacagtgacagtgaagaaccctgtgggggaggaccaggtgaacctgactgtgaaggtgattgatgtgcctgatgccccagctgcccccaagatcagcaatgtgggggaggacagctgcaccgtgcagtgggagcccccagcctatgatggcggccagcccatcctgggctacatcctggagaggaagaagaagaagagctaccgctggatgaggctgaactttgacctgatccaggagctgagccatgaggcccggaggatgattgagggcgtggtgtatgagatgagggtgtatgctgtgaatgccatcggcatgagccggcccagccctgccagccagcccttcatgcccatcggcccccccagcgagcccacccacctggccgtggaggatgtgtctgacaccaccgtgtccctgaagtggaggcctcctgagcgggtgggcgccggcggcctggatggctacagcgtggagtactgcccagagggctgcagcgagtgggtggccgccctgcagggcctgacagagcacaccagcatcctggtgaaggacctgcccactggagcccggctgctcttccgggtgcgggcccacaacatggccggccctggggcccctgtgaccaccacagagcctgtgacagtgcaggagatcctgcagaggccccggctgcagctgcccaggcacctgcggcagaccatccagaagaaggtgggggagcctgtgaacctgctgatccccttccagggcaagccccggccccaggtgacctggaccaaggagggccagcccctggccggggaggaggtgtccatccggaacagccccacagacaccatcctcttcatccgggccgccaggagagtgcacagcggcacctaccaggtgacagtgagaattgagaacatggaggacaaggccaccctggtgctgcaggtggtggacaagcccagccccccccaggacctgcgggtgacagatgcctggggcctgaatgtggccctggagtggaagccaccccaggatgtgggcaacacagagctgtggggctacacagtgcagaaggctgacaagaagaccatggagtggttcaccgtgctggagcactacagaaggacccactgtgtggtgcctgagctgatcattggaaatggctactacttccgggtcttcagccagaacatggtgggcttcagtgaccgggccgccaccaccaaggagcccgtcttcatcccccggcccggcatcacctatgagccccccaactacaaggccctggacttcagcgaggcccccagcttcacccagcccctggtgaacagatctgtgattgctggctacacagccatgctgtgctgtgctgtgcggggcagccccaagcccaagatctcctggttcaagaatggcctggacctgggggaggatgcccgcttcaggatgttcagcaagcagggcgtgctgaccctggagatcaggaagccctgcccctttgatggcggcatctacgtgtgccgggccaccaacctgcagggcgaggcccgctgtgagtgccgcctggaggtgcgggtgccccagtag

SEQ ID NO: 160757 - DNA, 3825 bp, Artificial Sequence
  Description of Artificial Sequence: Synthetic coding sequence
atgcctgagcccgggaagaagcctgtgtctgccttcagcaagaagcccaggtctgtggaggtggccgccggcagccctgctgtgtttgaagctgagacagagcgggccggcgtgaaggtgcgctggcagagaggaggcagtgacatcagcgccagcaacaagtatggcctggccacagagggcaccaggcacaccctgactgtgcgggaggtgggccctgctgaccagggcagctatgctgtgattgctggcagcagcaaggtgaagtttgacctgaaggtgattgaagctgagaaggccgagcccatgctggccccagccccagccccagctgaggccaccggggcccctggagaggccccagccccagctgctgagctgggggagagcgcccccagccccaagggcagcagcagcgctgccctgaatggccccacccctggggccccagatgaccccatcggcctgtttgtgatgaggccccaggatggagaggtgacagtgggcggcagcatcaccttcagcgcccgggtggccggggccagcctgctgaagccccctgtggtgaagtggttcaagggcaagtgggtggacctgagcagcaaggtgggccagcacctgcagctgcatgacagctatgaccgggccagcaaggtgtacctgtttgagctgcacatcacagatgcccagcctgccttcaccggcagctaccgctgtgaggtgtccaccaaggacaagtttgactgcagcaacttcaacctgactgtgcatgaggccatgggcaccggggacctggacctgctgagcgccttccggaggaccagcctggccggcggcggccgccgcatcagtgacagccatgaggacaccggcatcctggacttcagcagcctgctgaagaagagcagcagcttccgcaccccccgggacagcaagctggaggccccagcagaagaagatgtgtgggagatcctgcggcaggcccctccttctgaatatgagcgcatcgccttccagtatggagtgacagacctgcggggcatgctgaagaggctgaagggcatgagaagagatgagaagaagagcacagccttccagaagaagctggagcccgcctaccaggtgtccaagggccacaagatccggctgactgtggagctggccgaccatgatgctgaggtgaagtggctgaagaatggccaggagatccagatgagcggcagcaagtacatctttgagagcattggagccaagaggaccctgaccatcagccagtgcagcctggctgatgatgctgcctaccagtgtgtggtgggcggggagaagtgcagcacagagctgtttgtgaaggagccccctgtgctgatcacccggcccctggaggaccagctggtgatggtgggccagagggtggagtttgaatgtgaggtgtctgaggagggcgcccaggtgaagtggctgaaggatggagtggagctgacccgggaggagaccttcaagtaccgcttcaagaaggatggccagaggcaccacctgatcatcaatgaggccatgctggaggatgctggccactacgccctgtgcaccagcggcggccaggccctggccgagctgattgtgcaggagaagaagctggaggtgtaccagagcattgctgacctgatggtgggcgccaaggaccaggccgtgttcaagtgtgaggtgtctgatgaaaatgtgcggggcgtgtggctgaagaatggcaaggagctggtgcctgacagccgcatcaaggtgagccacatcggccgggtgcacaagctgaccattgatgatgtgaccccagcagatgaggccgactacagctttgtgcctgagggctttgcctgcaacctgagcgccaagctgcacttcatggaggtgaagattgactttgtgccccggcaggagccccccaagatccacctggactgccccggccgcatcccagacaccatcgtggtggtggccggcaacaagctgcggctggatgtgcccatcagcggggaccctgcccccaccgtcatctggcagaaggccatcacccagggcaacaaggccccagcccggcctgccccagatgccccagaagatactggagacagtgatgagtgggtgtttgacaagaagctgctgtgtgaaacagagggccgggtgcgggtggagaccaccaaggacaggagcatcttcaccgtggagggcgctgagaaggaggatgaaggagtgtacacagtgacagtgaagaaccctgtgggggaggaccaggtgaacctgactgtgaaggtgattgatgtgcctgatgccccagctgcccccaagatcagcaatgtgggggaggacagctgcaccgtgcagtgggagcccccagcctatgatggcggccagcccatcctgggctacatcctggagaggaagaagaagaagagctaccgctggatgaggctgaactttgacctgatccaggagctgagccatgaggcccggaggatgattgaaggagtggtgtatgagatgagggtgtatgctgtgaatgccatcggcatgagccggcccagccctgccagccagcccttcatgcccatcggccccccatctgagcccacccacctggccgtggaggatgtgtctgacaccaccgtgtccctgaagtggaggcctcctgagcgggtgggcgctgggggcctggatggctacagcgtggagtactgcccagagggctgcagcgagtgggtggccgccctgcagggcctgacagagcacaccagcatcctggtgaaggacctgcccaccggggcccggctgctcttccgggtgcgggcccacaacatggccggccctggggcccctgtgaccaccacagagcctgtgacagtgcaggagatcctgcagaggccccggctgcagctgcccaggcacctgcggcagaccatccagaagaaggtgggggagcctgtgaacctgctgatccccttccagggcaagccccggccccaggtgacctggaccaaggagggccagcccctggccggggaggaggtgtccatccggaacagccccacagacaccatcctcttcatccgggccgcccggcgggtgcacagcggcacctaccaggtgacagtgagaattgagaacatggaggacaaggccaccctggtgctgcaggtggtggacaagcccagccccccccaggacctgcgggtgacagatgcctggggcctgaatgtggccctggagtggaagccaccccaggatgtgggcaacacagagctgtggggctacacagtgcagaaggctgacaagaagaccatggagtggttcaccgtgctggagcactacagaaggacccactgtgtggtgcctgagctgatcattggaaatggctactacttccgggtcttcagccagaacatggtgggcttcagtgacagagctgccaccaccaaggagcctgtgttcatccccaggcctggcatcacctatgagccccccaactacaaggccctggacttcagcgaggcccccagcttcacccagcccctggtgaacagatctgtgattgctggctacacagccatgctgtgctgtgctgtgcggggcagccccaagcccaagatctcctggttcaagaatggcctggacctgggagaagatgcccgcttcaggatgttcagcaagcagggcgtgctgaccctggagatcaggaagccctgcccctttgatggcggcatctacgtgtgccgggccaccaacctgcagggcgaggcccgctgtgaatgtcggctggaggtgcgggtgccccagtag

SEQ ID NO: 160758 - DNA, 3825 bp, Artificial Sequence
  Description of Artificial Sequence: Synthetic coding sequence
atgcctgagcccgggaagaagcctgtgtctgccttcagcaagaagcccaggtctgtggaggtggccgccggcagccctgctgtgtttgaagctgagacagagcgggccggcgtgaaggtgcgctggcagagaggaggcagtgacatcagcgccagcaacaagtatggcctggccacagagggcaccaggcacaccctgactgtgcgggaggtgggccctgctgaccagggcagctatgctgtgattgctggcagcagcaaggtgaagtttgacctgaaggtgattgaagctgagaaggccgagcccatgctggccccagccccagccccagctgaggccaccggggcccctggagaggccccagccccagctgctgagctgggggagagcgcccccagccccaagggcagcagcagcgctgccctgaatggccccacccctggggccccagatgaccccatcggcctgtttgtgatgaggccccaggatggagaggtgacagtgggcggcagcatcaccttcagcgcccgggtggccggggccagcctgctgaagccccctgtggtgaagtggttcaagggcaagtgggtggacctgagcagcaaggtgggccagcacctgcagctgcatgacagctatgaccgggccagcaaggtgtacctgtttgagctgcacatcacagatgcccagcctgccttcaccggcagctaccgctgtgaggtgtccaccaaggacaagtttgactgcagcaacttcaacctgactgtgcatgaggccatgggcaccggggacctggacctgctgagcgccttccggaggaccagcctggccggcggcggccgccgcatcagtgacagccatgaggacaccggcatcctggacttcagcagcctgctgaagaagagggacagcttccgcaccccccgggacagcaagctggaggccccagcagaagaagatgtgtgggagatcctgcggcaggcccctccttctgaatatgagcgcatcgccttccagtatggagtgacagacctgcggggcatgctgaagaggctgaagggcatgagaagagatgagaagaagagcacagccttccagaagaagctggagcccgcctaccaggtgtccaagggccacaagatccggctgactgtggagctggccgaccatgatgctgaggtgaagtggctgaagaatggccaggagatccagatgagcggcagcaagtacatctttgagagcattggagccaagaggaccctgaccatcagccagtgcagcctggctgatgatgctgcctaccagtgtgtggtgggcggggagaagtgcagcacagagctgtttgtgaaggagccccctgtgctgatcacccggcccctggaggaccagctggtgatggtgggccagagggtggagtttgaatgtgaggtgtctgaggagggcgcccaggtgaagtggctgaaggatggagtggagctgacccgggaggagaccttcaagtaccgcttcaagaaggatggccagaggcaccacctgatcatcaatgaggccatgctggaggatgctggccactacgccctgtgcaccagcggcggccaggccctggccgagctgattgtgcaggagaagaagctggaggtgtaccagagcattgctgacctgatggtgggcgccaaggaccaggccgtgttcaagtgtgaggtgtctgatgaaaatgtgcggggcgtgtggctgaagaatggcaaggagctggtgcctgacagccgcatcaaggtgagccacatcggccgggtgcacaagctgaccattgatgatgtgaccccagcagatgaggccgactacagctttgtgcctgagggctttgcctgcaacctgagcgccaagctgcacttcatggaggtgaagattgactttgtgccccggcaggagccccccaagatccacctggactgccccggccgcatcccagacaccatcgtggtggtggccggcaacaagctgcggctggatgtgcccatcagcggggaccctgcccccaccgtcatctggcagaaggccatcacccagggcaacaaggccccagcccggcctgccccagatgccccagaagatactggagacagtgatgagtgggtgtttgacaagaagctgctgtgtgaaacagagggccgggtgcgggtggagaccaccaaggacaggagcatcttcaccgtggagggcgctgagaaggaggatgaaggagtgtacacagtgacagtgaagaaccctgtgggggaggaccaggtgaacctgactgtgaaggtgattgatgtgcctgatgccccagctgcccccaagatcagcaatgtgggggaggacagctgcaccgtgcagtgggagcccccagcctatgatggcggccagcccatcctgggctacatcctggagaggaagaagaagaagagctaccgctggatgaggctgaactttgacctgatccaggagctgagccatgaggcccggaggatgattgaaggagtggtgtatgagatgagggtgtatgctgtgaatgccatcggcatgagccggcccagccctgccagccagcccttcatgcccatcggccccccatctgagcccacccacctggccgtggaggatgtgtctgacaccaccgtgtccctgaagtggaggcctcctgagcgggtgggcgctgggggcctggatggctacagcgtggagtactgcccagagggctgcagcgagtgggtggccgccctgcagggcctgacagagcacaccagcatcctggtgaaggacctgcccaccggggcccggctgctcttccgggtgcgggcccacaacatggccggccctggggcccctgtgaccaccacagagcctgtgacagtgcaggagatcctgcagaggccccggctgcagctgcccaggcacctgcggcagaccatccagaagaaggtgggggagcctgtgaacctgctgatccccttccagggcaagccccggccccaggtgacctggaccaaggagggccagcccctggccggggaggaggtgtccatccggaacagccccacagacaccatcctcttcatccgggccgcccggcgggtgcacagcggcacctaccaggtgacagtgagaattgagaacatggaggacaaggccaccctggtgctgcaggtggtggacaagcccagccccccccaggacctgcgggtgacagatgcctggggcctgaatgtggccctggagtggaagccaccccaggatgtgggcaacacagagctgtggggctacacagtgcagaaggctgacaagaagaccatggagtggttcaccgtgctggagcactacagaaggacccactgtgtggtgcctgagctgatcattggaaatggctactacttccgggtcttcagccagaacatggtgggcttcagtgacagagctgccaccaccaaggagcctgtgttcatccccaggcctggcatcacctatgagccccccaactacaaggccctggacttcagcgaggcccccagcttcacccagcccctggtgaacagatctgtgattgctggctacacagccatgctgtgctgtgctgtgcggggcagccccaagcccaagatctcctggttcaagaatggcctggacctgggagaagatgcccgcttcaggatgttcagcaagcagggcgtgctgaccctggagatcaggaagccctgcccctttgatggcggcatctacgtgtgccgggccaccaacctgcagggcgaggcccgctgtgaatgtcggctggaggtgcgggtgccccagtag

SEQ ID NO: 160759 - DNA, 3426 bp, Artificial Sequence
  Description of Artificial Sequence: Synthetic coding sequence
atgcctgaggccaagccagctgccaagaaggcccccaagggcaaggatgcccccaagggggcccccaaggaggccccacccaaggaggccccagctgaggcccccaaggaggcccccccagaggaccagagccccacagctgaggagcccactggagtcttcctgaagaagccagacagcgtgtctgtggagaccgggaaggatgctgtggtggtggccaaggtgaatggcaaggagctgcctgacaagcccaccatcaagtggttcaagggcaagtggctggagctgggcagcaagagcggggcccgcttctccttcaaggagagccacaacagcgccagcaatgtgtacacagtggagctgcacatcggcaaggtggtgctgggggaccggggctactaccgcctggaggtgaaggccaaggacacctgtgacagctgtggcttcaacattgatgtggaggccccccggcaggatgccagcggccagagcctggagagcttcaagaggaccagcgagaagaagagtgacacagctggggagctggacttcagcggcctgctgaagaagcgggaggtggtggaggaggagaagaagaagaagaagaaggatgatgatgacctgggcatccccccagagatctgggagctgctgaagggggccaagaagtcagaatatgagaagatcgccttccagtatggcatcacagacctgcggggcatgctgaagaggctgaagaaggccaaggtggaggtgaagaagtctgctgccttcaccaagaagctggaccctgcctaccaggtggaccggggcaacaagatcaagctgatggtggagatcagtgaccctgacctgaccctgaagtggttcaagaatggccaggagatcaagcccagcagcaaatatgtgtttgaaaatgtgggcaagaagaggatcctgaccatcaacaagtgcaccctggctgatgatgctgcctatgaggtggccgtgaaggatgagaagtgcttcacagagctgtttgtgaaggagccccctgtgctgattgtgacccccctggaggaccagcaggtgtttgtgggggacagagtggagatggctgtggaggtgtctgaggagggcgcccaggtgatgtggatgaaggatggagtggagctgacccgggaggacagcttcaaggcccgctaccgcttcaagaaggatggcaagaggcacatcctgatcttcagtgatgtggtgcaggaggaccggggccgctaccaggtgatcaccaacggcggccagtgtgaggccgagctgattgtggaggagaagcagctggaggtgctgcaggacattgctgacctgactgtgaaggccagcgagcaggccgtgttcaagtgtgaggtgtctgatgagaaggtgacaggcaagtggtacaagaatggagtggaggtgcggcccagcaagaggatcaccatcagccacgtgggccgcttccacaagctggtgattgatgatgtgcggccagaagatgaaggagactacacctttgtgcctgatggctacgccctgagcctgagcgccaagctgaacttcctggagatcaaggtggagtatgtgcccaagcaggagccccccaagatccacctggactgcagcggcaagaccagtgaaaatgccatcgtggtggtggccggcaacaagctgcggctggatgtgtccatcactggagagcccccacctgtggccacctggctgaagggagatgaggtgttcaccaccacagagggccgcacccgcatcgagaagagggtggactgcagcagctttgtgattgaaagtgcccagagagaagatgagggccgctacaccatcaaggtgaccaaccctgtgggggaggatgtggccagcatcttcctgcaggtggtggatgtgcctgaccccccagaggccgtgcgcatcacctctgtgggggaggactgggccatcctggtgtgggagccccccatgtatgatggcggcaagcctgtgacaggctacctggtggagaggaagaagaagggcagccagcgctggatgaagctgaactttgaggtgttcacagagaccacctatgagagcaccaagatgattgagggcatcctgtatgagatgagggtgtttgctgtgaatgccatcggcgtgtcccagcccagcatgaacaccaagcccttcatgcccatcgcccccaccagcgagcccctgcacctgattgtggaggatgtgacagacaccaccaccaccctgaagtggaggcctcccaacagaattggagctgggggcattgatggctacctggtggagtactgcctggagggcagcgaggagtgggtgcctgccaacacagagcctgtggagcgctgtggcttcaccgtgaagaacctgcccactggagcccgcatcctcttccgggtggtgggcgtgaacattgctggccgctctgagcccgccaccctggcccagcctgtgaccatccgggagattgctgagccccccaagatccggctgcccaggcacctgcggcagacctacatcaggaaggtgggggagcagctgaacctggtggtgcccttccagggcaagccccggccccaggtggtgtggaccaagggcggggcccccctggacaccagccgggtgcacgtgaggaccagtgactttgacacagtgttctttgtgcggcaggccgcccggagtgacagcggggagtatgagctgtctgtgcagatcgagaacatgaaggacacagccaccatccgcatccgggtggtggagaaggccggcccccccatcaacgtgatggtgaaggaggtgtggggcaccaatgccctggtggagtggcaggcccccaaggatgatggcaacagcgagatcatgggctactttgtgcagaaggctgacaagaagaccatggagtggttcaacgtgtatgaaagaaacagacacaccagctgcaccgtgtctgacctgattgtgggcaatgagtactacttccgggtgtacacagagaacatctgtggcctgagtgacagccctggggtgtccaagaacacagcccgcatcctgaagacaggcatcaccttcaagccctttgagtacaaggagcatgacttcaggatggcccccaagttcctgacccccctgattgacagagtggtggtggccggctacagcgctgccctgaactgtgctgtgcggggccaccccaagcccaaggtggtgtggatgaagaacaagatggagatccgggaggaccccaagttcctgatcaccaactaccagggcgtgctgaccctgaacatccggcggcccagcccctttgatgctggcacctacacctgcagagctgtgaatgagctgggggaggccctggccgagtgcaagctggaggtgcgggtgccccagtag

SEQ ID NO: 160760 - DNA, 3426 bp, Artificial Sequence
  Description of Artificial Sequence: Synthetic coding sequence
atgcctgagcccaccaagaaggaggagaatgaggtgcctgccccagcccctcctcctgaggagcccagcaaggagaaggaggccggcaccaccccagccaaggactggaccctggtggagaccccacctggagaggagcaggccaagcagaatgccaacagccagctgagcatcctcttcatcgagaagccccagggcggcaccgtgaaggtgggggaggacatcaccttcatcgccaaggtgaaggccgaggacctgctgaggaagcccaccatcaagtggttcaagggcaagtggatggacctggccagcaaggccggcaagcacctgcagctgaaggagacctttgagcggcacagccgggtgtacacctttgagatgcagatcatcaaggccaaggacaactttgctggcaactaccgctgtgaggtgacctacaaggacaagtttgacagctgcagctttgacctggaggtgcatgagagcacaggcaccacccccaacatcgacatccgcagcgccttcaagaggtctggagagggccaggaggatgctggggagctggacttcagcggcctgctgaagaggcgggaggtgaagcagcaggaggaggagccccaggtggatgtgtgggagctgctgaagaatgccaagcccagtgaatatgagaagatcgccttccagtatggcatcacagacctgcggggcatgctgaagaggctgaagaggatgagaagagaggagaagaagtctgctgcctttgccaagatcctggaccctgcctaccaggtggacaagggcggccgggtgcgctttgtggtggagctggccgaccccaagctggaggtgaagtggtacaagaatggccaggagatccggcccagcaccaagtacatctttgagcacaagggctgccagaggatcctcttcatcaacaactgccagatgacagatgacagcgagtactacgtgacagctggagatgagaagtgcagcacagagctgtttgtgcgggagccccccatcatggtgaccaagcagctggaggacaccacagcctactgtggggagcgggtggagctggagtgtgaggtgtctgaagatgatgccaacgtgaagtggttcaagaatggagaggagatcatccctggccccaagagccgctaccgcatccgggtggagggcaagaagcacatcctgatcatcgagggcgccaccaaggcagatgctgctgagtacagcgtgatgaccaccggcggccagagcagcgccaagctgtctgtggacctgaagcccctgaagatcctgacccccctgacagaccagacagtgaacctgggcaaggagatctgcctgaagtgtgagatcagcgagaacatccctgggaagtggaccaagaatggcctgcctgtgcaggagagtgaccggctgaaggtggtgcacaagggccgcatccacaagctggtgattgccaatgccctgacagaagatgaaggagactatgtgtttgccccagatgcctacaacgtgaccctgcctgccaaggtgcacgtgattgatcctcccaagatcatcctggatggcctggatgctgacaacacagtgacagtgattgctggcaacaagctgcggctggagatccccatcagcggggagcccccacccaaggccatgtggagcagaggagacaaggccatcatggagggcagcggccgcatcagaacagagagctacccagacagcagcaccctggtgattgatattgctgagagagatgacagcggcgtgtaccacatcaacctgaagaatgaagctggggaggcccacgccagcatcaaggtgaaggtggtggacttcccagacccccctgtggcccccaccgtgacagaggtgggagatgactggtgcatcatgaactgggagcccccagcctatgatggcggcagccccatcctgggctacttcatcgagaggaagaagaagcagagcagccgctggatgaggctgaactttgacctgtgcaaggagaccacctttgagcccaagaagatgattgaaggagtggcctatgaggtgcgcatctttgctgtgaatgccatcggcatcagcaagcccagcatgcccagccggccctttgtgcccctggccgtgaccagcccccccaccctgctgactgtggacagcgtgacagacaccaccgtgaccatgcgctggaggcccccagaccacatcggggctgctggcctggatggctacgtgctggagtactgctttgagggcagcaccagcgccaagcagagtgatgaaaatggagaggccgcctatgacctgcctgctgaggactggatcgtggccaacaaggacctgattgacaagaccaagttcaccatcaccggcctgcccacagatgccaagatctttgtgcgggtgaaggctgtgaatgctgctggggccagcgagcccaagtactacagccagcccatcctggtgaaggagatcatcgagccccccaagatccgcatccccaggcacctgaagcagacctacatcagaagagtgggggaggccgtgaacctggtgatccccttccagggcaagcccaggcctgagctgacctggaagaaggatggagctgagattgacaagaaccagatcaacatccggaacagcgagacagacaccatcatcttcatcaggaaggccgagaggagccacagcggcaagtatgacctgcaggtgaaggtggacaagtttgtggagacagccagcattgacatccagatcatcgaccggcccggccccccccagatcgtgaagattgaagatgtgtggggagaaaatgtggccctgacctggaccccacccaaggatgatggaaatgctgccatcaccggctacaccatccagaaggctgacaagaagtccatggagtggttcaccgtcatcgagcactaccacaggaccagcgccaccatcacagagctggtgattggaaatgagtactacttccgggtcttcagcgagaacatgtgtggcctgtctgaagatgccaccatgaccaaggagagcgctgtgattgccagagatggcaagatctacaagaaccctgtgtatgaagattttgacttcagcgaggcccccatgttcacccagcccctggtgaacacctacgccatcgccggctacaatgccaccctgaactgcagcgtgcggggcaaccccaagcccaagatcacctggatgaagaacaaggtggccatcgtggatgacccccgctacaggatgttcagcaaccagggcgtgtgcaccctggagatcaggaagcccagcccctatgatggcggcacctactgctgcaaggctgtgaatgacctgggcaccgtggagattgagtgcaagctggaggtgaaggtgattgcccagtag

SEQ ID NO: 160761 - DNA, 3516 bp, Artificial Sequence
  Description of Artificial Sequence: Synthetic coding sequence
atgcctgagcccaccaagaaggaggagaatgaggtgcctgccccagcccctcctcctgaggagcccagcaaggagaaggaggccggcaccaccccagccaaggatgaggaggaggtgtccccaccttctgccctgcccccaggcctgggcagccgggccctggagaggaaggacagcgactggaccctggtggagaccccacctggagaggagcaggccaagcagaatgccaacagccagctgagcatcctcttcatcgagaagccccagggcggcaccgtgaaggtgggggaggacatcaccttcatcgccaaggtgaaggccgaggacctgctgaggaagcccaccatcaagtggttcaagggcaagtggatggacctggccagcaaggccggcaagcacctgcagctgaaggagacctttgagcggcacagccgggtgtacacctttgagatgcagatcatcaaggccaaggacaactttgctggcaactaccgctgtgaggtgacctacaaggacaagtttgacagctgcagctttgacctggaggtgcatgagagcacaggcaccacccccaacatcgacatccgcagcgccttcaagaggtctggagagggccaggaggatgctggggagctggacttcagcggcctgctgaagagaagagaggtgaagcagcaggaggaggagccccaggtggatgtgtgggagctgctgaagaatgccaagcccagtgaatatgagaagatcgccttccagtatggcatcacagacctgcggggcatgctgaagaggctgaagaggatgaggcgggaggagaagaagtctgctgcctttgccaagatcctggaccctgcctaccaggtggacaagggcggccgggtgcgctttgtggtggagctggccgaccccaagctggaggtgaagtggtacaagaatggccaggagatccggcccagcaccaagtacatctttgagcacaagggctgccagaggatcctcttcatcaacaactgccagatgacagatgattctgagtactacgtgacagctggagatgagaagtgcagcacagagctgtttgtgcgggagccccccatcatggtgaccaagcagctggaggacaccacagcctactgtggggagcgggtggagctggagtgtgaggtgtctgaagatgatgccaacgtgaagtggttcaagaatggagaggagatcatccctggccccaagagccgctaccgcatccgggtggagggcaagaagcacatcctgatcattgaaggagccaccaaggcagatgctgctgagtacagcgtgatgaccactggaggccagagcagcgccaagctgtctgtggacctgaagcccctgaagatcctgacccccctgacagaccagacagtgaacctgggcaaggagatctgcctgaagtgtgagatcagcgagaacatccctgggaagtggaccaagaatggcctgcctgtgcaggagagtgaccggctgaaggtggtgcacaagggccgcatccacaagctggtgattgccaatgccctgacagaagatgaaggagactatgtgtttgccccagatgcctacaacgtgaccctgcctgccaaggtgcacgtgattgacccccccaagatcatcctggatggcctggatgctgacaacacagtgacagtgattgctggcaacaagctgcggctggagatccccatctctggagagcccccacccaaggccatgtggagcagaggagacaaggccatcatggagggcagcggccgcatcagaacagagagctacccagacagcagcaccctggtgattgatattgctgagagagatgattctggagtgtaccacatcaacctgaagaatgaggccggggaggcccacgccagcatcaaggtgaaggtggtggacttcccagacccccctgtggcccccaccgtgacagaggtgggagatgactggtgcatcatgaactgggagcccccagcctatgatggcggcagccccatcctgggctacttcattgaaaggaagaagaagcagagcagccgctggatgaggctgaactttgacctgtgcaaggagaccacctttgagcccaagaagatgattgagggcgtggcctatgaggtgcgcatctttgctgtgaatgccatcggcatcagcaagcccagcatgcccagccggccctttgtgcccctggccgtgaccagcccccccaccctgctgactgtggacagcgtgacagacaccaccgtgaccatgcgctggaggcccccagaccacatcggggccgccggcctggatggctacgtgctggagtactgctttgagggcacagaggactggatcgtggccaacaaggacctgattgacaagaccaagttcaccatcaccggcctgcccacagatgccaagatctttgtgcgggtgaaggctgtgaatgctgctggggccagcgagcccaagtactacagccagcccatcctggtgaaggagatcatcgagccccccaagatccgcatccccaggcacctgaagcagacctacatccggcgggtgggggaggccgtgaacctggtgatccccttccagggcaagcccaggcctgagctgacctggaagaaggatggagctgagattgacaagaaccagatcaacatcagaaattctgaaacagacaccatcatcttcatcaggaaggccgagaggagccacagcggcaagtatgacctgcaggtgaaggtggacaagtttgtggagacagccagcattgacatccagatcatcgacaggcctggccccccccagatcgtgaagattgaagatgtgtggggagaaaatgtggccctgacctggaccccacccaaggatgatggaaatgctgccatcaccggctacaccatccagaaggctgacaagaagtccatggagtggttcaccgtgattgagcactaccacaggaccagcgccaccatcacagagctggtgattggaaatgagtactacttccgggtcttcagcgagaacatgtgtggcctgtctgaagatgccaccatgaccaaggagagcgctgtgattgccagagatggcaagatctacaagaaccctgtgtatgaggactttgacttcagcgaggcccccatgttcacccagcccctggtgaacacctacgccatcgccggctacaatgccaccctgaactgcagcgtgcggggcaaccccaagcccaagatcacctggatgaagaacaaggtggccatcgtggatgacccccgctacaggatgttcagcaaccagggcgtgtgcaccctggagatcaggaagcccagcccctatgatggcggcacctactgctgcaaggctgtgaatgacctgggcaccgtggagattgagtgcaagctggaggtgaaggtgatctaccagggcgtgaacaccccaggccagcccgtcttcctggagggccagcagcagagcctgcacaacaaggacttctag

SEQ ID NO: 160762 - DNA, 3447 bp, Artificial Sequence
  Description of Artificial Sequence: Synthetic coding sequence
atgcctgagcccaccaagaaggaggagaatgaggtgcctgccccagcccctcctcctgaggagcccagcaaggagaaggaggccggcaccaccccagccaaggatgaggaggaggtgtccccaccttctgccctgcccccaggcctgggcagccgggccctggagaggaaggacagcgactggaccctggtggagaccccacctggagaggagcaggccaagcagaatgccaacagccagctgagcatcctcttcatcgagaagccccagggcggcaccgtgaaggtgggggaggacatcaccttcatcgccaaggtgaaggccgaggacctgctgaggaagcccaccatcaagtggttcaagggcaagtggatggacctggccagcaaggccggcaagcacctgcagctgaaggagacctttgagcggcacagccgggtgtacacctttgagatgcagatcatcaaggccaaggacaactttgctggcaactaccgctgtgaggtgacctacaaggacaagtttgacagctgcagctttgacctggaggtgcatgagagcacaggcaccacccccaacatcgacatccgcagcgccttcaagaggtctggagagggccaggaggatgctggggagctggacttcagcggcctgctgaagagaagagaggtgaagcagcaggaggaggagccccaggtggatgtgtgggagctgctgaagaatgccaagcccagtgaatatgagaagatcgccttccagtatggcatcacagacctgcggggcatgctgaagaggctgaagaggatgaggcgggaggagaagaagtctgctgcctttgccaagatcctggaccctgcctaccaggtggacaagggcggccgggtgcgctttgtggtggagctggccgaccccaagctggaggtgaagtggtacaagaatggccaggagatccggcccagcaccaagtacatctttgagcacaagggctgccagaggatcctcttcatcaacaactgccagatgacagatgattctgagtactacgtgacagctggagatgagaagtgcagcacagagctgtttgtgcgggagccccccatcatggtgaccaagcagctggaggacaccacagcctactgtggggagcgggtggagctggagtgtgaggtgtctgaagatgatgccaacgtgaagtggttcaagaatggagaggagatcatccctggccccaagagccgctaccgcatccgggtggagggcaagaagcacatcctgatcattgaaggagccaccaaggcagatgctgctgagtacagcgtgatgaccactggaggccagagcagcgccaagctgtctgtggacctgaagcccctgaagatcctgacccccctgacagaccagacagtgaacctgggcaaggagatctgcctgaagtgtgagatcagcgagaacatccctgggaagtggaccaagaatggcctgcctgtgcaggagagtgaccggctgaaggtggtgcacaagggccgcatccacaagctggtgattgccaatgccctgacagaagatgaaggagactatgtgtttgccccagatgcctacaacgtgaccctgcctgccaaggtgcacgtgattgacccccccaagatcatcctggatggcctggatgctgacaacacagtgacagtgattgctggcaacaagctgcggctggagatccccatctctggagagcccccacccaaggccatgtggagcagaggagacaaggccatcatggagggcagcggccgcatcagaacagagagctacccagacagcagcaccctggtgattgatattgctgagagagatgattctggagtgtaccacatcaacctgaagaatgaggccggggaggcccacgccagcatcaaggtgaaggtggtggacttcccagacccccctgtggcccccaccgtgacagaggtgggagatgactggtgcatcatgaactgggagcccccagcctatgatggcggcagccccatcctgggctacttcattgaaaggaagaagaagcagagcagccgctggatgaggctgaactttgacctgtgcaaggagaccacctttgagcccaagaagatgattgagggcgtggcctatgaggtgcgcatctttgctgtgaatgccatcggcatcagcaagcccagcatgcccagccggccctttgtgcccctggccgtgaccagcccccccaccctgctgactgtggacagcgtgacagacaccaccgtgaccatgcgctggaggcccccagaccacatcggggccgccggcctggatggctacgtgctggagtactgctttgagggcacagaggactggatcgtggccaacaaggacctgattgacaagaccaagttcaccatcaccggcctgcccacagatgccaagatctttgtgcgggtgaaggctgtgaatgctgctggggccagcgagcccaagtactacagccagcccatcctggtgaaggagatcatcgagccccccaagatccgcatccccaggcacctgaagcagacctacatccggcgggtgggggaggccgtgaacctggtgatccccttccagggcaagcccaggcctgagctgacctggaagaaggatggagctgagattgacaagaaccagatcaacatcagaaattctgaaacagacaccatcatcttcatcaggaaggccgagaggagccacagcggcaagtatgacctgcaggtgaaggtggacaagtttgtggagacagccagcattgacatccagatcatcgacaggcctggccccccccagatcgtgaagattgaagatgtgtggggagaaaatgtggccctgacctggaccccacccaaggatgatggaaatgctgccatcaccggctacaccatccagaaggctgacaagaagtccatggagtggttcaccgtgattgagcactaccacaggaccagcgccaccatcacagagctggtgattggaaatgagtactacttccgggtcttcagcgagaacatgtgtggcctgtctgaagatgccaccatgaccaaggagagcgctgtgattgccagagatggcaagatctacaagaaccctgtgtatgaggactttgacttcagcgaggcccccatgttcacccagcccctggtgaacacctacgccatcgccggctacaatgccaccctgaactgcagcgtgcggggcaaccccaagcccaagatcacctggatgaagaacaaggtggccatcgtggatgacccccgctacaggatgttcagcaaccagggcgtgtgcaccctggagatcaggaagcccagcccctatgatggcggcacctactgctgcaaggctgtgaatgacctgggcaccgtggagattgagtgcaagctggaggtgaaggtgattgcccagtag

SEQ ID NO: 160763 - DNA, 3495 bp, Artificial Sequence
  Description of Artificial Sequence: Synthetic coding sequence
atgcctgagcccaccaagaaggaggagaatgaggtgcctgccccagcccctcctcctgaggagcccagcaaggagaaggaggccggcaccaccccagccaaggactggaccctggtggagaccccacctggagaggagcaggccaagcagaatgccaacagccagctgagcatcctcttcatcgagaagccccagggcggcaccgtgaaggtgggggaggacatcaccttcatcgccaaggtgaaggccgaggacctgctgaggaagcccaccatcaagtggttcaagggcaagtggatggacctggccagcaaggccggcaagcacctgcagctgaaggagacctttgagcggcacagccgggtgtacacctttgagatgcagatcatcaaggccaaggacaactttgctggcaactaccgctgtgaggtgacctacaaggacaagtttgacagctgcagctttgacctggaggtgcatgagagcacaggcaccacccccaacatcgacatccgcagcgccttcaagaggtctggagagggccaggaggatgctggggagctggacttcagcggcctgctgaagaggcgggaggtgaagcagcaggaggaggagccccaggtggatgtgtgggagctgctgaagaatgccaagcccagtgaatatgagaagatcgccttccagtatggcatcacagacctgcggggcatgctgaagaggctgaagaggatgagaagagaggagaagaagtctgctgcctttgccaagatcctggaccctgcctaccaggtggacaagggcggccgggtgcgctttgtggtggagctggccgaccccaagctggaggtgaagtggtacaagaatggccaggagatccggcccagcaccaagtacatctttgagcacaagggctgccagaggatcctcttcatcaacaactgccagatgacagatgacagcgagtactacgtgacagctggagatgagaagtgcagcacagagctgtttgtgcgggagccccccatcatggtgaccaagcagctggaggacaccacagcctactgtggggagcgggtggagctggagtgtgaggtgtctgaagatgatgccaacgtgaagtggttcaagaatggagaggagatcatccctggccccaagagccgctaccgcatccgggtggagggcaagaagcacatcctgatcatcgagggcgccaccaaggcagatgctgctgagtacagcgtgatgaccaccggcggccagagcagcgccaagctgtctgtggacctgaagcccctgaagatcctgacccccctgacagaccagacagtgaacctgggcaaggagatctgcctgaagtgtgagatcagcgagaacatccctgggaagtggaccaagaatggcctgcctgtgcaggagagtgaccggctgaaggtggtgcacaagggccgcatccacaagctggtgattgccaatgccctgacagaagatgaaggagactatgtgtttgccccagatgcctacaacgtgaccctgcctgccaaggtgcacgtgattgatcctcccaagatcatcctggatggcctggatgctgacaacacagtgacagtgattgctggcaacaagctgcggctggagatccccatcagcggggagcccccacccaaggccatgtggagcagaggagacaaggccatcatggagggcagcggccgcatcagaacagagagctacccagacagcagcaccctggtgattgatattgctgagagagatgacagcggcgtgtaccacatcaacctgaagaatgaagctggggaggcccacgccagcatcaaggtgaaggtggtggacttcccagacccccctgtggcccccaccgtgacagaggtgggagatgactggtgcatcatgaactgggagcccccagcctatgatggcggcagccccatcctgggctacttcatcgagaggaagaagaagcagagcagccgctggatgaggctgaactttgacctgtgcaaggagaccacctttgagcccaagaagatgattgaaggagtggcctatgaggtgcgcatctttgctgtgaatgccatcggcatcagcaagcccagcatgcccagccggccctttgtgcccctggccgtgaccagcccccccaccctgctgactgtggacagcgtgacagacaccaccgtgaccatgcgctggaggcccccagaccacatcggggctgctggcctggatggctacgtgctggagtactgctttgagggcagcaccagcgccaagcagagtgatgaaaatggagaggccgcctatgacctgcctgctgaggactggatcgtggccaacaaggacctgattgacaagaccaagttcaccatcaccggcctgcccacagatgccaagatctttgtgcgggtgaaggctgtgaatgctgctggggccagcgagcccaagtactacagccagcccatcctggtgaaggagatcatcgagccccccaagatccgcatccccaggcacctgaagcagacctacatcagaagagtgggggaggccgtgaacctggtgatccccttccagggcaagcccaggcctgagctgacctggaagaaggatggagctgagattgacaagaaccagatcaacatccggaacagcgagacagacaccatcatcttcatcaggaaggccgagaggagccacagcggcaagtatgacctgcaggtgaaggtggacaagtttgtggagacagccagcattgacatccagatcatcgaccggcccggccccccccagatcgtgaagattgaagatgtgtggggagaaaatgtggccctgacctggaccccacccaaggatgatggaaatgctgccatcaccggctacaccatccagaaggctgacaagaagtccatggagtggttcaccgtcatcgagcactaccacaggaccagcgccaccatcacagagctggtgattggaaatgagtactacttccgggtcttcagcgagaacatgtgtggcctgtctgaagatgccaccatgaccaaggagagcgctgtgattgccagagatggcaagatctacaagaaccctgtgtatgaagattttgacttcagcgaggcccccatgttcacccagcccctggtgaacacctacgccatcgccggctacaatgccaccctgaactgcagcgtgcggggcaaccccaagcccaagatcacctggatgaagaacaaggtggccatcgtggatgacccccgctacaggatgttcagcaaccagggcgtgtgcaccctggagatcaggaagcccagcccctatgatggcggcacctactgctgcaaggctgtgaatgacctgggcaccgtggagattgagtgcaagctggaggtgaaggtgatctaccagggcgtgaacaccccaggccagcctgtgttcctggagggccagcagcagagcctgcacaacaaggacttctag

SEQ ID NO: 160764 - DNA, 2349 bp, Artificial Sequence
  Description of Artificial Sequence: Synthetic coding sequence
atgcctgagcccaccaagaaggaggagaatgaggtgcctgccccagcccctcctcctgaggagcccagcaaggagaaggaggccggcaccaccccagccaaggatgaggaggaggtgtccccaccttctgccctgcccccaggcctgggcagccgggccctggagaggaaggacagcgactggaccctggtggagaccccacctggagaggagcaggccaagcagaatgccaacagccagctgagcatcctcttcatcgagaagccccagggcggcaccgtgaaggtgggggaggacatcaccttcatcgccaaggtgaaggccgaggacctgctgaggaagcccaccatcaagtggttcaagggcaagtggatggacctggccagcaaggccggcaagcacctgcagctgaaggagacctttgagcggcacagccgggtgtacacctttgagatgcagatcatcaaggccaaggacaactttgctggcaactaccgctgtgaggtgacctacaaggacaagtttgacagctgcagctttgacctggaggtgcatgagagcacaggcaccacccccaacatcgacatccgcagcgccttcaagaggtctggagagggccaggaggatgctggggagctggacttcagcggcctgctgaagagaagagaggtgaagcagcaggaggaggagccccaggtggatgtgtgggagctgctgaagaatgccaagcccagtgaatatgagaagatcgccttccagtatggcatcacagacctgcggggcatgctgaagaggctgaagaggatgaggcgggaggagaagaagtctgctgcctttgccaagatcctggaccctgcctaccaggtggacaagggcggccgggtgcgctttgtggtggagctggccgaccccaagctggaggtgaagtggtacaagaatggccaggagatccggcccagcaccaagtacatctttgagcacaagggctgccagaggatcctcttcatcaacaactgccagatgacagatgattctgagtactacgtgacagctggagatgagaagtgcagcacagagctgtttgtgcgggagccccccatcatggtgaccaagcagctggaggacaccacagcctactgtggggagcgggtggagctggagtgtgaggtgtctgaagatgatgccaacgtgaagtggttcaagaatggagaggagatcatccctggccccaagagccgctaccgcatccgggtggagggcaagaagcacatcctgatcattgaaggagccaccaaggcagatgctgctgagtacagcgtgatgaccactggaggccagagcagcgccaagctgtctgtggacctgaagcccctgaagatcctgacccccctgacagaccagacagtgaacctgggcaaggagatctgcctgaagtgtgagatcagcgagaacatccctgggaagtggaccaagaatggcctgcctgtgcaggagagtgaccggctgaaggtggtgcacaagggccgcatccacaagctggtgattgccaatgccctgacagaagatgaaggagactatgtgtttgccccagatgcctacaacgtgaccctgcctgccaaggtgcacgtgattgacccccccaagatcatcctggatggcctggatgctgacaacacagtgacagtgattgctggcaacaagctgcggctggagatccccatctctggagagcccccacccaaggccatgtggagcagaggagacaaggccatcatggagggcagcggccgcatcagaacagagagctacccagacagcagcaccctggtgattgatattgctgagagagatgattctggagtgtaccacatcaacctgaagaatgaggccggggaggcccacgccagcatcaaggtgaaggtggtggacttcccagacccccctgtggcccccaccgtgacagaggtgggagatgactggtgcatcatgaactgggagcccccagcctatgatggcggcagccccatcctgggctacttcattgaaaggaagaagaagcagagcagccgctggatgaggctgaactttgacctgtgcaaggagaccacctttgagcccaagaagatgattgagggcgtggcctatgaggtgcgcatctttgctgtgaatgccatcggcatcagcaagcccagcatgcccagccggccctttgtgcccctggccgtgaccagcccccccaccctgctgactgtggacagcgtgacagacaccaccgtgaccatgcgctggaggccccggccccactggtgcagccgcttccgctggctgtgtgcccgggtgctgctgtag

SEQ ID NO: 160765 - DNA, 3426 bp, Artificial Sequence; identical to SEQ ID NO: 160760
  Description of Artificial Sequence: Synthetic coding sequence

SEQ ID NO: 160766 - DNA, 3372 bp, Artificial Sequence
  Description of Artificial Sequence: Synthetic coding sequence
atgcctgagcccaccaagaaggaggagaatgaggtgcctgccccagcccctcctcctgaggagcccagcaaggagaaggaggccggcaccaccccagccaaggactggaccctggtggagaccccacctggagaggagcaggccaagcagaatgccaacagccagctgagcatcctcttcatcgagaagccccagggcggcaccgtgaaggtgggggaggacatcaccttcatcgccaaggtgaaggccgaggacctgctgaggaagcccaccatcaagtggttcaagggcaagtggatggacctggccagcaaggccggcaagcacctgcagctgaaggagacctttgagcggcacagccgggtgtacacctttgagatgcagatcatcaaggccaaggacaactttgctggcaactaccgctgtgaggtgacctacaaggacaagtttgacagctgcagctttgacctggaggtgcatgagagcacaggcaccacccccaacatcgacatccgcagcgccttcaagaggtctggagagggccaggaggatgctggggagctggacttcagcggcctgctgaagaggcgggaggtgaagcagcaggaggaggagccccaggtggatgtgtgggagctgctgaagaatgccaagcccagtgaatatgagaagatcgccttccagtatggcatcacagacctgcggggcatgctgaagaggctgaagaggatgagaagagaggagaagaagtctgctgcctttgccaagatcctggaccctgcctaccaggtggacaagggcggccgggtgcgctttgtggtggagctggccgaccccaagctggaggtgaagtggtacaagaatggccaggagatccggcccagcaccaagtacatctttgagcacaagggctgccagaggatcctcttcatcaacaactgccagatgacagatgacagcgagtactacgtgacagctggagatgagaagtgcagcacagagctgtttgtgcgggagccccccatcatggtgaccaagcagctggaggacaccacagcctactgtggggagcgggtggagctggagtgtgaggtgtctgaagatgatgccaacgtgaagtggttcaagaatggagaggagatcatccctggccccaagagccgctaccgcatccgggtggagggcaagaagcacatcctgatcatcgagggcgccaccaaggcagatgctgctgagtacagcgtgatgaccaccggcggccagagcagcgccaagctgtctgtggacctgaagcccctgaagatcctgacccccctgacagaccagacagtgaacctgggcaaggagatctgcctgaagtgtgagatcagcgagaacatccctgggaagtggaccaagaatggcctgcctgtgcaggagagtgaccggctgaaggtggtgcacaagggccgcatccacaagctggtgattgccaatgccctgacagaagatgaaggagactatgtgtttgccccagatgcctacaacgtgaccctgcctgccaaggtgcacgtgattgatcctcccaagatcatcctggatggcctggatgctgacaacacagtgacagtgattgctggcaacaagctgcggctggagatccccatcagcggggagcccccacccaaggccatgtggagcagaggagacaaggccatcatggagggcagcggccgcatcagaacagagagctacccagacagcagcaccctggtgattgatattgctgagagagatgacagcggcgtgtaccacatcaacctgaagaatgaagctggggaggcccacgccagcatcaaggtgaaggtggtggacttcccagacccccctgtggcccccaccgtgacagaggtgggagatgactggtgcatcatgaactgggagcccccagcctatgatggcggcagccccatcctgggctacttcatcgagaggaagaagaagcagagcagccgctggatgaggctgaactttgacctgtgcaaggagaccacctttgagcccaagaagatgattgaaggagtggcctatgaggtgcgcatctttgctgtgaatgccatcggcatcagcaagcccagcatgcccagccggccctttgtgcccctggccgtgaccagcccccccaccctgctgactgtggacagcgtgacagacaccaccgtgaccatgcgctggaggcccccagaccacatcggggctgctggcctggatggctacgtgctggagtactgctttgagggcacagaggactggatcgtggccaacaaggacctgattgacaagaccaagttcaccatcaccggcctgcccacagatgccaagatctttgtgcgggtgaaggctgtgaatgctgctggggccagcgagcccaagtactacagccagcccatcctggtgaaggagatcatcgagccccccaagatccgcatccccaggcacctgaagcagacctacatcagaagagtgggggaggccgtgaacctggtgatccccttccagggcaagcccaggcctgagctgacctggaagaaggatggagctgagattgacaagaaccagatcaacatccggaacagcgagacagacaccatcatcttcatcaggaaggccgagaggagccacagcggcaagtatgacctgcaggtgaaggtggacaagtttgtggagacagccagcattgacatccagatcatcgaccggcccggccccccccagatcgtgaagattgaagatgtgtggggagaaaatgtggccctgacctggaccccacccaaggatgatggaaatgctgccatcaccggctacaccatccagaaggctgacaagaagtccatggagtggttcaccgtcatcgagcactaccacaggaccagcgccaccatcacagagctggtgattggaaatgagtactacttccgggtcttcagcgagaacatgtgtggcctgtctgaagatgccaccatgaccaaggagagcgctgtgattgccagagatggcaagatctacaagaaccctgtgtatgaagattttgacttcagcgaggcccccatgttcacccagcccctggtgaacacctacgccatcgccggctacaatgccaccctgaactgcagcgtgcggggcaaccccaagcccaagatcacctggatgaagaacaaggtggccatcgtggatgacccccgctacaggatgttcagcaaccagggcgtgtgcaccctggagatcaggaagcccagcccctatgatggcggcacctactgctgcaaggctgtgaatgacctgggcaccgtggagattgagtgcaagctggaggtgaaggtgattgcccagtag

SEQ ID NO: 160767 - DNA, 1434 bp, Artificial Sequence
  Description of Artificial Sequence: Synthetic coding sequence
atgatggagaagaacaccagcgagggccctgcctgcagccctgaggagacagccagcgagagcgccaaggtgcccacagctgagcccccaggagaggtggccgtgtctgagagcacccgggaggagcaggtgcccaagccccaggccccagccccccaggcccccacagccagcacagccaccaagccagcccctccttctgaagatgtgcccagcgcccccctgctgctgaccctggatgatgtgagcagcagctctgtgacagtgtcctgggagcccccagagcggctgggccgcctgggcctgcagggctacgtgctggagctgtgccgggagggcgccagcgagtgggtgcctgtgtctgcccggcccatgatggtgacccagcagacagtgaggaacctggccctgggggacaagttcctgctgcgggtgtctgctgtgagcagcgctggagctggccccccagccatgctggaccagcccatccacatcagagaaaatattgaggcccccaagatccgggtgcccaggcacctgcggcagacctacatccggcaggtgggggagaccgtgaacctgcagatccccttccagggcaagcccaagccccaggccacctggacccacaatggacatgccctggacagccagagggtgtccatgaggactggagaccaggacagcatcctcttcatccgcagcgcccagaggagtgacagcggccgctatgagctgactgtgcgggtggaggacctggaggccaaggctgtgattgacatcctggtgattgagaagccaggcccccccagcagcatccggctgctggatgtgtggggctgcaatgctgccctgcagtggaccccaccccaggacaccggcaacacagagctgctgggctacatggtgcagaaggctgacaagaagacaggccagtggttcaccgtgctggagcgctaccaccccaccacctgcaccatcagtgacctgatcatcggcaacagctacagcttccgggtcttcagcgagaacctgtgtggcctgagcaccagcgccaccgtgaccaaggagctggcccacatccagaaggctgacattgctgccaagcccaagggcttcatcgagcgggacttcagcgaggcccccagcttcacccagcccctggccgaccacaccagcaccccaggctacagcacccagctgttctgcagcgtgcgggccagccccaagcccaagatcatctggatgaagaacaagatggagatccagggcaaccccaagtaccgggccctgtctgagcagggcgtgtgcaccctggagatcaggaagcccagcccctttgattctggagtgtacacctgcaaggccatcaacgtgctgggggaggcctctgtggactgccgcctggaggtgaaggccagcgctgcccactag

SEQ ID NO: 160768 - DNA, 5817 bp, Artificial Sequence
  Description of Artificial Sequence: Synthetic coding sequence
atgagcagtgatgctgagatggccatctttggagaggccgccccctacctgaggaagccagagaaggagagaattgaggcccagaaccggccctttgacagcaagaaggcctgctttgtggccgacaacaaggagatgtatgtgaagggcatgatccagacccgggagaatgacaaggtgattgtgaagaccctggatgacaggatgctgaccctgaacaatgaccaggtgttccccatgaacccccccaagtttgacaagattgaggacatggccatgatgacccacctgcacgagcctgctgtgctgtacaacctgaaggagagatatgctgcctggatgatctacacctacagcggcctcttctgtgtgacagtgaacccctacaagtggctgcctgtgtacaagccagaggtggtggccgcctaccggggcaagaagaggcaggaggccccaccccacatcttcagcatcagtgacaatgcctaccagttcatgctgacagaccgggacaaccagagcatcctgatcaccggggagagcggggccggcaagacagtgaacaccaagagggtcatccagtactttgccaccatcgctgtgactggagacaagaagaaggagacccagcccgggaagatgcagggcaccctggaggaccagatcatccaggccaaccccctgctggaggcctttggaaatgccaagacagtgagaaatgacaacagcagcagatttgggaagttcatccgcatccactttggagccaccgggaagctggccagcgctgacatcgagacctacctgctggagaagagccgggtgaccttccagctgagcagcgagaggagctaccacatcttctaccagatcatgagcaacaagaagccagagctgattgacctgctgctgatcagcaccaacccctttgacttcccctttgtgtcccagggcgaggtgacagtggccagcattgatgacagcgaggagctgctggccacagacaatgccatcgacatcctgggcttcagcagcgaggagaaggtgggcatctacaagctgactggagctgtgatgcactacggcaacatgaagttcaagcagaagcagcgggaggagcaggccgagccagatggaacagaggtggccgacaaggccggctacctgatgggcctgaacagcgctgagatgctgaagggcctgtgctgcccccgggtgaaggtgggcaatgaatatgtgaccaagggccagaatgtgcagcaggtgaccaacagcgtgggcgccctggccaaggctgtgtatgagaagatgttcctgtggatggtgacccgcatcaaccagcagctggacaccaagcagccccggcagtacttcatcggcgtgctggacattgctggctttgagatctttgacttcaacagcctggagcagctgtgcatcaacttcaccaatgagaagctgcagcagttcttcaaccaccacatgtttgtgctggagcaggaggagtacaagaaggagggcatcgagtgggagttcatcgactttggcatggacctggccgcctgcatcgagctgattgagaagcccatgggcatcttcagcatcctggaggaggagtgcatgttccccaaggccacagacaccagcttcaagaacaagctgtatgaccagcacctgggcaagagcaacaacttccagaagcccaagccagccaagggcaaggccgaggcccacttcagcctggtgcactacgccggcaccgtggactacaacattgctggctggctggacaagaacaaggaccccctgaatgagaccgtggtgggcctgtaccagaagagcagcctgaagctgctgtccttcctgttcagcaactatgctggagctgagactggagacagcggcggcagcaagaagggcggcaagaagaagggcagcagcttccagacagtgtctgctgtgttccgggagaacctgaacaagctgatgaccaacctgcggagcacccacccccactttgtgcgctgcctgatccccaatgagaccaagaccccaggagtgatggaccactacctggtgatgcaccagctgcgctgcaatggagtgctggagggcatccgcatctgcaggaagggcttccccagccgcatcctgtatgctgacttcaagcagcgctaccgcatcctgaatgccagcgccatccctgagggccagttcatcgacagcaagaatgccagcgagaagctgctgaacagcattgatgtggaccgggagcagttccgcttcggcaacaccaaggtgttcttcaaggccggcctgctgggcctgctggaggagatgagagatgagaagctggtgaccctgatgaccagcacccaggccgtgtgccggggctacctgatgagggtggagttcaagaagatgatggagcggcgggacagcatcttctgcatccagtacaacatccgctccttcatgaatgtgaagcactggccctggatgaacctcttcttcaagatcaagcccctgctgaagtctgctgaggccgagaaggagatggccaccatgaaggaggactttgagaggaccaaggaggagctggcccggtctgaggcccggaggaaggagctggaggagaagatggtgtccctgctgcaggagaagaatgacctgcagctgcaggtgcagagcgagacagagaacctgatggatgctgaggagcgctgtgagggcctcatcaagagcaagatcctgctggaggccaaggtgaaggagctgacagagcggctggaggaggaggaggagatgaacagcgagctggtggccaagaagaggaacctggaggacaagtgcagcagcctgaagagggacattgatgacctggagctgaccctgaccaaggtggagaaggagaagcacgccacagagaacaaggtgaagaacctgtctgaggagatgacagccctggaggagaacatcagcaagctgaccaaggagaagaagagcctgcaggaggcccaccagcagaccctggatgacctgcaggtggaggaggacaaggtgaatggcctcatcaagatcaatgccaagctggagcagcagacagatgacctggagggcagcctggagcaggagaagaagctgcgggctgacctggagcgggccaagaggaagctggagggggacctgaagatgagccaggagagcatcatggacctggagaatgacaagcagcagatcgaggagaagctgaagaagaaggagtttgagctgagccagctgcaggccaagattgatgatgagcaggtgcacagcctgcagttccagaagaagatcaaggagctgcaggccagaattgaggagctggaggaggagattgaggccgagcacaccctgcgggccaagattgagaagcagaggagtgacctggcccgggagctggaggagatcagcgagcggctggaggaggccagcggggccaccagcgcccagatcgagatgaacaagaagcgggaggccgagttccagaagatgagaagagacctggaggaggccaccctgcagcacgaggccacagctgccaccctgaggaagaagcaggccgacagcgtggccgagctgggggagcagattgacaacctgcagagggtgaagcagaagctggagaaggagaagtctgagctgaagatggagattgatgacatggccagcaacatcgaggccctgagcaagagcaagagcaacattgaaagaacctgcaggacagtggaggaccagttcagcgagatcaaggccaaggatgagcagcagacccagctgattcatgacctgaacatgcagaaggcccggctgcagacccagaatggagagctgagccaccgggtggaggagaaggagagcctcatcagccagctgaccaagagcaagcaggccctgacccagcagctggaggagctgaagaggcagatggaggaggagaccaaggccaagaatgccatggcccacgccctgcagagcagcagacatgactgtgacctgctgcgggagcagtatgaggaggagcaggaggccaaggccgagctgcagagggccctgagcaaggccaacagcgaggtggcccagtggaggaccaagtatgaaacagatgccatccagaggacagaggagctggaggaggccaagaagaagctggcccagaggctgcaggaggccgaggagaacacagaaacagccaacagcaaatgtgccagcctggagaagaccaagcagaggctgcagggcgaggtggaggacctgatgagggacctggagaggagccacacagcctgtgccaccctggacaagaagcagaggaactttgacaaggtgctggccgagtggaagcagaagctggatgagagccaggccgagctggaggccgcccagaaggagagccgcagcctgagcacagagctgttcaagatgagaaatgcctatgaggaggtggtggaccagctggagaccctgcggcgggagaacaagaacctgcaggaggagatcagtgacctgacagagcagattgctgagaccgggaagaacctgcaggaggccgagaagaccaagaagctggtggagcaggagaagagtgacctgcaggtggccctggaggaggtggagggcagcctggagcacgaggagagcaagatcctgcgggtgcagctggagctgagccaggtgaagtctgagctggacaggaaggtgattgagaaggatgaggagattgagcagctgaagaggaacagccagagagctgctgaggccctgcagagcgtgctggatgctgagatccgcagcagaaatgatgccctgcggctgaagaagaagatggagggggacctgaatgagatggagatccagctgggccacagcaaccggcagatggccgagacccagaagcacctgaggacagtgcagggccagctgaaggacagccagctgcacctggatgatgccctgcggagcaatgaagacctgaaggagcagctggccatcgtggagaggagaaatggcctgctgctggaggagctggaggagatgaaggtggccctggagcagacagagaggacccggcggctgtctgagcaggagctgctggatgccagtgacagagtgcagctgctgcacagccagaacaccagcctcatcaacaccaagaagaagctggaggccgacatcgcccagtgccaggccgaggtggagaacagcatccaggagagcagaaatgctgaggagaaggccaagaaggccatcacagatgctgccatgatggccgaggagctgaagaaggagcaggacaccagcgcccacctggagaggatgaagaagaacctggagcagacagtgaaggacctgcagcaccggctggatgaggccgagcagctggccctgaagggcggcaagaagcagatccagaagctggagaacagagtgcgggagctggagaatgagctggatgtggagcagaagagaggagctgaggccctgaagggggcccacaagtatgaaaggaaggtgaaggagatgacctaccaggccgaggaggaccacaagaacatcctgcggctgcaggacctggtggacaagctgcaggccaaggtgaagagctacaagaggcaggccgaggaggccgaggagcaggccaacacccagctgagccgctgcagaagagtgcagcacgagctggaggaggccgctgagagagctgacattgctgagagccaggtgaacaagctgcgggccaagagcagagatgtgggcagccagaagatggaggagtag

SEQ ID NO: 160769 - DNA, 6111 bp, Artificial Sequence
  Description of Artificial Sequence: Synthetic coding sequence
atggctgctgtgaccatgtctgtgcccggcaggaaggccccacccaggcctggccctgtgcctgaggccgcccagcccttcctgttcaccccccggggccccagcgctgggggcggccctggcagcggcaccagcccccaggtggagtggacagcccggcggctggtgtgggtgcccagcgagctgcacggctttgaagctgctgccctgagagatgaaggagaggaggaggccgaggtggagctggccgagagcggccgccgcctgcggctgccccgggaccagatccagaggatgaacccccccaagttcagcaaggccgaggacatggccgagctgacctgcctgaatgaggcctctgtgctgcacaacctgcgggagcgctactacagcggcctcatctacacctacagcggcctcttctgtgtggtgatcaacccctacaagcagctgcccatctacacagaggccatcgtggagatgtaccggggcaagaagagacatgaggtgccccctcatgtgtatgctgtgacagagggcgcctaccgctccatgctgcaggaccgggaggaccagagcatcctgtgcacaggagagagcggggccggcaagacagagaacaccaagaaggtgatccagtacctggcccacgtggccagcagccccaagggcaggaaggagcccggggtgcctgcctctgtgtccacagtgtcctatggagagctggagcggcagctgctgcaggccaaccccatcctggaggcctttggaaatgccaagacagtgaagaatgacaacagcagcagatttgggaagttcatccgcatcaactttgatgtggccggctacatcgtgggcgccaacatcgagacctacctgctggagaagagccgggccatccggcaggccaaggatgagtgcagcttccacatcttctaccagctgctgggcggggccggggagcagctgaaggctgacctgctgctggagccctgcagccactaccgcttcctgaccaacggccccagcagcagccctggccaggagcgggagctgttccaggagaccctggagagcctgcgggtgctgggcttcagccatgaggagatcatctccatgctgaggatggtgtctgctgtgctgcagtttggaaacatcgccctgaagcgggagaggaacacagaccaggccaccatgccagacaacacagctgcccagaagctgtgccgcctgctgggcctgggcgtgacagacttcagccgggccctgctgaccccccgcatcaaggtgggccgggactatgtgcagaaggcccagaccaaggagcaggccgactttgccctggaggccctggccaaggccacctatgaaagactcttccgctggctggtgctgcggctgaacagagccctggacaggagcccccggcagggcgccagcttcctgggcatcctggacattgctggctttgagatcttccagctgaacagctttgagcagctgtgcatcaactacaccaatgagaagctgcagcagctgttcaaccacaccatgtttgtgctggagcaggaggagtaccagcgggagggcatcccctggaccttcctggactttggcctggacctgcagccctgcatcgacctgattgaaagacctgccaaccccccaggcctgctggccctgctggatgaggagtgctggttccccaaggccacagacaagagctttgtggagaaggtggcccaggagcagggcggccaccccaagttccagaggcccaggcacctgcgggaccaggccgacttctctgtgctgcactacgccggcaaggtggactacaaggccaatgagtggctgatgaagaacatggaccccctgaatgacaacgtggccgccctgctgcaccagagcacagaccggctgacagctgagatctggaaggatgagcacggcggcttccagcagttctccttcctgggcagcttcccccccagccccccaggcagcgctgagcgctgcagcagcgccatcagccccccaggagtggagggcatcgtgggcctggagcaggtgagcagcctgggagatggccccccaggcggccggccccggcggggcatgttcagaacagtgggccagctgtacaaggagagcctgagccggctgatggccaccctgagcaacaccaaccccagctttgtgcgctgcatcgtgcccaaccacgagaagagagctgggaagctggagccccggctggtgctggaccagctgcgctgcaatggagtgctggagggcatccgcatctgccggcagggcttccccaaccgcatcctcttccaggagttccggcagagatatgagatcctgaccccaaatgccatccccaagggcttcatggatggcaagcaggcctgtgagaagatgatccaggccctggagctggaccccaacctgtacagagtgggccagagcaagatcttcttccgggccggcgtgctggcccagctggaggaggagcgggacctgaaggtgacagacatcatcgtgtccttccaggccgccgcccggggctacctggcccggcgggccttccagaagaggcagcagcagcagagcgccctgcgggtgatgcagaggaactgtgccgcctacctgaagctgcggcactggcagtggtggaggctcttcaccaaggtgaagcccctgctgcaggtgacccggcaggatgaggtgctgcaggcccgggcccaggagctgcagaaggtgcaggagctgcagcagcagagcgcccgggaggtgggggagctgcagggccgggtggcccagctggaggaggagcgggcccggctggccgagcagctgcgggcagaggccgagctgtgtgccgaggccgaggagacccggggccgcctggccgccaggaagcaggagctggagctggtggtgtctgagctggaggcccgggtgggggaggaggaggagtgcagccggcagatgcagacagagaagaagaggctgcagcagcacatccaggagctggaggcccacctggaggccgaggagggcgcccggcagaagctgcagctggagaaggtgaccacagaggccaagatgaagaagtttgaggaggacctgctgctgctggaggaccagaacagcaagctgagcaaggagaggaagctgctggaggaccggctggccgagttcagcagccaggccgctgaggaggaggagaaggtgaagagcctgaacaagctgcggctgaagtatgaggccaccatcgctgacatggaggaccggctgaggaaggaggagaagggccggcaggagctggagaagctgaagaggcggctggatggagagagcagcgagctgcaggagcagatggtggagcagcagcagagagctgaggagctgcgggcccagctgggcaggaaggaggaggagctgcaggccgccctggcccgggcagaagatgaaggaggagcccgggcccagctgctgaagagcctgcgggaggcccaggccgccctggccgaggcccaggaggacctggagagcgagcgggtggcccggaccaaggccgagaagcagaggcgggacctgggggaggagctggaggccctgcggggggagctggaggacaccctggacagcaccaatgcccagcaggagctgcggagcaagcgggagcaggaggtgacagagctgaagaagaccctggaggaggagacccgcatccacgaggccgctgtgcaggagctgcggcagagacatggccaggccctgggggagctggccgagcagctggagcaggcccggcggggcaaaggagcctgggagaagacccggctggccctggaggccgaggtgtctgagctgcgggcagagctgagcagcctgcagacagcccggcaggagggggagcagaggagaagaaggctggagctgcagctgcaggaggtgcagggccgggctggagatggagagcgggcccgggcagaggccgctgagaagctgcagagggcccaggccgagctggagaatgtgtctggggccctgaatgaagctgagagcaagaccatccggctgagcaaggagctgagcagcacagaggcccagctgcatgatgcccaggagctgctgcaggaggagacccgggccaagctggccctgggcagccgggtgcgggccatggaggccgaggccgccggcctgcgggagcagctggaggaggaggccgccgcccgggagcgggccggccgggagctgcagacagcccaggcccagctgtctgagtggaggcggcggcaggaggaggaggccggggccctggaggccggggaggaggccaggagaagagctgcccgggaggccgaggccctgacccagaggctggccgagaagacagagaccgtggaccggctggagcggggcagaagaaggctgcagcaggagctggatgatgccaccatggacctggagcagcagaggcagctggtgtccaccctggagaagaagcagaggaagtttgaccagctgctggccgaggagaaggctgctgtgctgcgggctgtggaggagcgggagcgggcagaggccgagggccgggagcgggaggcccgggccctgagcctgacccgggccctggaggaggagcaggaggcccgggaggagctggagcggcagaacagagccctgcgggcagagctggaggccctgctgagcagcaaggatgatgtgggcaagtctgtgcatgagctggagcgggcctgccgggtggccgagcaggccgccaatgacctgcgggcccaggtgacagagctggaggatgagctgacagctgctgaagatgccaagctgcggctggaggtgacagtgcaggccctgaagacccagcacgagcgggacctgcagggcagagatgaggccggggaggagcggcggcggcagctggccaagcagctgagagatgctgaggtggagagagatgaggagaggaagcagaggaccctggccgtggccgccaggaagaagctggagggggagctggaggagctgaaggcccagatggccagcgctggccagggcaaggaggaggccgtgaagcagctgaggaagatgcaggcccagatgaaggagctgtggagggaggtggaggagaccaggaccagccgggaggagatcttcagccagaaccgggagagcgagaagaggctgaagggcctggaggccgaggtgctgcggctgcaggaggagctggccgccagtgaccgggcccggcggcaggcccagcaggacagagatgagatggctgatgaggtggccaatggaaacctgagcaaggccgccatcctggaggagaagaggcagctggagggccgcctgggccagctggaggaggagctggaggaggagcagagcaacagcgagctgctgaatgaccgctacaggaagctgctgctgcaggtggagagcctgaccacagagctgtctgctgagaggagcttcagcgccaaggccgagagcggccggcagcagctggagcggcagatccaggagctgcggggccgcctgggggaggaggatgctggggcccgggcccggcacaagatgaccatcgccgccctggagagcaagctggcccaggccgaggagcagctggagcaggagacccgggagcgcatcctgagcggcaagctggtgagaagagctgagaagaggctgaaggaggtggtgctgcaggtggaggaggagcggcgggtggccgaccagctgcgggaccagctggagaagggcaacctgcgggtgaagcagctgaagaggcagctggaggaggccgaggaggaggccagccgggcccaggccggcagaagaaggctgcagcgggagctggaggatgtgacagaatctgctgagagcatgaaccgggaggtgaccaccctgaggaaccggctgcggcggggccccctgaccttcaccaccaggacagtgcggcaggtgttccggctggaggagggcgtggccagtgatgaggaggccgaggaggcccagcccggcagcggccccagccctgagcctgagggcagccccccagcccacccccagtag

SEQ ID NO: 160770 - DNA, 5823 bp, Artificial Sequence
  Description of Artificial Sequence: Synthetic coding sequence
atgagcagtgacacagagatggaggtgtttggaattgctgcccccttcctgaggaagtctgagaaggagagaattgaggcccagaaccagccctttgatgccaagacctactgctttgtggtggacagcaaggaggagtatgccaagggcaagatcaagagcagccaggacggcaaggtgacagtggagacagaggacaacagaaccctggtggtgaagccagaagatgtgtatgccatgaacccccccaagtttgacagaattgaggacatggccatgctgacccacctgaatgaacctgctgtgctgtacaacctgaaggaccgctacacctcctggatgatctacacctacagcggcctcttctgtgtgacagtgaacccctacaagtggctgcctgtgtacaaccctgaggtggtggagggctaccggggcaagaagaggcaggaggccccaccccacatcttcagcatcagtgacaatgcctaccagttcatgctgacagaccgggagaaccagagcatcctgatcaccggggagagcggggccggcaagacagtgaacaccaagagggtcatccagtactttgccaccatcgccgccaccggggacctggccaagaagaaggacagcaagatgaagggcaccctggaggaccagatcatcagcgccaaccccctgctggaggcctttggaaatgccaagacagtgagaaatgacaacagcagcagatttgggaagttcatccgcatccacttcggcaccaccgggaagctggccagcgctgacatcgagacctacctgctggagaagagccgggtgaccttccagctgaaggccgagaggagctaccacatcttctaccagatcctgagcaacaagaagccagagctgattgagctgctgctgatcaccaccaacccctatgactaccccttcatcagccagggcgagatcctggtggccagcattgatgatgctgaggagctgctggccacagattctgccatcgacatcctgggcttcaccccagaggagaagagcggcctgtacaagctgaccggggctgtgatgcactacggcaacatgaagttcaagcagaagcagcgggaggagcaggccgagccagatggaacagaggtggccgacaagacagcctacctgatgggcctgaacagcagtgacctgctgaaggccctgtgcttcccccgggtgaaggtgggcaatgaatatgtgaccaagggccagacagtggaccaggtgcaccacgctgtgaatgccctgagcaagtctgtgtatgagaagctgttcctgtggatggtgacccgcatcaaccagcagctggacaccaagctgccccggcagcacttcatcggcgtgctggacattgctggctttgagatctttgagtacaacagcctggagcagctgtgcatcaacttcaccaatgagaagctgcagcagttcttcaaccaccacatgtttgtgctggagcaggaggagtacaagaaggagggcatcgagtggaccttcatcgactttggcatggacctggccgcctgcatcgagctgattgagaagcccatgggcatcttcagcatcctggaggaggagtgcatgttccccaaggccacagacaccagcttcaagaacaagctgtatgaccagcacctgggcaagagcaacaacttccagaagcccaaggtggtgaagggccgggcagaggcccacttcagcctcatccactacgccggcaccgtggactacagcgtgtctggctggctggagaagaacaaggaccccctgaatgaaacagtggtgggcctgtaccagaagagcagcaaccggctgctggcccacctgtatgccacctttgccacagcagatgctgacagcggcaagaagaaggtggccaagaagaagggcagcagcttccagacagtgtctgccctcttccgggagaacctgaacaagctgatgagcaacctgcggaccacccacccccactttgtgcgctgcatcatccccaatgagaccaagacccctggggccatggagcacagcctggtgctgcaccagctgcgctgcaatggagtgctggagggcatccgcatctgcaggaagggcttccccaaccgcatcctgtatggagacttcaagcagcgctacagagtgctgaatgccagcgccatccctgagggccagttcatcgacagcaagaaggcctgtgagaagctgctggccagcattgacatcgaccacacccagtacaagtttggccacaccaaggtgttcttcaaggccggcctgctgggcaccctggaggagatgagagatgaccggctggccaagctgatcaccaggacccaggccgtgtgccggggcttcctgatgagggtggagttccagaagatggtgcagaggcgggagagcatcttctgcatccagtacaacatccgctccttcatgaatgtgaagcactggccctggatgaagctgttcttcaagatcaagcccctgctgaagtctgctgagacagagaaggagatggccaccatgaaggaggagttccagaagaccaaggatgagctggccaagtctgaggccaagaggaaggagctggaggagaagctggtgaccctggtgcaggagaagaatgacctgcagctgcaggtgcaggccgagagcgagaacctgctggatgctgaggagcgctgtgaccagctgatcaaggccaagttccagctggaggccaagatcaaggaggtgacagaaagagcagaagatgaggaggagatcaatgctgagctgacagccaagaagaggaagctggaggatgaatgttctgagctgaagaaggacattgatgacctggagctgaccctggccaaggtggagaaggagaagcacgccacagagaacaaggtgaagaacctgacagaggagctgagcggcctggatgagaccatcgccaagctgacccgggagaagaaggccctgcaggaggcccaccagcaggccctggatgacctgcaggccgaggaggacaaggtgaacagcctgaacaagaccaagagcaagctggagcagcaggtggaggacctggagagcagcctggagcaggagaagaagctgcgggtggacctggagaggaacaagaggaagctggagggggacctgaagctggcccaggagagcatcctggacctggagaatgacaagcagcagctggatgagcggctgaagaagaaggactttgagtactgccagctgcagagcaaggtggaggatgagcagaccctgggcctgcagttccagaagaagatcaaggagctgcaggcccgcatcgaggagctggaggaggagattgaagctgagcgggccacccgggccaagacagagaagcagaggagtgactatgcccgggagctggaggagctgtctgagcggctggaggaggccggcggcgtgaccagcacccagatcgagctgaacaagaagcgggaggccgagttcctgaagctgcggcgggacctggaggaggccaccctgcagcacgaggccatggtggccgccctgaggaagaagcacgccgacagcgtggccgagctgggggagcagattgacaacctgcagagggtgaagcagaagctggagaaggagaagtctgagttcaagctggagattgatgacctgagcagctccatggagagcgtgtccaagagcaaggccaacctggagaagatctgcaggaccctggaggaccagctgtctgaggcccggggcaagaatgaggagatccagaggagcctgtctgagctgaccacccagaagagccggctgcagacagaagctggggagctgagccggcagctggaggagaaggagagcatcgtgtcccagctgagccgcagcaagcaggccttcacccagcagacagaggagctgaagaggcagctggaggaggagaacaaggccaagaatgccctggcccacgccctgcagagcagcagacatgactgtgacctgctgcgggagcagtatgaggaggagcaggagggcaaggccgagctgcagagggccctgagcaaggccaacagcgaggtggcccagtggaggaccaagtatgaaacagatgccatccagaggacagaggagctggaggaggccaagaagaagctggcccagaggctgcaggacagcgaggagcaggtggaggccgtgaatgccaagtgtgccagcctggagaagaccaagcagaggctgcagggcgaggtggaggacctgatggtggatgtggagcgggccaacagcctggccgccgccctggacaagaagcagaggaactttgacaaggtgctggccgagtggaagaccaagtgtgaggagagccaggccgagctggaggccagcctgaaggagagccgcagcctgagcacagagctgttcaagctgaagaatgcctatgaggaggccctggaccagctggagaccgtgaagcgggagaacaagaacctggagcaggagattgctgacctgacagagcagattgctgaaaatggcaagaccatccacgagctggagaagagcaggaagcagatcgagctggagaaggctgacatccagctggccctggaggaggccgaggccgccctggagcacgaggaggccaagatcctgcgcatccagctggagctgacccaggtgaagtcagaaattgacaggaagattgctgagaaggatgaggagattgagcagctgaagaggaactaccagaggacagtggagaccatgcagagcgccctggatgctgaggtgcgcagcagaaatgaggccatccggctgaagaagaagatggagggggacctgaatgaaattgagatccagctgagccacgccaaccggcaggccgctgagaccctgaagcacctgcggtctgtgcagggccagctgaaggacacccagctgcacctggatgatgccctgcggggccaggaggacctgaaggagcagctggccatcgtggagcggcgggccaacctgctgcaggccgaggtggaggagctgcgggccaccctggagcagacagagcgggccaggaagctggccgagcaggagctgctggacagcaatgaaagagtgcagctgctgcacacccagaacaccagcctcatccacaccaagaagaagctggagacagacctgatgcagctgcagagcgaggtggaggatgccagcagagatgccagaaatgctgaggagaaggccaagaaggccatcacagatgctgccatgatggccgaggagctgaagaaggagcaggacaccagcgcccacctggagaggatgaagaagaacctggagcagacagtgaaggacctgcagcaccggctggatgaagctgagcagctggccctgaagggcggcaagaagcagatccagaagctggagacccgcatccgggagctggagtttgagctggagggggagcagaagaagaacacagaatctgtgaagggcctgaggaaatatgaaagaagagtgaaggagctgacctaccagagcgaggaggacaggaagaatgtgctgcggctgcaggacctggtggacaagctgcaggtgaaggtgaagagctacaagaggcaggccgaggaggctgatgagcaggccaatgcccacctgaccaagttcaggaaggcccagcacgagctggaggaggccgaggagagagctgacattgctgagagccaggtgaacaagctgcgggccaagacccgggacttcaccagcagcaggatggtggtgcatgagagcgaggagtag

SEQ ID NO: 160771 - DNA, 3132 bp, Artificial Sequence
  Description of Artificial Sequence: Synthetic coding sequence
atgcccctgctggagggctctgtgggcgtggaggacctggtgctgctggagcccctggtggaggagagcctgctgaagaacctgcagctgcgctatgagaacaaggagatctacacctacatcggaaatgtggtgatctctgtgaacccctaccagcagctgcccatctacggccctgagttcatcgccaagtaccaggactacaccttctatgagctgaagccccacatctatgccctggccaacgtggcctaccagagcctgcgggaccgggaccgggaccagtgcatcctgatcaccggggagagcggcagcggcaagacagaggccagcaagctggtgatgtcctatgtggccgctgtgtgtgggaagggggagcaggtgaacagcgtgaaggagcagctgctgcagagcaaccctgtgctggaggcctttggaaatgccaagaccatccggaacaacaacagcagcagatttgggaagtacatggacattgaatttgacttcaagggcagccccctgggcggcgtcatcaccaactacctgctggagaagagccggctggtgaagcagctgaagggggagaggaacttccacatcttctaccagctgctggccggggctgatgagcagctgctgaaggccctgaagctggagcgggacaccaccggctacgcctacctgaaccacgaggtgtcccgggtggatggcatggatgatgccagcagcttccgggctgtgcagagcgccatggccgtcatcggcttcagcgaggaggagatccggcaggtgctggaggtgacctccatggtgctgaagctgggcaatgtgctggtggctgatgagttccaggccagcggcatcccagccagcggcatcagagatggccggggcgtgcgggagatcggggagatggtgggcctgaacagcgaggaggtggagcgggccctgtgcagcaggaccatggagacagccaaggagaaggtggtgacagccctgaatgtgatgcaggcccagtatgccagagatgccctggccaagaacatctacagccggctgtttgactggatcgtgaaccgcatcaatgaaagcatcaaggtgggcattggagagaagaagaaggtgatgggcgtgctggacatctacggctttgagatcctggaggacaacagctttgagcagtttgtgatcaactactgcaatgagaagctgcagcaggtgttcatcgagatgaccctgaaggaggagcaggaggagtacaagcgggagggcatcccctggaccaaggtggactactttgacaatggcatcatctgcaagctgattgagcacaaccagaggggcatcctggccatgctggatgaggagtgcctgcggcctggggtggtgtctgacagcaccttcctggccaagctgaaccagctgttcagcaagcacggccactatgagagcaaggtgacccagaatgcccagaggcagtatgaccacaccatgggcctgagctgcttccgcatctgccactacgccggcaaggtgacctacaacgtgaccagcttcatcgacaagaacaatgacctgctcttccgggacctgctgcaggccatgtggaaggcccagcaccccctgctgcggagcctcttccctgagggcaaccccaagcaggccagcctgaagaggcctcccacagctggggcccagttcaagagctctgtggccatcctgatgaagaacctgtacagcaagagccccaactacatccgctgcatcaagcccaatgagcaccagcagaggggccagttcagcagtgacctggtggccacccaggcccgctacctgggcctgctggagaatgtgcgggtgagaagagctggctacgcccaccggcagggctacggccccttcctggagcgctaccgcctgctgagccgcagcacctggccccactggaatggaggagaccgggagggcgtggagaaggtgctgggggagctgtccatgagcagcggggagctggccttcggcaagaccaagatcttcatccgcagccccaagaccctcttctacctggaggagcagaggcggctgcggctgcagcagctggccaccctcatccagaagatctaccggggctggcgctgcaggacccactaccagctgatgaggaagagccagatcctgatcagctcctggttccggggcaacatgcagaagaagtgctacggcaagatcaaggcctctgtgctgctgatccaggcctttgtgcggggctggaaggccaggaagaactacaggaagtacttccgctctgaggccgccctgaccctggccgacttcatctacaagtccatggtgcagaagttcctgctgggcctgaagaacaacctgcccagcaccaacgtgctggacaagacctggccagctgccccctacaagtgcctgagcacagccaaccaggagctgcagcagctgttctaccagtggaagtgcaagcgcttccgggaccagctgagccccaagcaggtggagatcctgcgggagaagctgtgtgccagcgagctgttcaagggcaagaaggccagctacccccagagcgtgcccatccccttctgtggggactacatcggcctgcagggcaaccccaagctgcagaagctgaagggcggggaggagggccctgtgctgatggccgaggccgtgaagaaggtgaacagaggaaatggcaagaccagcagccgcatcctgctgctgaccaagggccacgtgatcctgacagacaccaagaagagccaggccaagatcgtgattggcctggacaacgtggccggcgtgtctgtgaccagcctgaaggatggcctcttcagcctgcacctgtctgagatgagctctgtgggcagcaagggggacttcctgctggtgtctgaacatgtgattgagctgctgaccaagatgtacagagctgtgctggatgccacccagaggcagctgactgtgacagtgacagagaagttctctgtgcgcttcaaggaaaattctgtggccgtgaaggtggtgcagggccctgctggaggagacaacagcaagctgcgctacaagaagaagggcagccactgcctggaggtgacagtgcagtag

SEQ ID NO: 160772 - DNA, 291 bp, Artificial Sequence
  Description of Artificial Sequence: Synthetic coding sequence
atgcccctgctggagggctctgtgggcgtggaggacctggtgctgctggagcccctggtggaggagagcctgctgaagaacctgcagctgcgctatgagaacaaggagatctacacctacatcggaaatgtggtgatctctgtgaacccctaccagcagctgcccatctacggccctgagttcatcgccaagtaccaggactacaccttctatgagctgaagccccacatctatgccctggccaacgtggcctaccagagcctgcgggaccgggaccgggaccagtgctag

SEQ ID NO: 160773 - DNA, 3132 bp, Artificial Sequence; identical to SEQ ID NO: 160771
  Description of Artificial Sequence: Synthetic coding sequence

SEQ ID NO: 160774 - DNA, 2646 bp, Artificial Sequence
  Description of Artificial Sequence: Synthetic coding sequence
atggacattgaatttgacttcaagggcagccccctgggcggcgtcatcaccaactacctgctggagaagagccggctggtgaagcagctgaagggggagaggaacttccacatcttctaccagctgctggccggggctgatgagcagctgctgaaggccctgaagctggagcgggacaccaccggctacgcctacctgaaccacgaggtgtcccgggtggatggcatggatgatgccagcagcttccgggctgtgcagagcgccatggccgtcatcggcttcagcgaggaggagatccggcaggtgctggaggtgacctccatggtgctgaagctgggcaatgtgctggtggctgatgagttccaggccagcggcatcccagccagcggcatcagagatggccggggcgtgcgggagatcggggagatggtgggcctgaacagcgaggaggtggagcgggccctgtgcagcaggaccatggagacagccaaggagaaggtggtgacagccctgaatgtgatgcaggcccagtatgccagagatgccctggccaagaacatctacagccggctgtttgactggatcgtgaaccgcatcaatgaaagcatcaaggtgggcattggagagaagaagaaggtgatgggcgtgctggacatctacggctttgagatcctggaggacaacagctttgagcagtttgtgatcaactactgcaatgagaagctgcagcaggtgttcatcgagatgaccctgaaggaggagcaggaggagtacaagcgggagggcatcccctggaccaaggtggactactttgacaatggcatcatctgcaagctgattgagcacaaccagaggggcatcctggccatgctggatgaggagtgcctgcggcctggggtggtgtctgacagcaccttcctggccaagctgaaccagctgttcagcaagcacggccactatgagagcaaggtgacccagaatgcccagaggcagtatgaccacaccatgggcctgagctgcttccgcatctgccactacgccggcaaggtgacctacaacgtgaccagcttcatcgacaagaacaatgacctgctcttccgggacctgctgcaggccatgtggaaggcccagcaccccctgctgcggagcctcttccctgagggcaaccccaagcaggccagcctgaagaggcctcccacagctggggcccagttcaagagctctgtggccatcctgatgaagaacctgtacagcaagagccccaactacatccgctgcatcaagcccaatgagcaccagcagaggggccagttcagcagtgacctggtggccacccaggcccgctacctgggcctgctggagaatgtgcgggtgagaagagctggctacgcccaccggcagggctacggccccttcctggagcgctaccgcctgctgagccgcagcacctggccccactggaatggaggagaccgggagggcgtggagaaggtgctgggggagctgtccatgagcagcggggagctggccttcggcaagaccaagatcttcatccgcagccccaagaccctcttctacctggaggagcagaggcggctgcggctgcagcagctggccaccctcatccagaagatctaccggggctggcgctgcaggacccactaccagctgatgaggaagagccagatcctgatcagctcctggttccggggcaacatgcagaagaagtgctacggcaagatcaaggcctctgtgctgctgatccaggcctttgtgcggggctggaaggccaggaagaactacaggaagtacttccgctctgaggccgccctgaccctggccgacttcatctacaagtccatggtgcagaagttcctgctgggcctgaagaacaacctgcccagcaccaacgtgctggacaagacctggccagctgccccctacaagtgcctgagcacagccaaccaggagctgcagcagctgttctaccagtggaagtgcaagcgcttccgggaccagctgagccccaagcaggtggagatcctgcgggagaagctgtgtgccagcgagctgttcaagggcaagaaggccagctacccccagagcgtgcccatccccttctgtggggactacatcggcctgcagggcaaccccaagctgcagaagctgaagggcggggaggagggccctgtgctgatggccgaggccgtgaagaaggtgaacagaggaaatggcaagaccagcagccgcatcctgctgctgaccaagggccacgtgatcctgacagacaccaagaagagccaggccaagatcgtgattggcctggacaacgtggccggcgtgtctgtgaccagcctgaaggatggcctcttcagcctgcacctgtctgagatgagctctgtgggcagcaagggggacttcctgctggtgtctgaacatgtgattgagctgctgaccaagatgtacagagctgtgctggatgccacccagaggcagctgactgtgacagtgacagagaagttctctgtgcgcttcaaggaaaattctgtggccgtgaaggtggtgcagggccctgctggaggagacaacagcaagctgcgctacaagaagaagggcagccactgcctggaggtgacagtgcagtag

SEQ ID NO: 160775 - DNA, 3411 bp, Artificial Sequence
  Description of Artificial Sequence: Synthetic coding sequence
atggccaagatggaggtgaagaccagcctgctggacaacatgattggagtgggggacatggtgctgctggagcccctgaatgaggagaccttcatcaacaacctgaagaagagatttgaccacagcgagatctacacctacatcggctctgtggtgatctctgtgaacccctaccgcagcctgcccatctacagccctgagaaggtggaggagtacagaaacagaaacttctatgagctgagcccccacatctttgccctgagtgatgaggcctaccgcagcctgcgggaccaggacaaggaccagtgcatcctgatcactggagagagcggggccggcaagacagaggccagcaagctggtgatgtcctatgtggccgctgtgtgtgggaaaggagctgaggtgaaccaggtgaaggagcagctgctgcagagcaaccctgtgctggaggcctttggaaatgccaagacagtgagaaatgacaacagcagcagatttgggaagtacatggacatcgagtttgacttcaagggggaccccctgggcggcgtcatcagcaactacctgctggagaagagccgggtggtgaagcagcccagaggagagaggaacttccacgtgttctaccagctgctgagcggggccagcgaggagctgctgaacaagctgaagctggagcgggacttcagccgctacaactacctgagcctggacagcgccaaggtgaatggagtggatgatgctgccaacttcagaacagtgagaaatgccatgcagatcgtgggcttcatggaccacgaggccgagagcgtgctggccgtggtggccgctgtgctgaagctgggcaacatcgagttcaagccagagagccgggtgaatggcctggatgagagcaagatcaaggacaagaatgagctgaaggagatctgtgagctgactggaattgaccagagcgtgctggagcgggccttctccttcagaacagtggaggccaagcaggagaaggtgtccaccaccctgaatgtggcccaggcctactatgccagagatgccctggccaagaacctgtacagccgcctcttctcctggctggtgaaccgcatcaatgaaagcatcaaggcccagaccaaggtgaggaagaaggtgatgggcgtgctggacatctacggctttgagatctttgaggacaacagctttgagcagttcatcatcaactactgcaatgagaagctgcagcagatcttcatcgagctgaccctgaaggaggagcaggaggagtacatccgggaggacatcgagtggacccacatcgactacttcaacaatgccatcatctgtgacctgattgagaacaacaccaacggcatcctggccatgctggatgaagaatgtctgcggcccggcaccgtgacagatgagaccttcctggagaagctgaaccaggtgtgtgccacccaccagcactttgagagcaggatgagcaagtgcagccgcttcctgaatgacaccagcctgccccacagctgcttccgcatccagcactacgccggcaaggtgctgtaccaggtggagggctttgtggacaagaacaatgacctgctgtacagagacctgagccaggccatgtggaaggccagccacgccctgatcaagagcctcttccctgagggcaacccagccaagatcaacctgaagaggcctcccacagctggcagccagttcaaggcctctgtggccaccctgatgaagaacctgcagaccaagaaccccaactacatccgctgcatcaagcccaatgacaagaaggccgcccacatcttcaatgaggccctggtgtgccaccagatccgctacctgggcctgctggagaatgtgcgggtgcggcgggccggctacgccttccggcaggcctatgagccctgcctggagcgctacaagatgctgtgcaagcagacctggccccactggaagggccctgcccggtctggagtggaggtgctcttcaatgagctggagatccctgtggaggagtacagctttggccgcagcaagatcttcatccggaaccccaggaccctcttcaagctggaggacctgaggaagcagaggctggaggacctggccaccctcatccagaagatctaccggggctggaagtgcaggacccacttcctgctgatgaagaagagccagatcgtgattgctgcctggtacagaagatatgcccagcagaagcgctaccagcagaccaagagcagcgccctggtgatccagagctacatccggggctggaaggccaggaagatcctgcgggagctgaagcaccagaagcgctgcaaggaggccgtgaccaccatcgccgcctactggcacggcacccaggcccggcgggagctgcggcggctgaaggaggaggccaggaacaagcacgccatcgctgtgatctgggcctactggctgggcagcaaggcccggcgggagctgaagaggctgaaggaggaggcccggaggaagcatgctgtggccgtcatctgggcctactggctgggcctgaaggtgcggcgggagtacaggaagttcttccgggccaatgccggcaagaagatctatgagttcaccctgcagagaattgtgcagaagtacttcctggagatgaagaacaagatgcccagcctgagccccatcgacaagaactggcccagccggccctacctgttcctggacagcacccacaaggagctgaagaggatcttccacctgtggcgctgcaagaagtacagagaccagttcacagaccagcagaagctgatctatgaggagaagctggaggccagcgagctgttcaaggacaagaaggccctgtaccccagctctgtgggccagcccttccagggcgcctacctggagatcaacaagaaccccaagtacaagaagctgaaggatgccatcgaggagaagatcatcatcgccgaggtggtgaacaagatcaacagagccaacgggaagagcaccagccgcatcttcctgctgaccaacaacaacctgctgctggccgaccagaagagcggccagatcaagtctgaggtgcccctggtggatgtgaccaaggtgtccatgagcagccagaatgatggcttctttgctgtgcacctgaaggagggcagcgaggccgccagcaagggggacttcctgttcagcagtgaccacctgattgagatggccaccaagctgtaccgcaccaccctgagccagaccaagcagaagctgaacatcgagatcagtgatgagttcctggtgcagttccggcaggacaaggtgtgtgtgaagttcatccagggcaaccagaagaatggatctgtgcccacctgcaagaggaagaacaaccggctgctggaggtggccgtgccctag

SEQ ID NO: 160776 - DNA, 3237 bp, Artificial Sequence
  Description of Artificial Sequence: Synthetic coding sequence
atggccaagatggaggtgaagaccagcctgctggacaacatgattggagtgggggacatggtgctgctggagcccctgaatgaggagaccttcatcaacaacctgaagaagagatttgaccacagcgagatctacacctacatcggctctgtggtgatctctgtgaacccctaccgcagcctgcccatctacagccctgagaaggtggaggagtacagaaacagaaacttctatgagctgagcccccacatctttgccctgagtgatgaggcctaccgcagcctgcgggaccaggacaaggaccagtgcatcctgatcactggagagagcggggccggcaagacagaggccagcaagctggtgatgtcctatgtggccgctgtgtgtgggaaaggagctgaggtgaaccaggtgaaggagcagctgctgcagagcaaccctgtgctggaggcctttggaaatgccaagacagtgagaaatgacaacagcagcagatttgggaagtacatggacatcgagtttgacttcaagggggaccccctgggcggcgtcatcagcaactacctgctggagaagagccgggtggtgaagcagcccagaggagagaggaacttccacgtgttctaccagctgctgagcggggccagcgaggagctgctgaacaagctgaagctggagcgggacttcagccgctacaactacctgagcctggacagcgccaaggtgaatggagtggatgatgctgccaacttcagaacagtgagaaatgccatgcagatcgtgggcttcatggaccacgaggccgagagcgtgctggccgtggtggccgctgtgctgaagctgggcaacatcgagttcaagccagagagccgggtgaatggcctggatgagagcaagatcaaggacaagaatgagctgaaggagatctgtgagctgactggaattgaccagagcgtgctggagcgggccttctccttcagaacagtggaggccaagcaggagaaggtgtccaccaccctgaatgtggcccaggcctactatgccagagatgccctggccaagaacctgtacagccgcctcttctcctggctggtgaaccgcatcaatgaaagcatcaaggcccagaccaaggtgaggaagaaggtgatgggcgtgctggacatctacggctttgagatctttgaggacaacagctttgagcagttcatcatcaactactgcaatgagaagctgcagcagatcttcatcgagctgaccctgaaggaggagcaggaggagtacatccgggaggacatcgagtggacccacatcgactacttcaacaatgccatcatctgtgacctgattgagaacaacaccaacggcatcctggccatgctggatgaagaatgtctgcggcccggcaccgtgacagatgagaccttcctggagaagctgaaccaggtgtgtgccacccaccagcactttgagagcaggatgagcaagtgcagccgcttcctgaatgacaccagcctgccccacagctgcttccgcatccagcactacgccggcaaggtgctgtaccaggtggagggctttgtggacaagaacaatgacctgctgtacagagacctgagccaggccatgtggaaggccagccacgccctgatcaagagcctcttccctgagggcaacccagccaagatcaacctgaagaggcctcccacagctggcagccagttcaaggcctctgtggccaccctgatgaagaacctgcagaccaagaaccccaactacatccgctgcatcaagcccaatgacaagaaggccgcccacatcttcaatgaggccctggtgtgccaccagatccgctacctgggcctgctggagaatgtgcgggtgcggcgggccggctacgccttccggcaggcctatgagccctgcctggagcgctacaagatgctgtgcaagcagacctggccccactggaagggccctgcccggtctggagtggaggtgctcttcaatgagctggagatccctgtggaggagtacagctttggccgcagcaagatcttcatccggaaccccaggaccctcttcaagctggaggacctgaggaagcagaggctggaggacctggccaccctcatccagaagatctaccggggctggaagtgcaggacccacttcctgctgatgaagaagagccagatcgtgattgctgcctggtacagaagatatgcccagcagaagcgctaccagcagaccaagagcagcgccctggtgatccagagctacatccggggctggaaggccaggaagatcctgcgggagctgaagcaccagaagcgctgcaaggaggccgtgaccaccatcgccgcctactggcacggcacccaggtgcggcgggagtacaggaagttcttccgggccaatgccggcaagaagatctatgagttcaccctgcagagaattgtgcagaagtacttcctggagatgaagaacaagatgcccagcctgagccccatcgacaagaactggcccagccggccctacctgttcctggacagcacccacaaggagctgaagaggatcttccacctgtggcgctgcaagaagtacagagaccagttcacagaccagcagaagctgatctatgaggagaagctggaggccagcgagctgttcaaggacaagaaggccctgtaccccagctctgtgggccagcccttccagggcgcctacctggagatcaacaagaaccccaagtacaagaagctgaaggatgccatcgaggagaagatcatcatcgccgaggtggtgaacaagatcaacagagccaacgggaagagcaccagccgcatcttcctgctgaccaacaacaacctgctgctggccgaccagaagagcggccagatcaagtctgaggtgcccctggtggatgtgaccaaggtgtccatgagcagccagaatgatggcttctttgctgtgcacctgaaggagggcagcgaggccgccagcaagggggacttcctgttcagcagtgaccacctgattgagatggccaccaagctgtaccgcaccaccctgagccagaccaagcagaagctgaacatcgagatcagtgatgagttcctggtgcagttccggcaggacaaggtgtgtgtgaagttcatccagggcaaccagaagaatggatctgtgcccacctgcaagaggaagaacaaccggctgctggaggtggccgtgccctag

SEQ ID NO: 160777 - DNA, 3324 bp, Artificial Sequence
  Description of Artificial Sequence: Synthetic coding sequence
atggccaagatggaggtgaagaccagcctgctggacaacatgattggagtgggggacatggtgctgctggagcccctgaatgaggagaccttcatcaacaacctgaagaagagatttgaccacagcgagatctacacctacatcggctctgtggtgatctctgtgaacccctaccgcagcctgcccatctacagccctgagaaggtggaggagtacagaaacagaaacttctatgagctgagcccccacatctttgccctgagtgatgaggcctaccgcagcctgcgggaccaggacaaggaccagtgcatcctgatcactggagagagcggggccggcaagacagaggccagcaagctggtgatgtcctatgtggccgctgtgtgtgggaaaggagctgaggtgaaccaggtgaaggagcagctgctgcagagcaaccctgtgctggaggcctttggaaatgccaagacagtgagaaatgacaacagcagcagatttgggaagtacatggacatcgagtttgacttcaagggggaccccctgggcggcgtcatcagcaactacctgctggagaagagccgggtggtgaagcagcccagaggagagaggaacttccacgtgttctaccagctgctgagcggggccagcgaggagctgctgaacaagctgaagctggagcgggacttcagccgctacaactacctgagcctggacagcgccaaggtgaatggagtggatgatgctgccaacttcagaacagtgagaaatgccatgcagatcgtgggcttcatggaccacgaggccgagagcgtgctggccgtggtggccgctgtgctgaagctgggcaacatcgagttcaagccagagagccgggtgaatggcctggatgagagcaagatcaaggacaagaatgagctgaaggagatctgtgagctgactggaattgaccagagcgtgctggagcgggccttctccttcagaacagtggaggccaagcaggagaaggtgtccaccaccctgaatgtggcccaggcctactatgccagagatgccctggccaagaacctgtacagccgcctcttctcctggctggtgaaccgcatcaatgaaagcatcaaggcccagaccaaggtgaggaagaaggtgatgggcgtgctggacatctacggctttgagatctttgaggacaacagctttgagcagttcatcatcaactactgcaatgagaagctgcagcagatcttcatcgagctgaccctgaaggaggagcaggaggagtacatccgggaggacatcgagtggacccacatcgactacttcaacaatgccatcatctgtgacctgattgagaacaacaccaacggcatcctggccatgctggatgaagaatgtctgcggcccggcaccgtgacagatgagaccttcctggagaagctgaaccaggtgtgtgccacccaccagcactttgagagcaggatgagcaagtgcagccgcttcctgaatgacaccagcctgccccacagctgcttccgcatccagcactacgccggcaaggtgctgtaccaggtggagggctttgtggacaagaacaatgacctgctgtacagagacctgagccaggccatgtggaaggccagccacgccctgatcaagagcctcttccctgagggcaacccagccaagatcaacctgaagaggcctcccacagctggcagccagttcaaggcctctgtggccaccctgatgaagaacctgcagaccaagaaccccaactacatccgctgcatcaagcccaatgacaagaaggccgcccacatcttcaatgaggccctggtgtgccaccagatccgctacctgggcctgctggagaatgtgcgggtgcggcgggccggctacgccttccggcaggcctatgagccctgcctggagcgctacaagatgctgtgcaagcagacctggccccactggaagggccctgcccggtctggagtggaggtgctcttcaatgagctggagatccctgtggaggagtacagctttggccgcagcaagatcttcatccggaaccccaggaccctcttcaagctggaggacctgaggaagcagaggctggaggacctggccaccctcatccagaagatctaccggggctggaagtgcaggacccacttcctgctgatgaagaagagccagatcgtgattgctgcctggtacagaagatatgcccagcagaagcgctaccagcagaccaagagcagcgccctggtgatccagagctacatccggggctggaaggccaggaagatcctgcgggagctgaagcaccagaagcgctgcaaggaggccgtgaccaccatcgccgcctactggcacggcacccaggcccggcgggagctgaagaggctgaaggaggaggcccggaggaagcatgctgtggccgtcatctgggcctactggctgggcctgaaggtgagaagagagtacaggaagttcttccgggccaatgctgggaagaagatctatgagttcaccctgcagagaattgtgcagaagtacttcctggagatgaagaacaagatgcccagcctgagccccatcgacaagaactggcccagccggccctacctgttcctggacagcacccacaaggagctgaagaggatcttccacctgtggcgctgcaagaagtacagagaccagttcacagaccagcagaagctgatctatgaggagaagctggaggccagcgagctgttcaaggacaagaaggccctgtaccccagctctgtgggccagcccttccagggcgcctacctggagatcaacaagaaccccaagtacaagaagctgaaggatgccatcgaggagaagatcatcatcgccgaggtggtgaacaagatcaacagagccaacgggaagagcaccagccgcatcttcctgctgaccaacaacaacctgctgctggccgaccagaagagcggccagatcaagtctgaggtgcccctggtggatgtgaccaaggtgtccatgagcagccagaatgatggcttctttgctgtgcacctgaaggagggcagcgaggccgccagcaaaggagacttcctgttcagcagtgaccacctgattgagatggccaccaagctgtaccgcaccaccctgagccagaccaagcagaagctgaacatcgagatcagtgatgagttcctggtgcagttccggcaggacaaggtgtgtgtgaagttcatccagggcaaccagaagaatggatctgtgcccacctgcaagaggaagaacaaccggctgctggaggtggccgtgccctag

SEQ ID NO: 160778 - DNA, 3411 bp, Artificial Sequence; identical to SEQ ID NO: 160775
  Description of Artificial Sequence: Synthetic coding sequence

SEQ ID NO: 160779 - DNA, 492 bp, Artificial Sequence
  Description of Artificial Sequence: Synthetic coding sequence
atggccaagatggaggtgaagaccagcctgctggacaacatgattggagtgggggacatggtgctgctggagcccctgaatgaggagaccttcatcaacaacctgaagaagagatttgaccacagcgagatctacacctacatcggctctgtggtgatctctgtgaacccctaccgcagcctgcccatctacagccctgagaaggtggaggagtacagaaacagaaacttctatgagctgagcccccacatctttgccctgagtgatgaggcctaccgcagcctgcgggaccaggacaaggaccagtgcatcctgatcactggagagagcggggccggcaagacagaggccagcaagctggtgatgtcctatgtggccgctgtgtgtgggaaaggagctgaggtgaaccaggtgaaggagcagctgctgcagagcaaccctgtgctggaggcctttggaaatgccaagacagtgagaaatgacaacagctag

SEQ ID NO: 160780 - DNA, 252 bp, Artificial Sequence
  Description of Artificial Sequence: Synthetic coding sequence
atggccaagatggaggtgaagaccagcctgctggacaacatgattggagtgggggacatggtgctgctggagcccctgaatgaggagaccttcatcaacaacctgaagaagagatttgaccacagcgagatctacacctacatcggctctgtggtgatctctgtgaacccctaccgcagcctgcccatctacagccctgagaaggtggaggagtacagaaacagaaacttctatgagctgagcccccactag

SEQ ID NO: 160781 - DNA, 450 bp, Artificial Sequence
  Description of Artificial Sequence: Synthetic coding sequence
atggccaagatggaggtgaagaccagcctgctggacaacatgattggagtgggggacatggtgctgctggagcccctgaatgaggagaccttcatcaacaacctgaagaagagatttgaccacagcgagatctacacctacatcggctctgtggtgatctctgtgaacccctaccgcagcctgcccatctacagccctgagaaggtggaggagtacagaaacagaaacttctatgagctgagcccccacatctttgccctgagtgatgaggcctaccgcagcctgcgggaccaggacaaggaccagtgcatcctgatcactggagagagcggggccggcaagacagaggccagcaagctggtgatgtcctatgtggccgctgtgtgtgggaaaggagctgaggtgaaccaggtgaaggagcagctgctgcagagcaaccctgtgctgtag

SEQ ID NO: 160782 - DNA, 1146 bp, Artificial Sequence
  Description of Artificial Sequence: Synthetic coding sequence
atgaagaagagccagatcgtgattgctgcctggtacagaagatatgcccagcagaagcgctaccagcagaccaagagcagcgccctggtgatccagagctacatccggggctggaaggccaggaagatcctgcgggagctgaagcaccagaagcgctgcaaggaggccgtgaccaccatcgccgcctactggcacggcacccaggcccggcgggagctgaagaggctgaaggaggaggcccggaggaagcatgctgtggccgtcatctgggcctactggctgggcctgaaggtgagaagagagtacaggaagttcttccgggccaatgctgggaagaagatctatgagttcaccctgcagagaattgtgcagaagtacttcctggagatgaagaacaagatgcccagcctgagccccatcgacaagaactggcccagccggccctacctgttcctggacagcacccacaaggagctgaagaggatcttccacctgtggcgctgcaagaagtacagagaccagttcacagaccagcagaagctgatctatgaggagaagctggaggccagcgagctgttcaaggacaagaaggccctgtaccccagctctgtgggccagcccttccagggcgcctacctggagatcaacaagaaccccaagtacaagaagctgaaggatgccatcgaggagaagatcatcatcgccgaggtggtgaacaagatcaacagagccaacgggaagagcaccagccgcatcttcctgctgaccaacaacaacctgctgctggccgaccagaagagcggccagatcaagtctgaggtgcccctggtggatgtgaccaaggtgtccatgagcagccagaatgatggcttctttgctgtgcacctgaaggagggcagcgaggccgccagcaaaggagacttcctgttcagcagtgaccacctgattgagatggccaccaagctgtaccgcaccaccctgagccagaccaagcagaagctgaacatcgagatcagtgatgagttcctggtgcagttccggcaggacaaggtgtgtgtgaagttcatccagggcaaccagaagaatggatctgtgcccacctgcaagaggaagaacaaccggctgctggaggtggccgtgccctag

SEQ ID NO: 160783 - DNA, 924 bp, Artificial Sequence
  Description of Artificial Sequence: Synthetic coding sequence
atggccaagatggaggtgaagaccagcctgctggacaacatgattggagtgggggacatggtgctgctggagcccctgaatgaggagaccttcatcaacaacctgaagaagagatttgaccacagcgagatctacacctacatcggctctgtggtgatctctgtgaacccctaccgcagcctgcccatctacagccctgagaaggtggaggagtacagaaacagaaacttctatgagctgagcccccacatctttgccctgagtgatgaggcctaccgcagcctgcgggaccaggacaaggaccagtgcatcctgatcactggagagagcggggccggcaagacagaggccagcaagctggtgatgtcctatgtggccgctgtgtgtgggaaaggagctgaggtgaaccaggtgaaggagcagctgctgcagagcaaccctgtgctggaggcctttggaaatgccaagacagtgagaaatgacaacagcagcagatttgggaagtacatggacatcgagtttgacttcaagggggaccccctgggcggcgtcatcagcaactacctgctggagaagagccgggtggtgaagcagcccagaggagagaggaacttccacgtgttctaccagctgctgagcggggccagcgaggagctgctgaacaagctgaagctggagcgggacttcagccgctacaactacctgagcctggacagcgccaaggtgaatggagtggatgatgctgccaacttcagaacagtgagaaatgccatgcagatcgtgggcttcatggaccacgaggccgagagcgtgctggccgtggtggccgctgtgctgaagctgggcaacatcgagttcaagccagagagccgggtgaatggcctggatgagagcaagatcaaggacaagaatgaaagcaagtag

SEQ ID NO: 160784 - DNA, 912 bp, Artificial Sequence
  Description of Artificial Sequence: Synthetic coding sequence
atggccaagatggaggtgaagaccagcctgctggacaacatgattggagtgggggacatggtgctgctggagcccctgaatgaggagaccttcatcaacaacctgaagaagagatttgaccacagcgagatctacacctacatcggctctgtggtgatctctgtgaacccctaccgcagcctgcccatctacagccctgagaaggtggaggagtacagaaacagaaacttctatgagctgagcccccacatctttgccctgagtgatgaggcctaccgcagcctgcgggaccaggacaaggaccagtgcatcctgatcactggagagagcggggccggcaagacagaggccagcaagctggtgatgtcctatgtggccgctgtgtgtgggaaaggagctgaggtgaaccaggtgaaggagcagctgctgcagagcaaccctgtgctggaggcctttggaaatgccaagacagtgagaaatgacaacagcagcagatttgggaagtacatggacatcgagtttgacttcaagggggaccccctgggcggcgtcatcagcaactacctgctggagaagagccgggtggtgaagcagcccagaggagagaggaacttccacgtgttctaccagctgctgagcggggccagcgaggagctgctgaacaagctgaagctggagcgggacttcagccgctacaactacctgagcctggacagcgccaaggtgaatggagtggatgatgctgccaacttcagaacagtgagaaatgccatgcagatcgtgggcttcatggaccacgaggccgagagcgtgctggccgtggtggccgctgtgctgaagctgggcaacatcgagttcaagccagagagccgggtgaatggcctggatgagagcaagatcaaggacaagtag

SEQ ID NO: 160785 - DNA, 3192 bp, Artificial Sequence
  Description of Artificial Sequence: Synthetic coding sequence
atggccctgcaggtggagctggtgcccaccggggagatcatccgggtggtgcacccccaccggccctgcaagctggccctgggcagtgatggagtgcgggtgaccatggagagcgccctgacagcccgggacagagtgggcgtgcaggactttgtgctgctggagaacttcaccagcgaggccgccttcatcgagaacctgcggcggcgcttcagagaaaatctcatctacacctacatcggccctgtgctggtgtctgtgaacccctacagagacctgcagatctacagccggcagcacatggagcgctaccggggcgtgtccttctatgaggtgcccccccacctgtttgctgtggccgacacagtgtaccgggccctgaggacagaaagaagagaccaggccgtgatgatctctggagagagcggggccggcaagacagaggccaccaagaggctgctgcagttctacgccgagacctgcccagcccctgagcggggcggcgctgtgcgggaccggctgctgcagagcaaccctgtgctggaggcctttggaaatgccaagaccctgagaaatgacaacagcagcagatttgggaagtacatggatgtgcagtttgacttcaagggggcccctgtgggcggccacatcctgagctacctgctggagaagagccgggtggtgcaccagaaccacggggagaggaacttccacatcttctaccagctgctggagggcggggaggaggagaccctgcggcggctgggcctggagaggaacccccagagctacctgtacctggtgaagggccagtgtgccaaggtgagcagcatcaatgacaagagtgactggaaggtggtgaggaaggccctgaccgtcatcgacttcacagaagatgaggtggaggacctgctgagcatcgtggcctctgtgctgcacctgggcaacatccactttgctgccaatgaggagagcaatgcccaggtgaccacagagaaccagctgaagtacctgacccggctgctgtctgtggagggcagcaccctgcgggaggccctgacccacaggaagatcatcgccaagggggaggagctgctgagccccctgaacctggagcaggccgcctatgccagagatgccctggccaaggctgtgtacagcaggaccttcacctggctggtgggcaagatcaacagaagcctggccagcaaggatgtggagagccccagctggaggagcaccaccgtgctgggcctgctggacatctacggctttgaggtgttccagcacaacagctttgagcagttctgcatcaactactgcaatgagaagctgcagcagctgttcatcgagctgaccctgaagtctgagcaggaggagtatgaagctgagggcatcgcctgggagcctgtgcagtacttcaacaacaagatcatctgtgacctggtggaggagaagttcaagggcatcatcagcatcctggatgaagaatgtctgcggcctggagaggccacagacctgaccttcctggagaagctggaggacacagtgaagcaccacccccacttcctgacccacaagctggccgaccagaggaccaggaagagcctgggccgcggggagttccggctgctgcactacgccggggaggtgacctacagcgtgacaggcttcctggacaagaacaatgacctgctcttcaggaacctgaaggagaccatgtgcagcagcaagaaccccatcatgagccagtgctttgacagaagtgagctgagtgacaagaagaggcctgagaccgtggccacccagttcaagatgagcctgctgcagctggtggagatcctgcagagcaaggagcccgcctacgtgcgctgcatcaagcccaatgatgccaagcagcccggccgctttgatgaggtgctgatccgccaccaggtgaagtacctgggcctgctggagaacctgcgggtgcggcgggccggctttgcctacagaagaaaatatgaggccttcctgcagcgctacaagagcctgtgcccagagacctggcccacctgggccggccggccccaggatggagtggccgtgctggtgcgccacctgggctacaagccagaggagtacaagatgggccgcaccaagatcttcatccgcttccccaagaccctgtttgccacagaagatgccctggaggtgcggcggcagagcctggccaccaagatccaggccgcctggaggggcttccactggaggcagaagttcctgcgggtgaagaggtctgccatctgcatccagagctggtggaggggcaccctgggccgcaggaaggccgccaagaggaagtgggccgcccagaccatccggcggctcatccggggctttgtgctgcggcatgccccccgctgcccagaaaatgccttcttcctggaccacgtgaggaccagcttcctgctgaacctgcggcggcagctgccccagaatgtgctggacacctcctggcccaccccacctccagccctgcgggaggccagcgagctgctgcgggagctgtgcatcaagaacatggtgtggaagtactgccgcagcatcagccctgagtggaagcagcagctgcagcagaaggctgtggccagcgagatcttcaagggcaagaaggacaactacccccagagcgtgcccaggctcttcatcagcacccggctgggcacagatgagatcagcccccgggtgctgcaggccctgggcagcgagcccatccagtatgctgtgcctgtggtgaagtatgacaggaagggctacaagcccaggagccggcagctgctgctgaccccaaatgctgtggtgattgtggaggatgccaaggtgaagcagagaattgattatgccaacctgaccggcatctctgtgagcagcctgagtgacagcctgtttgtgctgcacgtgcagagagctgacaacaagcagaagggagatgtggtgctgcagagcgaccacgtgattgagaccctgaccaagacagccctgagcgccaacagagtgaacagcatcaacatcaaccagggcagcatcacctttgctgggggccctggaagagatggcaccatcgacttcaccccaggcagcgagctgctgatcaccaaggccaagaatggccacctggccgtggtggccccccggctgaacagcaggtag

SEQ ID NO: 160786 - DNA, 3087 bp, Artificial Sequence
  Description of Artificial Sequence: Synthetic coding sequence
atggagagcgccctgacagcccgggacagagtgggcgtgcaggactttgtgctgctggagaacttcaccagcgaggccgccttcatcgagaacctgcggcggcgcttccgggagaacctgatctacacctacatcggccctgtgctggtgtctgtgaacccctacagagacctgcagatctacagccggcagcacatggagcgctacagaggagtgtccttctatgaggtgcccccccacctgtttgctgtggccgacacagtgtaccgggccctgaggacagagcggcgggaccaggccgtgatgatcagcggggagagcggggccggcaagacagaggccaccaagaggctgctgcagttctatgcagagacctgcccagcccctgagcggggcggcgctgtgcgggaccggctgctgcagagcaaccctgtgctggaggcctttggaaatgccaagaccctgagaaatgacaacagcagcagatttgggaagtacatggatgtgcagtttgacttcaagggggcccctgtgggcggccacatcctgagctacctgctggagaagagccgggtggtgcaccagaaccacggggagaggaacttccacatcttctaccagctgctggagggcggggaggaggagaccctgcggcggctgggcctggagaggaacccccagagctacctgtacctggtgaagggccagtgtgccaaggtgagcagcatcaatgacaagagtgactggaaggtggtgaggaaggccctgactgtgattgacttcacagaagatgaggtggaggacctgctgagcatcgtggcctctgtgctgcacctgggcaacatccactttgctgccaatgaggagagcaatgcccaggtgaccacagagaaccagctgaagtacctgacccggctgctgtctgtggagggcagcaccctgcgggaggccctgacccacaggaagatcatcgccaagggggaggagctgctgagccccctgaacctggagcaggccgcctatgccagagatgccctggccaaggctgtgtacagcaggaccttcacctggctggtgggcaagatcaacagaagcctggccagcaaggatgtggagagccccagctggaggagcaccaccgtgctgggcctgctggacatctacggctttgaggtgttccagcacaacagctttgagcagttctgcatcaactactgcaatgagaagctgcagcagctgttcatcgagctgaccctgaagtctgagcaggaggagtatgaggccgagggcatcgcctgggagcctgtgcagtacttcaacaacaagatcatctgtgacctggtggaggagaagttcaagggcatcatcagcatcctggatgaggagtgcctgcggcctggagaggccacagacctgaccttcctggagaagctggaggacacagtgaagcaccacccccacttcctgacccacaagctggccgaccagaggaccaggaagagcctgggccgcggggagttccggctgctgcactacgccggggaggtgacctacagcgtgacaggcttcctggacaagaacaatgacctgctcttcaggaacctgaaggagaccatgtgcagcagcaagaaccccatcatgagccagtgctttgacagaagtgagctgagtgacaagaagaggcctgagaccgtggccacccagttcaagatgagcctgctgcagctggtggagatcctgcagagcaaggagcccgcctacgtgcgctgcatcaagcccaatgatgccaagcagcccggccgctttgatgaggtgctgatccgccaccaggtgaagtacctgggcctgctggagaacctgcgggtgagaagagctggctttgcctacagaagaaaatatgaggccttcctgcagcgctacaagagcctgtgcccagagacctggcccacctgggccggccggccccaggatggagtggccgtgctggtgcgccacctgggctacaagccagaggagtacaagatgggccgcaccaagatcttcatccgcttccccaagaccctgtttgccacagaagatgccctggaggtgcggcggcagagcctggccaccaagatccaggccgcctggaggggcttccactggaggcagaagttcctgcgggtgaagaggtctgccatctgcatccagagctggtggaggggcaccctgggccgcaggaaggccgccaagaggaagtgggccgcccagaccatcagaagactcatccggggctttgtgctgcggcatgccccccgctgcccagaaaatgccttcttcctggaccacgtgaggaccagcttcctgctgaacctgcggcggcagctgccccagaatgtgctggacacctcctggcccaccccacctccagccctgcgggaggccagcgagctgctgcgggagctgtgcatcaagaacatggtgtggaagtactgccgcagcatcagccctgagtggaagcagcagctgcagcagaaggctgtggccagcgagatcttcaagggcaagaaggacaactacccccagagcgtgcccaggctcttcatcagcacccggctgggcacagatgagatcagcccccgggtgctgcaggccctgggcagcgagcccatccagtatgctgtgcctgtggtgaagtatgacaggaagggctacaagcccaggagccggcagctgctgctgaccccaaatgctgtggtgattgtggaggatgccaaggtgaagcagagaattgattatgccaacctgaccggcatctctgtgagcagcctgagtgacagcctgtttgtgctgcacgtgcagagagctgacaacaagcagaagggagatgtggtgctgcagagcgaccacgtgattgagaccctgaccaagacagccctgagcgccaacagagtgaacagcatcaacatcaaccagggcagcatcacctttgctgggggccctggaagagatggcaccatcgacttcaccccaggcagcgagctgctgatcaccaaggccaagaatggccacctggccgtggtggccccccggctgaacagcaggtag

SEQ ID NO: 160787 - DNA, 3135 bp, Artificial Sequence
  Description of Artificial Sequence: Synthetic coding sequence
atgagataccgggccagcgccctgggcagtgatggagtgcgggtgaccatggagagcgccctgacagcccgggacagagtgggcgtgcaggactttgtgctgctggagaacttcaccagcgaggccgccttcatcgagaacctgcggcggcgcttccgggagaacctgatctacacctacatcggccctgtgctggtgtctgtgaacccctacagagacctgcagatctacagccggcagcacatggagcgctacagaggagtgtccttctatgaggtgcccccccacctgtttgctgtggccgacacagtgtaccgggccctgaggacagagcggcgggaccaggccgtgatgatcagcggggagagcggggccggcaagacagaggccaccaagaggctgctgcagttctatgcagagacctgcccagcccctgagcggggcggcgctgtgcgggaccggctgctgcagagcaaccctgtgctggaggcctttggaaatgccaagaccctgagaaatgacaacagcagcagatttgggaagtacatggatgtgcagtttgacttcaagggggcccctgtgggcggccacatcctgagctacctgctggagaagagccgggtggtgcaccagaaccacggggagaggaacttccacatcttctaccagctgctggagggcggggaggaggagaccctgcggcggctgggcctggagaggaacccccagagctacctgtacctggtgaagggccagtgtgccaaggtgagcagcatcaatgacaagagtgactggaaggtggtgaggaaggccctgactgtgattgacttcacagaagatgaggtggaggacctgctgagcatcgtggcctctgtgctgcacctgggcaacatccactttgctgccaatgaggagagcaatgcccaggtgaccacagagaaccagctgaagtacctgacccggctgctgtctgtggagggcagcaccctgcgggaggccctgacccacaggaagatcatcgccaagggggaggagctgctgagccccctgaacctggagcaggccgcctatgccagagatgccctggccaaggctgtgtacagcaggaccttcacctggctggtgggcaagatcaacagaagcctggccagcaaggatgtggagagccccagctggaggagcaccaccgtgctgggcctgctggacatctacggctttgaggtgttccagcacaacagctttgagcagttctgcatcaactactgcaatgagaagctgcagcagctgttcatcgagctgaccctgaagtctgagcaggaggagtatgaggccgagggcatcgcctgggagcctgtgcagtacttcaacaacaagatcatctgtgacctggtggaggagaagttcaagggcatcatcagcatcctggatgaggagtgcctgcggcctggagaggccacagacctgaccttcctggagaagctggaggacacagtgaagcaccacccccacttcctgacccacaagctggccgaccagaggaccaggaagagcctgggccgcggggagttccggctgctgcactacgccggggaggtgacctacagcgtgacaggcttcctggacaagaacaatgacctgctcttcaggaacctgaaggagaccatgtgcagcagcaagaaccccatcatgagccagtgctttgacagaagtgagctgagtgacaagaagaggcctgagaccgtggccacccagttcaagatgagcctgctgcagctggtggagatcctgcagagcaaggagcccgcctacgtgcgctgcatcaagcccaatgatgccaagcagcccggccgctttgatgaggtgctgatccgccaccaggtgaagtacctgggcctgctggagaacctgcgggtgagaagagctggctttgcctacagaagaaaatatgaggccttcctgcagcgctacaagagcctgtgcccagagacctggcccacctgggccggccggccccaggatggagtggccgtgctggtgcgccacctgggctacaagccagaggagtacaagatgggccgcaccaagatcttcatccgcttccccaagaccctgtttgccacagaagatgccctggaggtgcggcggcagagcctggccaccaagatccaggccgcctggaggggcttccactggaggcagaagttcctgcgggtgaagaggtctgccatctgcatccagagctggtggaggggcaccctgggccgcaggaaggccgccaagaggaagtgggccgcccagaccatcagaagactcatccggggctttgtgctgcggcatgccccccgctgcccagaaaatgccttcttcctggaccacgtgaggaccagcttcctgctgaacctgcggcggcagctgccccagaatgtgctggacacctcctggcccaccccacctccagccctgcgggaggccagcgagctgctgcgggagctgtgcatcaagaacatggtgtggaagtactgccgcagcatcagccctgagtggaagcagcagctgcagcagaaggctgtggccagcgagatcttcaagggcaagaaggacaactacccccagagcgtgcccaggctcttcatcagcacccggctgggcacagatgagatcagcccccgggtgctgcaggccctgggcagcgagcccatccagtatgctgtgcctgtggtgaagtatgacaggaagggctacaagcccaggagccggcagctgctgctgaccccaaatgctgtggtgattgtggaggatgccaaggtgaagcagagaattgattatgccaacctgaccggcatctctgtgagcagcctgagtgacagcctgtttgtgctgcacgtgcagagagctgacaacaagcagaagggagatgtggtgctgcagagcgaccacgtgattgagaccctgaccaagacagccctgagcgccaacagagtgaacagcatcaacatcaaccagggcagcatcacctttgctgggggccctggaagagatggcaccatcgacttcaccccaggcagcgagctgctgatcaccaaggccaagaatggccacctggccgtggtggccccccggctgaacagcaggtag

SEQ ID NO: 160788 - DNA, 2418 bp, Artificial Sequence
  Description of Artificial Sequence: Synthetic coding sequence
atggagagcgccctgacagcccgggacagagtgggcgtgcaggactttgtgctgctggagaacttcaccagcgaggccgccttcatcgagaacctgcggcggcgcttccgggagaacctgatctacacctacatcggccctgtgctggtgtctgtgaacccctacagagacctgcagatctacagccggcagcacatggagcgctacagaggagtgtccttctatgaggtgcccccccacctgtttgctgtggccgacacagtgtaccgggccctgaggacagagcggcgggaccaggccgtgatgatcagcggggagagcggggccggcaagacagaggccaccaagaggctgctgcagttctatgcagagacctgcccagcccctgagcggggcggcgctgtgcgggaccggctgctgcagagcaaccctgtgctggaggcctttggaaatgccaagaccctgagaaatgacaacagcagcagatttgggaagtacatggatgtgcagtttgacttcaagggggcccctgtgggcggccacatcctgagctacctgctggagaagagccgggtggtgcaccagaaccacggggagaggaacttccacatcttctaccagctgctggagggcggggaggaggagaccctgcggcggctgggcctggagaggaacccccagagctacctgtacctggtgaagggccagtgtgccaaggtgagcagcatcaatgacaagagtgactggaaggtggtgaggaaggccctgactgtgattgacttcacagaagatgaggtggaggacctgctgagcatcgtggcctctgtgctgcacctgggcaacatccactttgctgccaatgaggagagcaatgcccaggtgaccacagagaaccagctgaagtacctgacccggctgctgtctgtggagggcagcaccctgcgggaggccctgacccacaggaagatcatcgccaagggggaggagctgctgagccccctgaacctggagcaggccgcctatgccagagatgccctggccaaggctgtgtacagcaggaccttcacctggctggtgggcaagatcaacagaagcctggccagcaaggatgtggagagccccagctggaggagcaccaccgtgctgggcctgctggacatctacggctttgaggtgttccagcacaacagctttgagcagttctgcatcaactactgcaatgagaagctgcagcagctgttcatcgagctgaccctgaagtctgagcaggaggagtatgaggccgagggcatcgcctgggagcctgtgcagtacttcaacaacaagatcatctgtgacctggtggaggagaagttcaagggcatcatcagcatcctggatgaggagtgcctgcggcctggagaggccacagacctgaccttcctggagaagctggaggacacagtgaagcaccacccccacttcctgacccacaagctggccgaccagaggaccaggaagagcctgggccgcggggagttccggctgctgcactacgccggggaggtgacctacagcgtgacaggcttcctggacaagaacaatgacctgctcttcaggaacctgaaggagaccatgtgcagcagcaagaaccccatcatgagccagtgctttgacagaagtgagctgagtgacaagaagaggcctgagaccgtggccacccagttcaagatgagcctgctgcagctggtggagatcctgcagagcaaggagcccgcctacgtgcgctgcatcaagcccaatgatgccaagcagcccggccgctttgatgaggtgctgatccgccaccaggtgaagtacctgggcctgctggagaacctgcgggtgagaagagctggctttgcctacagaagaaaatatgaggccttcctgcagcgctacaagagcctgtgcccagagacctggcccacctgggccggccggccccaggatggagtggccgtgctggtgcgccacctgggctacaagccagaggagtacaagatgggccgcaccaagatcttcatccgcttccccaagaccctgtttgccacagaagatgccctggaggtgcggcggcagagcctggccaccaagatccaggccgcctggaggggcttccactggaggcagaagttcctgcgggtgaagaggtctgccatctgcatccagagctggtggaggggcaccctgggccgcaggaaggccgccaaggaggtgggcggcacagaccaccctgctgcccacccccggctgcggcctgccccccggccccccctgccccgggagcggctgctgcccggcccctgtgcccacctgttctttgccaagccagaggccgccgccgccccagaatgtcctggccacctggtggcccacgcccccacctgcccagcctag

SEQ ID NO: 160789 - DNA, 3135 bp, Artificial Sequence
  Description of Artificial Sequence: Synthetic coding sequence
atgaggggccgggccagcgccctgggcagtgatggagtgcgggtgaccatggagagcgccctgacagcccgggacagagtgggcgtgcaggactttgtgctgctggagaacttcaccagcgaggccgccttcatcgagaacctgcggcggcgcttccgggagaacctgatctacacctacatcggccctgtgctggtgtctgtgaacccctacagagacctgcagatctacagccggcagcacatggagcgctacagaggagtgtccttctatgaggtgcccccccacctgtttgctgtggccgacacagtgtaccgggccctgaggacagagcggcgggaccaggccgtgatgatcagcggggagagcggggccggcaagacagaggccaccaagaggctgctgcagttctatgcagagacctgcccagcccctgagcggggcggcgctgtgcgggaccggctgctgcagagcaaccctgtgctggaggcctttggaaatgccaagaccctgagaaatgacaacagcagcagatttgggaagtacatggatgtgcagtttgacttcaagggggcccctgtgggcggccacatcctgagctacctgctggagaagagccgggtggtgcaccagaaccacggggagaggaacttccacatcttctaccagctgctggagggcggggaggaggagaccctgcggcggctgggcctggagaggaacccccagagctacctgtacctggtgaagggccagtgtgccaaggtgagcagcatcaatgacaagagtgactggaaggtggtgaggaaggccctgactgtgattgacttcacagaagatgaggtggaggacctgctgagcatcgtggcctctgtgctgcacctgggcaacatccactttgctgccaatgaggagagcaatgcccaggtgaccacagagaaccagctgaagtacctgacccggctgctgtctgtggagggcagcaccctgcgggaggccctgacccacaggaagatcatcgccaagggggaggagctgctgagccccctgaacctggagcaggccgcctatgccagagatgccctggccaaggctgtgtacagcaggaccttcacctggctggtgggcaagatcaacagaagcctggccagcaaggatgtggagagccccagctggaggagcaccaccgtgctgggcctgctggacatctacggctttgaggtgttccagcacaacagctttgagcagttctgcatcaactactgcaatgagaagctgcagcagctgttcatcgagctgaccctgaagtctgagcaggaggagtatgaggccgagggcatcgcctgggagcctgtgcagtacttcaacaacaagatcatctgtgacctggtggaggagaagttcaagggcatcatcagcatcctggatgaggagtgcctgcggcctggagaggccacagacctgaccttcctggagaagctggaggacacagtgaagcaccacccccacttcctgacccacaagctggccgaccagaggaccaggaagagcctgggccgcggggagttccggctgctgcactacgccggggaggtgacctacagcgtgacaggcttcctggacaagaacaatgacctgctcttcaggaacctgaaggagaccatgtgcagcagcaagaaccccatcatgagccagtgctttgacagaagtgagctgagtgacaagaagaggcctgagaccgtggccacccagttcaagatgagcctgctgcagctggtggagatcctgcagagcaaggagcccgcctacgtgcgctgcatcaagcccaatgatgccaagcagcccggccgctttgatgaggtgctgatccgccaccaggtgaagtacctgggcctgctggagaacctgcgggtgagaagagctggctttgcctacagaagaaaatatgaggccttcctgcagcgctacaagagcctgtgcccagagacctggcccacctgggccggccggccccaggatggagtggccgtgctggtgcgccacctgggctacaagccagaggagtacaagatgggccgcaccaagatcttcatccgcttccccaagaccctgtttgccacagaagatgccctggaggtgcggcggcagagcctggccaccaagatccaggccgcctggaggggcttccactggaggcagaagttcctgcgggtgaagaggtctgccatctgcatccagagctggtggaggggcaccctgggccgcaggaaggccgccaagaggaagtgggccgcccagaccatcagaagactcatccggggctttgtgctgcggcatgccccccgctgcccagaaaatgccttcttcctggaccacgtgaggaccagcttcctgctgaacctgcggcggcagctgccccagaatgtgctggacacctcctggcccaccccacctccagccctgcgggaggccagcgagctgctgcgggagctgtgcatcaagaacatggtgtggaagtactgccgcagcatcagccctgagtggaagcagcagctgcagcagaaggctgtggccagcgagatcttcaagggcaagaaggacaactacccccagagcgtgcccaggctcttcatcagcacccggctgggcacagatgagatcagcccccgggtgctgcaggccctgggcagcgagcccatccagtatgctgtgcctgtggtgaagtatgacaggaagggctacaagcccaggagccggcagctgctgctgaccccaaatgctgtggtgattgtggaggatgccaaggtgaagcagagaattgattatgccaacctgaccggcatctctgtgagcagcctgagtgacagcctgtttgtgctgcacgtgcagagagctgacaacaagcagaagggagatgtggtgctgcagagcgaccacgtgattgagaccctgaccaagacagccctgagcgccaacagagtgaacagcatcaacatcaaccagggcagcatcacctttgctgggggccctggaagagatggcaccatcgacttcaccccaggcagcgagctgctgatcaccaaggccaagaatggccacctggccgtggtggccccccggctgaacagcaggtag

SEQ ID NO: 160790 - DNA, 3120 bp, Artificial Sequence
  Description of Artificial Sequence: Synthetic coding sequence
atggccctgggcagtgatggagtgcgggtgaccatggagagcgccctgacagcccgggacagagtgggcgtgcaggactttgtgctgctggagaacttcaccagcgaggccgccttcatcgagaacctgcggcggcgcttcagagaaaatctcatctacacctacatcggccctgtgctggtgtctgtgaacccctacagagacctgcagatctacagccggcagcacatggagcgctaccggggcgtgtccttctatgaggtgcccccccacctgtttgctgtggccgacacagtgtaccgggccctgaggacagaaagaagagaccaggccgtgatgatctctggagagagcggggccggcaagacagaggccaccaagaggctgctgcagttctacgccgagacctgcccagcccctgagcggggcggcgctgtgcgggaccggctgctgcagagcaaccctgtgctggaggcctttggaaatgccaagaccctgagaaatgacaacagcagcagatttgggaagtacatggatgtgcagtttgacttcaagggggcccctgtgggcggccacatcctgagctacctgctggagaagagccgggtggtgcaccagaaccacggggagaggaacttccacatcttctaccagctgctggagggcggggaggaggagaccctgcggcggctgggcctggagaggaacccccagagctacctgtacctggtgaagggccagtgtgccaaggtgagcagcatcaatgacaagagtgactggaaggtggtgaggaaggccctgaccgtcatcgacttcacagaagatgaggtggaggacctgctgagcatcgtggcctctgtgctgcacctgggcaacatccactttgctgccaatgaggagagcaatgcccaggtgaccacagagaaccagctgaagtacctgacccggctgctgtctgtggagggcagcaccctgcgggaggccctgacccacaggaagatcatcgccaagggggaggagctgctgagccccctgaacctggagcaggccgcctatgccagagatgccctggccaaggctgtgtacagcaggaccttcacctggctggtgggcaagatcaacagaagcctggccagcaaggatgtggagagccccagctggaggagcaccaccgtgctgggcctgctggacatctacggctttgaggtgttccagcacaacagctttgagcagttctgcatcaactactgcaatgagaagctgcagcagctgttcatcgagctgaccctgaagtctgagcaggaggagtatgaagctgagggcatcgcctgggagcctgtgcagtacttcaacaacaagatcatctgtgacctggtggaggagaagttcaagggcatcatcagcatcctggatgaagaatgtctgcggcctggagaggccacagacctgaccttcctggagaagctggaggacacagtgaagcaccacccccacttcctgacccacaagctggccgaccagaggaccaggaagagcctgggccgcggggagttccggctgctgcactacgccggggaggtgacctacagcgtgacaggcttcctggacaagaacaatgacctgctcttcaggaacctgaaggagaccatgtgcagcagcaagaaccccatcatgagccagtgctttgacagaagtgagctgagtgacaagaagaggcctgagaccgtggccacccagttcaagatgagcctgctgcagctggtggagatcctgcagagcaaggagcccgcctacgtgcgctgcatcaagcccaatgatgccaagcagcccggccgctttgatgaggtgctgatccgccaccaggtgaagtacctgggcctgctggagaacctgcgggtgcggcgggccggctttgcctacagaagaaaatatgaggccttcctgcagcgctacaagagcctgtgcccagagacctggcccacctgggccggccggccccaggatggagtggccgtgctggtgcgccacctgggctacaagccagaggagtacaagatgggccgcaccaagatcttcatccgcttccccaagaccctgtttgccacagaagatgccctggaggtgcggcggcagagcctggccaccaagatccaggccgcctggaggggcttccactggaggcagaagttcctgcgggtgaagaggtctgccatctgcatccagagctggtggaggggcaccctgggccgcaggaaggccgccaagaggaagtgggccgcccagaccatccggcggctcatccggggctttgtgctgcggcatgccccccgctgcccagaaaatgccttcttcctggaccacgtgaggaccagcttcctgctgaacctgcggcggcagctgccccagaatgtgctggacacctcctggcccaccccacctccagccctgcgggaggccagcgagctgctgcgggagctgtgcatcaagaacatggtgtggaagtactgccgcagcatcagccctgagtggaagcagcagctgcagcagaaggctgtggccagcgagatcttcaagggcaagaaggacaactacccccagagcgtgcccaggctcttcatcagcacccggctgggcacagatgagatcagcccccgggtgctgcaggccctgggcagcgagcccatccagtatgctgtgcctgtggtgaagtatgacaggaagggctacaagcccaggagccggcagctgctgctgaccccaaatgctgtggtgattgtggaggatgccaaggtgaagcagagaattgattatgccaacctgaccggcatctctgtgagcagcctgagtgacagcctgtttgtgctgcacgtgcagagagctgacaacaagcagaagggagatgtggtgctgcagagcgaccacgtgattgagaccctgaccaagacagccctgagcgccaacagagtgaacagcatcaacatcaaccagggcagcatcacctttgctgggggccctggaagagatggcaccatcgacttcaccccaggcagcgagctgctgatcaccaaggccaagaatggccacctggccgtggtggccccccggctgaacagcaggtag

SEQ ID NO: 160791 - DNA, 3021 bp, Artificial Sequence
  Description of Artificial Sequence: Synthetic coding sequence
atggccgagcaggagagcctggagtttgggaaggctgactttgtgctgatggacacagtgtccatgcctgagttcatggccaacctgcggctgcgctttgagaagggccgcatctacaccttcatcggggaggtggtggtgtctgtgaacccctacaagctgctgaacatctacggccgggacaccatcgagcagtacaagggccgggagctgtatgaaagaccaccccacctgtttgccatcgcagatgctgcctacaaggccatgaagagaagaagcaaggacacctgcatcgtcatctctggagagagcggggccggcaagacagaggccagcaagtacatcatgcagtacatcgccgccatcaccaaccccagccagagagctgaggtggagcgggtgaagaacatgctgctgaagagcaactgtgtgctggaggcctttggaaatgccaagaccaacagaaatgacaacagcagcagatttgggaagtacatggacatcaactttgacttcaagggggaccccatcggcggccacatcaacaactacctgctggagaagagcagggtcatcgtgcagcagcccggggagaggagcttccacagcttctaccagctgctgcagggcggcagcgagcagatgctgcggagcctgcacctgcagaagagcctgagcagctacaactacatccacgtgggcgcccagctgaagagcagcatcaatgatgctgctgagttccgggtggtggctgatgccatgaaggtgattggcttcaagccagaggagatccagacagtgtacaagatcctggccgccatcctgcacctgggcaacctgaagtttgtggtggatggagacacccccctgattgaaaatggcaaggtggtgtccatcatcgccgagctgctgagcaccaagacagacatggtggagaaggccctgctgtacagaacagtggccaccggccgggacatcatcgacaagcagcacacagagcaggaggccagctatggaagagatgcctttgccaaggccatctatgaaagactcttctgctggatcgtgacccgcatcaatgacatcatcgaggtgaagaactatgacaccaccatccacggcaagaacacagtgattggagtgctggacatctacggctttgagatctttgacaacaacagctttgagcagttctgcatcaactactgcaatgagaagctgcagcagctgttcatccagctggtgctgaagcaggagcaggaggagtaccagcgggagggcatcccctggaagcacatcgactacttcaacaaccagatcatcgtggacctggtggagcagcagcacaagggcatcatcgccatcctggatgatgcctgcatgaatgtgggcaaggtgacagatgagatgttcctggaggccctgaacagcaagctgggcaagcacgcccacttcagcagcaggaagctgtgtgccagtgacaagatcctggagtttgaccgggacttccgcatccgccactatgctggagatgtggtgtacagcgtgattggcttcatcgacaagaacaaggacaccctcttccaggacttcaagaggctgatgtacaacagcagcaaccctgtgctgaagaacatgtggccagagggcaagctgagcatcacagaggtgaccaagaggcccctgacagctgccaccctcttcaagaacagcatgattgccctggtggacaacctggccagcaaggagccctactacgtgcgctgcatcaagcccaatgacaagaagagcccccagatctttgatgatgagcgctgccgccaccaggtggagtacctgggcctgctggagaatgtgcgggtgcggcgggccggctttgccttccggcagacctatgagaagttcctgcaccgctacaagatgatcagcgagttcacctggcccaaccacgacctgcccagcgacaaggaggccgtgaagaagctgattgagcgctgtggcttccaggatgatgtggcctacggcaagaccaagatcttcatccgcacccccaggaccctcttcaccctggaggagctgcgggcccagatgctgatcagaattgtgctcttcctgcagaaggtgtggaggggcaccctggccaggatgagatacaagaggaccaaggccgccctgaccatcatccgctactaccgccgctacaaggtgaagagctacatccacgaggtggcccggcgcttccacggcgtgaagaccatgagggactatggcaagcacgtgaagtggcccagcccccccaaggtgctgcggagatttgaggaggccctgcagaccatcttcaaccgctggagggccagccagctgatcaagagcatcccagccagtgacctgccccaggtgcgggccaaggtggccgctgtggagatgctgaagggccagagagctgacctgggcctgcagagggcctgggagggcaactacctggccagcaagccagacaccccccagaccagcggcacctttgtgcctgtggccaatgagctgaagaggaaggacaagtacatgaatgtgctcttcagctgccacgtgaggaaggtgaaccgcttcagcaaggtggaggaccgggccatctttgtgacagacagacacctgtacaagatggaccccaccaagcagtacaaggtgatgaagaccatccccctgtacaacctgaccggcctgtctgtgtccaatggcaaggaccagctggtggtgttccacaccaaggacaacaaggacctgattgtgtgcctcttcagcaagcagcccacccatgagagccgcatcggggagctggtgggcgtgctggtgaaccacttcaagtctgagaagaggcacctgcaggtgaatgtgaccaaccctgtgcagtgcagcctgcacggcaagaagtgcaccgtgtctgtggagacccggctgaaccagccccagcctgacttcaccaagaacagaagtggcttcatcctgtctgtgcccggcaactag

SEQ ID NO: 160792 - DNA, 597 bp, Artificial Sequence
  Description of Artificial Sequence: Synthetic coding sequence
atgctgaagggccagagagctgacctgggcctgcagagggcctgggagggcaactacctggccagcaagccagacaccccccagaccagcggcacctttgtgcctgtggccaatgagctgaagaggaaggacaagtacatgaatgtgctcttcagctgccacgtgaggaaggtgaaccgcttcagcaaggtggaggaccgggccatctttgtgacagacagacacctgtacaagatggaccccaccaagcagtacaaggtgatgaagaccatccccctgtacaacctgaccggcctgtctgtgtccaatggcaaggaccagctggtggtgttccacaccaaggacaacaaggacctgattgtgtgcctcttcagcaagcagcccacccatgagagccgcatcggggagctggtgggcgtgctggtgaaccacttcaagtctgagaagaggcacctgcaggtgaatgtgaccaaccctgtgcagtgcagcctgcacggcaagaagtgcaccgtgtctgtggagacccggctgaaccagccccagcctgacttcaccaagaacagaagtggcttcatcctgtctgtgcccggcaactag

SEQ ID NO: 160793 - DNA, 3327 bp, Artificial Sequence
  Description of Artificial Sequence: Synthetic coding sequence
atgggcagcaagggcgtgtaccagtaccactggcagagccacaacgtgaagcacagcggcgtggatgacatggtgctgctgagcaagatcacagagaacagcatcgtggagaacctgaagaagcgctacatggatgactacatcttcacctacatcggctctgtgctgatctctgtgaaccccttcaagcagatgccctactttggagagaaggagattgagatgtaccagggcgccgcccagtatgaaaatccaccccacatctatgccctggccgacaacatgtacagaaacatgatcatcgaccgggagaaccagtgtgtgatcatctctggagagagcggggccggcaagacagtggccgccaagtacatcatgagctacatcagccgggtgtctgggggcggcaccaaggtgcagcacgtgaaggacatcatcctgcagagcaaccccctgctggaggcctttggaaatgccaagacagtgaggaacaacaacagcagcagatttgggaagtactttgagatccagttcagccctggaggagagccagatggcggcaagatcagcaacttcctgctggagaagagccgggtggtgatgaggaaccctggagagaggagcttccacatcttctaccagctgattgagggcgccagcgctgagcagaagcacagcctgggcatcacctccatggactactactactacctgagcctgagcggcagctacaaggtggatgacattgatgaccggcgggagttccaggagaccctgcacgccatgaatgtgattggcatctttgctgaggagcagaccctggtgctgcagatcgtggccggcatcctgcacctgggcaacatctccttcaaggaggtgggcaactatgctgctgtggagagcgaggagttcctggccttccctgcctacctgctgggcatcaaccaggaccggctgaaggagaagctgaccagccggcagatggacagcaagtggggcggcaagtctgagagcatccacgtgaccctgaatgtggagcaggcctgctacaccagagatgccctggccaaggccctgcacgcccgggtgtttgacttcctggtggacagcatcaacaaggccatggagaaggaccacgaggagtacaacatcggcgtgctggacatctacggctttgagatcttccagaagaatggatttgagcagttctgcatcaactttgtgaatgagaagctgcagcagatcttcatcgagctgaccctgaaggccgagcaggaggagtatgtgcaggagggcatccgctggacccccatcgagtacttcaacaacaagatcgtgtgtgacctgattgagaacaaggtgaaccccccaggcatcatgagcatcctggatgatgtgtgtgccaccatgcatgctgtgggggagggcgctgaccagaccctgctgcagaagctgcagatgcagatcggcagccatgagcacttcaacagctggaaccagggcttcatcatccaccactacgccggcaaggtgtcctatgacatggatggcttctgtgaaagaaacagagatgtgctcttcatggacctgattgagctgatgcagagcagcgagctgcccttcatcaagagcctcttccctgagaacctgcaggccgacaagaagggccggcccaccacagctggcagcaagatcaagaagcaggccaatgacctggtgtccaccctgatgaagtgcaccccccactacatccgctgcatcaagcccaatgagaccaagaagccccgggactgggaggagagccgggtgaagcaccaggtggagtacctgggcctgaaggagaacatccgggtgagaagagctggctacgcctaccgccgcatcttccagaagttcctgcagagatatgccatcctgaccaaggccacctggcccagctggcagggcgaggagaagcagggcgtgctgcacctgctgcagagcgtgaacatggacagcgaccagttccagctgggccgcagcaaggtgttcatcaaggcccctgagagcctcttcctgctggaggagatgagggagaggaaatatgatggctacgcccgggtcatccagaagtcctggaggaagtttgtggccaggaagaagtatgtgcagatgagggaggaggccagtgacctgctgctgaacaagaaggagaggagaagaaacagcatcaacagaaacttcatcggggactacatcggcatggaggagcaccctgagctgcagcagtttgtgggcaagcgggagaagattgactttgctgacacagtgaccaagtatgaccggcgcttcaagggcgtgaagagggacctgctgctgacccccaagtgcctgtacctgattggccgggagaaggtgaagcagggccctgacaagggcctggtgaaggaggtgctgaagaggaagattgaaattgaaagaatcctgtctgtgtccctgagcaccatgcaggatgacatcttcatcctgcacgagcaggagtatgacagcctgctggagagcgtcttcaagacagagttcctgagcctgctggccaagagatatgaggagaagacccagaagcagctgcccctgaagttcagcaacaccctggagctgaagctgaagaaggagaactggggcccctggagcgctgggggcagccggcaggtgcagttccaccagggctttggagacctggccgtgctgaagcccagcaacaaggtgctgcaggtgtccatcggccctggcctgcccaagaacagccggcccaccaggaggaacaccacccagaacacaggctacagcagcggcacccagaatgccaactaccctgtgcgggccgcccctcctcctcctggctaccaccagaatggagtcatccggaaccagtatgtgccctacccccacgcccctggcagccagaggagcaaccagaagagcctgtacacctccatggcccggccccccctgccccggcagcagagcaccagcagtgacagagtgtcccagaccccagagagcctggacttcctgaaggtgcctgaccagggcgccgccggcgtgcggcggcagaccaccagccggcccccacctgctgggggccggcccaagccccagcccaagcccaagccccaggtgccccagtgcaaggccctgtatgcctatgatgcccaggacacagatgagctgtccttcaatgccaatgacatcatcgacatcatcaaggaggaccccagcggctggtggacaggccgcctgcggggcaagcagggcctcttccccaacaactacgtgaccaagatctag

SEQ ID NO: 160794 - DNA, 3312 bp, Artificial Sequence
  Description of Artificial Sequence: Synthetic coding sequence
ggcaccaaggccggcagccctgtgaatggccagaagcagggccacgcccaggccacccccaagatccccctgaacctgcacctgcaccacgaccccttccgcagcctgcaggagcccaggcaccagccccccaccatgggcagcaaggagcgcttccactggcagagccacaacgtgaagcagagcggcgtggatgacatggtgctgctgccccagatcacagaagatgccatcgccgccaacctgaggaagcgcttcatggatgactacatcttcacctacatcggctctgtgctgatctctgtgaaccccttcaagcagatgccctacttcacagaccgggagattgacctgtaccagggcgccgcccagtatgagaaccccccccacatctatgccctgacagacaacatgtacagaaacatgctgattgactgtgagaaccagtgtgtgatcatcagcggggagagcggggccggcaagacagtggccgccaagtacatcatgggctacatcagcaaggtgtctgggggcggggagaaggtgcagcacgtgaaggacatcatcctgcagagcaaccccctgctggaggcctttggaaatgccaagacagtgaggaacaacaacagcagcagatttgggaagtactttgagatccagttcagccggggcggggagccagatggcggcaagatcagcaacttcctgctggagaagagccgggtggtgatgcagaatgaaaatgaaagaaacttccacatctactaccagctgctggagggcgccagccaggagcagaggcagaacctgggcctgatgaccccagactactactactacctgaaccagagcgacacctaccaggtggatggaacagatgacagaagtgactttggagagaccctgagcgccatgcaggtgattggcatccccccatccatccagcagctggtgctgcagctggtggccggcatcctgcacctgggcaacatctccttctgtgaagatggcaactatgcccgggtggagagcgtggacctgctggccttccctgcctacctgctgggcattgattctggccgcctgcaggagaagctgaccagcaggaagatggacagccgctggggcggccgctctgagagcatcaacgtgaccctgaatgtggagcaggccgcctacaccagagatgccctggccaagggcctgtatgcccggctgtttgacttcctggtggaggccatcaacagagccatgcagaagccccaggaggagtacagcattggagtgctggacatctacggctttgagatcttccagaagaatggatttgagcagttctgcatcaactttgtgaatgagaagctgcagcagatcttcatcgagctgaccctgaaggccgagcaggaggagtatgtgcaggagggcatccgctggacccccatccagtacttcaacaacaaggtggtgtgtgacctgattgagaacaagctgagccccccaggcatcatgtctgtgctggatgatgtgtgtgccaccatgcacgccaccggcggcggcgctgaccagaccctgctgcagaagctgcaggccgctgtgggcacccatgagcacttcaacagctggagcgctggctttgtgatccaccactacgccggcaaggtgtcctatgatgtgtctggcttctgtgagaggaacagagatgtgctcttcagtgacctgattgagctgatgcagaccagcgagcaggccttcctgaggatgctgtttcctgagaagctggatggagacaagaagggccggcccagcacagctggcagcaagatcaagaagcaggccaatgacctggtggccaccctgatgcgctgcaccccccactacatccgctgcatcaagcccaatgagaccaagaggccccgggactgggaggagaacagagtgaagcaccaggtggagtacctgggcctgaaggagaacatccgggtgcggcgggccggctttgcctaccgccggcagtttgccaagttcctgcagagatatgccatcctgaccccagagacctggccccgctggagaggagatgagcggcagggcgtgcagcacctgctgcgggctgtgaacatggagccagaccagtaccagatgggcagcaccaaggtgtttgtgaagaaccctgagagcctcttcctgctggaggaggtgcgggagaggaagtttgatggctttgcccggaccatccagaaggcctggaggagacatgtggccgtgaggaaatatgaggagatgagggaggaggccagcaacatcctgctgaacaagaaggagaggagaagaaattccatcaacagaaactttgtgggggactacctgggcctggaggagaggcctgagctgcggcagttcctgggcaagcgggagcgggtggactttgctgacagcgtgaccaagtatgaccggcgcttcaagcccatcaagagggacctgatcctgacccccaagtgtgtgtatgtgattggccgggagaaggtgaagaagggccctgagaagggccaggtgtgtgaggtgctgaagaagaaggtggacatccaggccctgcggggcgtgtccctgagcacccggcaggatgacttcttcatcctgcaggaggatgctgctgacagcttcctggagagcgtcttcaagacagaatttgtgtccctgctgtgcaagagatttgaggaggccacccggcggcccctgcccctgaccttcagtgacaccctgcagttccgggtgaagaaggagggctggggcggcggcggcaccaggtctgtgaccttcagccggggctttggagacctggccgtgctgaaggtgggcggccgcaccctgactgtgtctgtgggagatggcctgcccaagagcagcaagcccaccaggaagggcatggccaagggcaagcccaggaggagcagccaggcccccacccgggccgccccagccccaccccggggcatggacagaaatggagtgccccccagcgcccggggcggccccctgcccggggaccacgtgtggaggggccacccccaggccagccctggcctgcggccccacccctgggagccagcagatgatcctggccacgtgcggccccagagcaccacccagaacagcagcacctgcctgacccgggcctggccagcctgccggggcagcgctgcctggggcaatggccagtgcctggtgtgggccgaccccagccccagcctgggccacatggtgcctggggccggcccctacaccagcacctgggccaagatgtggaccagctag

SEQ ID NO: 160795 - DNA, 3297 bp, Artificial Sequence
  Description of Artificial Sequence: Synthetic coding sequence
atgggcagcaaggagcgcttccactggcagagccacaacgtgaagcagagcggcgtggatgacatggtgctgctgccccagatcacagaagatgccatcgccgccaacctgaggaagcgcttcatggatgactacatcttcacctacatcggctctgtgctgatctctgtgaaccccttcaagcagatgccctacttcacagaccgggagattgacctgtaccagggcgccgcccagtatgaaaatccaccccacatctatgccctgacagacaacatgtacagaaacatgctgattgactgtgagaaccagtgtgtgatcatctctggagagagcggggccggcaagacagtggccgccaagtacatcatgggctacatcagcaaggtgtctgggggcggggagaaggtgcagcacgtgaaggacatcatcctgcagagcaaccccctgctggaggcctttggaaatgccaagacagtgaggaacaacaacagcagcagatttgggaagtactttgagatccagttcagcagaggaggagagccagatggcggcaagatcagcaacttcctgctggagaagagccgggtggtgatgcagaatgaaaatgaaagaaacttccacatctactaccagctgctggagggcgccagccaggagcagaggcagaacctgggcctgatgaccccagactactactactacctgaaccagagcgacacctaccaggtggatggaacagatgacagaagtgactttggagagaccctgagcgccatgcaggtgattggcatcccccccagcatccagcagctggtgctgcagctggtggccggcatcctgcacctgggcaacatctccttctgtgaagatggcaactatgcccgggtggagagcgtggacctgctggccttccctgcctacctgctgggcatcgacagcggccgcctgcaggagaagctgaccagcaggaagatggacagccgctggggcggccgctctgagagcatcaacgtgaccctgaatgtggagcaggccgcctacaccagagatgccctggccaagggcctgtatgcccggctgtttgacttcctggtggaggccatcaacagagccatgcagaagccccaggaggagtacagcattggagtgctggacatctacggctttgagatcttccagaagaatggatttgagcagttctgcatcaactttgtgaatgagaagctgcagcagatcttcatcgagctgaccctgaaggccgagcaggaggagtatgtgcaggagggcatccgctggacccccatccagtacttcaacaacaaggtggtgtgtgacctgattgagaacaagctgagccccccaggcatcatgtctgtgctggatgatgtgtgtgccaccatgcacgccactggaggcggcgctgaccagaccctgctgcagaagctgcaggccgctgtgggcacccatgagcacttcaacagctggagcgctggcttcgtcatccaccactacgccggcaaggtgtcctatgatgtgtctggcttctgtgaaagaaacagagatgtgctcttcagtgacctgattgagctgatgcagaccagcgagcaggccttcctgaggatgctgtttcctgagaagctggatggagacaagaagggccggcccagcacagctggcagcaagatcaagaagcaggccaatgacctggtggccaccctgatgcgctgcaccccccactacatccgctgcatcaagcccaatgagaccaagaggccccgggactgggaggagaacagagtgaagcaccaggtggagtacctgggcctgaaggagaacatccgggtgagaagagctggctttgcctaccgccggcagtttgccaagttcctgcagagatatgccatcctgaccccagagacctggccccgctggagaggagatgagcggcagggcgtgcagcacctgctgcgggctgtgaacatggagccagaccagtaccagatgggcagcaccaaggtgtttgtgaagaaccctgagagcctcttcctgctggaggaggtgcgggagaggaagtttgatggctttgcccggaccatccagaaggcctggaggagacatgtggccgtgaggaaatatgaggagatgagggaggaggccagcaacatcctgctgaacaagaaggagaggagaagaaacagcatcaacagaaactttgtgggggactacctgggcctggaggagaggcctgagctgcggcagttcctgggcaagcgggagcgggtggactttgctgacagcgtgaccaagtatgaccggcgcttcaagcccatcaagagggacctgatcctgacccccaagtgtgtgtatgtgattggccgggagaaggtgaagaagggccctgagaagggccaggtgtgtgaggtgctgaagaagaaggtggacatccaggccctgcggggcgtgtccctgagcacccggcaggatgacttcttcatcctgcaggaggatgctgctgacagcttcctggagagcgtcttcaagacagaatttgtgtccctgctgtgcaagagatttgaggaggccacccggcggcccctgcccctgaccttcagtgacaccctgcagttccgggtgaagaaggagggctggggcggcggcggcaccaggtctgtgaccttcagccggggctttggagacctggccgtgctgaaggtgggcggccgcaccctgactgtgtctgtgggagatggcctgcccaagagcagcaagcccaccaggaagggcatggccaagggcaagccccggcgcagcagccaggcccccaccagggctgccccagccccaccccggggcatggacagaaatggagtgcccccatctgcccggggcggccccctgcccctggagatcatgtctgggggcggcacccaccggcccccccggggcccccccagcaccagcctgggcgccagcagaagaccccgggcccggcccccatctgagcacaacacagagttcctgaatgtgcctgaccagggcatggccggcatgcagaggaagaggtctgtgggccagaggcctgtgcctggggtgggccggcccaagccccagcccaggacccacggcccccgctgccgggccctgtaccagtatgtgggccaggatgtggatgagctgtccttcaacgtgaatgaagtcatcgagatcctgatggaggaccccagcggctggtggaagggccgcctgcacggccaggagggcctcttccctggcaactacgtggagaagatctag

SEQ ID NO: 160796 - DNA, 3057 bp, Artificial Sequence
  Description of Artificial Sequence: Synthetic coding sequence
atggaggatgaggagggcccagaatatggcaagccagactttgtgctgctggaccaggtgaccatggaggacttcatgaggaacctgcagctgcgctttgagaagggccgcatctacacctacatcggggaggtgctggtgtctgtgaacccctaccaggagctgcccctgtatggccctgaggccatcgcccgctaccagggccgggagctgtatgaaagaccaccccacctgtatgctgtggccaatgctgcctacaaggccatgaagcacaggagccgggacacctgcatcgtcatctctggagagagcggggccggcaagacagaggccagcaagcacatcatgcagtacatcgctgctgtgaccaaccccagccagagagctgaggtggagcgggtgaaggatgtgctgctgaagagcacctgtgtgctggaggcctttggaaatgcccggaccaacagaaaccacaacagcagcagatttgggaagtacatggacatcaactttgacttcaagggggaccccatcggcggccacatccacagctacctgctggagaagagccgggtgctgaagcagcacgtgggggagaggaacttccacgccttctaccagctgctgcggggcagcgaggacaagcagctgcacgagctgcacctggagagaaatcctgctgtgtacaacttcacccaccagggcgccggcctgaacatgacagtgcacagcgccctggacagtgatgagcagagccaccaggccgtgacagaggccatgagggtcatcggcttcagccctgaggaggtggagagcgtgcaccgcatcctggccgccatcctgcacctgggcaacattgaatttgtggagacagaggagggcggcctgcagaaggagggcctggccgtggccgaggaggccctggtggaccacgtggccgagctgacagccaccccccgggacctggtgctgcggagcctgctggccaggacagtggccagcggcggccgggagctgattgagaagggccacacagctgctgaggccagctatgccagagatgcctgtgccaaggctgtgtaccagaggctgtttgagtgggtggtgaaccgcatcaacagcgtgatggagccccggggccgggaccccaggagagatggcaaggacacagtgattggagtgctggacatctacggctttgaggtgtttcctgtgaacagctttgagcagttctgcatcaactactgcaatgagaagctgcagcagctgttcatccagctgatcctgaagcaggagcaggaggagtatgagcgggagggcatcacctggcagagcgtggagtacttcaacaatgccaccatcgtggacctggtggagcggccccaccggggcatcctggccgtgctggatgaggcctgcagcagcgctggcaccatcacagaccgcatcttcctgcagaccctggacatgcaccaccgccaccacctgcactacaccagccggcagctgtgccccacagacaagaccatggagtttggccgggacttccgcatcaagcactatgctggagatgtgacctacagcgtggagggcttcatcgacaagaacagagacttcctgttccaggacttcaagaggctgctgtacaacagcacagaccccaccctgcgggccatgtggccagatggccagcaggacatcacagaggtgaccaagaggcccctgacagctggcaccctcttcaagaacagcatggtggccctggtggagaacctggccagcaaggagcccttctacgtgcgctgcatcaagcccaatgaagacaaggtggccggcaagctggatgagaaccactgccgccaccaggtggcctacctgggcctgctggagaatgtgcgggtgcggcgggccggctttgccagccggcagccctacagccgcttcctgctgcgctacaagatgacctgtgagtacacctggcccaaccacctgctgggcagtgacaaggctgctgtgtctgccctgctggagcagcacggcctgcagggagatgtggccttcggccacagcaagctgttcatccgcagccccaggaccctggtgaccctggagcagagccgggcccggctcatccccatcatcgtgctgctgctgcagaaggcctggaggggcaccctggcccgctggcgctgccggcggctgcgggccatctacaccatcatgcgctggttccgccgccacaaggtgcgggcccacctggccgagctgcagaggcgcttccaggccgcccggcagccccccctgtatggccgggacctggtgtggcccctgcccccagctgtgctgcagcccttccaggacacctgccacgccctcttctgccgctggagggcccggcagctggtgaagaacatccccccaagtgacatgccccagatcaaggccaaggtggccgccatgggcgccctgcagggcctgcggcaggactggggctgccggcgggcctgggcccgggactacctgagcagcgccacagacaaccccacagccagcagcctgtttgcccagaggctgaagaccctgcaggacaaggatggctttggagctgtgctcttcagcagccacgtgaggaaggtgaaccgcttccacaagatccggaacagagccctgctgctgacagaccagcacctgtacaagctggaccctgaccggcagtacagagtgatgagagctgtgcccctggaggccgtgacaggcctgtctgtgaccagcggcggggaccagctggtggtgctgcacgcccggggccaggatgacctggtggtgtgcctgcacaggagccggccccccctggacaacagagtgggggagctggtgggcgtgctggccgcccactgccagggcgagggccgcaccctggaggtgcgggtgtctgactgcatccccctgagccaccggggcgtgcggcggctcatctctgtggagcccaggcctgagcagcctgagccagacttccgctgtgcccggggcagcttcaccctgctgtggcccagcaggtag

SEQ ID NO: 160797 - DNA, 4851 bp, Artificial Sequence
  Description of Artificial Sequence: Synthetic coding sequence
atgttccccctgattggcaagaccatcatctttgacaacttcccagaccccagcgacacctgggagatcacagagaccatcggcaagggcacctacggcaaggtgttcaaggtgctgaacaagaagaatggccagaaggctgctgtgaagatcctggaccccatccatgacattgatgaggagattgaggccgagtacaacatcctgaaggccctgagtgaccaccccaacgtggtgcgcttctacggcatctacttcaagaaggacaaggtgaatggagacaagctgtggctggtgctggagctgtgcagcggcggctctgtgacagacctggtgaagggcttcctgaagagaggagagaggatgtctgagcccctgattgcctacatcctgcacgaggccctgatgggcctgcagcacctgcacaacaacaagaccatccacagagatgtgaagggcaacaacatcctgctgaccacagagggcggcgtgaagctggtggactttggagtgtctgcccagctgaccagcaccaggcacagaagaaacacctctgtgggcacccccttctggatggcccctgaggtgattgcctgtgagcagcagctggacaccacctatgatgcccgctgtgacacctggagcctgggcatcacagccatcgagctgggagatggagacccccccctggccgacctgcaccccatgagggccctcttcaagatccccaggaaccccccacccaagctgcggcagcctgagctgtggagcgctgagttcaatgacttcatcagcaagtgcctgaccaaggactatgagaagaggcccaccgtgtctgagctgctgcagcacaagttcatcacccagatcgagggcaaggatgtgatgctgcagaagcagctgacagagttcatcggcatccaccagtgcatgggcggcacagagaaggcccggcgggagcgcatccacaccaagaagggcaacttcaaccggcccctcatcagcaacctgaaggatgtggatgacctggccaccctggagatcctggatgaaaatacagtgtctgagcagctggagaagtgctacagccgggaccagatctacgtgtatgtgggggacatcctgattgccctgaaccccttccagagcctgggcctgtacagcaccaagcacagcaagctgtacatcggcagcaagaggacagccagccccccccacatctttgccatggctgacctgggctaccagagcatgatcacctacaacagcgaccagtgcatcgtcatcagcggggagagcggggccggcaagacagaaaatgcccacctgctggtgcagcagctgactgtgctgggcaaggccaacaacagaaccctgcaggagaagatcctgcaggtgaacaacctggtggaggcctttggaaatgcctgcaccatcatcaatgacaacagcagcagatttgggaagtacctggagatgaagttcaccagcagcggggctgtggtgggcgcccagatcagcgagtacctgctggagaagagcagggtcatccaccaggccatcggggagaagaacttccacatcttctactacatctatgccggcctggccgagaagaagaagctggcccactacaagctgcctgagaacaagccaccccgctacctgcagaatgaccacctgaggacagtgcaggacatcatgaacaacagcttctacaagagccagtatgagctgattgagcagtgcttcaaggtgattggcttcaccatggagcagctgggcagcatctacagcatcctggccgccatcctgaatgtgggcaacatcgagttcagctctgtggccacagagcaccagattgacaagagccacatcagcaaccacacagccctggagaactgtgccagcctgctgtgcatccgggcagatgagctgcaggaggccctgaccagccactgtgtggtgaccagaggagagaccatcatccggcccaacacagtggagaaggccacagatgtgagagatgccatggccaagaccctgtatggccgcctcttctcctggatcgtgaactgcatcaacagcctgctgaagcatgacagcagccccagcggaaatggagatgagctgagcatcggcatcctggacatctttggatttgagaacttcaagaagaacagctttgagcagctgtgcatcaacatcgccaatgagcagatccagtactactacaaccagcacgtgtttgcctgggagcagaatgagtacctgaatgaagatgtggatgcccgggtgattgaatatgaggacaactggcccctgctggacatgttcctgcagaagcccatgggcctgctgagcctgctggatgaggagagccgcttccccaaggccacagaccagaccctggtggagaagtttgagggcaacctgaagagccagtacttctggaggcccaagaggatggagctgagctttggcatccaccactacgccggcaaggtgctgtacaatgccagcggcttcctggccaagaacagagacaccctgcccacagacatcgtgctgctgctgcggagcagtgacaacagcgtcatccggcagctggtgaaccaccccctgaccaagacaggcaacctgccccacagcaagaccaagaatgtcatcaactaccagatgaggaccagcgagaagctgatcaacctggccaagggggacaccggggaggccaccaggcatgcccgggagaccaccaacatgaagacccagacagtggccagctacttccgctacagcctgatggacctgctgagcaagatggtggtgggccagccccactttgtgcgctgcatcaagcccaacagcgagcggcaggccaggaaatatgacaaggagaaggtgctgctgcagctgcgctacacaggcatcctggagacagcccgcatccggcggctgggcttcagccaccgcatcctgtttgccaacttcatcaagcgctactacctgctgtgctacaagagcagcgaggagcccaggatgagcccagacacctgtgccaccatcctggagaaggccggcctggacaactgggccctgggcaagaccaaggtgttcctgaagtactaccacgtggagcagctgaacctgatgaggaaggaggccatcgacaagctgatcctgatccaggcctgtgtgcgggccttcctgtgcagccgccgctaccagaagatccaggagaagaggaaggagagcgccatcatcatccagagcgctgcccggggccacctggtgaggaagcagaggaaggagatcgtggacatgaagaacacagctgtgaccaccatccagaccagtgaccaggagtttgactacaagaagaactttgagaacacccgggagagctttgtgaagaagcaggccgagaatgccatcagcgccaatgaacgcttcatcagcgcccccaacaacaagggctctgtgtctgtggtgaagaccagcaccttcaagccagaggaggagaccaccaatgctgtggagagcaacaacagagtgtaccagacccccaagaagatgaacaacgtgtatgaggaggaggtgaagcaggagttctacctggtgggccctgaggtgagccccaagcagaagtctgtgaaggacctggaggagaacagcaacctgaggaaggtggagaaggaggaggccatgatccagagctactaccagcgctacacagaggagaggaactgtgaggagagcaaggccgcctacctggagaggaaggccatcagcgagcggcccagctaccctgtgccctggctggccgagaatgagaccagcttcaagaagaccctggagcccaccctgagccagaggagcatctaccagaatgccaacagcatggagaaggagaagaagacctctgtggtgacccagagggcccccatctgcagccaggaggagggccggggccgcctgcggcatgagaccgtgaaggagcggcaggtggagcctgtgacccaggcccaggaggaggaggacaaggctgctgtgttcatccagagcaagtaccggggctacaagaggcggcagcagctgaggaaggacaagatgagcagcttcaagcaccagagaattgtgaccacccccacagaggtggccaggaacacccacaacctgtacagctaccccaccaagcatgaggagatcaacaacatcaagaagaaggacaacaaggacagcaaggccaccagcgagcgggaggcctgtggcctggccatcttcagcaagcagatcagcaagctgtctgaggagtacttcatcctgcagaagaagctgaatgagatgatcctgagccagcagctgaagagcctgtacctgggcgtgagccaccacaagcccatcaacagaagagtgagcagccagcagtgcctgtctggagtgtgcaagggggaggagcccaagatcctgcggcccccccggcggcccaggaagcccaagaccctgaacaaccctgaggacagcacctactactacctgctgcacaagagcatccaggaggagaagagaagacccaggaaggacagccagggcaagctgctggacctggaggacttctactacaaggagttcctgcccagccgcagcggccccaaggagcacagccccagcctgcgggagcggcggccccagcaggagctgcagaaccagtgcatcaaggccaatgaacgctgctgggccgctgagagccctgagaaggaggaggagcgggagcctgctgccaacccctatgacttccggcggctgctgaggaagaccagccagaggcggcggctggtgcagcagagctag

SEQ ID NO: 160798 - DNA, 594 bp, Artificial Sequence
  Description of Artificial Sequence: Synthetic coding sequence
atgttccccctgattggcaagaccatcatctttgacaacttcccagaccccagcgacacctgggagatcacagagaccatcggcaagggcacctacggcaaggtgttcaaggtgctgaacaagaagaatggccagaaggctgctgtgaagatcctggaccccatccatgacattgatgaggagattgaggccgagtacaacatcctgaaggccctgagtgaccaccccaacgtggtgcgcttctacggcatctacttcaagaaggacaaggtgaatggagacaagctgtggctggtgctggagctgtgcagcggcggctctgtgacagacctggtgaagggcttcctgaagagaggagagaggatgtctgagcccctgattgcctacatcctgcacgaggccctgatgggcctgcagcacctgcacaacaacaagaccatccacagagatgtgaagggcaacaacatcctgctgaccacagagggcggcgtgaagctggtggactttggagtgtctgcccagctgaccagcaccaggcacagaagaaacacctctgtgggcacccccttctggatggcccctgaggtgaggtag

SEQ ID NO: 160799 - DNA, 744 bp, Artificial Sequence
  Description of Artificial Sequence: Synthetic coding sequence
atgttccccctgattggcaagaccatcatctttgacaacttcccagaccccagcgacacctgggagatcacagagaccatcggcaagggcacctacggcaaggtgttcaaggtgctgaacaagaagaatggccagaaggctgctgtgaagatcctggaccccatccatgacattgatgaggagattgaggccgagtacaacatcctgaaggccctgagtgaccaccccaacgtggtgcgcttctacggcatctacttcaagaaggacaaggtgaatggagacaagctgtggctggtgctggagctgtgcagcggcggctctgtgacagacctggtgaagggcttcctgaagagaggagagaggatgtctgagcccctgattgcctacatcctgcacgaggccctgatgggcctgcagcacctgcacaacaacaagaccatccacagagatgtgaagggcaacaacatcctgctgaccacagagggcggcgtgaagctggtggactttggagtgtctgcccagctgaccagcaccaggcacagaagaaacacctctgtgggcacccccttctggatggcccctgaggtgattgcctgtgagcagcagctggacaccacctatgatgcccgctgtgacacctggagcctgggcatcacagccatcgagctgggagatggagacccccccctggccgacctgcaccccatgagggccctcttcaagatccccaggagtgatgactag

SEQ ID NO: 160800 - DNA, 1995 bp, Artificial Sequence
  Description of Artificial Sequence: Synthetic coding sequence
atgttccccctgattggcaagaccatcatctttgacaacttcccagaccccagcgacacctgggagatcacagagaccatcggcaagggcacctacggcaaggtgttcaaggtgctgaacaagaagaatggccagaaggctgctgtgaagatcctggaccccatccatgacattgatgaggagattgaggccgagtacaacatcctgaaggccctgagtgaccaccccaacgtggtgcgcttctacggcatctacttcaagaaggacaaggtgaatggagacaagctgtggctggtgctggagctgtgcagcggcggctctgtgacagacctggtgaagggcttcctgaagagaggagagaggatgtctgagcccctgattgcctacatcctgcacgaggccctgatgggcctgcagcacctgcacaacaacaagaccatccacagagatgtgaagggcaacaacatcctgctgaccacagagggcggcgtgaagctggtggactttggagtgtctgcccagctgaccagcaccaggcacagaagaaacacctctgtgggcacccccttctggatggcccctgaggtgattgcctgtgagcagcagctggacaccacctatgatgcccgctgtgacacctggagcctgggcatcacagccatcgagctgggagatggagacccccccctggccgacctgcaccccatgagggccctcttcaagatccccaggaaccccccacccaagctgcggcagcctgagctgtggagcgctgagttcaatgacttcatcagcaagtgcctgaccaaggactatgagaagaggcccaccgtgtctgagctgctgcagcacaagttcatcacccagatcgagggcaaggatgtgatgctgcagaagcagctgacagagttcatcggcatccaccagtgcatgggcggcacagagaaggcccggcgggagcgcatccacaccaagaagggcaacttcaaccggcccctcatcagcaacctgaaggatgtggatgacctggccaccctggagatcctggatgaaaatacagtgtctgagcagctggagaagtgctacagccgggaccagatctacgtgtatgtgggggacatcctgattgccctgaaccccttccagagcctgggcctgtacagcaccaagcacagcaagctgtacatcggcagcaagaggacagccagccccccccacatctttgccatggctgacctgggctaccagagcatgatcacctacaacagcgaccagtgcatcgtcatcagcggggagagcggggccggcaagacagaaaatgcccacctgctggtgcagcagctgactgtgctgggcaaggccaacaacagaaccctgcaggagaagatcctgcaggtgaacaacctggtggaggcctttggaaatgcctgcaccatcatcaatgacaacagcagcagatttgggaagtacctggagatgaagttcaccagcagcggggctgtggtgggcgcccagatcagcgagtacctgctggagaagagcagggtcatccaccaggccatcggggagaagaacttccacatcttctactacatctatgccggcctggccgagaagaagaagctggcccactacaagctgcctgagaacaagccaccccgctacctgcagaatgaccacctgaggacagtgcaggacatcatgaacaacagcttctacaagagccagtatgagctgattgagcagtgcttcaaggtgattggcttcaccatggaggtgctgggcggcggggagccccgggagggcggcggggagcgggccagcagccagcccctgcggctgcaggaggccccagcccagaacctgcctgccccagcccccaggcctgctgtgctgactgtgcagaggggcagccacagaagaaggaaggccctggagcccgccggccagcagggccccagccgccacagcggggccggcaccagccgccactag

SEQ ID NO: 160801 - DNA, 3834 bp, Artificial Sequence
  Description of Artificial Sequence: Synthetic coding sequence
aagcacctgtatggcctcttccactacaaccccatgatgctgggcctggagagcctgcctgaccccacagacacctgggagatcatcgagaccatcggcaagggcacctacggcaaggtgtacaaggtgaccaacaagagagatggcagcctggccgctgtgaagatcctggaccctgtgtctgacatggatgaggagattgaagctgagtacaacatcctgcagttcctgcccaaccaccccaacgtggtgaagttctacggcatgttctacaaggctgaccactgtgtgggcggccagctgtggctggtgctggagctgtgcaatggaggctctgtgacagagctggtgaagggcctgctgcgctgtggccagaggctggatgaggccatgatctcctacatcctgtatggagccctgctgggcctgcagcacctgcacaacaaccgcatcatccacagagatgtgaagggcaacaacatcctgctgaccacagaaggaggagtgaagctggtggactttggagtgtctgcccagctgaccagcacccggctgcggaggaacacctctgtgggcacccccttctggatggcccctgaggtgattgcctgtgagcagcagtatgacagcagctatgatgcccgctgtgatgtgtggagcctgggcatcacagccatcgagctgggagatggagacccccccctgtttgacatgcaccctgtgaagaccctcttcaagatccccagaaatcctccacccaccctgctgcaccctgagaagtggtgtgaggagttcaaccacttcatcagccagtgcctgatcaaggactttgaaagaagacccagcgtgacccacctgctggaccaccccttcatcaagggcgtgcacggcaaggtgctcttcctgcagaagcagctggccaaggtgctgcaggaccagaagcaccagaaccctgtggccaagaccaggcatgagaggatgcacacccggcggccctaccacgtggaggatgctgagaagtactgcctggaggatgacctggtgaacctggaggtgctggatgaggacaccatcatccaccagctgcagaagagatatgctgacctgctgatctacacctacgtgggggacatcctgattgccctgaaccccttccagaacctgagcatctacagcccccagttcagccggctgtaccacggcgtgaagagggccagcaaccccccccacatctttgccagcgcagatgctgcctaccagtgcatggtgaccctgagcaaggaccagtgcatcgtcatcagcggggagagcggcagcggcaagacagagagcgcccacctgattgtgcagcacctgaccttcctgggcaaggccaacaaccagaccctgcgggagaagatcctgcaggtgaacagcctggtggaggcctttggaaacagctgcacagccatcaatgacaacagcagcagatttgggaagtacctggagatgatgttcacccccaccggggtggtgatgggcgcccgcatcagcgagtacctgctggagaagagcagggtcatcaagcaggccgcccgggagaagaacttccacatcttctactacatctatgccggcctgcaccaccagaagaagctgagtgacttccggctgcctgaggagaagccaccccgctacatcgcagatgagaccggccgggtgatgcatgacatcaccagcaaggagagctaccgccggcagtttgaggccatccagcactgcttccgcatcatcggcttcacagacaaggaggtgcacagcgtgtaccgcatcctggccggcatcctgaacatcggcaacatcgagtttgctgccatcagcagccagcaccagacagacaagtctgaggtgcccaatgctgaggccctgcagaatgctgcctctgtgctgtgcatcagccctgaggagctgcaggaggccctgaccagccactgtgtggtgaccagaggagagaccatcatccgggccaacacagtggacagagctgctgatgtgagagatgccatgagcaaggccctgtatggccgcctcttctcctggatcgtgaaccgcatcaacaccctgctgcagccagatgagaacatctgcagcgctgggggcggcatgaatgtgggcatcctggacatctttggatttgagaacttccagaggaacagctttgagcagctgtgcatcaacatcgccaatgagcagatccagtactacttcaaccagcacgtgtttgccctggagcagatggagtaccagaatgaaggaattgatgctgtgcctgtggagtatgaggacaaccggcccctgctggacatgttcctgcagaagcccctgggcctgctggccctgctggatgaggagagccgcttcccccaggccacagaccagaccctggtggacaagtttgaggacaacctgcgctgcaagtacttctggaggcccaagggcgtggagctgtgcttcggcatccagcactacgccggcaaggtgctgtatgatgccagcggcgtgctggagaagaacagagacaccctgcctgcagatgtggtggtggtgctgcggaccagcgagaacaagctgctgcagcagctgttcagcatccccctgaccaagacaggcaacctggcccagacccgggcccgcatcaccgtggccagcagcagcctgcccccccacttctctgctgggaaggccaaggtggacaccctggaggtgatccgccaccctgaggagaccaccaacatgaagaggcagacagtggccagctacttccgctacagcctgatggacctgctgagcaagatggtggtgggccagccccactttgtgcgctgcatcaagcccaatgatgaccgggaggccctgcagttcagccgggagcgggtgctggcccagctgcggagcacaggcatcctggagaccgtgtccatccggcggcagggctacagccaccgcatcctgtttgaggagtttgtgaagcgctactactacctggccttcaccgcccaccagacccccctggccagcaaggagagctgtgtggccatcctggagaagagccggctggaccactgggtgctgggcaagaccaaggtgttcctgaagtactaccacgtggagcagctgaacctgctgctgcgggaggtgattggccgggtggtggtgctgcaggcctacaccaagggctggctgggcgcccggcgctacaagagggtgcgggagaagcgggagaagggggccatcgccatccagagcgcctggaggggctatgatgcccggaggaagttcaagaagatcagcaacagaagaaatgaatctgctgcccacaaccaggccggggacaccagcaaccagagcagcggcccccacagccctgtggccgccggcacccggggcagcgctgaggtgcaggactgcagcgagcccggggaccacaaggtgctgcggggctctgtgcaccggcgcagccacagccaggccgagagcaacaacggccgcacccagaccagcagcaacagccctgctgtgacagagaagaatggccacagccaggcccagagcagccccaagggctgtgacatctttgctggccacgccaacaagcacagcgtgtctggaacagacctgctgagcagccgcatctgccacccagccccagaccagcagggcctgagcctgtggggcgccccccagaagccagccttcccccactacggctgcaacttctacggcttcaggaagtggagctgcacagaggccagcaacaccagccccaccatgtctgctgcccagaatgctgagtag

SEQ ID NO: 160802 - DNA, 4053 bp, Artificial Sequence
  Description of Artificial Sequence: Synthetic coding sequence
atgctgcagagcgccctgctgagcaccaggaagcacctgtatggcctcttccactacaaccccatgatgctgggcctggagagcctgcctgaccccacagacacctgggagatcatcgagaccatcggcaagggcacctacggcaaggtgtacaaggtgaccaacaagagagatggcagcctggccgctgtgaagatcctggaccctgtgtctgacatggatgaggagattgaagctgagtacaacatcctgcagttcctgcccaaccaccccaacgtggtgaagttctacggcatgttctacaaggctgaccactgtgtgggcggccagctgtggctggtgctggagctgtgcaatggaggctctgtgacagagctggtgaagggcctgctgcgctgtggccagaggctggatgaggccatgatctcctacatcctgtatggagccctgctgggcctgcagcacctgcacaacaaccgcatcatccacagagatgtgaagggcaacaacatcctgctgaccacagaaggaggagtgaagctggtggactttggagtgtctgcccagctgaccagcacccggctgcggaggaacacctctgtgggcacccccttctggatggcccctgaggtgattgcctgtgagcagcagtatgacagcagctatgatgcccgctgtgatgtgtggagcctgggcatcacagccatcgagctgggagatggagacccccccctgtttgacatgcaccctgtgaagaccctcttcaagatccccagaaatcctccacccaccctgctgcaccctgagaagtggtgtgaggagttcaaccacttcatcagccagtgcctgatcaaggactttgaaagaagacccagcgtgacccacctgctggaccaccccttcatcaagggcgtgcacggcaaggtgctcttcctgcagaagcagctggccaaggtgctgcaggaccagaagcaccagaaccctgtggccaagaccaggcatgagaggatgcacacccggcggccctaccacgtggaggatgctgagaagtactgcctggaggatgacctggtgaacctggaggtgctggatgaggacaccatcatccaccagctgcagaagagatatgctgacctgctgatctacacctacgtgggggacatcctgattgccctgaaccccttccagaacctgagcatctacagcccccagttcagccggctgtaccacggcgtgaagagggccagcaaccccccccacatctttgccagcgcagatgctgcctaccagtgcatggtgaccctgagcaaggaccagtgcatcgtcatcagcggggagagcggcagcggcaagacagagagcgcccacctgattgtgcagcacctgaccttcctgggcaaggccaacaaccagaccctgcgggagaagatcctgcaggtgaacagcctggtggaggcctttggaaacagctgcacagccatcaatgacaacagcagcagatttgggaagtacctggagatgatgttcacccccaccggggtggtgatgggcgcccgcatcagcgagtacctgctggagaagagcagggtcatcaagcaggccgcccgggagaagaacttccacatcttctactacatctatgccggcctgcaccaccagaagaagctgagtgacttccggctgcctgaggagaagccaccccgctacatcgcagatgagaccggccgggtgatgcatgacatcaccagcaaggagagctaccgccggcagtttgaggccatccagcactgcttccgcatcatcggcttcacagacaaggaggtgcacagcgtgtaccgcatcctggccggcatcctgaacatcggcaacatcgagtttgctgccatcagcagccagcaccagacagacaagtctgaggtgcccaatgctgaggccctgcagaatgctgcctctgtgctgtgcatcagccctgaggagctgcaggaggccctgaccagccactgtgtggtgaccagaggagagaccatcatccgggccaacacagtggacagagctgctgatgtgagagatgccatgagcaaggccctgtatggccgcctcttctcctggatcgtgaaccgcatcaacaccctgctgcagccagatgagaacatctgcagcgctgggggcggcatgaatgtgggcatcctggacatctttggatttgagaacttccagaggaacagctttgagcagctgtgcatcaacatcgccaatgagcagatccagtactacttcaaccagcacgtgtttgccctggagcagatggagtaccagaatgaaggaattgatgctgtgcctgtggagtatgaggacaaccggcccctgctggacatgttcctgcagaagcccctgggcctgctggccctgctggatgaggagagccgcttcccccaggccacagaccagaccctggtggacaagtttgaggacaacctgcgctgcaagtacttctggaggcccaagggcgtggagctgtgcttcggcatccagcactacgccggcaaggtgctgtatgatgccagcggcgtgctggagaagaacagagacaccctgcctgcagatgtggtggtggtgctgcggaccagcgagaacaagctgctgcagcagctgttcagcatccccctgaccaagacaggcaacctggcccagacccgggcccgcatcaccgtggccagcagcagcctgcccccccacttctctgctgggaaggccaaggtggacaccctggaggtgatccgccaccctgaggagaccaccaacatgaagaggcagacagtggccagctacttccgctacagcctgatggacctgctgagcaagatggtggtgggccagccccactttgtgcgctgcatcaagcccaatgatgaccgggaggccctgcagttcagccgggagcgggtgctggcccagctgcggagcacaggcatcctggagaccgtgtccatccggcggcagggctacagccaccgcatcctgtttgaggagtttgtgaagcgctactactacctggccttcaccgcccaccagacccccctggccagcaaggagagctgtgtggccatcctggagaagagccggctggaccactgggtgctgggcaagaccaaggtgttcctgaagtactaccacgtggagcagctgaacctgctgctgcgggaggtgattggccgggtggtggtgctgcaggcctacaccaagggctggctgggcgcccggcgctacaagagggtgcgggagaagcgggagaagggggccatcgccatccagagcgcctggaggggctatgatgcccggaggaagttcaagaagatcagcaacagaagaaatgaatctgctgcccacaaccaggccggggacaccagcaaccagagcagcggcccccacagccctgtggccgccggcacccggggcagcgctgaggtgcaggactgcagcgagcccggggaccacaaggtgctgcggggctctgtgcaccggcgcagccacagccaggccgagagcaacaacggccgcacccagaccagcagcaacagccctgctgtgacagagaagaatggccacagccaggcccagagcagccccaagggctgtgacatctttgctggccacgccaacaagcacagcgtgtctggaacagacctgctgagcagccgcatctgccacccagccccagaccagcagggcctgagcctgtggggcgccccccagaagccaggctctgaaaatggcctggcccagaagcacaggaccccaagaagacgctgccagcagcccaagatgctgagcagccctgaggacaccatgtactacaaccagctgaatggcaccctggagtaccagggcagcaagaggaagcccaggaagctgggccagatcaaggtgctggatggagaagatgagtactacaagagcctgagccctgtggactgcatccctgaggagaacaacagcgcccaccccagcttcttcagcagcagcagcaaaggagacagctttgcccagcactag

SEQ ID NO: 160803 - DNA, 4026 bp, Artificial Sequence
  Description of Artificial Sequence: Synthetic coding sequence
atgaagcacctgtatggcctcttccactacaaccccatgatgctgggcctggagagcctgcctgaccccacagacacctgggagatcatcgagaccatcggcaagggcacctacggcaaggtgtacaaggtgaccaacaagagagatggcagcctggccgctgtgaagatcctggaccctgtgtctgacatggatgaggagattgaggccgagtacaacatcctgcagttcctgcccaaccaccccaacgtggtgaagttctacggcatgttctacaaggctgaccactgtgtgggcggccagctgtggctggtgctggagctgtgcaatggaggctctgtgacagagctggtgaagggcctgctgcgctgtggccagaggctggatgaggccatgatctcctacatcctgtatggagccctgctgggcctgcagcacctgcacaacaaccgcatcatccacagagatgtgaagggcaacaacatcctgctgaccacagagggcggcgtgaagctggtggactttggagtgtctgcccagctgaccagcacccggctgcggaggaacacctctgtgggcacccccttctggatggcccctgaggtgattgcctgtgagcagcagtatgacagcagctatgatgcccgctgtgatgtgtggagcctgggcatcacagccatcgagctgggagatggagacccccccctgtttgacatgcaccctgtgaagaccctcttcaagatccccaggaaccccccacccaccctgctgcaccctgagaagtggtgtgaggagttcaaccacttcatcagccagtgcctgatcaaggactttgagcggcggcccagcgtgacccacctgctggaccaccccttcatcaagggcgtgcacggcaaggtgctcttcctgcagaagcagctggccaaggtgctgcaggaccagaagcaccagaaccctgtggccaagaccaggcatgagaggatgcacacccggcggccctaccacgtggaggatgctgagaagtactgcctggaggatgacctggtgaacctggaggtgctggatgaggacaccatcatccaccagctgcagaagagatatgctgacctgctgatctacacctacgtgggggacatcctgattgccctgaaccccttccagaacctgagcatctacagcccccagttcagccggctgtaccatggagtgaagagggccagcaaccccccccacatctttgccagcgcagatgctgcctaccagtgcatggtgaccctgagcaaggaccagtgcatcgtcatctctggagagagcggcagcggcaagacagaaagtgcccacctgattgtgcagcacctgaccttcctgggcaaggccaacaaccagaccctgcgggagaagatcctgcaggtgaacagcctggtggaggccttcggcaacagctgcacagccatcaatgacaacagcagcagatttgggaagtacctggagatgatgttcacccccactggagtggtgatgggcgcccgcatcagcgagtacctgctggagaagagcagggtcatcaagcaggccgcccgggagaagaacttccacatcttctactacatctatgccggcctgcaccaccagaagaagctgagtgacttccggctgcctgaggagaagcccccacgctacatcgcagatgaaacaggccgggtgatgcatgacatcaccagcaaggagagctaccgccggcagtttgaggccatccagcactgcttccgcatcatcggcttcacagacaaggaggtgcacagcgtgtaccgcatcctggccggcatcctgaacatcggcaacattgaatttgctgccatcagcagccagcaccagacagacaagtctgaggtgcccaatgctgaggccctgcagaatgctgcctctgtgctgtgcatcagccctgaggagctgcaggaggccctgaccagccactgtgtggtgaccagaggagagaccatcatccgggccaacacagtggacagagctgctgatgtgagagatgccatgagcaaggccctgtatggccgcctcttctcctggatcgtgaaccgcatcaacaccctgctgcagccagatgagaacatctgcagcgctgggggcggcatgaatgtgggcatcctggacatcttcggctttgagaacttccagagaaattcctttgagcagctgtgcatcaacatcgccaatgagcagatccagtactacttcaaccagcacgtgtttgccctggagcagatggagtaccagaatgaaggaattgatgctgtgcctgtggagtatgaggacaaccggcccctgctggacatgttcctgcagaagcccctgggcctgctggccctgctggatgaggagagccgcttcccccaggccacagaccagaccctggtggacaagtttgaggacaacctgcgctgcaagtacttctggaggcccaagggcgtggagctgtgcttcggcatccagcactacgccggcaaggtgctgtatgatgccagcggcgtgctggagaagaacagagacaccctgcctgcagatgtggtggtggtgctgcggaccagcgagaacaagctgctgcagcagctgttcagcatccccctgaccaagacaggcaacctggcccagacccgggcccgcatcaccgtggccagcagcagcctgcccccccacttctctgctgggaaggccaaggtggacaccctggaggtgatccgccaccctgaggagaccaccaacatgaagaggcagacagtggccagctacttccgctacagcctgatggacctgctgagcaagatggtggtgggccagccccactttgtgcgctgcatcaagcccaatgatgaccgggaggccctgcagttcagccgggagcgggtgctggcccagctgcggagcacaggcatcctggagaccgtgtccatccggcggcagggctacagccaccgcatcctgtttgaggagtttgtgaagcgctactactacctggccttcaccgcccaccagacccccctggccagcaaggagagctgtgtggccatcctggagaagagccggctggaccactgggtgctgggcaagaccaaggtgttcctgaagtactaccacgtggagcagctgaacctgctgctgcgggaggtgattggccgggtggtggtgctgcaggcctacaccaagggctggctgggcgcccggcgctacaagagggtgcgggagaagcgggagaagggggccatcgccatccagagcgcctggaggggctatgatgcccggaggaagttcaagaagatcagcaacagaagaaatgaatctgctgcccacaaccaggccggggacaccagcaaccagagcagcggcccccacagccctgtggccgccggcacccggggcagcgctgaggtgcaggactgcagcgagcccggggaccacaaggtgctgcggggctctgtgcacagaagaagccacagccaggccgagagcaacaatggaagaacccagaccagcagcaacagccctgctgtgacagagaagaatggccacagccaggcccagagcagccccaagggctgtgacatctttgctggccacgccaacaagcacagcgtgtctggaacagacctgctgagcagccgcatctgccacccagccccagaccagcagggcctgagcctgtggggcgccccccagaagccaggctctgaaaatggcctggcccagaagcacaggaccccccggcggcgctgccagcagcccaagatgctgagcagccctgaggacaccatgtactacaaccagctgaatggcaccctggagtaccagggcagcaagaggaagcccaggaagctgggccagatcaaggtgctggatggagaagatgagtactacaagagcctgagccctgtggactgcatccctgaggagaacaacagcgcccaccccagcttcttcagcagcagcagcaagggggacagctttgcccagcactag

SEQ ID NO: 160804 - DNA, 3945 bp, Artificial Sequence
  Description of Artificial Sequence: Synthetic coding sequence
atgaagcacctgtatggcctcttccactacaaccccatgatgctgggcctggagagcctgcctgaccccacagacacctgggagatcatcgagaccatcggcaagggcacctacggcaaggtgtacaaggtgaccaacaagagagatggcagcctggccgctgtgaagatcctggaccctgtgtctgacatggatgaggagattgaggccgagtacaacatcctgcagttcctgcccaaccaccccaacgtggtgaagttctacggcatgttctacaaggctgaccactgtgtgggcggccagctgtggctggtgctggagctgtgcaatggaggctctgtgacagagctggtgaagggcctgctgcgctgtggccagaggctggatgaggccatgatctcctacatcctgtatggagccctgctgggcctgcagcacctgcacaacaaccgcatcatccacagagatgtgaagggcaacaacatcctgctgaccacagagggcggcgtgaagctggtggactttggagtgtctgcccagctgaccagcacccggctgcggaggaacacctctgtgggcacccccttctggatggcccctgaggtgattgcctgtgagcagcagtatgacagcagctatgatgcccgctgtgatgtgtggagcctgggcatcacagccatcgagctgggagatggagacccccccctgtttgacatgcaccctgtgaagaccctcttcaagatccccaggaaccccccacccaccctgctgcaccctgagaagtggtgtgaggagttcaaccacttcatcagccagtgcctgatcaaggactttgagcggcggcccagcgtgacccacctgctggaccaccccttcatcaagggcgtgcacggcaaggtgctcttcctgcagaagcagctggccaaggtgctgcaggaccagaagcaccagaaccctgtggccaagaccaggcatgagaggatgcacacccggcggccctaccacgtggaggatgctgagaagtactgcctggaggatgacctggtgaacctggaggtgctggatgaggacaccatcatccaccagctgcagaagagatatgctgacctgctgatctacacctacgtgggggacatcctgattgccctgaaccccttccagaacctgagcatctacagcccccagttcagccggctgtaccatggagtgaagagggccagcaaccccccccacatctttgccagcgcagatgctgcctaccagtgcatggtgaccctgagcaaggaccagtgcatcgtcatctctggagagagcggcagcggcaagacagaaagtgcccacctgattgtgcagcacctgaccttcctgggcaaggccaacaaccagaccctgcgggagaagatcctgcaggtgaacagcctggtggaggccttcggcaacagctgcacagccatcaatgacaacagcagcagatttgggaagtacctggagatgatgttcacccccactggagtggtgatgggcgcccgcatcagcgagtacctgctggagaagagcagggtcatcaagcaggccgcccgggagaagaacttccacatcttctactacatctatgccggcctgcaccaccagaagaagctgagtgacttccggctgcctgaggagaagcccccacgctacatcgcagatgaaacaggccgggtgatgcatgacatcaccagcaaggagagctaccgccggcagtttgaggccatccagcactgcttccgcatcatcggcttcacagacaaggaggtgcacagcgtgtaccgcatcctggccggcatcctgaacatcggcaacattgaatttgctgccatcagcagccagcaccagacagacaagtctgaggtgcccaatgctgaggccctgcagaatgctgcctctgtgctgtgcatcagccctgaggagctgcaggaggccctgaccagccactgtgtggtgaccagaggagagaccatcatccgggccaacacagtggacagagctgctgatgtgagagatgccatgagcaaggccctgtatggccgcctcttctcctggatcgtgaaccgcatcaacaccctgctgcagccagatgagaacatctgcagcgctgggggcggcatgaatgtgggcatcctggacatcttcggctttgagaacttccagagaaattcctttgagcagctgtgcatcaacatcgccaatgagcagatccagtactacttcaaccagcacgtgtttgccctggagcagatggagtaccagaatgaaggaattgatgctgtgcctgtggagtatgaggacaaccggcccctgctggacatgttcctgcagaagcccctgggcctgctggccctgctggatgaggagagccgcttcccccaggccacagaccagaccctggtggacaagtttgaggacaacctgcgctgcaagtacttctggaggcccaagggcgtggagctgtgcttcggcatccagcactacgccggcaaggtgctgtatgatgccagcggcgtgctggagaagaacagagacaccctgcctgcagatgtggtggtggtgctgcggaccagcgagaacaagctgctgcagcagctgttcagcatccccctgaccaagacaggcaacctggcccagacccgggcccgcatcaccgtggccagcagcagcctgcccccccacttctctgctgggaaggccaaggtggacaccctggaggtgatccgccaccctgaggagaccaccaacatgaagaggcagacagtggccagctacttccgctacagcctgatggacctgctgagcaagatggtggtgggccagccccactttgtgcgctgcatcaagcccaatgatgaccgggaggccctgcagttcagccgggagcgggtgctggcccagctgcggagcacaggcatcctggagaccgtgtccatccggcggcagggctacagccaccgcatcctgtttgaggagtttgtgaagcgctactactacctggccttcaccgcccaccagacccccctggccagcaaggagagctgtgtggccatcctggagaagagccggctggaccactgggtgctgggcaagaccaaggtgttcctgaagtactaccacgtggagcagctgaacctgctgctgcgggaggtgattggccgggtggtggtgctgcaggcctacaccaagggctggctgggcgcccggcgctacaagagggtgcgggagaagcgggagaagggggccatcgccatccagagcggggacaccagcaaccagagcagcggcccccacagccctgtggccgccggcacccggggcagcgctgaggtgcaggactgcagcgagcccggggaccacaaggtgctgcggggctctgtgcaccggcgcagccacagccaggccgagagcaacaacggccgcacccagaccagcagcaacagccctgctgtgacagagaagaatggccacagccaggcccagagcagccccaagggctgtgacatctttgctggccacgccaacaagcacagcgtgtctggaacagacctgctgagcagccgcatctgccacccagccccagaccagcagggcctgagcctgtggggcgccccccagaagccaggctctgaaaatggcctggcccagaagcacaggaccccaagaagacgctgccagcagcccaagatgctgagcagccctgaggacaccatgtactacaaccagctgaatggcaccctggagtaccagggcagcaagaggaagcccaggaagctgggccagatcaaggtgctggatggagaagatgagtactacaagagcctgagccctgtggactgcatccctgaggagaacaacagcgcccaccccagcttcttcagcagcagcagcaaaggagacagctttgcccagcactag

SEQ ID NO: 160805 - DNA, 3390 bp, Artificial Sequence
  Description of Artificial Sequence: Synthetic coding sequence
atgaacatcaatgatggcggcagaagaagatttgaggacaatgagcacaccctgcgcatctacccaggggccatcagcgagggcaccatctactgccccatcccagccaggaagaacagcacagctgctgaggtgattgagagcctcatcaacaagctgcacctggacaagaccaagtgctacgtgctggccgaggtgaaggagtttggaggagaggagtggatcctgaaccccacagactgccctgtgcagaggatgatgctgtggcccaggatggccctggagaaccggctgtctggagaggactaccgcttcctgctgcgggagaagaacctggatggcagcatccactacggcagcctgcagagctggctgcgggtgacagaggagaggaggaggatgatggagcggggcttcctgccccagccccagcagaaggactttgatgacctgtgcagcctgcctgacctgaatgagaagaccctgctggagaacctgaggaaccgcttcaagcatgagaagatctacacctacgtgggcagcatcctgattgtcatcaaccccttcaagttcctgcccatctacaaccccaagtatgtgaagatgtatgacaaccaccagctgggcaagctggagccccacatctatgctgtggctgatgtggcctaccacgccatgctgcagaggaagaagaaccagtgcatcgtcatcagcggggagagcggcagcggcaagacccagagcaccaacttcctgatccaccacctgacagccctgagccagaagggctttgccagcggcgtggagcagatcatcctgggcgccggccctgtgctggaggcctttggaaatgccaagacagcccacaacaacaacagcagcagatttgggaagttcatccaggtgaactaccaggagactggaacagtgctgggcgcctacgtggagaagtacctgctggagaagagccggctggtgtaccaggagcacaatgaaagaaactaccacgtgttctactacctgctggccggggcctctgaagatgagaggtctgccttccacctgaagcagcctgaggagtaccactacctgaaccaggactgcttcaccgtggagggggaggacctgcggcatgactttgagcggctgcagctggccatggagatggtgggcttcctgcccaagacccggcggcagatcttcagcctgctgagcgccatcctgcacctgggcaacatctgctacaagaagaagacctacagagatgacagcattgacatctgcaaccctgaggtgctgcccatcgtgtctgagctgctggaggtgaaggaggagatgctgtttgaggccctggtgaccaggaagacagtgacagtgggggagaagctgatcctgccctacaagctggccgaggccgtgacagtgaggaacagcatggccaagagcctgtacagcgccctgtttgactggatcgtgttccgcatcaaccacgccctgctgaacagcaaggacctggagcacaacaccaagaccctgagcattggagtgctggacatcttcggctttgaagattatgagaacaacagctttgagcagttctgcatcaactttgccaatgaaaggctgcagcactacttcaaccagcacatcttcaagctggagcaggaggagtacagaacagagggcatctcctggcacaacatcgactacatcgacaacacctgctgcatcaacctgatcagcaagaagcccaccggcctgctgcacctgctggatgaggagagcaacttcccccaggccaccaaccagaccctgctggacaagttcaagcaccagcacgaggacaacagctacatcgagttccctgctgtgatggagcccgccttcatcatcaagcactacgccggcaaggtgaagtatggagtgaaggacttccgggagaagaacacagaccacatgaggccagacatcgtggccctgctgcggagcagcaagaatgccttcatcagcggcatgattggaattgatcctgtggccgtgttccgctgggccatcctgcgggccttcttccgggccatggtggccttccgggaggccggcaagaggaacatccacaggaagacaggccatgatgacacagccccctgtgccatcctgaagtccatggacagcttctccttcctgcagcaccctgtgcaccagaggagcctggagatcctgcagcgctgcaaggaggagaagtacagcatcaccaggaagaaccccaggacccccctgagtgacctgcagggcatgaatgccctgaatgagaagaaccagcacgacacctttgatattgcctggaatggccgcacaggcatccggcagagccggctgagcagcggcaccagcctgctggacaaggatggcatctttgccaacagcaccagcagcaagctgctggagcgggcccacggcatcctgaccaggaacaagaacttcaagagcaagccagccctgcccaagcacctgctggaggtgaacagcctgaagcacctgacccggctgaccctgcaggaccgcatcaccaagagcctgctgcacctgcacaagaagaagaagccacccagcatcagcgcccagttccaggccagcctgagcaagctgatggagaccctgggccaggccgagccctactttgtgaagtgcatccgcagcaatgctgagaagctgcccctgcgcttcagtgatgtgctggtgctgcggcagctgcgctacacaggcatgctggagaccgtgcgcatccggcagagcggctacagcagcaagtacagcttccaggactttgtgagccacttccacgtgctgctgcccaggaacatcatccccagcaagttcaacatccaggacttcttcaggaagatcaacctgaacccagacaactaccaggtgggcaagaccatggtgttcctgaaggagcaggagcggcagcacctgcaggacctgctgcaccaggaggtgctgcggcgcatcatcctgctgcagcgctggttccgggtgctgctgtgccggcagcacttcctgcacctgcggcaggccagcgtcatcatccagcgcttctggaggaactacctgaaccagaagcaggtgagagatgctgctgtgcagaaggatgcctttgtgatggccagcgctgctgccctgctgcaggcctcctggagggcccacctggagcggcagcgctacctggagctgcgggctgctgccatcgtcatccagcagaagtggagggactactacagaagaagacacatggccgccatctgcatccaggcccgctggaaggcctaccgggagagcaagcgctaccaggagcagaggaagaactacccctttgccatcaacatgtag

SEQ ID NO: 160806 - DNA, 7647 bp, Artificial Sequence
  Description of Artificial Sequence: Synthetic coding sequence
atgaacatcaatgatggcggcagaagaagatttgaggacaatgagcacaccctgcgcatctacccaggggccatcagcgagggcaccatctactgccccatcccagccaggaagaacagcacagctgctgaggtgattgagagcctcatcaacaagctgcacctggacaagaccaagtgctacgtgctggccgaggtgaaggagtttggaggagaggagtggatcctgaaccccacagactgccctgtgcagaggatgatgctgtggcccaggatggccctggagaaccggctgtctggagaggactaccgcttcctgctgcgggagaagaacctggatggcagcatccactacggcagcctgcagagctggctgcgggtgacagaggagaggaggaggatgatggagcggggcttcctgccccagccccagcagaaggactttgatgacctgtgcagcctgcctgacctgaatgagaagaccctgctggagaacctgaggaaccgcttcaagcatgagaagatctacacctacgtgggcagcatcctgattgtcatcaaccccttcaagttcctgcccatctacaaccccaagtatgtgaagatgtatgacaaccaccagctgggcaagctggagccccacatctatgctgtggctgatgtggcctaccacgccatgctgcagaggaagaagaaccagtgcatcgtcatcagcggggagagcggcagcggcaagacccagagcaccaacttcctgatccaccacctgacagccctgagccagaagggctttgccagcggcgtggagcagatcatcctgggcgccggccctgtgctggaggcctttggaaatgccaagacagcccacaacaacaacagcagcagatttgggaagttcatccaggtgaactaccaggagactggaacagtgctgggcgcctacgtggagaagtacctgctggagaagagccggctggtgtaccaggagcacaatgaaagaaactaccacgtgttctactacctgctggccggggcctctgaagatgagaggtctgccttccacctgaagcagcctgaggagtaccactacctgaaccagatcaccaagaagcccctgcggcagagctgggatgactactgctatgattctgagccagactgcttcaccgtggagggggaggacctgcggcatgactttgagcggctgcagctggccatggagatggtgggcttcctgcccaagacccggcggcagatcttcagcctgctgagcgccatcctgcacctgggcaacatctgctacaagaagaagacctacagagatgacagcattgacatctgcaaccctgaggtgctgcccatcgtgtctgagctgctggaggtgaaggaggagatgctgtttgaggccctggtgaccaggaagacagtgacagtgggggagaagctgatcctgccctacaagctggccgaggccgtgacagtgagaaattccatggccaagagcctgtacagcgccctgtttgactggatcgtgttccgcatcaaccacgccctgctgaacagcaaggacctggagcacaacaccaagaccctgagcattggagtgctggacatctttggatttgaggactatgagaacaacagctttgagcagttctgcatcaactttgccaatgaaaggctgcagcactacttcaaccagcacatcttcaagctggagcaggaggagtacagaacagagggcatctcctggcacaacatcgactacatcgacaacacctgctgcatcaacctgatcagcaagaagcccaccggcctgctgcacctgctggatgaggagagcaacttcccccaggccaccaaccagaccctgctggacaagttcaagcaccagcacgaggacaacagctacatcgagttccctgctgtgatggagcccgccttcatcatcaagcactacgccggcaaggtgaagtatggagtgaaggacttccgggagaagaacacagaccacatgaggccagacatcgtggccctgctgcggagcagcaagaatgccttcatcagcggcatgattggcatcgaccctgtggccgtgttccgctgggccatcctgcgggccttcttccgggccatggtggccttccgggaggccggcaagaggaacatccacaggaagacaggccatgatgacacagccccctgtgccatcctgaagtccatggacagcttctccttcctgcagcaccctgtgcaccagaggagcctggagatcctgcagcgctgcaaggaggagaagtacagcatcaccaggaagaaccccaggacccccctgagtgacctgcagggcatgaatgccctgaatgagaagaaccagcacgacacctttgacatcgcctggaatggaagaacaggcatccggcagagccggctgagcagcggcaccagcctgctggacaaggatggcatctttgccaacagcaccagcagcaagctgctggagcgggcccacggcatcctgaccaggaacaagaacttcaagagcaagccagccctgcccaagcacctgctggaggtgaacagcctgaagcacctgacccggctgaccctgcaggaccgcatcaccaagagcctgctgcacctgcacaagaagaagaagcccccatccatcagcgcccagttccaggccagcctgagcaagctgatggagaccctgggccaggccgagccctactttgtgaagtgcatccgcagcaatgctgagaagctgcccctgcgcttcagtgatgtgctggtgctgcggcagctgcgctacacaggcatgctggagaccgtgcgcatccggcagagcggctacagcagcaagtacagcttccaggactttgtgagccacttccacgtgctgctgcccaggaacatcatccccagcaagttcaacatccaggacttcttcaggaagatcaacctgaacccagacaactaccaggtgggcaagaccatggtgttcctgaaggagcaggagcggcagcacctgcaggacctgctgcaccaggaggtgctgcggcgcatcatcctgctgcagcgctggttccgggtgctgctgtgccggcagcacttcctgcacctgcggcaggccagcgtcatcatccagcgcttctggaggaactacctgaaccagaagcaggtgagagatgctgctgtgcagaaggatgcctttgtgatggccagcgctgctgccctgctgcaggcctcctggagggcccacctggagcggcagcgctacctggagctgcgggccgccgccatcgtcatccagcagaagtggagggactactacagaagaagacacatggccgccatctgcatccaggcccgctggaaggcctaccgggagagcaagcgctaccaggagcagaggaagaagatcatcctgctgcagagcacctgccggggcttccgggcccggcagcgcttcaaggccctgaaggagcagaggctgcgggagaccaagccagaggtgggcctggtgaacatcaagggctacggcagcctggagatccagggcagtgaccccagcggctgggaggactgcagctttgacaaccgcatcaaggccatcgaggagtgcaagtctgtgattgagagcaaccgcatcagccgggagagctctgtggactgcctgaaggagagccccaacaagcagcaggagcgggcccagagccagagcggcgtggacctgcaggaggatgtgctggtgcgggagcggcccaggagcctggaggacctgcaccagaagaaggtgggccgggccaagcgggagagcaggaggatgagggagctggagcaggccatcttcagcctggagctgctgaaggtgcgcagcctgggcggcatcagccccagcgaggaccggcgctggagcacagagctggtgcctgagggcctgcagagcccccggggcaccccagacagcgagagcagccagggcagcctggagctgctgtcctatgaggagagccagaagagcaagctggagagcgtcatcagtgatgaaggagacctgcagttccccagccccaagatcagcagcagccccaagtttgacagccgggacaatgccctgagcgccagcaatgagaccagcagcgctgagcacctgaaggatggcaccatgaaggagatggtggtgtgcagcagcgagagcatcacctgcaagccccagctgaaggacagcttcatcagcaacagcctgcccaccttcttctacatcccccagcaggaccccctgaagaccaacagccagctggacaccagcatccagaggaacaagctgctggagaatgaagacacagctggggaggccctgaccctggacatcaaccgggagacccggcgctaccactgcagcggcaaggaccagatcgtgcccagcctgaacacagagagcagcaaccctgtgctgaagaagctggagaagctgaacacagagaaggaggagcggcagaagcagctgcagcagcagaatgagaaggagatgatggagcagatccggcagcagacagacatcctggagaaggagaggaaggccttcaagaccatcgagaagccccgcatcggggagtgcctggtggcccccagcagctaccagagcaagcagagggtggagcggcccagcagcctgctgagcctgaacaccagcaacaagggggagctgaatgtgctgggcagcctgagcctgaaggatgctgccctggcccagaaggacagcagcagcgcccacctgccccccaaggacaggcctgtgaccgtcttctttgagaggaagggcagcccctgccagagcagcacagtgaaggagctgagcaagacagacaggatgggcacccagctgaatgtggcctgcaagctgagcaacaaccgcatcagcaagcgggagcacttccggcccacccagagctacagccacaacagtgatgacctgagccgggagggcaatgcccggcccatcttcttcacccccaaggacaacatgagcatccccctggtgtccaaggaggccctgaacagcaagaacccccagctgcacaaggaggatgagcccgcctggaagcctgtgaagctggccggccctggccagcgggagaccagccagcgcttcagctctgtggatgagcaggccaagctgcacaagaccatgagccagggcgagatcaccaagctggccgtgcggcagaaggccagtgacagcgacatccggccccagagggccaagatgaggttctgggccaagggcaagcagggcgagaagaagaccaccagggtgaagcccaccacccagagcgaggtgagccccctgtttgctggaacagatgtgatcccagcccaccagttcccagatgagctggccgcctaccaccccaccccacccctgagccctgagctgcccggcagctgcaggaaggagttcaaggagaacaaggagcccagccccaaggccaagaggaagaggtctgtgaagatcagcaatgtggccctggacagcatgcactggcagaatgacagcgtgcagatcatcgcctctgtgtctgacctgaagtccatggatgagttcctgctgaagaaggtgaatgacctggacaatgaagacagcaagaaggacaccctggtggatgtggtgttcaagaaggccctgaaggagttccggcagaacatcttctccttctacagcagcgccctggccatggatgatggcaagagcatccgctacaaggacctgtatgccctgtttgagcagatcctggagaagaccatgaggctggagcagagggacagcctgggggagagccctgtgcgggtgtgggtgaacaccttcaaggtgttcctggatgagtacatgaatgagttcaagaccagtgactgcacagccaccaaggtgcccaagacagagaggaagaagaggaggaagaaggagacagacctggtggaggagcacaacggccacatcttcaaggccacccagtacagcatccccacctactgtgagtactgcagcagcctcatctggatcatggaccgggcctctgtgtgcaagctgtgcaagtatgcctgccacaagaagtgctgcctgaagaccacagccaagtgcagcaagaagtatgaccctgagctgagcagccggcagtttggagtggagctgagccggctgaccagcgaggacagaacagtgcccctggtggtggagaagctgatcaactacatcgagatgcacggcctgtacacagagggcatctacaggaagagcggcagcaccaacaagatcaaggagctgcggcagggcctggacacagatgctgagagcgtgaacctggatgactacaacatccacgtgattgccagcgtcttcaagcagtggctgcgggacctgcccaaccccctgatgacctttgagctgtatgaggagttcctgcgggccatgggcctgcaggagaggaaggagaccatccggggcgtgtacagcgtcatcgaccagctgagcaggacccacctgaacaccctggagcggctcatcttccacctggtgagaattgccctgcaggaggacaccaacaggatgtctgccaatgccctggccatcgtgtttgccccctgcatcctgcgctgcccagacaccacagaccccctgcagagcgtgcaggacatcagcaagaccaccacctgtgtggagctgattgtggtggagcagatgaacaagtacaaggcccggctgaaggacatcagcagcctggagtttgctgagaacaaggccaagacccggctgagcctcatccgccgctccatgggcaagggccgcatcagaagaggcaactacccaggccccagcagccctgtggtggtgcggctgcccagcgtgtctgatgtgtctgaggagaccctgaccagcgaggccgccatggagacagacatcacagagcagcagcaggccgccatgcagcaggaggagcgggtgctgacagagcagatcgagaacctgcagaaggagaaggaggagctgacctttgagatgctggtgctggagccccgggccagtgatgatgagaccctggagagcgaggccagcattggaacagctgacagcagcgagaacctgaacatggagagtgaatatgccatcagcgagaagtctgagaggagcctggccctgagcagcctgaagacagctgggaagtctgagcccagcagcaagctgaggaagcagctgaagaagcagcaggacagcctggatgtggtggacagctctgtgagcagcctgtgcctgagcaacacagccagcagccacggcaccaggaagctgttccagatctacagcaagagccccttctaccgggccgccagcggaaatgaggccctgggcatggagggccccctgggccagaccaagttcctggaggacaagccccagttcatcagccggggcaccttcaaccctgagaagggcaagcagaagctgaagaatgtgaagaacagcccccagaagaccaaggagaccccagagggcaccgtgatgagcggccgcaggaagacagtggaccctgactgcaccagcaaccagcagctggccctgtttggaaataatgagttcatggtgtag

SEQ ID NO: 160807 - DNA, 7860 bp, Artificial Sequence
  Description of Artificial Sequence: Synthetic coding sequence
atgaacatcaatgatggcggcagaagaagatttgaggacaatgagcacaccctgcgcatctacccaggggccatcagcgagggcaccatctactgccccatcccagccaggaagaacagcacagctgctgaggtgattgagagcctcatcaacaagctgcacctggacaagaccaagtgctacgtgctggccgaggtgaaggagtttggaggagaggagtggatcctgaaccccacagactgccctgtgcagaggatgatgctgtggcccaggatggccctggagaaccggctgtctggagaggactaccgcttcctgctgcgggagaagaacctggatggcagcatccactacggcagcctgcagagctggctgcgggtgacagaggagaggaggaggatgatggagcggggcttcctgccccagccccagcagaaggactttgatgacctgtgcagcctgcctgacctgaatgagaagaccctgctggagaacctgaggaaccgcttcaagcatgagaagatctacacctacgtgggcagcatcctgattgtcatcaaccccttcaagttcctgcccatctacaaccccaagtatgtgaagatgtatgacaaccaccagctgggcaagctggagccccacatctatgctgtggctgatgtggcctaccacgccatgctgcagaggaagaagaaccagtgcatcgtcatcagcggggagagcggcagcggcaagacccagagcaccaacttcctgatccaccacctgacagccctgagccagaagggctttgccagcggcgtggagcagatcatcctgggcgccggccctgtgctggaggcctttggaaatgccaagacagcccacaacaacaacagcagcagatttgggaagttcatccaggtgaactaccaggagactggaacagtgctgggcgcctacgtggagaagtacctgctggagaagagccggctggtgtaccaggagcacaatgaaagaaactaccacgtgttctactacctgctggccggggcctctgaagatgagaggtctgccttccacctgaagcagcctgaggagtaccactacctgaaccagatcaccaagaagcccctgcggcagagctgggatgactactgctatgattctgagccagactgcttcaccgtggagggggaggacctgcggcatgactttgagcggctgcagctggccatggagatggtgggcttcctgcccaagacccggcggcagatcttcagcctgctgagcgccatcctgcacctgggcaacatctgctacaagaagaagacctacagagatgacagcattgacatctgcaaccctgaggtgctgcccatcgtgtctgagctgctggaggtgaaggaggagatgctgtttgaggccctggtgaccaggaagacagtgacagtgggggagaagctgatcctgccctacaagctggccgaggccgtgacagtgagaaattccatggccaagagcctgtacagcgccctgtttgactggatcgtgttccgcatcaaccacgccctgctgaacagcaaggacctggagcacaacaccaagaccctgagcattggagtgctggacatctttggatttgaggactatgagaacaacagctttgagcagttctgcatcaactttgccaatgaaaggctgcagcactacttcaaccagcacatcttcaagctggagcaggaggagtacagaacagagggcatctcctggcacaacatcgactacatcgacaacacctgctgcatcaacctgatcagcaagaagcccaccggcctgctgcacctgctggatgaggagagcaacttcccccaggccaccaaccagaccctgctggacaagttcaagcaccagcacgaggacaacagctacatcgagttccctgctgtgatggagcccgccttcatcatcaagcactacgccggcaaggtgaagtatggagtgaaggacttccgggagaagaacacagaccacatgaggccagacatcgtggccctgctgcggagcagcaagaatgccttcatcagcggcatgattggcatcgaccctgtggccgtgttccgctgggccatcctgcgggccttcttccgggccatggtggccttccgggaggccggcaagaggaacatccacaggaagacaggccatgatgacacagccccctgtgccatcctgaagtccatggacagcttctccttcctgcagcaccctgtgcaccagaggagcctggagatcctgcagcgctgcaaggaggagaagtacagcatcaccaggaagaaccccaggacccccctgagtgacctgcagggcatgaatgccctgaatgagaagaaccagcacgacacctttgacatcgcctggaatggaagaacaggcatccggcagagccggctgagcagcggcaccagcctgctggacaaggatggcatctttgccaacagcaccagcagcaagctgctggagcgggcccacggcatcctgaccaggaacaagaacttcaagagcaagccagccctgcccaagcacctgctggaggtgaacagcctgaagcacctgacccggctgaccctgcaggaccgcatcaccaagagcctgctgcacctgcacaagaagaagaagcccccatccatcagcgcccagttccaggccagcctgagcaagctgatggagaccctgggccaggccgagccctactttgtgaagtgcatccgcagcaatgctgagaagctgcccctgcgcttcagtgatgtgctggtgctgcggcagctgcgctacacaggcatgctggagaccgtgcgcatccggcagagcggctacagcagcaagtacagcttccaggactttgtgagccacttccacgtgctgctgcccaggaacatcatccccagcaagttcaacatccaggacttcttcaggaagatcaacctgaacccagacaactaccaggtgggcaagaccatggtgttcctgaaggagcaggagcggcagcacctgcaggacctgctgcaccaggaggtgctgcggcgcatcatcctgctgcagcgctggttccgggtgctgctgtgccggcagcacttcctgcacctgcggcaggccagcgtcatcatccagcgcttctggaggaactacctgaaccagaagcaggtgagagatgctgctgtgcagaaggatgcctttgtgatggccagcgctgctgccctgctgcaggcctcctggagggcccacctggagcggcagcgctacctggagctgcgggccgccgccatcgtcatccagcagaagtggagggactactacagaagaagacacatggccgccatctgcatccaggcccgctggaaggcctaccgggagagcaagcgctaccaggagcagaggaagaagatcatcctgctgcagagcacctgccggggcttccgggcccggcagcgcttcaaggccctgaaggagcagaggctgcgggagaccaagccagaggtgggcctggtgaacatcaagggctacggcagcctggagatccagggcagtgaccccagcggctgggaggactgcagctttgacaaccgcatcaaggccatcgaggagtgcaagtctgtgattgagagcaaccgcatcagccgggagagctctgtggactgcctgaaggagagccccaacaagcagcaggagcgggcccagagccagagcggcgtggacctgcaggaggatgtgctggtgcgggagcggcccaggagcctggaggacctgcaccagaagaaggtgggccgggccaagcgggagagcaggaggatgagggagctggagcaggccatcttcagcctggagctgctgaaggtgcgcagcctgggcggcatcagccccagcgaggaccggcgctggagcacagagctggtgcctgagggcctgcagagcccccggggcaccccagacagcgagagcagccagggcagcctggagctgctgtcctatgaggagagccagaagagcaagctggagagcgtcatcagtgatgaaggagacctgcagttccccagccccaagatcagcagcagccccaagtttgacagccgggacaatgccctgagcgccagcaatgagaccagcagcgctgagcacctgaaggatggcaccatgaaggagatggtggtgtgcagcagcgagagcatcacctgcaagccccagctgaaggacagcttcatcagcaacagcctgcccaccttcttctacatcccccagcaggaccccctgaagaccaacagccagctggacaccagcatccagaggaacaagctgctggagaatgaagacacagctggggaggccctgaccctggacatcaaccgggagacccggcgctaccactgcagcggcaaggaccagatcgtgcccagcctgaacacagagagcagcaaccctgtgctgaagaagctggagaagctgaacacagagaaggaggagcggcagaagcagctgcagcagcagaatgagaaggagatgatggagcagatccggcagcagacagacatcctggagaaggagaggaaggccttcaagaccatcgagaagccccgcatcggggagtgcctggtggcccccagcagctaccagagcaagcagagggtggagcggcccagcagcctgctgagcctgaacaccagcaacaagggggagctgaatgtgctgggcagcctgagcctgaaggatgctgccctggcccagaaggacagcagcagcgcccacctgccccccaaggacaggcctgtgaccgtcttctttgagaggaagggcagcccctgccagagcagcacagtgaaggagctgagcaagacagacaggatgggcacccagctgaatgtggcctgcaagctgagcaacaaccgcatcagcaagcgggagcacttccggcccacccagagctacagccacaacagtgatgacctgagccgggagggcaatgcccggcccatcttcttcacccccaaggacaacatgagcatccccctggtgtccaaggaggccctgaacagcaagaacccccagctgcacaaggaggatgagcccgcctggaagcctgtgaagctggccggccctggccagcgggaggtggcccggcctgcccacaagaagaaggccaggatggcccggaccaggagtgacttcctgacccggggcacctttgctgatggagagggggacacagaggaggatgattatgatgacatcatcgagcccctgctgagcctggaccaggccagccactgtgagctgggccctgcccccagcctgggccaggccagccacagcgacagcgagatgaccagccagcgcttcagctctgtggatgagcaggccaagctgcacaagaccatgagccagggcgagatcaccaagctggccgtgcggcagaaggccagtgacagcgacatccggccccagagggccaagatgaggttctgggccaagggcaagcagggcgagaagaagaccaccagggtgaagcccaccacccagagcgaggtgagccccctgtttgctggaacagatgtgatcccagcccaccagttcccagatgagctggccgcctaccaccccaccccacccctgagccctgagctgcccggcagctgcaggaaggagttcaaggagaacaaggagcccagccccaaggccaagaggaagaggtctgtgaagatcagcaatgtggccctggacagcatgcactggcagaatgattctgtgcagatcatcgcctctgtgtctgacctgaagtccatggatgagttcctgctgaagaaggtgaatgacctggacaatgaagacagcaagaaggacaccctggtggatgtggtgttcaagaaggccctgaaggagttccggcagaacatcttctccttctacagcagcgccctggccatggatgatggcaagagcatccgctacaaggacctgtatgccctgtttgagcagatcctggagaagaccatgaggctggagcagagggacagcctgggggagagccctgtgcgggtgtgggtgaacaccttcaaggtgttcctggatgagtacatgaatgagttcaagaccagtgactgcacagccaccaaggtgcccaagacagagaggaagaagaggaggaagaaggagacagacctggtggaggagcacaacggccacatcttcaaggccacccagtacagcatccccacctactgtgagtactgcagcagcctcatctggatcatggaccgggcctctgtgtgcaagctgtgcaagtatgcctgccacaagaagtgctgcctgaagaccacagccaagtgcagcaagaagtatgaccctgagctgagcagccggcagtttggagtggagctgagccggctgaccagcgaggacagaacagtgcccctggtggtggagaagctgatcaactacatcgagatgcacggcctgtacacagagggcatctacaggaagagcggcagcaccaacaagatcaaggagctgcggcagggcctggacacagatgctgagagcgtgaacctggatgactacaacatccacgtgattgcctctgtgttcaagcagtggctgcgggacctgcccaaccccctgatgacctttgagctgtatgaggagttcctgcgggccatgggcctgcaggagaggaaggagaccatccggggcgtgtacagcgtgattgaccagctgagcaggacccacctgaacaccctggagcggctcatcttccacctggtgcgcatcgccctgcaggaggacaccaacaggatgtctgccaatgccctggccatcgtgtttgccccctgcatcctgcgctgcccagacaccacagaccccctgcagagcgtgcaggacatcagcaagaccaccacctgtgtggagctgattgtggtggagcagatgaacaagtacaaggcccggctgaaggacatcagcagcctggagtttgctgagaacaaggccaagacccggctgagcctcatcagaagatccatgggcaagggccgcatccggcggggcaactacccaggccccagcagccctgtggtggtgcggctgcccagcgtgtctgatgtgtctgaggagaccctgaccagcgaggccgccatggagacagacatcacagagcagcagcaggccgccatgcagcaggaggagcgggtgctgacagagcagatcgagaacctgcagaaggagaaggaggagctgacctttgagatgctggtgctggagccccgggccagtgatgatgagaccctggagagcgaggccagcatcggcacagctgacagcagcgagaacctgaacatggagagtgaatatgccatcagcgagaagtctgagaggagcctggccctgagcagcctgaagacagctgggaagtctgagcccagcagcaagctgaggaagcagctgaagaagcagcaggacagcctggatgtggtggacagctctgtgagcagcctgtgcctgagcaacacagccagcagccacggcaccaggaagctgttccagatctacagcaagagccccttctacagagctgccagcggaaatgaggccctgggcatggagggccccctgggccagaccaagttcctggaggacaagccccagttcatcagccggggcaccttcaaccctgagaagggcaagcagaagctgaagaatgtgaagaacagcccccagaagaccaaggagaccccagagggcaccgtgatgtctggaagaaggaagacagtggaccctgactgcaccagcaaccagcagctggccctgtttggaaataatgagttcatggtgtag

SEQ ID NO: 160808 - DNA, 7590 bp, Artificial Sequence
  Description of Artificial Sequence: Synthetic coding sequence
atgaacatcaatgatggcggcagaagaagatttgaggacaatgagcacaccctgcgcatctacccaggggccatcagcgagggcaccatctactgccccatcccagccaggaagaacagcacagctgctgaggtgattgagagcctcatcaacaagctgcacctggacaagaccaagtgctacgtgctggccgaggtgaaggagtttggaggagaggagtggatcctgaaccccacagactgccctgtgcagaggatgatgctgtggcccaggatggccctggagaaccggctgtctggagaggactaccgcttcctgctgcgggagaagaacctggatggcagcatccactacggcagcctgcagagctggctgcgggtgacagaggagaggaggaggatgatggagcggggcttcctgccccagccccagcagaaggactttgatgacctgtgcagcctgcctgacctgaatgagaagaccctgctggagaacctgaggaaccgcttcaagcatgagaagatctacacctacgtgggcagcatcctgattgtcatcaaccccttcaagttcctgcccatctacaaccccaagtatgtgaagatgtatgacaaccaccagctgggcaagctggagccccacatctatgctgtggctgatgtggcctaccacgccatgctgcagaggaagaagaaccagtgcatcgtcatcagcggggagagcggcagcggcaagacccagagcaccaacttcctgatccaccacctgacagccctgagccagaagggctttgccagcggcgtggagcagatcatcctgggcgccggccctgtgctggaggcctttggaaatgccaagacagcccacaacaacaacagcagcagatttgggaagttcatccaggtgaactaccaggagactggaacagtgctgggcgcctacgtggagaagtacctgctggagaagagccggctggtgtaccaggagcacaatgaaagaaactaccacgtgttctactacctgctggccggggcctctgaagatgagaggtctgccttccacctgaagcagcctgaggagtaccactacctgaaccaggactgcttcaccgtggagggggaggacctgcggcatgactttgagcggctgcagctggccatggagatggtgggcttcctgcccaagacccggcggcagatcttcagcctgctgagcgccatcctgcacctgggcaacatctgctacaagaagaagacctacagagatgacagcattgacatctgcaaccctgaggtgctgcccatcgtgtctgagctgctggaggtgaaggaggagatgctgtttgaggccctggtgaccaggaagacagtgacagtgggggagaagctgatcctgccctacaagctggccgaggccgtgacagtgaggaacagcatggccaagagcctgtacagcgccctgtttgactggatcgtgttccgcatcaaccacgccctgctgaacagcaaggacctggagcacaacaccaagaccctgagcattggagtgctggacatcttcggctttgaagattatgagaacaacagctttgagcagttctgcatcaactttgccaatgaaaggctgcagcactacttcaaccagcacatcttcaagctggagcaggaggagtacagaacagagggcatctcctggcacaacatcgactacatcgacaacacctgctgcatcaacctgatcagcaagaagcccaccggcctgctgcacctgctggatgaggagagcaacttcccccaggccaccaaccagaccctgctggacaagttcaagcaccagcacgaggacaacagctacatcgagttccctgctgtgatggagcccgccttcatcatcaagcactacgccggcaaggtgaagtatggagtgaaggacttccgggagaagaacacagaccacatgaggccagacatcgtggccctgctgcggagcagcaagaatgccttcatcagcggcatgattggaattgatcctgtggccgtgttccgctgggccatcctgcgggccttcttccgggccatggtggccttccgggaggccggcaagaggaacatccacaggaagacaggccatgatgacacagccccctgtgccatcctgaagtccatggacagcttctccttcctgcagcaccctgtgcaccagaggagcctggagatcctgcagcgctgcaaggaggagaagtacagcatcaccaggaagaaccccaggacccccctgagtgacctgcagggcatgaatgccctgaatgagaagaaccagcacgacacctttgatattgcctggaatggccgcacaggcatccggcagagccggctgagcagcggcaccagcctgctggacaaggatggcatctttgccaacagcaccagcagcaagctgctggagcgggcccacggcatcctgaccaggaacaagaacttcaagagcaagccagccctgcccaagcacctgctggaggtgaacagcctgaagcacctgacccggctgaccctgcaggaccgcatcaccaagagcctgctgcacctgcacaagaagaagaagccacccagcatcagcgcccagttccaggccagcctgagcaagctgatggagaccctgggccaggccgagccctactttgtgaagtgcatccgcagcaatgctgagaagctgcccctgcgcttcagtgatgtgctggtgctgcggcagctgcgctacacaggcatgctggagaccgtgcgcatccggcagagcggctacagcagcaagtacagcttccaggactttgtgagccacttccacgtgctgctgcccaggaacatcatccccagcaagttcaacatccaggacttcttcaggaagatcaacctgaacccagacaactaccaggtgggcaagaccatggtgttcctgaaggagcaggagcggcagcacctgcaggacctgctgcaccaggaggtgctgcggcgcatcatcctgctgcagcgctggttccgggtgctgctgtgccggcagcacttcctgcacctgcggcaggccagcgtcatcatccagcgcttctggaggaactacctgaaccagaagcaggtgagagatgctgctgtgcagaaggatgcctttgtgatggccagcgctgctgccctgctgcaggcctcctggagggcccacctggagcggcagcgctacctggagctgcgggctgctgccatcgtcatccagcagaagtggagggactactacagaagaagacacatggccgccatctgcatccaggcccgctggaaggcctaccgggagagcaagcgctaccaggagcagaggaagaagatcatcctgctgcagagcacctgccggggcttccgggcccggcagcgcttcaaggccctgaaggagcagaggctgcgggagaccaagccagaggtgggcctggtgaacatcaagggctacggcagcctggagatccagggcagtgaccccagcggctgggaggactgcagctttgacaaccgcatcaaggccatcgaggagtgcaagagcgtcatcgagagcaaccgcatcagccgggagagctctgtggactgcctgaaggagagccccaacaagcagcaggagcgggcccagagccagagcggcgtggacctgcaggaggatgtgctggtgcgggagcggcccaggagcctggaggacctgcaccagaagaaggtgggccgggccaagcgggagagcaggaggatgagggagctggagcaggccatcttcagcctggagctgctgaaggtgcgcagcctgggcggcatcagccccagtgaagatcggcgctggagcacagagctggtgcctgagggcctgcagagcccccggggcaccccagattctgagagcagccagggcagcctggagctgctgtcctatgaggagagccagaagagcaagctggagagcgtcatcagtgatgaaggagacctgcagttccccagccccaagatcagcagcagccccaagtttgacagccgggacaatgccctgagcgccagcaatgagaccagcagcgctgagcacctgaaggatggcaccatgaaggagatggtggtgtgcagcagcgagagcatcacctgcaagccccagctgaaggacagcttcatcagcaacagcctgcccaccttcttctacatcccccagcaggaccccctgaagaccaacagccagctggacaccagcatccagaggaacaagctgctggagaatgaagacacagctggggaggccctgaccctggacatcaaccgggagacccggcgctaccactgcagcggcaaggaccagatcgtgcccagcctgaacacagagagcagcaaccctgtgctgaagaagctggagaagctgaacacagagaaggaggagcggcagaagcagctgcagcagcagaatgagaaggagatgatggagcagatccggcagcagacagacatcctggagaaggagaggaaggccttcaagaccatcgagaagcccagaattggagaatgtctggtggcccccagcagctaccagagcaagcagagggtggagcggcccagcagcctgctgagcctgaacaccagcaacaagggggagctgaatgtgctgggcagcctgagcctgaaggatgctgccctggcccagaaggacagcagcagcgcccacctgccccccaaggacaggcctgtgacagtgttctttgagaggaagggcagcccctgccagagcagcacagtgaaggagctgagcaagacagacaggatgggcacccagctgaatgtggcctgcaagctgagcaacaaccgcatcagcaagcgggagcacttccggcccacccagagctacagccacaacagtgatgacctgagccgggagggcaatgcccggcccatcttcttcacccccaaggacaacatgagcatccccctggtgtccaaggaggccctgaacagcaagaacccccagctgcacaaggaggatgagcccgcctggaagcctgtgaagctggccggccctggccagcgggagaccagccagcgcttcagctctgtggatgagcaggccaagctgcacaagaccatgagccagggcgagatcaccaagctggccgtgcggcagaaggccagtgacagcgacatccggccccagagggccaagatgaggttctgggccaagggcaagcagggcgagaagaagaccaccagggtgaagcccaccacccagagcgaggtgagccccctgtttgctggaacagatgtgatcccagcccaccagttcccagatgagctggccgcctaccaccccaccccacccctgagccctgagctgcccggcagctgcaggaaggagttcaaggagaacaaggagcccagccccaaggccaagaggaagaggtctgtgaagatcagcaatgtggccctggacagcatgcactggcagaatgattctgtgcagatcatcgcctctgtgtctgacctgaagtccatggatgagttcctgctgaagaaggtgaatgacctggacaatgaagacagcaagaaggacaccctggtggatgtggtgttcaagaaggccctgaaggagttccggcagaacatcttctccttctacagcagcgccctggccatggatgatggcaagagcatccgctacaaggacctgtatgccctgtttgagcagatcctggagaagaccatgaggctggagcagagggacagcctgggggagagccctgtgcgggtgtgggtgaacaccttcaaggtgttcctggatgagtacatgaatgagttcaagaccagtgactgcacagccaccaaggtgcccaagacagagaggaagaagaggaggaagaaggagacagacctggtggaggagcacaacggccacatcttcaaggccacccagtacagcatccccacctactgtgagtactgcagcagcctcatctggatcatggaccgggcctctgtgtgcaagctgtgcaagtatgcctgccacaagaagtgctgcctgaagaccacagccaagtgcagcaagaagtatgaccctgagctgagcagccggcagtttggagtggagctgagccggctgaccagcgaggacagaacagtgcccctggtggtggagaagctgatcaactacatcgagatgcacggcctgtacacagagggcatctacaggaagagcggcagcaccaacaagatcaaggagctgcggcagggcctggacacagatgctgagagcgtgaacctggatgactacaacatccacgtgattgcctctgtgttcaagcagtggctgcgggacctgcccaaccccctgatgacctttgagctgtatgaggagttcctgcgggccatgggcctgcaggagaggaaggagaccatccggggcgtgtacagcgtgattgaccagctgagcaggacccacctgaacaccctggagcggctcatcttccacctggtgcgcatcgccctgcaggaggacaccaacaggatgtctgccaatgccctggccatcgtgtttgccccctgcatcctgcgctgcccagacaccacagaccccctgcagagcgtgcaggacatcagcaagaccaccacctgtgtggagctgattgtggtggagcagatgaacaagtacaaggcccggctgaaggacatcagcagcctggagtttgctgagaacaaggccaagacccggctgagcctcatcagaagatccatgggcaagggccgcatccggcggggcaactacccaggccccagcagccctgtggtggtgcggctgcccagcgtgtctgatgtgtctgaggagaccctgaccagcgaggccgccatggagacagacatcacagagcagcagcaggccgccatgcagcaggaggagcgggtgctgacagagcagatcgagaacctgcagaaggagaaggaggagctgacctttgagatgctggtgctggagccccgggccagtgatgatgagaccctggagagcgaggccagcatcggcacagctgacagcagcgagaacctgaacatggagagtgaatatgccatcagcgagaagtctgagaggagcctggccctgagcagcctgaagacagctgggaagtctgagcccagcagcaagctgaggaagcagctgaagaagcagcaggacagcctggatgtggtggacagctctgtgagcagcctgtgcctgagcaacacagccagcagccacggcaccaggaagctgttccagatctacagcaagagccccttctacagagctgccagcggaaatgaggccctgggcatggagggccccctgggccagaccaagttcctggaggacaagccccagttcatcagccggggcaccttcaaccctgagaagggcaagcagaagctgaagaatgtgaagaacagcccccagaagaccaaggagaccccagagggcaccgtgatgtctggaagaaggaagacagtggaccctgactgcaccagcaaccagcagctggccctgtttggaaataatgagttcatggtgtag

SEQ ID NO: 160809 - DNA, 2190 bp, Artificial Sequence
  Description of Artificial Sequence: Synthetic coding sequence
atgaacatcaatgatggcggcagaagaagatttgaggacaatgagcacaccctgcgcatctacccaggggccatcagcgagggcaccatctactgccccatcccagccaggaagaacagcacagctgctgaggtgattgagagcctcatcaacaagctgcacctggacaagaccaagtgctacgtgctggccgaggtgaaggagtttggaggagaggagtggatcctgaaccccacagactgccctgtgcagaggatgatgctgtggcccaggatggccctggagaaccggctgtctggagaggactaccgcttcctgctgcgggagaagaacctggatggcagcatccactacggcagcctgcagagctggctgcgggtgacagaggagaggaggaggatgatggagcggggcttcctgccccagccccagcagaaggactttgatgacctgtgcagcctgcctgacctgaatgagaagaccctgctggagaacctgaggaaccgcttcaagcatgagaagatctacacctacgtgggcagcatcctgattgtcatcaaccccttcaagttcctgcccatctacaaccccaagtatgtgaagatgtatgacaaccaccagctgggcaagctggagccccacatctatgctgtggctgatgtggcctaccacgccatgctgcagaggaagaagaaccagtgcatcgtcatcagcggggagagcggcagcggcaagacccagagcaccaacttcctgatccaccacctgacagccctgagccagaagggctttgccagcggcgtggagcagatcatcctgggcgccggccctgtgctggaggcctttggaaatgccaagacagcccacaacaacaacagcagcagatttgggaagttcatccaggtgaactaccaggagactggaacagtgctgggcgcctacgtggagaagtacctgctggagaagagccggctggtgtaccaggagcacaatgaaagaaactaccacgtgttctactacctgctggccggggcctctgaagatgagaggtctgccttccacctgaagcagcctgaggagtaccactacctgaaccagatcaccaagaagcccctgcggcagagctgggatgactactgctatgattctgagccagactgcttcaccgtggagggggaggacctgcggcatgactttgagcggctgcagctggccatggagatggtgggcttcctgcccaagacccggcggcagatcttcagcctgctgagcgccatcctgcacctgggcaacatctgctacaagaagaagacctacagagatgacagcattgacatctgcaaccctgaggtgctgcccatcgtgtctgagctgctggaggtgaaggaggagatgctgtttgaggccctggtgaccaggaagacagtgacagtgggggagaagctgatcctgccctacaagctggccgaggccgtgacagtgagaaattccatggccaagagcctgtacagcgccctgtttgactggatcgtgttccgcatcaaccacgccctgctgaacagcaaggacctggagcacaacaccaagaccctgagcattggagtgctggacatctttggatttgaggactatgagaacaacagctttgagcagttctgcatcaactttgccaatgaaaggctgcagcactacttcaaccagcacatcttcaagctggagcaggaggagtacagaacagagggcatctcctggcacaacatcgactacatcgacaacacctgctgcatcaacctgatcagcaagaagcccaccggcctgctgcacctgctggatgaggagagcaacttcccccaggccaccaaccagaccctgctggacaagttcaagcaccagcacgaggacaacagctacatcgagttccctgctgtgatggagcccgccttcatcatcaagcactacgccggcaaggtgaagtatggagtgaaggacttccgggagaagaacacagaccacatgaggccagacatcgtggccctgctgcggagcagcaagaatgccttcatcagcggcatgattggcatcgaccctgtggccgtgttccgctgggccatcctgcgggccttcttccgggccatggtggccttccgggaggccggcaagaggaacatccacaggaagacaggcaagtag

SEQ ID NO: 160810 - DNA, 1509 bp, Artificial Sequence
  Description of Artificial Sequence: Synthetic coding sequence
atggacaaggccctgctgtgcagcgtgtgcaagatgacctgccacaagaagtgtgtgcacaagatccagagccactgcagctacacctacggcaggaaaggagagcccggggtggagcccggccactttggagtgtgtgtggacagcctgaccagtgacaaggcctctgtgcccatcgtgctggagaagctgctggagcacgtggagatgcacggcctgtacacagagggcctgtacaggaagagcggggccgccaacagaacccgggagctgcggcaggccctgcagacagatcctgctgctgtgaagctggagaacttccccatccacgccatcactggagtgctgaagcagtggctgcgggagctgcctgagcccctgatgacctttgcccagtatggagacttcctgcgggctgtggagctgcctgagaagcaggagcagctggccgccatctatgctgtgctggagcacctgcctgaggccaaccacaacagcctggagcggctcatcttccacctgctggccgtggccctgctggaggatgtgaacaggatgagccctggggccctggccatcatctttgccccctgcctgctgcgctgcccagacaacagcgaccccctgacctccatgaaggatgtgctgaagatcaccacctgtgtggagatgctgatcaaggagcagatgaggaagtacaaggtgaagatggaggagatcagccagctggaggccgctgagagcatcgccttccggcggctgagcctgctgcggcagaatgccccctggcccctgaagctgggcttcagcagcccctatgaaggagtgctgaacaagagccccaagacccgggacatccaggaggaggagctggaggtgctgctggaggaggaggccgctggaggagatgaggaccgggagaaggagatcctgattgaaagaatccagagcatcaaggaggagaagcaggacatcacctaccgcctgcctgagctggacccccggggcagtgatgaggagaacctggacagcgagaccagcgccagcacagagagcctgctggaggagcgggccggccgcggggccagcgagggccccccagccccagccctgccctgccctggggcccccacccccagccccctgcccaccgtggccgccccacccaggagaagacccagcagctttgtgacagtgcgggtgaagacccccaggaggacccccatcatgcccacagccaacatcaagctgcccccaggcctgcccagccacctgccccgctgggcccctggggcccgggaggccgccgcccctgtgagaagaagagagcccccagcccggcggccagaccagatccacagcgtgtacatcaccccaggagctgacctgcctgtgcagggcgccctggagcccctggaggaggatggccagcccccaggggccaagaggcgctacagcgacccccccacctactgcctgcccccagccagcggccagaccaatggatag

SEQ ID NO: 160811 - DNA, 6069 bp, Artificial Sequence
  Description of Artificial Sequence: Synthetic coding sequence
atgtctgtgaaggaggccggcagcagtggaagaagagagcaggccgcctaccacctgcacatctacccccagctgagcaccacagagagccaggccagctgccgggtgacagccaccaaggacagcaccaccagtgatgtgatcaaggatgccatcgccagcctgcggctggatggcaccaagtgctacgtgctggtggaggtgaaggagagcggcggggaggagtgggtgctggatgccaatgacagccctgtgcaccgggtgctgctgtggccccggcgggcccaggatgagcacccccaggaggatggctactacttcctgctgcaggagagaaatgctgatggcaccatcaagtatgtgcacatgcagctggtggcccaggccacagccacccggcggctggtggagcggggcctgctgccccggcagcaggccgactttgatgacctgtgcaacctgcctgagctgacagagggcaacctgctgaagaacctgaagcaccgcttcctgcagcagaagatctacacctacgccggcagcatcctggtggccatcaaccccttcaagttcctgcccatctacaaccccaagtatgtgaagatgtatgagaaccagcagctgggcaagctggagccccacgtgtttgccctggctgatgtggcctactacaccatgctgaggaagagggtgaaccagtgcatcgtcatcagcggggagagcggcagcggcaagacccagagcaccaacttcctgatccactgcctgacagccctgagccagaagggctacgccagcggcgtggagaggaccatcctgggcgccggccctgtgctggaggcctttggaaatgccaagacagcccacaacaacaacagcagcagatttgggaagttcatccaggtgtcctacctggagagcggcatcgtgagaggagctgtggtggagaagtacctgctggagaagagccggctggtgtcccaggagaaggatgaaagaaactaccacgtgttctactacctgctgctgggcgtgtctgaggaggagcggcaggagttccagctgaagcagcctgaggactacttctacctgaaccagcacaacctgaagattgaagatggagaggacctgaagcatgactttgagcggctgaagcaggccatggagatggtgggcttcctgcctgccaccaagaagcagatctttgctgtgctgagcgccatcctgtacctgggcaatgtgacctacaagaagagggccaccggccgggaggagggcctggaggtgggccccccagaggtgctggacaccctgagccagctgctgaaggtgaagcgggagatcctggtggaggtgctgaccaagaggaagacagtgacagtgaatgacaagctgatcctgccctacagcctgtctgaggccatcacagcccgggacagcatggccaagagcctgtacagcgccctgtttgactggatcgtgctgcgcatcaaccacgccctgctgaacaagaaggatgtggaggaggccgtgtcctgcctgagcattggagtgctggacatcttcggctttgaagattttgaaagaaattcctttgagcagttctgcatcaactatgccaatgagcagctgcagtactacttcaaccagcacatcttcaagctggagcaggaggagtaccagggcgagggcatcacctggcacaacatcggctacacagacaacgtgggctgcatccacctgatcagcaagaagcccaccggcctcttctacctgctggatgaggagagcaacttcccccacgccaccagccagaccctgctggccaagttcaagcagcagcacgaggacaacaagtacttcctgggcacccctgtgatggagcccgccttcatcatccagcactttgctgggaaggtgaagtaccagatcaaggacttccgggagaagaacatggactacatgaggccagacatcgtggccctgctgcggggcagtgacagcagctatgtgcgggagctgattggcatggaccctgtggccgtgttccgctgggccgtgctgcgggccgccatccgggccatggctgtgctgcgggaggccggccgcctgcgggcagagagagctgagaaggctgctggcatgagcagccctggggcccagagccaccctgaggagctgcccaggggggccagcaccccatctgagaagctgtacagagacctgcacaaccagatgatcaagagcatcaagggcctgccctggcagggcgaggaccccaggagcctgctgcagagcctgagccggctgcagaagccccgggccttcatcctgaagagcaagggcatcaagcagaagcagatcatccccaagaacctgctggacagcaagagcctgaagctgatcatctccatgaccctgcatgacaggaccaccaagagcctgctgcacctgcacaagaagaagaagccacccagcatcagcgcccagttccagaccagcctgaacaagctgctggaggccctgggcaaggccgagcccttcttcatccgctgcatccgcagcaatgctgagaagaaggagctgtgctttgatgatgagctggtgctgcagcagctgcgctacacaggcatgctggagaccgtgcgcatcagaagaagtggctacagcgccaagtacaccttccaggacttcacagagcagttccaggtgctgctgcccaaggatgcccagccctgccgggaggtgatcagcaccctgctggagaagatgaagattgacaagaggaactaccagatcggcaagaccaaggtgttcctgaaggagacagagcggcaggccctgcaggagaccctgcaccgggaggtggtgaggaagatcctgctgctgcagagctggttcaggatggtgctggagaggaggcacttcctgcagatgaagagagctgctgtgaccatccaggcctgctggaggagctacagagtgcggcgggccctggagaggacccaggccgctgtgtacctgcaggcctcctggaggggctactggcagaggaagctgtaccgccaccagaagcagagcatcatccggctgcagagcctgtgccggggccacctgcagaggaagagcttcagccagatgatcagcgagaagcagaaggccgaggagaaggagcgggaggccctggaggccgcccgggccggggctgaggagggcggccagggccaggccgccggcggccagcaggtggccgagcagggccctgagccagcagaagatggcggccacctggccagcgagcctgaggtgcagcccagcgacaggagccccctggagcacagcagccctgagaaggaggcccccagccctgagaagaccctgcccccccagaagacagtggccgctgagagccatgagaaggtgcccagcagccgggagaagcgggagagccggcggcagaggggcctggagcacgtgaagttccagaacaagcacatccagagctgcaaggaggagagcgccctgcgggagcccagccggcgggtgacccaggagcagggcgtgtccctgctggaggacaagaaggagagcagagaagatgagaccctgctggtggtggagacagaagctgagaacaccagccagaagcagcccacagagcagccccaggccatggctgtgggcaaggtgtctgaggagacagagaagaccctgcccagcggcagccccaggcctggccagctggagcggcccaccagcctggccctggacagccgggtgagccccccagcccctggcagcgcccctgagaccccagaggacaagagcaagccctgtggcagcccccgggtgcaggagaagccagacagccctgggggcagcacccagatccagcgctacctggatgctgagcggctggccagcgctgtggagctgtggaggggcaagaagctggtggccgccgccagccccagcgccatgctgagccagagcctggacctgagtgacagacaccgggccactggagctgccctgacccccacagaggagaggaggaccagcttcagcaccagtgatgtgtccaagctgctgcccagcctggccaaggcccagcctgctgctgagaccacagatggagagaggtctgccaagaagccagctgtgcagaagaagaagccaggagatgccagcagcctgcctgatgctggcctgagccctggcagccaggtggacagcaagagcaccttcaagaggctcttcctgcacaagaccaaggacaagaagtacagcctggagggcgctgaggagctggagaatgctgtgtctggccacgtggtgctggaggccaccaccatgaagaagggcctggaggcccccagcggccagcagcacagacatgctgctggggagaagaggaccaaggagcccggcggcaagggcaagaagaacagaaatgtgaagattggcaagatcaccgtgtctgagaagtggagggagagcgtcttccggcagatcaccaatgccaatgagctgaagtacctggatgagttcctgctgaacaagatcaatgacctgcggagccagaagacccccatcgagagcctcttcatcgaggccacagagaagttccgcagcaacatcaagaccatgtacagcgtgcccaacgggaagatccacgtgggctacaaggacctgatggagaactaccagatcgtggtgagcaacctggccacagagcggggccagaaggacaccaacctggtgctgaacctcttccagagcctgctggatgagttcacccggggctacaccaagaatgactttgagcctgtgaagcagagcaaggcccagaagaagaagaggaagcaggagagagctgtgcaggagcacaatggacatgtgtttgccagctaccaggtgtccatcccccagagctgtgagcagtgcctgagctacatctggctgatggacaaggccctgctgtgcagcgtgtgcaagatgacctgccacaagaagtgtgtgcacaagatccagagccactgcagctacacctacggcaggaagggggagcccggggtggagcccggccactttggagtgtgtgtggacagcctgaccagtgacaaggcctctgtgcccatcgtgctggagaagctgctggagcacgtggagatgcacggcctgtacacagagggcctgtacaggaagtctggagctgccaacagaacccgggagctgcggcaggccctgcagacagatcctgctgctgtgaagctggagaacttccccatccacgccatcaccggggtgctgaagcagtggctgcgggagctgcctgagcccctgatgacctttgcccagtacggggacttcctgcgggctgtggagctgcctgagaagcaggagcagctggccgccatctatgctgtgctggagcacctgcctgaggccaaccacaacagcctggagcggctcatcttccacctggtgaaggtggccctgctggaggatgtgaacaggatgagccctggggccctggccatcatctttgccccctgcctgctgcgctgcccagacaacagcgaccccctgacctccatgaaggatgtgctgaagatcaccacctgtgtggagatgctgatcaaggagcagatgaggaagtacaaggtgaagatggaggagatcagccagctggaggccgctgagagcatcgccttccggcggctgagcctgctgcggcagaatgccccctggcccctgaagctgggcttcagcagcccctatgagggcgtgctgaacaagagccccaagacccgggacatccaggaggaggagctggaggtgctgctggaggaggaggccgctggaggagatgaagatcgggagaaggagatcctgattgagcgcatccagagcatcaaggaggagaaggaggacatcacctaccgcctgcctgagctggacccccggggcagtgatgaggagaacctggacagcgagaccagcgccagcacagagagcctgctggaggagagagctggccgcggggccagcgagggccagtactag

SEQ ID NO: 160812 - DNA, 6069 bp, Artificial Sequence; identical to SEQ ID NO: 160811
  Description of Artificial Sequence: Synthetic coding sequence

SEQ ID NO: 160813 - DNA, 519 bp, Artificial Sequence
  Description of Artificial Sequence: Synthetic coding sequence
atgagcagcaagaaggccaagaccaagaccaccaagaagaggccccagagggccaccagcaatgtgtttgccatgtttgaccagagccagatccaggagttcaaggaggccttcaacatgattgaccagaacagagatggcttcatcgacaaggaggacctgcatgacatgctggccagcctgggcaagaaccccacagatgcctacctggatgccatgatgaatgaggcccctggccccatcaacttcaccatgttcctgaccatgtttggagagaagctgaatggaacagatcctgaagatgtgatcagaaatgcctttgcctgctttgatgaggaggccaccggcaccatccaggaggactacctgcgggagctgctgaccaccatgggagaccgcttcacagatgaggaggtggatgagctgtaccgggaggcccccatcgacaagaagggcaacttcaactacatcgagttcacccgcatcctgaagcatggagccaaggacaaggatgactag

SEQ ID NO: 160814 - DNA, 1791 bp, Artificial Sequence
  Description of Artificial Sequence: Synthetic coding sequence
atggccacagaaaatggagctgtggagctgggcatccagaaccccagcacagacaaggcccccaagggccccactggagagcggcccctggccgccggcaaggaccccggccccccagaccccaagaaggccccagacccccccaccctgaagaaggatgccaaggccccagccagcgagaagggagatggcaccctggcccagcccagcaccagcagccagggccccaagggggagggggacagaggaggcggccctgctgagggcagcgctggccccccagctgccctgccccagcagacagccaccccagagacctctgtgaagaagcccaaggccgagcagggcgccagcggcagccaggaccccgggaagccccgggtgggcaagaaggctgctgagggccaggccgccgcccggcggggcagccctgccttcctgcacagccccagctgcccagccatcatcagcagcagcgagaagctgctggccaagaagcccccatctgaggccagcgagctgacctttgagggcgtgcccatgacccacagccccacagaccccaggcctgccaaggccgaggagggcaagaacatcctggccgagagccagaaggaggtgggggagaagaccccaggccaggccggccaggccaagatgcagggcgacaccagccggggcatcgagttccaggccgtgcccagcgagaagtctgaggtgggccaggccctgtgcctgacagcccgggaggaggactgcttccagatcctggatgactgccccccacctccagcccccttcccccacaggatggtggagctgaggactggaaatgtgtcctctgagttctccatgaacagcaaggaggccctgggcggcggcaagtttggagctgtgtgcacctgcatggagaaggccaccggcctgaagctggccgccaaggtgatcaagaagcagacccccaaggacaaggagatggtgctgctggagattgaggtgatgaaccagctgaaccacaggaacctgatccagctgtatgctgccatcgagacccctcatgaaattgtgctcttcatggagtacatcgagggcggggagctgtttgaaagaattgtggatgaggactaccacctgacagaggtggacaccatggtgtttgtgcggcagatctgtgatggcatcctcttcatgcacaagatgagggtgctgcacctggacctgaagccagagaacatcctgtgtgtgaacaccaccggccacctggtgaagatcatcgactttggcctggcccggcgctacaaccccaatgagaagctgaaggtgaactttggcaccccagagttcctgagccctgaggtggtgaactatgaccagatcagtgacaagacagacatgtggagcatgggcgtcatcacctacatgctgctgagcggcctgagccccttcctgggagatgatgacacagagaccctgaacaacgtgctgagcggcaactggtactttgatgaggagacctttgaggccgtgtctgatgaggccaaggactttgtgagcaacctgattgtgaaggaccagagggccaggatgaatgctgcccagtgcctggcccacccctggctgaacaacctggccgagaaggccaagcgctgcaacagaaggctgaagagccagatcctgctgaagaagtacctgatgaagaggcgctggaagaagaacttcatcgctgtgtctgctgccaaccgcttcaagaagatcagcagcagcggggccctgatggccctgggcgtgtag

SEQ ID NO: 160815 - DNA, 1791 bp, Artificial Sequence; identical to SEQ ID NO: 160814
  Description of Artificial Sequence: Synthetic coding sequence

SEQ ID NO: 160816 - DNA, 2460 bp, Artificial Sequence
  Description of Artificial Sequence: Synthetic coding sequence
atgagcggcaccagcaaggagagcctgggccatggaggcctgcccggcctgggcaagacctgcctgaccaccatggacaccaagctgaacatgctgaatgagaaggtggaccagctgctgcacttccaggaggatgtgacagagaagctgcagagcatgtgccgggacatgggccacctggagcggggcctgcaccggctggaggccagccgggcccctggccctggaggagcagatggagtgccccacatcgacacccaggccggctggccagaggtgctggagctggtgcgggccatgcagcaggatgctgcccagcacggggcccggctggaggccctcttcaggatggtggccgctgtggaccgggccatcgccctggtgggcgccaccttccagaagagcaaggtggccgacttcctgatgcagggccgggtgccctggaggcggggcagccctggggacagccctgaggagaacaaggagcgggtggaggaggagggcggcaagcccaagcacgtgctgagcaccagcggcgtgcagagtgatgcccgggagcctggagaggagagccagaaggcagatgtgctggagggcacagctgagcggctgccccccatccgggccagcggcctgggcgctgaccctgcccaggccgtggtgtccccaggccagggagatggagtgcccggccctgcccaggccttccctggccacctgcccctgcccaccaaggtggaggccaaggcccctgagaccccatctgagaacctgaggacaggcctggagctggccccagcccctggccgggtgaatgtggtgagccccagcctggaggtggcccctggggccggccagggcgccagcagcagcaggccagaccctgagcccctggaggagggcacccggctgaccccaggccctggcccccagtgccccggccccccaggcctgcctgcccaggcccgggccacccacagcggcggggagaccccaccccgcatcagcatccacatccaggagatggacaccccaggagagatgctgatgacaggccggggcagcctgggccccaccctgaccacagaggccccagctgctgcccagcccgggaagcagggccccccaggcaccggccgctgcctgcaggcccctggaacagagcctggagagcagaccccagagggcgcccgggagctgagccccctgcaggagagcagcagccctggaggagtgaaggccgaggaggagcagagagctggagctgagcccggcacccggcccagcctggcccggagtgatgacaatgaccacgaggtgggcgccctgggcctgcagcagggcaagagccctggagctggcaaccctgagcctgagcaggactgtgccgcccgggcccctgtgcgggcagaggccgtgcggaggatgcctcctggagctgaggccggctctgtggtgctggatgacagccctgcccccccagccccctttgagcaccgggtggtgtctgtgaaggagaccagcatctctgctggctatgaggtgtgccagcacgaggtgctgggcggcggccgcttcggccaggtgcaccgctgcacagagaagagcacaggcctgcccctggccgccaagatcatcaaggtgaagagcgccaaggacagagaagatgtgaagaatgagatcaacatcatgaaccagctgagccacgtgaacctgatccagctgtatgatgcctttgagagcaagcacagctgcaccctggtgatggagtatgtggatggaggagagctgtttgaccgcatcacagatgagaagtaccacctgacagagctggatgtggtgctcttcacccggcagatctgtgaaggagtgcactacctgcaccagcactacatcctgcacctggacctgaagccagagaacatcctgtgtgtgaaccagacaggccaccagatcaagatcatcgactttggcctggcccggcgctacaagccccgggagaagctgaaggtgaactttggcaccccagagttcctggcccctgaggtggtgaactatgaatttgtgtccttccccacagacatgtggagcgtgggcgtcatcacctacatgctgctgagcggcctgagccccttcctgggggagacagatgctgagaccatgaacttcatcgtgaactgctcctgggactttgatgctgacacctttgagggcctgtctgaggaggccaaggactttgtgtcccggctgctggtgaaggagaagagctgcaggatgtctgccacccagtgcctgaagcatgagtggctgaacaacctgcctgccaaggccagccgcagcaagacccggctgaagagccagctgctgctgcagaagtacatcgcccagaggaagtggaagaagcacttctacgtggtgacagctgccaaccggctgaggaagttccccaccagcccctag

SEQ ID NO: 160817 - DNA, 1437 bp, Artificial Sequence
  Description of Artificial Sequence: Synthetic coding sequence
atggacaccccaggagagatgctgatgacaggccggggcagcctgggccccaccctgaccacagaggccccagctgctgcccagcccgggaagcagggccccccaggcaccggccgctgcctgcaggcccctggaacagagcccggggagcagaccccagagggcgcccgggagctgagccccctgcaggagagcagcagccctgggggcgtgaaggccgaggaggagcagagagctggagctgagcccggcacccggcccagcctggcccggagtgatgacaatgaccacgaggtgggcgccctgggcctgcagcagggcaagagccctggggccggcaaccctgagcctgagcaggactgtgccgcccgggcccctgtgcgggcagaggccgtgcggaggatgcctcctggagctgaggccggctctgtggtgctggatgacagccctgcccccccagccccctttgagcaccgggtggtgtctgtgaaggagaccagcatctctgctggctatgaggtgtgccagcacgaggtgctgggcggcggccgcttcggccaggtgcaccgctgcacagagaagagcacaggcctgcccctggccgccaagatcatcaaggtgaagagcgccaaggaccgggaggatgtgaagaatgagatcaacatcatgaaccagctgagccacgtgaacctgatccagctgtatgatgcctttgagagcaagcacagctgcaccctggtgatggagtatgtggatggaggagagctgtttgaccgcatcacagatgagaagtaccacctgacagagctggatgtggtgctcttcacccggcagatctgtgagggcgtgcactacctgcaccagcactacatcctgcacctggacctgaagccagagaacatcctgtgtgtgaaccagacaggccaccagatcaagatcatcgactttggcctggcccggcgctacaagccccgggagaagctgaaggtgaactttggcaccccagagttcctggcccctgaggtggtgaactatgaatttgtgtccttccccacagacatgtggagcgtgggcgtcatcacctacatgctgctgagcggcctgagccccttcctgggggagacagatgctgagaccatgaacttcatcgtgaactgctcctgggactttgatgctgacacctttgagggcctgtctgaggaggccaaggactttgtgtcccggctgctggtgaaggagaagagctgcaggatgtctgccacccagtgcctgaagcatgagtggctgaacaacctgcctgccaaggccagccgcagcaagacccggctgaagagccagctgctgctgcagaagtacatcgcccagaggaagtggaagaagcacttctacgtggtgacagctgccaaccggctgaggaagttccccaccagcccctag

SEQ ID NO: 160818 - DNA, 4212 bp, Artificial Sequence
  Description of Artificial Sequence: Synthetic coding sequence
tgactgctgctggagagctgtgagaaggagaagcaggccctgctgcagaacctgaaggaggtggaggacaaggccagcgcctatgaggaccagctgcagggccaggcccagcaggtggagaccctgcagaaggagaagctgagcgccacctttgagggcagcgagcaggtgcaccagctggaggagcagctggaggcccgggaggcctctgtgcggcggctggccgagcacgtgcagagcctgtgtgatgagcgggacctgctgcggcagcgcttccaggagctgacagagcgggtggccaccagtgatgaagatgtggccgagctgcgggagaagctgcggcggcgggaggccgacaaccagagcctggagcacagctaccagagggtgagcagccagctgcagagcatgcacaccctgctgcgggagaaggaggaggagctggagcgcatcaaggaggcccacgagaaggtgctggagaagaaggagcaggacctgaatgaggccctggtgaagatggtggccctgggcagcagcctggaggagacagagatcaagctgcaggccaaggaggagatcctgaggaagtttgccagcgagagccccaaggacatggaggagcccaggagcaccccagaggagacagaaagagatggcaccctgctgcccggccagcctgtgcaggccacccgggcccccctgggcctgccccacacccggctggaggatgaagatgaggacctgggcgcccctcctggagaggagtatggagatggcagccccagccgggaggacagcatggtgccccccaagtctgtggaggtgctggaccgggagggccaccagcagggcacagccaagctggaccagggcgcccctggggtgaagaggcagaggatccgcttcagcaccatccagtgccagcgctacatccaccctgagggcagcgagaagacctggaccagcagcaccagcagtgacaccagccaggacaggagccccagcgaggagagcatgagcagcgagcccgcccccagcgtgctgcctgccactggagacagcgacacctacctgagcatcatccacagcctggagaccaagctgtatgtgacagaggagaagctgaaggatgtgacagtgcggctggagagccagcagggccagagccgggaggccctgctggccctgcaccaccagtgggccggcacagaggcccagctgcgggagcagctgcgggccagcctgctgcaggtgggcgccctggccagccagctggagcaggagcggcaggagcgggcccggcgggtggagggccacgtgggggagctgggggacttccaggtgaagaacagccaggccctgatgtgcctggagaactgccgggagcagctgcggagcctgccccgggccagccaggaggatgagcaggatgcccgggccgccagcctggcctctgtggagagcgccctggtgtctgccatccaggccctgcagcactggccagccccagcccatggaggagcccgggcccagctggagaccggcggcacagaagaaaatggcaagccagccagcctgcagcagtgcagccagagcgagctgacagagcaggagcaggtgcggctgctgagtgaccagatcgccctggaggccagcctcatcagccagattgctgacagcctgaagaacaccaccagtgatgtgtccaggatgctgcacgagatctcctggagcggccagccccccatggagagcgctggggcccctgtggacacctgggccaggaaggtgctggtggatggagagttctggagccaggtggagagcctgaggaagcacctgggcaccctgggcggggaggccgtgggcgccagcggagatggccagcagagcatcccccagggcctggcccccatcctggccaatgccacctgggtgcgggcagagctgagctttgccacccagagcgtgcgggagagcttccaccggcggctgcagagcatccaggagaccctgcggggcacccagacagccctgcggcagcacaagtgcctgctgcgggagatcctgggcgcctaccagaccccagactttgagcgggtgatgcagcaggtgctggaggccctgcggctgcctgctggccatgaagatggagtgcagctgtcctgggacctgagccccctgggggaggtgctgggccgggacagcgacagcagccaggagccctttgatgtgtctgaccagagccctggggcctttgtggccatccaggaggagctggcccagcagctgaaggagaaggccagcctgctggaggagattgctgctgccctgcccagcctgccccctgtggagagcctgcgggactgccagaagctgctgcaggtgtcccagagcctgagctacaacacctgcctgggcggcctgggccagtacagcagcctgctggtgcaggatgccatcatccaggcccaggtgtgctacgccagctgccgcatccggctggagtatgagaaggagctgcagctgtgcaaggagagctggcagacccgggagcccagctgcagcgagcaggcccaggccgcccgggccctgcgggaggagtatgaggagctgctgaggaagcagaagtctgagtacctggatgtgattgccatcgtggagcgggagaatgctgagctgaaggccaaggccgcccagctggaccaccagcagcagtgcctggaggatgctgagagcaagcacagcatgtccatgttcaccctgcggggccgctatgaggaggagatccgctgtgtggtggagcagctgaccaggacagagagcaccctgcaggccgagaggagccgggtgctgagccagctggatgcctctgtgcgggaccggcaggacatggagcggcaccacggggagcagatccagaccctggaggaccgcttccagctgaaggtgcgggagctgcagaccatccacgaggaggagctgcggaccctgcaggagcactacagccagagcctgcgctgcctgcaggacaccctgtgcctgcaccagggcccccaccccaaggccctgcctgccccagcccccaactggcaggccacccagggcgaggccgacagcatgacaggcctgcgggagcgcatccaggagctggaggcccagatggatgtgatgagggaggagctgggccacaaggacctggagggagatgctgccaccctgcgggagaagtaccagagggacctggagagcctgaaggccacctgtgagcggggctttgctgccatggaggagacccaccagaagaagattgaggacctgcagaggcagcaccagcgggagctggagaagctgcgggaggagaaggaccggctgctggccgaggagacagctgccaccatcagcgccatcgaggccatgaagaatgcccaccgggaggagatggagcgggagctggagaagagccagaggagccagatcagctctgtgaacagtgatgtggaggccctgcggcggcagtacctggaggagctgcagagcgtgcagcgggagctggaggtgctgtctgagcagtacagccagaagtgcctggagaatgcccacctggcccaggccctggaggccgagcggcaggccctgcggcagtgccagcgggagaaccaggagctgaatgcccacaaccaggagctgaacaaccggctggccgctgagatcacccggctgcggaccctgctgactggagatggcggcggggaggccaccggcagccccctggcccagggcaaggatgcctatgagctggaggtgctgctgcgggtgaaggagagcgagatccagtacctgaagcaggagatcagcagcctgaaggatgagctgcagacagccctgcgggacaagaagtatgccagtgacaagtacaaggacatctacacagagctgagcatcgccaaggccaaggctgactgtgacatcagccggctgaaggagcagctgaaggccgccacagaggccctgggggagaagagcccagattctgccaccgtgtctggctatgacatcatgaagagcaagagcaacccagacttcctgaagaaggacaggagctgtgtgacccggcagctgaggaacatccgcagcaagagcctgaaggagggcctgactgtgcaggagcggctgaagctgtttgagagccgggacctgaagaaggactag

SEQ ID NO: 160819 - DNA, 3078 bp, Artificial Sequence
  Description of Artificial Sequence: Synthetic coding sequence
atgtctgctgccaaggagaacccctgcaggaagttccaggccaacatcttcaacaagagcaagtgccagaactgcttcaagccccgggagagccacctgctgaatgatgaggacctgacccaggccaagcccatctacggcggctggctgctgctggccccagatggaacagactttgacaaccctgtgcacaggagcaggaagtggcagaggcgcttcttcatcctgtatgaacatggcctgctgcgctatgccctggatgagatgcccaccaccctgccccagggcaccatcaacatgaaccagtgcacagatgtggtggatggagagggccgcacaggccagaagttcagcctgtgcatcctgaccccagagaaggagcacttcatccgggcagagaccaaggagatcgtgtctggctggctggagatgctgatggtgtaccccaggaccaacaagcagaaccagaagaagaagaggaaggtggagccccccaccccccaggagcccggccctgccaaggtggccgtgaccagcagcagcagcagcagcagcagcagcagcagcatccccagcgctgagaaggtgcccaccaccaagagcaccctgtggcaggaggagatgaggaccaaggaccagccagatggcagcagcctgagccctgcccagagccccagccagagccagcccccagctgccagcagcctgcgggagcccggcctggagagcaaggaggaggagagcgccatgagcagtgacaggatggactgtggcaggaaggtgcgggtggagagcggctacttcagcctggagaagaccaagcaggacctgaaggccgaggagcagcagctgcccccacccctgagcccccccagccccagcacccccaaccacagaagaagccaggtgattgagaagtttgaggccctggacatcgagaaggccgagcacatggagaccaatgctgtgggccccagccccagcagtgacacccggcagggccgctctgagaagagggccttccccaggaagagggacttcaccaatgaggcccccccagcccccctgcctgatgccagcgccagccccctgagcccccaccggcgggccaagagcctggacagaagaagcacagagcccagcgtgaccccagacctgctgaacttcaagaagggctggctgaccaagcagtatgaagatggccagtggaagaagcactggtttgtgctggccgaccagagcctgcgctactacagagattctgtggccgaggaggccgctgacctggatggagaaattgacctgagcgcctgctatgatgtgacagagtaccctgtgcagaggaactacggcttccagatccacaccaaggagggggagttcaccctgagcgccatgaccagcggcatcagaagaaactggatccagaccatcatgaagcacgtgcaccccaccacagccccagatgtgaccagcagcctgcctgaggagaagaacaagagcagctgcagctttgagacctgcccccggcccacagagaagcaggaggccgagctgggggagccagaccctgagcagaagaggagccgggcccgggagaggagaagagagggccgcagcaagacctttgactgggccgagttccggcccatccagcaggccctggcccaggagcgggtgggcggcgtgggccctgctgacacccatgagcccctgcggcctgaggccgagcccggggagctggagcgggagcgggcccggcggcgggaggagaggaggaagcgcttcggcatgctggatgccacagatggccctggaacagaagatgctgccctgaggatggaggtggacaggagccctggcctgcccatgtctgacctgaagacccacaacgtgcacgtggagattgagcagcgctggcaccaggtggagaccacccccctgcgggaggagaagcaggtgcccatcgcccctgtgcacctgagcagtgaagatggaggagaccggctgagcacccatgagctgaccagcctgctggagaaggagctggagcagagccagaaggaggccagtgacctgctggagcagaaccggctgctgcaggaccagctgcgggtggccctgggccgggagcagagcgcccgggagggctacgtgctgcaggccacctgtgagcggggctttgctgccatggaggagacccaccagaagaagattgaggacctgcagaggcagcaccagcgggagctggagaagctgcgggaggagaaggaccggctgctggccgaggagacagctgccaccatcagcgccatcgaggccatgaagaatgcccaccgggaggagatggagcgggagctggagaagagccagaggagccagatcagctctgtgaacagtgatgtggaggccctgcggcggcagtacctggaggagctgcagagcgtgcagcgggagctggaggtgctgtctgagcagtacagccagaagtgcctggagaatgcccacctggcccaggccctggaggccgagcggcaggccctgcggcagtgccagcgggagaaccaggagctgaatgcccacaaccaggagctgaacaaccggctggccgctgagatcacccggctgcggaccctgctgactggagatggcggcggggaggccaccggcagccccctggcccagggcaaggatgcctatgagctggaggtgctgctgcgggtgaaggagagcgagatccagtacctgaagcaggagatcagcagcctgaaggatgagctgcagacagccctgcgggacaagaagtatgccagtgacaagtacaaggacatctacacagagctgagcatcgccaaggccaaggctgactgtgacatcagccggctgaaggagcagctgaaggccgccacagaggccctgggggagaagagcccagacagcgccaccgtgtctggctatgacatcatgaagagcaagagcaacccagacttcctgaagaaggacaggagctgtgtgacccggcagctgaggaacatccgcagcaagagcgtcatcgagcaggtgtcctgggacacctag

SEQ ID NO: 160820 - DNA, 3078 bp, Artificial Sequence; identical to SEQ ID NO: 160819
  Description of Artificial Sequence: Synthetic coding sequence

SEQ ID NO: 160821 - DNA, 192 bp, Artificial Sequence
  Description of Artificial Sequence: Synthetic coding sequence
atgtctgctgccaaggagaacccctgcaggaagttccaggccaacatcttcaacaagagcaagtgccagaactgcttcaagccccgggagagccacctgctgaatgatgaggacctgacccagcagaacacccaccccctggagatgaagagaggagcccacatctatgatgccaggatgttcagctgctag

SEQ ID NO: 160822 - DNA, 282 bp, Artificial Sequence
  Description of Artificial Sequence: Synthetic coding sequence
atgtctgctgccaaggagaacccctgcaggaagttccaggccaacatcttcaacaagagcaagtgccagaactgcttcaagccccgggagagccacctgctgaatgatgaggacctgacccaggccaagcccatctacggcggctggctgctgctggccccagatggaacagactttgacaaccctgtgcacaggagcaggaagtggcagaggcgcttcttcatcctgtatgaacatggcctgctgcgctatgccctggatgagatgatgagcagccagtag

SEQ ID NO: 160823 - DNA, 3117 bp, Artificial Sequence
  Description of Artificial Sequence: Synthetic coding sequence
atgtctgctgccaaggagaacccctgcaggaagttccaggccaacatcttcaacaagagcaagtgccagaactgcttcaagccccgggagagccacctgctgaatgatgaggacctgacccaggccaagcccatctacggcggctggctgctgctggccccagatggaacagactttgacaaccctgtgcacaggagcaggaagtggcagaggcgcttcttcatcctgtatgaacatggcctgctgcgctatgccctggatgagatgcccaccaccctgccccagggcaccatcaacatgaaccagtgcacagatgtggtggatggagagggccgcacaggccagaagttcagcctgtgcatcctgaccccagagaaggagcacttcatccgggcagagaccaaggagatcgtgtctggctggctggagatgctgatggtgtaccccaggaccaacaagcagaaccagaagaagaagaggaaggtggagccccccaccccccaggagcccggccctgccaaggtggccgtgaccagcagcagcagcagcagcagcagcagcagcagcatccccagcgctgagaaggtgcccaccaccaagagcaccctgtggcaggaggagatgaggaccaaggaccagccagatggcagcagcctgagccctgcccagagccccagccagagccagcccccagctgccagcagcctgcgggagcccggcctggagagcaaggaggaggagagcgccatgagcagtgacaggatggactgtggcaggaaggtgcgggtggagagcggctacttcagcctggagaagaccaagcaggacctgaaggccgaggagcagcagctgcccccacccctgagcccccccagccccagcacccccaaccacagaagaagccaggtgattgagaagtttgaggccctggacatcgagaaggccgagcacatggagaccaatgctgtgggccccagccccagcagtgacacccggcagggccgctctgagaagagggccttccccaggaagagggacttcaccaatgaggcccccccagcccccctgcctgatgccagcgccagccccctgagcccccaccggcgggccaagagcctggacagaagaagcacagagcccagcgtgaccccagacctgctgaacttcaagaagggctggctgaccaagcagtatgaagatggccagtggaagaagcactggtttgtgctggccgaccagagcctgcgctactacagagattctgtggccgaggaggccgctgacctggatggagaaattgacctgagcgcctgctatgatgtgacagagtaccctgtgcagaggaactacggcttccagatccacaccaaggagggggagttcaccctgagcgccatgaccagcggcatcagaagaaactggatccagaccatcatgaagcacgtgcaccccaccacagccccagatgtgaccagcagcctgcctgaggagaagaacaagagcagctgcagctttgagacctgcccccggcccacagagaagcaggaggccgagctgggggagccagaccctgagcagaagaggagccgggcccgggagaggagaagagagggccgcagcaagacctttgactgggccgagttccggcccatccagcaggccctggcccaggagcgggtgggcggcgtgggccctgctgacacccatgagcccctgcggcctgaggccgagcccggggagctggagcgggagcgggcccggcggcgggaggagaggaggaagcgcttcggcatgctggatgccacagatggccctggaacagaagatgctgccctgaggatggaggtggacaggagccctggcctgcccatgtctgacctgaagacccacaacgtgcacgtggagattgagcagcgctggcaccaggtggagaccacccccctgcgggaggagaagcaggtgcccatcgcccctgtgcacctgagcagtgaagatggaggagaccggctgagcacccatgagctgaccagcctgctggagaaggagctggagcagagccagaaggaggccagtgacctgctggagcagaaccggctgctgcaggaccagctgcgggtggccctgggccgggagcagagcgcccgggagggctacgtgctgcaggccacctgtgagcggggctttgctgccatggaggagacccaccagaagaagattgaggacctgcagaggcagcaccagcgggagctggagaagctgcgggaggagaaggaccggctgctggccgaggagacagctgccaccatcagcgccatcgaggccatgaagaatgcccaccgggaggagatggagcgggagctggagaagagccagaggagccagatcagctctgtgaacagtgatgtggaggccctgcggcggcagtacctggaggagctgcagagcgtgcagcgggagctggaggtgctgtctgagcagtacagccagaagtgcctggagaatgcccacctggcccaggccctggaggccgagcggcaggccctgcggcagtgccagcgggagaaccaggagctgaatgcccacaaccaggagctgaacaaccggctggccgctgagatcacccggctgcggaccctgctgactggagatggcggcggggaggccaccggcagccccctggcccagggcaaggatgcctatgagctggaggtgctgctgcgggtgaaggagagcgagatccagtacctgaagcaggagatcagcagcctgaaggatgagctgcagacagccctgcgggacaagaagtatgccagtgacaagtacaaggacatctacacagagctgagcatcgccaaggccaaggctgactgtgacatcagccggctgaaggagcagctgaaggccgccacagaggccctgggggagaagagcccagacagcgccaccgtgtctggctatgacatcatgaagagcaagagcaacccagacttcctgaagaaggacaggagctgtgtgacccggcagctgaggaacatccgcagcaagagcctgaaggagggcctgactgtgcaggagcggctgaagctgtttgagagccgggacctgaagaaggactag

SEQ ID NO: 160824 - DNA, 3276 bp, Artificial Sequence
  Description of Artificial Sequence: Synthetic coding sequence
tgaagattcagcaccatccagtgccagcgctacatccaccctgagggcagcgagaagacctggaccagcagcaccagcagtgacaccagccaggacaggagccccagcgaggagagcatgagcagcgagcccgcccccagcgtgctgcctgccaccggggacagcgacacctacctgagcatcatccacagcctggagaccaagctgtatgtgacagaggagaagctgaaggatgtgacagtgcggctggagagccagcagggccagagccgggaggccctgctggccctgcaccaccagtgggccggcacagaggcccagctgcgggagcagctgcgggccagcctgctgcaggtgggcgccctggccagccagctggagcaggagcggcaggagcgggccaggagagtggagggccacgtgggggagctgggggacttccaggtgaagaacagccaggccctgatgtgcctggagaactgccgggagcagctgcggagcctgccccgggccagccaggaggatgagcaggatgcccgggccgccagcctggcctctgtggagagcgccctggtgtctgccatccaggccctgcagcactggccagccccagcccacggcggggcccgggcccagctggagactggaggaacagaggagaatggcaagccagccagcctgcagcagtgcagccagagcgagctgacagagcaggagcaggtgcggctgctgagtgaccagatcgccctggaggccagcctcatcagccagattgctgacagcctgaagaacaccaccagtgatgtgtccaggatgctgcacgagatctcctggagcggccagccccccatggagagcgctggggcccctgtggacacctgggccaggaaggtgctggtggatggagagttctggagccaggtggagagcctgaggaagcacctgggcaccctgggcggggaggccgtgggcgccagcggagatggccagcagagcatcccccagggcctggcccccatcctggccaatgccacctgggtgcgggcagagctgagctttgccacccagagcgtgcgggagagcttccaccggcggctgcagagcatccaggagaccctgcggggcacccagacagccctgcggcagcacaagtgcctgctgcgggagatcctgggcgcctaccagaccccagactttgagcgggtgatgcagcaggtgctggaggccctgcggctgcctgctggccatgaagatggagtgcagctgtcctgggacctgagccccctgggggaggtgctgggccgggacagcgacagcagccaggagccctttgatgtgtctgaccagagccctggggcctttgtggccatccaggaggagctggcccagcagctgaaggagaaggccagcctgctggaggagattgctgctgccctgcccagcctgccccctgtggagagcctgcgggactgccagaagctgctgcaggtgtcccagagcctgagctacaacacctgcctgggcggcctgggccagtacagcagcctgctggtgcaggatgccatcatccaggcccaggtgtgctacgccagctgccgcatccggctggagtatgagaaggagctgcagctgtgcaaggagagctggcagacccgggagcccagctgcagcgagcaggcccaggccgcccgggccctgcgggaggagtatgaggagctgctgaggaagcagaagtctgagtacctggatgtgattgccatcgtggagagagaaaatgctgagctgaaggccaaggccgcccagctggaccaccagcagcagtgcctggaggatgctgagagcaagcacagcatgtccatgttcaccctgcggggccgctatgaggaggagatccgctgtgtggtggagcagctgaccaggacagagagcaccctgcaggccgagaggagccgggtgctgagccagctggatgcctctgtgcgggaccggcaggacatggagcggcaccacggggagcagatccagaccctggaggaccgcttccagctgaaggtgcgggagctgcagaccatccacgaggaggagctgcggaccctgcaggagcactacagccagagcctgcgctgcctgcaggacaccctgtgcctgcaccagggcccccaccccaaggccctgcctgccccagcccccaactggcaggccacccagggcgaggccgacagcatgacaggcctgcgggagcgcatccaggagctggaggcccagatggatgtgatgagggaggagctgggccacaaggacctggagggagatgctgccaccctgcgggagaagtaccagagggacctggagagcctgaaggccacctgtgagcggggctttgctgccatggaggagacccaccagaagaagattgaggacctgcagaggcagcaccagcgggagctggagaagctgcgggaggagaaggaccggctgctggccgaggagacagctgccaccatcagcgccatcgaggccatgaagaatgcccaccgggaggagatggagcgggagctggagaagagccagaggagccagatcagctctgtgaacagtgatgtggaggccctgcggcggcagtacctggaggagctgcagagcgtgcagcgggagctggaggtgctgtctgagcagtacagccagaagtgcctggagaatgcccacctggcccaggccctggaggccgagcggcaggccctgcggcagtgccagcgggagaaccaggagctgaatgcccacaaccaggagctgaacaaccggctggccgctgagatcacccggctgcggaccctgctgactggagatggcggcggggaggccaccggcagccccctggcccagggcaaggatgcctatgagctggaggtgctgctgcgggtgaaggagagcgagatccagtacctgaagcaggagatcagcagcctgaaggatgagctgcagacagccctgcgggacaagaagtatgccagtgacaagtacaaggacatctacacagagctgagcatcgccaaggccaaggctgactgtgacatcagccggctgaaggagcagctgaaggccgccacagaggccctgggggagaagagcccagacagcgccaccgtgtctggctatgacatcatgaagagcaagagcaacccagacttcctgaagaaggacaggagctgtgtgacccggcagctgaggaacatccgcagcaagagcgtcatcgagcaggtgtcctgggacacctag

SEQ ID NO: 160825 - DNA, 840 bp, Artificial Sequence
  Description of Artificial Sequence: Synthetic coding sequence
tgacaggaggccgagctgggggagccagaccctgagcagaagaggagccgggcccgggagcggcggcgggagggccgcagcaagacctttgactgggccgagttccggcccatccagcaggccctggcccaggagcgggtgggcggcgtgggccctgctgacacccatgagcccctgcggcctgaggccgagcctggagagctggagcgggagcgggccaggagaagagaggagaggaggaagagatttggcatgctggatgccacagatggccctggaacagaagatgctgccctgaggatggaggtggacaggagccctggcctgcccatgtctgacctgaagacccacaacgtgcacgtggagattgagcagcgctggcaccaggtggagaccacccccctgcgggaggagaagcaggtgcccatcgcccctgtgcacctgagcagtgaagatggaggagaccggctgagcacccatgagctgaccagcctgctggagaaggagctggagcagagccagaaggaggccagtgacctgctggagcagaaccggctgctgcaggaccagctgcgggtggccctgggccgggagcagagcgcccgggagggctacgtgctgcagacagaggtggccgccagccccagcggggcctggcagaggctgcaccgggtgaaccaggacctgcagagcgagctggaggcccagtgccagaggcaggagctgatcacccaccagatccagaccctgaagaggagctatggagaggccaaggacaccatccgccaccacgaggccgagatccgcagcctgcaggcccggctgagcaatgctgcctag

SEQ ID NO: 160826 - DNA, 585 bp, Artificial Sequence
  Description of Artificial Sequence: Synthetic coding sequence
ctgcggcagcagacagtggaggagctgcagagcgtgcagcgggagctggaggtgctgtctgagcagtacagccagaagtgcctggagaatgcccacctggcccaggccctggaggccgagcggcaggccctgcggcagtgccagcgggagaaccaggagctgaatgcccacaaccaggtgctgctgcgggtgaaggagagcgagatccagtacctgaagcaggagatcagcagcctgaaggatgagctgcagacagccctgcgggacaagaagtatgccagtgacaagtacaaggacatctacacagagctgagcatcgccaaggccaaggctgactgtgacatcagccggctgaaggagcagctgaaggccgccacagaggccctgggggagaagagcccagacagcgccaccgtgtctggctatgacatcatgaagagcaagagcaacccagacttcctgaagaaggacaggagctgtgtgacccggcagctgaggaacatccgcagcaagagcctgaaggagggcctgactgtgcaggagcggctgaagctgtttgagagccgggacctgaagaaggactag

SEQ ID NO: 160827 - DNA, 3003 bp, Artificial Sequence
  Description of Artificial Sequence: Synthetic coding sequence
atgtctgctgccaaggagaacccctgcaggaagttccaggccaacatcttcaacaagagcaagtgccagaactgcttcaagccccgggagagccacctgctgaatgatgaggacctgacccaggccaagcccatctacggcggctggctgctgctggccccagatggaacagactttgacaaccctgtgcacaggagcaggaagtggcagaggcgcttcttcatcctgtatgaacatggcctgctgcgctatgccctggatgagatgcccaccaccctgccccagggcaccatcaacatgaaccagtgcacagatgtggtggatggagagggccgcacaggccagaagttcagcctgtgcatcctgaccccagagaaggagcacttcatccgggcagagaccaaggagatcgtgtctggctggctggagatgctgatggtgtaccccaggaccaacaagcagaaccagaagaagaagaggaaggtggagccccccaccccccaggagcccggccctgccaaggtggccgtgaccagcagcagcagcagcagcagcagcagcagcagcatccccagcgctgagaaggtgcccaccaccaagagcaccctgtggcaggaggagatgaggaccaaggaccagccagatggcagcagcctgagccctgcccagagccccagccagagccagcccccagctgccagcagcctgcgggagcccggcctggagagcaaggaggaggagagcgccatgagcagtgacaggatggactgtggcaggaaggtgcgggtggagagcggctacttcagcctggagaagaccaagcaggacctgaaggccgaggagcagcagctgcccccacccctgagcccccccagccccagcacccccaaccacagaagaagccaggtgattgagaagtttgaggccctggacatcgagaaggccgagcacatggagaccaatgctgtgggccccagccccagcagtgacacccggcagggccgctctgagaagagggccttccccaggaagaggccagacctgctgaacttcaagaagggctggctgaccaagcagtatgaagatggccagtggaagaagcactggtttgtgctggccgaccagagcctgcgctactacagagattctgtggccgaggaggccgctgacctggatggagaaattgacctgagcgcctgctatgatgtgacagagtaccctgtgcagaggaactacggcttccagatccacaccaaggagggggagttcaccctgagcgccatgaccagcggcatcagaagaaactggatccagaccatcatgaagcacgtgcaccccaccacagccccagatgtgaccagcagcctgcctgaggagaagaacaagagcagctgcagctttgagacctgcccccggcccacagagaagcaggaggccgagctgggggagccagaccctgagcagaagaggagccgggcccgggagaggagaagagagggccgcagcaagacctttgactgggccgagttccggcccatccagcaggccctggcccaggagcgggtgggcggcgtgggccctgctgacacccatgagcccctgcggcctgaggccgagcccggggagctggagcgggagcgggcccggcggcgggaggagaggaggaagcgcttcggcatgctggatgccacagatggccctggaacagaagatgctgccctgaggatggaggtggacaggagccctggcctgcccatgtctgacctgaagacccacaacgtgcacgtggagattgagcagcgctggcaccaggtggagaccacccccctgcgggaggagaagcaggtgcccatcgcccctgtgcacctgagcagtgaagatggaggagaccggctgagcacccatgagctgaccagcctgctggagaaggagctggagcagagccagaaggaggccagtgacctgctggagcagaaccggctgctgcaggaccagctgcgggtggccctgggccgggagcagagcgcccgggagggctacgtgctgcaggccacctgtgagcggggctttgctgccatggaggagacccaccagaagaagattgaggacctgcagaggcagcaccagcgggagctggagaagctgcgggaggagaaggaccggctgctggccgaggagacagctgccaccatcagcgccatcgaggccatgaagaatgcccaccgggaggagatggagcgggagctggagaagagccagaggagccagatcagctctgtgaacagtgatgtggaggccctgcggcggcagtacctggaggagctgcagagcgtgcagcgggagctggaggtgctgtctgagcagtacagccagaagtgcctggagaatgcccacctggcccaggccctggaggccgagcggcaggccctgcggcagtgccagcgggagaaccaggagctgaatgcccacaaccaggagctgaacaaccggctggccgctgagatcacccggctgcggaccctgctgactggagatggcggcggggaggccaccggcagccccctggcccagggcaaggatgcctatgagctggaggtgctgctgcgggtgaaggagagcgagatccagtacctgaagcaggagatcagcagcctgaaggatgagctgcagacagccctgcgggacaagaagtatgccagtgacaagtacaaggacatctacacagagctgagcatcgccaaggccaaggctgactgtgacatcagccggctgaaggagcagctgaaggccgccacagaggccctgggggagaagagcccagacagcgccaccgtgtctggctatgacatcatgaagagcaagagcaacccagacttcctgaagaaggacaggagctgtgtgacccggcagctgaggaacatccgcagcaagagcctgaaggagggcctgactgtgcaggagcggctgaagctgtttgagagccgggacctgaagaaggactag

SEQ ID NO: 160828 - DNA, 795 bp, Artificial Sequence
  Description of Artificial Sequence: Synthetic coding sequence
atggagaactacggcatcgagtggcacagcgtgcgggacagcgagggccagaagctgctgattggagtgggccctgagggcatcagcatctgcaaggatgacttcagccccatcaacagaattgcctaccctgtggtgcagatggccacccagagcggcaagaatgtgtacctgactgtgaccaaggagagcggcaacagcatcgtgctgctcttcaagatgatcagcaccagggctgccagcggcctgtaccgggccatcacagagacccacgccttctaccgctgtgacacagtgaccagcgctgtgatgatgcagtacagccgggacctgaagggccacctggccagcctcttcctgaatgaaaacatcaacctgggcaagaagtatgtgtttgacatcaagaggaccagcaaggaggtgtatgaccacgcccggcgggccctgtacaatgctggggtggtggacctggtgtccaggaacaaccagagccccagccacagccccctgaagagcagcgagagctccatgaactgcagcagctgtgagggcctgagctgccagcagaccagggtgctgcaggagaagctgaggaagctgaaggaggccatgctgtgcatggtgtgctgtgaggaggagatcaacagcaccttctgcccctgtggccacacagtgtgctgtgagagctgtgccgcccagctgcagagctgccctgtgtgccgcagccgggtggagcacgtgcagcacgtgtacctgcccacccacaccagcctgctgaacctgaccgtcatctag

SEQ ID NO: 160829 - DNA, 1338 bp, Artificial Sequence
  Description of Artificial Sequence: Synthetic coding sequence
atgctgtgctacgtgaccaggccagatgctgtgctgatggaggtggaggtggaggccaaggccaacggggaggactgcctgaaccaggtgtgccggcggctgggcatcatcgaggtggactacttcggcctgcagttcaccggcagcaagggggagagcctgtggctgaacctgaggaaccgcatcagccagcagatggatggcctggccccctaccgcctgaagctgcgggtgaagttctttgtggagccccacctgatcctgcaggagcagaccaggcacatcttcttcctgcacatcaaggaggccctgctggccggccacctgctgtgcagccctgagcaggccgtggagctgagcgccctgctggcccagaccaagtttggagactacaaccagaacacagccaagtacaactatgaggagctgtgtgccaaggagctgagcagcgccaccctgaacagcatcgtggccaagcacaaggagctggagggcaccagccaggccagcgctgagtaccaggtgctgcagatcgtgtctgccatggagaactatggaattgagtggcacagcgtgcgggacagcgagggccagaagctgctgattggagtgggccctgagggcatcagcatctgcaaggatgacttcagccccatcaaccgcatcgcctaccctgtggtgcagatggccacccagagcggcaagaatgtgtacctgactgtgaccaaggagagcggcaacagcatcgtgctgctcttcaagatgatcagcacccgggccgccagcggcctgtaccgggccatcacagagacccacgccttctaccgctgtgacacagtgaccagcgctgtgatgatgcagtacagccgggacctgaagggccacctggccagcctcttcctgaatgaaaacatcaacctgggcaagaagtatgtgtttgacatcaagaggaccagcaaggaggtgtatgaccacgcccggcgggccctgtacaatgccggcgtggtggacctggtgtccaggaacaaccagagccccagccacagccccctgaagagcagcgagagctccatgaactgcagcagctgtgagggcctgagctgccagcagaccagggtgctgcaggagaagctgaggaagctgaaggaggccatgctgtgcatggtgtgctgtgaggaggagatcaacagcaccttctgcccctgtggccacacagtgtgctgtgagagctgtgccgcccagctgcagagctgccctgtgtgccgcagccgggtggagcacgtgcagcacgtgtacctgcccacccacaccagcctgctgaacctgaccgtcatctag

SEQ ID NO: 160830 - DNA, 5487 bp, Artificial Sequence
  Description of Artificial Sequence: Synthetic coding sequence
atggccgccagcgagctgtacaccaagtttgcccgggtgtggatcccagaccctgaggaggtgtggaagtctgctgagctgctgaaggactacaagccaggggacaaggtgctgctgctgcacctggaggagggcaaggacctggagtaccacctggaccccaagaccaaggagctgccccacctgagaaatccagacatcctggtgggagaaaatgacctgacagccctgagctacctgcacgagcctgctgtgctgcacaacctgcgggtgcgcttcatcgacagcaagctgatctacacctactgcggcatcgtgctggtggccatcaacccctatgagcagctgcccatctatggagaggacatcatcaatgcctacagcggccagaacatgggagacatggacccccacatctttgctgtggccgaggaggcctacaagcagatggccagagatgaaagaaaccagagcatcatcgtgtctggagagagcggggccggcaagacagtgtctgccaagtatgccatgagatactttgccaccgtgtctggcagcgccagcgaggccaacgtggaggagaaggtgctggccagcaaccccatcatggagagcattggaaatgccaagaccaccagaaatgacaacagcagcagatttgggaagtacatcgagatcggctttgacaagcgctaccgcatcattggagccaacatgaggacctacctgctggagaagagccgggtggtgttccaggccgaggaggagaggaactaccacatcttctaccagctgtgtgccagcgccaagctgcctgagttcaagatgctgcggctgggcaatgctgacaacttcaactacaccaagcagggcggcagccctgtgattgagggcgtggatgatgccaaggagatggcccacacccggcaggcctgcaccctgctgggcatcagcgagagccaccagatgggcatcttccgcatcctggccggcatcctgcacctgggcaatgtgggcttcaccagcagagatgctgacagctgcaccatcccccccaagcatgagcccctgtgcatcttctgtgagctgatgggcgtggactatgaggagatgtgccactggctgtgccacaggaagctggccacagccacagagacctacatcaagcccatcagcaagctgcaggccaccaatgccagagatgccctggccaagcacatctatgccaagctgttcaactggatcgtggacaacgtgaaccaggccctgcacagcgctgtgaagcagcacagcttcatcggcgtgctggacatctacggctttgagacctttgagatcaacagctttgagcagttctgcatcaactatgccaatgagaagctgcagcagcagttcaacatgcacgtgttcaagctggagcaggaggagtacatgaaggagcagatcccctggaccctgattgacttctatgacaaccagccctgcatcaacctgattgagagcaagctgggcatcctggacctgctggatgaggagtgcaagatgcccaagggcacagatgacacctgggcccagaagctgtacaacacccacctgaacaagtgtgccctgtttgagaagccccggctgagcaacaaggccttcatcatccagcactttgctgacaaggtggagtaccagtgtgagggcttcctggagaagaacaaggacacagtgtttgaggagcagatcaaggtgctgaagagcagcaagttcaagatgctgcctgagctgttccaggatgatgagaaggccatcagccccaccagcgccaccagcagcggccgcacccccctgaccaggaccccagccaagcccaccaagggccggcccggccagatggccaaggagcacaagaagacagtgggccaccagttcaggaacagcctgcacctgctgatggagaccctgaatgccaccaccccccactacgtgcgctgcatcaagcccaatgacttcaagttccccttcacctttgatgagaagagagctgtgcagcagctgcgggcctgtggggtgctggagaccatccgcatctctgctgctggcttccccagccgctggacctaccaggagttcttcagccgctacagagtgctgatgaagcagaaggatgtgctgagtgacaggaagcagacctgcaagaatgtgctggagaagctgatcctggacaaggacaagtaccagtttgggaagaccaagatcttcttccgggccggccaggtggcctacctggagaagctgcgggctgacaagctgcgggccgcctgcatccgcatccagaagaccatccggggctggctgctgaggaagaagtacctgaggatgaggaaggccgccatcaccatgcagagatatgtgcggggctaccaggcccgctgctacgccaagttcctgcggaggaccaaggccgccaccatcatccagaagtactggaggatgtatgtggtgagaagacgctacaagatcagaagagctgccaccatcgtgctgcagagctacctgcggggcttcctggccaggaaccgctacaggaagatcctgcgggagcacaaggccgtcatcatccagaagagggtgcggggctggctggcccggacccactacaagaggtccatgcacgccatcatctacctgcagtgctgcttccggaggatgatggccaagcgggagctgaagaagctgaagattgaggcccggtctgtggagcgctacaagaagctgcacatcggcatggagaacaagatcatgcagctgcagaggaaggtggatgagcagaacaaggactacaagtgcctggtggagaagctgaccaacctggagggcatctacaacagcgagacagagaagctgcggagtgacctggagcggctgcagctgtctgaggaggaggccaaggtggccaccggccgggtgctgagcctgcaggaggagatcgccaagctgaggaaggacctggagcagaccaggtctgagaagaagtgcatcgaggagcacgccgaccgctacaagcaggagacagagcagctggtgagcaacctgaaggaggagaacaccctgctgaagcaggagaaggaggccctgaaccacagaattgtgcagcaggccaaggagatgacagagaccatggagaagaagctggtggaggagaccaagcagctggagctggacctgaatgatgagcggctgcgctaccagaacctgctgaatgagttcagccggctggaggagagatatgatgacctgaaggaggagatgaccctgatggtgcacgtgcccaagccaggccacaagaggacagacagcacccacagcagcaatgaaagtgagtacatcttcagcagcgagattgctgagatggaggacatccccagcaggacagaggagcccagcgagaagaaggtgcccctggacatgagcctcttcctgaagctgcagaagagggtgacagagctggagcaggagaagcaggtgatgcaggatgagctggacaggaaggaggagcaggtgctgcggagcaaggccaaggaggaggagcggccccagatcagaggagctgagctggagtatgagagcctgaagaggcaggagctggagagcgagaacaagaagctgaagaatgagctgaatgagctgaggaaggccctgtctgagaagagcgcccctgaggtgacagcccctggggccccagcctacagagtgctgatggagcagctgacctctgtgtctgaggagctggatgtgaggaaggaggaggtgctgatcctgcggagccagctggtgtcccagaaggaggccatccagcccaaggatgacaagaacaccatgacagacagcaccatcctgctggaggatgtgcagaagatgaaggacaagggggagatcgcccaggcctacatcggcctgaaggagaccaaccggctgctggagagccagctgcagagccagaagaggagccatgaaaatgaagctgaggccctgcggggggagatccagagcctgaaggaggagaacaaccggcagcagcagctgctggcccagaacctgcagctgcccccagaggcccgcatcgaggccagcctgcagcacgagatcacccggctgaccaatgaaaacctggacctgatggagcagctggagaagcaggacaagacagtgaggaagctgaagaagcagctgaaggtgtttgccaagaagattggagagctggaggtgggccagatggagaacatcagccctggccagatcattgatgagcccatccggcctgtgaacatccccaggaaggagaaggacttccagggcatgctggagtacaagaaggaggatgagcagaagctggtgaagaacctgatcctggagctgaagccccggggcgtggccgtgaacctgatccctggcctgcctgcctacatcctcttcatgtgtgtgagacatgctgactacctgaatgatgaccagaaggtgcgcagcctgctgaccagcaccatcaacagcatcaagaaggtgctgaagaagagaggagatgactttgagaccgtgtccttctggctgagcaacacctgccgcttcctgcactgcctgaagcagtacagcggggaggagggcttcatgaagcacaacaccagccggcagaatgagcactgcctgaccaactttgacctggccgagtaccggcaggtgctgagtgacctggccatccagatctaccagcagctggtgcgggtgctggagaacatcctgcagcccatgattgtgtctggcatgctggagcacgagaccatccagggcgtgtctggagtgaagcccaccggcctgaggaagaggaccagcagcattgctgatgagggcacctacaccctggacagcatcctgcggcagctgaacagcttccacagcgtgatgtgccagcacggcatggaccctgagctgatcaagcaggtggtgaagcagatgttctacatcattggagccatcaccctgaacaacctgctgctgaggaaggacatgtgctcctggagcaagggcatgcagatccgctacaacgtgtcccagctggaggagtggctgcgggacaagaacctgatgaacagcggggccaaggagaccctggagcccctcatccaggccgcccagctgctgcaggtgaagaagaagacagatgatgatgctgaggccatctgcagcatgtgcaatgccctgaccacagcccagatcgtgaaggtgctgaacctgtacacccctgtgaatgaatttgaggagcgggtgtctgtgtccttcatccgcaccatccagatgaggctgcgggacaggaaggacagcccccagctgctgatggatgccaagcacatcttccctgtgaccttccccttcaaccccagcagcctggccctggagaccatccagatcccagccagcctgggcctgggcttcatcagccgggtgtag

SEQ ID NO: 160831 - DNA, 5643 bp, Artificial Sequence
  Description of Artificial Sequence: Synthetic coding sequence
atgaagagcagcagcctggagaccatgtttgcccgggtgtggatcccagaccctgaggaggtgtggaagtctgctgagctgctgaaggactacaagccaggggacaaggtgctgctgctgcacctggaggagggcaaggacctggagtaccacctggaccccaagaccaaggagctgccccacctgagaaatccagacatcctggtgggagaaaatgacctgacagccctgagctacctgcacgagcctgctgtgctgcacaacctgcgggtgcgcttcatcgacagcaagctgatctacacctactgcggcatcgtgctggtggccatcaacccctatgagcagctgcccatctatggagaggacatcatcaatgcctacagcggccagaacatgggagacatggacccccacatctttgctgtggccgaggaggcctacaagcagatggccagagatgaaagaaaccagagcatcatcgtgtctggagagagcggggccggcaagacagtgtctgccaagtatgccatgagatactttgccaccgtgtctggcagcgccagcgaggccaacgtggaggagaaggtgctggccagcaaccccatcatggagagcattggaaatgccaagaccaccagaaatgacaacagcagcagatttgggaagtacatcgagatcggctttgacaagcgctaccgcatcattggagccaacatgaggacctacctgctggagaagagccgggtggtgttccaggccgaggaggagaggaactaccacatcttctaccagctgtgtgccagcgccaagctgcctgagttcaagatgctgcggctgggcaatgctgacaacttcaactacaccaagcagggcggcagccctgtgattgagggcgtggatgatgccaaggagatggcccacacccggcaggcctgcaccctgctgggcatcagcgagagccaccagatgggcatcttccgcatcctggccggcatcctgcacctgggcaatgtgggcttcaccagcagagatgctgacagctgcaccatcccccccaagcatgagcccctgtgcatcttctgtgagctgatgggcgtggactatgaggagatgtgccactggctgtgccacaggaagctggccacagccacagagacctacatcaagcccatcagcaagctgcaggccaccaatgccagagatgccctggccaagcacatctatgccaagctgttcaactggatcgtggacaacgtgaaccaggccctgcacagcgctgtgaagcagcacagcttcatcggcgtgctggacatctacggctttgagacctttgagatcaacagctttgagcagttctgcatcaactatgccaatgagaagctgcagcagcagttcaacatgcacgtgttcaagctggagcaggaggagtacatgaaggagcagatcccctggaccctgattgacttctatgacaaccagccctgcatcaacctgattgagagcaagctgggcatcctggacctgctggatgaggagtgcaagatgcccaagggcacagatgacacctgggcccagaagctgtacaacacccacctgaacaagtgtgccctgtttgagaagccccggctgagcaacaaggccttcatcatccagcactttgctgacaaggtggagtaccagtgtgagggcttcctggagaagaacaaggacacagtgtttgaggagcagatcaaggtgctgaagagcagcaagttcaagatgctgcctgagctgttccaggatgatgagaaggccatcagccccaccagcgccaccagcagcggccgcacccccctgaccaggaccccagccaagcccaccaagggccggcccggccagatggccaaggagcacaagaagacagtgggccaccagttcaggaacagcctgcacctgctgatggagaccctgaatgccaccaccccccactacgtgcgctgcatcaagcccaatgacttcaagttccccttcacctttgatgagaagagagctgtgcagcagctgcgggcctgtggggtgctggagaccatccgcatctctgctgctggcttccccagccgctggacctaccaggagttcttcagccgctacagagtgctgatgaagcagaaggatgtgctgagtgacaggaagcagacctgcaagaatgtgctggagaagctgatcctggacaaggacaagtaccagtttgggaagaccaagatcttcttccgggccggccaggtggcctacctggagaagctgcgggctgacaagctgcgggccgcctgcatccgcatccagaagaccatccggggctggctgctgaggaagaagtacctgaggatgaggaaggccgccatcaccatgcagagatatgtgcggggctaccaggcccgctgctacgccaagttcctgcggaggaccaaggccgccaccatcatccagaagtactggaggatgtatgtggtgagaagacgctacaagatcagaagagctgccaccatcgtgctgcagagctacctgcggggcttcctggccaggaaccgctacaggaagatcctgcgggagcacaaggccgtcatcatccagaagagggtgcggggctggctggcccggacccactacaagaggtccatgcacgccatcatctacctgcagtgctgcttccggaggatgatggccaagcgggagctgaagaagctgaagattgaggcccggtctgtggagcgctacaagaagctgcacatcggcatggagaacaagatcatgcagctgcagaggaaggtggatgagcagaacaaggactacaagtgcctggtggagaagctgaccaacctggagggcatctacaacagcgagacagagaagctgcggagtgacctggagcggctgcagctgtctgaggaggaggccaaggtggccaccggccgggtgctgagcctgcaggaggagatcgccaagctgaggaaggacctggagcagaccaggtctgagaagaagtgcatcgaggagcacgccgaccgctacaagcaggagacagagcagctggtgagcaacctgaaggaggagaacaccctgctgaagcaggagaaggaggccctgaaccacagaattgtgcagcaggccaaggagatgacagagaccatggagaagaagctggtggaggagaccaagcagctggagctggacctgaatgatgagcggctgcgctaccagaacctgctgaatgagttcagccggctggaggagagatatgatgacctgaaggaggagatgaccctgatggtgcacgtgcccaagccaggccacaagaggacagacagcacccacagcagcaatgaaagtgagtacatcttcagcagcgagattgctgagatggaggacatccccagcaggacagaggagcccagcgagaagaaggtgcccctggacatgagcctcttcctgaagctgcagaagagggtgacagagctggagcaggagaagcaggtgatgcaggatgagctggacaggaaggaggagcaggtgctgcggagcaaggccaaggaggaggagcggccccagatcagaggagctgagctggagtatgagagcctgaagaggcaggagctggagagcgagaacaagaagctgaagaatgagctgaatgagctgaggaaggccctgtctgagaagagcgcccctgaggtgacagcccctggggccccagcctacagagtgctgatggagcagctgacctctgtgtctgaggagctggatgtgaggaaggaggaggtgctgatcctgcggagccagctggtgtcccagaaggaggccatccagcccaagctgcacgagaacaccatgacagacagcaccatcctgctggaggatgtgcagaagatgaaggacaagggggagatcgcccaggcctacatcggcctgaaggagaccaacagaagcagcgccctggactaccacgagctgaatgaagatggagagctgtggctggtgtatgagggcctgaagcaggccaaccggctgctggagagccagctgcagagccagaagaggagccatgaaaatgaggccgaggccctgcggggggagatccagagcctgaaggaggagaacaaccggcagcagcagctgctggcccagaacctgcagctgcccccagaggccagaattgaggccagcctgcagcacgagatcacccggctgaccaatgaaaatctctactttgaggagctgtatgcagatgaccccaagaagtaccagagctaccgcatcagcctgtacaagaggatgattgacctgatggagcagctggagaagcaggacaagacagtgaggaagctgaagaagcagctgaaggtgtttgccaagaagattggagagctggaggtgggccagatggagaacatcagccctggccagatcattgatgagcccatccggcctgtgaacatccccaggaaggagaaggacttccagggcatgctggagtacaagaaggaggatgagcagaagctggtgaagaacctgatcctggagctgaagccccggggcgtggccgtgaacctgatccctggcctgcctgcctacatcctcttcatgtgtgtgagacatgctgactacctgaatgatgaccagaaggtgcgcagcctgctgaccagcaccatcaacagcatcaagaaggtgctgaagaagagaggagatgactttgagaccgtgtccttctggctgagcaacacctgccgcttcctgcactgcctgaagcagtacagcggggaggagggcttcatgaagcacaacaccagccggcagaatgagcactgcctgaccaactttgacctggccgagtaccggcaggtgctgagtgacctggccatccagatctaccagcagctggtgcgggtgctggagaacatcctgcagcccatgattgtgtctggcatgctggagcacgagaccatccagggcgtgtctggagtgaagcccaccggcctgaggaagaggaccagcagcattgctgatgagggcacctacaccctggacagcatcctgcggcagctgaacagcttccacagcgtgatgtgccagcacggcatggaccctgagctgatcaagcaggtggtgaagcagatgttctacatcattggagccatcaccctgaacaacctgctgctgaggaaggacatgtgctcctggagcaagggcatgcagatccgctacaacgtgtcccagctggaggagtggctgcgggacaagaacctgatgaacagcggggccaaggagaccctggagcccctcatccaggccgcccagctgctgcaggtgaagaagaagacagatgatgatgctgaggccatctgcagcatgtgcaatgccctgaccacagcccagatcgtgaaggtgctgaacctgtacacccctgtgaatgaatttgaggagcgggtgtctgtgtccttcatccgcaccatccagatgaggctgcgggacaggaaggacagcccccagctgctgatggatgccaagcacatcttccctgtgaccttccccttcaaccccagcagcctggccctggagaccatccagatcccagccagcctgggcctgggcttcatcagccgggtgtag

SEQ ID NO: 160832 - DNA, 4089 bp, Artificial Sequence
  Description of Artificial Sequence: Synthetic coding sequence
atgcacgtgttcaagctggagcaggaggagtacatgaaggagcagatcccctggaccctgattgacttctatgacaaccagccctgcatcaacctgattgagagcaagctgggcatcctggacctgctggatgaggagtgcaagatgcccaagggcacagatgacacctgggcccagaagctgtacaacacccacctgaacaagtgtgccctgtttgagaagccccggctgagcaacaaggccttcatcatccagcactttgctgacaaggtggagtaccagtgtgagggcttcctggagaagaacaaggacacagtgtttgaggagcagatcaaggtgctgaagagcagcaagttcaagatgctgcctgagctgttccaggatgatgagaaggccatcagccccaccagcgccaccagcagcggccgcacccccctgaccaggaccccagccaagcccaccaagggccggcccggccagatggccaaggagcacaagaagacagtgggccaccagttcaggaacagcctgcacctgctgatggagaccctgaatgccaccaccccccactacgtgcgctgcatcaagcccaatgacttcaagttccccttcacctttgatgagaagagagctgtgcagcagctgcgggcctgtggggtgctggagaccatccgcatctctgctgctggcttccccagccgctggacctaccaggagttcttcagccgctacagagtgctgatgaagcagaaggatgtgctgagtgacaggaagcagacctgcaagaatgtgctggagaagctgatcctggacaaggacaagtaccagtttgggaagaccaagatcttcttccgggccggccaggtggcctacctggagaagctgcgggctgacaagctgcgggccgcctgcatccgcatccagaagaccatccggggctggctgctgaggaagaagtacctgaggatgaggaaggccgccatcaccatgcagagatatgtgcggggctaccaggcccgctgctacgccaagttcctgcggaggaccaaggccgccaccatcatccagaagtactggaggatgtatgtggtgagaagacgctacaagatcagaagagctgccaccatcgtgctgcagagctacctgcggggcttcctggccaggaaccgctacaggaagatcctgcgggagcacaaggccgtcatcatccagaagagggtgcggggctggctggcccggacccactacaagaggtccatgcacgccatcatctacctgcagtgctgcttccggaggatgatggccaagcgggagctgaagaagctgaagattgaggcccggtctgtggagcgctacaagaagctgcacatcggcatggagaacaagatcatgcagctgcagaggaaggtggatgagcagaacaaggactacaagtgcctggtggagaagctgaccaacctggagggcatctacaacagcgagacagagaagctgcggagtgacctggagcggctgcagctgtctgaggaggaggccaaggtggccaccggccgggtgctgagcctgcaggaggagatcgccaagctgaggaaggacctggagcagaccaggtctgagaagaagtgcatcgaggagcacgccgaccgctacaagcaggagacagagcagctggtgagcaacctgaaggaggagaacaccctgctgaagcaggagaaggaggccctgaaccacagaattgtgcagcaggccaaggagatgacagagaccatggagaagaagctggtggaggagaccaagcagctggagctggacctgaatgatgagcggctgcgctaccagaacctgctgaatgagttcagccggctggaggagagatatgatgacctgaaggaggagatgaccctgatggtgcacgtgcccaagccaggccacaagaggacagacagcacccacagcagcaatgaaagtgagtacatcttcagcagcgagattgctgagatggaggacatccccagcaggacagaggagcccagcgagaagaaggtgcccctggacatgagcctcttcctgaagctgcagaagagggtgacagagctggagcaggagaagcaggtgatgcaggatgagctggacaggaaggaggagcaggtgctgcggagcaaggccaaggaggaggagcggccccagatcagaggagctgagctggagtatgagagcctgaagaggcaggagctggagagcgagaacaagaagctgaagaatgagctgaatgagctgaggaaggccctgtctgagaagagcgcccctgaggtgacagcccctggggccccagcctacagagtgctgatggagcagctgacctctgtgtctgaggagctggatgtgaggaaggaggaggtgctgatcctgcggagccagctggtgtcccagaaggaggccatccagcccaaggatgacaagaacaccatgacagacagcaccatcctgctggaggatgtgcagaagatgaaggacaagggggagatcgcccaggcctacatcggcctgaaggagaccaaccggctgctggagagccagctgcagagccagaagaggagccatgaaaatgaagctgaggccctgcggggggagatccagagcctgaaggaggagaacaaccggcagcagcagctgctggcccagaacctgcagctgcccccagaggcccgcatcgaggccagcctgcagcacgagatcacccggctgaccaatgaaaacctggacctgatggagcagctggagaagcaggacaagacagtgaggaagctgaagaagcagctgaaggtgtttgccaagaagattggagagctggaggtgggccagatggagaacatcagccctggccagatcattgatgagcccatccggcctgtgaacatccccaggaaggagaaggacttccagggcatgctggagtacaagaaggaggatgagcagaagctggtgaagaacctgatcctggagctgaagccccggggcgtggccgtgaacctgatccctggcctgcctgcctacatcctcttcatgtgtgtgagacatgctgactacctgaatgatgaccagaaggtgcgcagcctgctgaccagcaccatcaacagcatcaagaaggtgctgaagaagagaggagatgactttgagaccgtgtccttctggctgagcaacacctgccgcttcctgcactgcctgaagcagtacagcggggaggagggcttcatgaagcacaacaccagccggcagaatgagcactgcctgaccaactttgacctggccgagtaccggcaggtgctgagtgacctggccatccagatctaccagcagctggtgcgggtgctggagaacatcctgcagcccatgattgtgtctggcatgctggagcacgagaccatccagggcgtgtctggagtgaagcccaccggcctgaggaagaggaccagcagcattgctgatgagggcacctacaccctggacagcatcctgcggcagctgaacagcttccacagcgtgatgtgccagcacggcatggaccctgagctgatcaagcaggtggtgaagcagatgttctacatcattggagccatcaccctgaacaacctgctgctgaggaaggacatgtgctcctggagcaagggcatgcagatccgctacaacgtgtcccagctggaggagtggctgcgggacaagaacctgatgaacagcggggccaaggagaccctggagcccctcatccaggccgcccagctgctgcaggtgaagaagaagacagatgatgatgctgaggccatctgcagcatgtgcaatgccctgaccacagcccagatcgtgaaggtgctgaacctgtacacccctgtgaatgaatttgaggagcgggtgtctgtgtccttcatccgcaccatccagatgaggctgcgggacaggaaggacagcccccagctgctgatggatgccaagcacatcttccctgtgaccttccccttcaaccccagcagcctggccctggagaccatccagatcccagccagcctgggcctgggcttcatcagccgggtgtag

SEQ ID NO: 160833 - DNA, 5568 bp, Artificial Sequence
  Description of Artificial Sequence: Synthetic coding sequence
atggccgccagcgagctgtacaccaagtttgcccgggtgtggatcccagaccctgaggaggtgtggaagtctgctgagctgctgaaggactacaagccaggggacaaggtgctgctgctgcacctggaggagggcaaggacctggagtaccacctggaccccaagaccaaggagctgccccacctgagaaatccagacatcctggtgggagaaaatgacctgacagccctgagctacctgcacgagcctgctgtgctgcacaacctgcgggtgcgcttcatcgacagcaagctgatctacacctactgcggcatcgtgctggtggccatcaacccctatgagcagctgcccatctatggagaggacatcatcaatgcctacagcggccagaacatgggagacatggacccccacatctttgctgtggccgaggaggcctacaagcagatggccagagatgaaagaaaccagagcatcatcgtgtctggagagagcggggccggcaagacagtgtctgccaagtatgccatgagatactttgccaccgtgtctggcagcgccagcgaggccaacgtggaggagaaggtgctggccagcaaccccatcatggagagcattggaaatgccaagaccaccagaaatgacaacagcagcagatttgggaagtacatcgagatcggctttgacaagcgctaccgcatcattggagccaacatgaggacctacctgctggagaagagccgggtggtgttccaggccgaggaggagaggaactaccacatcttctaccagctgtgtgccagcgccaagctgcctgagttcaagatgctgcggctgggcaatgctgacaacttcaactacaccaagcagggcggcagccctgtgattgagggcgtggatgatgccaaggagatggcccacacccggcaggcctgcaccctgctgggcatcagcgagagccaccagatgggcatcttccgcatcctggccggcatcctgcacctgggcaatgtgggcttcaccagcagagatgctgacagctgcaccatcccccccaagcatgagcccctgtgcatcttctgtgagctgatgggcgtggactatgaggagatgtgccactggctgtgccacaggaagctggccacagccacagagacctacatcaagcccatcagcaagctgcaggccaccaatgccagagatgccctggccaagcacatctatgccaagctgttcaactggatcgtggacaacgtgaaccaggccctgcacagcgctgtgaagcagcacagcttcatcggcgtgctggacatctacggctttgagacctttgagatcaacagctttgagcagttctgcatcaactatgccaatgagaagctgcagcagcagttcaacatgcacgtgttcaagctggagcaggaggagtacatgaaggagcagatcccctggaccctgattgacttctatgacaaccagccctgcatcaacctgattgagagcaagctgggcatcctggacctgctggatgaggagtgcaagatgcccaagggcacagatgacacctgggcccagaagctgtacaacacccacctgaacaagtgtgccctgtttgagaagccccggctgagcaacaaggccttcatcatccagcactttgctgacaaggtggagtaccagtgtgagggcttcctggagaagaacaaggacacagtgtttgaggagcagatcaaggtgctgaagagcagcaagttcaagatgctgcctgagctgttccaggatgatgagaaggccatcagccccaccagcgccaccagcagcggccgcacccccctgaccaggaccccagccaagcccaccaagggccggcccggccagatggccaaggagcacaagaagacagtgggccaccagttcaggaacagcctgcacctgctgatggagaccctgaatgccaccaccccccactacgtgcgctgcatcaagcccaatgacttcaagttccccttcacctttgatgagaagagagctgtgcagcagctgcgggcctgtggggtgctggagaccatccgcatctctgctgctggcttccccagccgctggacctaccaggagttcttcagccgctacagagtgctgatgaagcagaaggatgtgctgagtgacaggaagcagacctgcaagaatgtgctggagaagctgatcctggacaaggacaagtaccagtttgggaagaccaagatcttcttccgggccggccaggtggcctacctggagaagctgcgggctgacaagctgcgggccgcctgcatccgcatccagaagaccatccggggctggctgctgaggaagaagtacctgaggatgaggaaggccgccatcaccatgcagagatatgtgcggggctaccaggcccgctgctacgccaagttcctgcggaggaccaaggccgccaccatcatccagaagtactggaggatgtatgtggtgagaagacgctacaagatcagaagagctgccaccatcgtgctgcagagctacctgcggggcttcctggccaggaaccgctacaggaagatcctgcgggagcacaaggccgtcatcatccagaagagggtgcggggctggctggcccggacccactacaagaggtccatgcacgccatcatctacctgcagtgctgcttccggaggatgatggccaagcgggagctgaagaagctgaagattgaggcccggtctgtggagcgctacaagaagctgcacatcggcatggagaacaagatcatgcagctgcagaggaaggtggatgagcagaacaaggactacaagtgcctggtggagaagctgaccaacctggagggcatctacaacagcgagacagagaagctgcggagtgacctggagcggctgcagctgtctgaggaggaggccaaggtggccaccggccgggtgctgagcctgcaggaggagatcgccaagctgaggaaggacctggagcagaccaggtctgagaagaagtgcatcgaggagcacgccgaccgctacaagcaggagacagagcagctggtgagcaacctgaaggaggagaacaccctgctgaagcaggagaaggaggccctgaaccacagaattgtgcagcaggccaaggagatgacagagaccatggagaagaagctggtggaggagaccaagcagctggagctggacctgaatgatgagcggctgcgctaccagaacctgctgaatgagttcagccggctggaggagagatatgatgacctgaaggaggagatgaccctgatggtgcacgtgcccaagccaggccacaagaggacagacagcacccacagcagcaatgaaagtgagtacatcttcagcagcgagattgctgagatggaggacatccccagcaggacagaggagcccagcgagaagaaggtgcccctggacatgagcctcttcctgaagctgcagaagagggtgacagagctggagcaggagaagcaggtgatgcaggatgagctggacaggaaggaggagcaggtgctgcggagcaaggccaaggaggaggagcggccccagatcagaggagctgagctggagtatgagagcctgaagaggcaggagctggagagcgagaacaagaagctgaagaatgagctgaatgagctgaggaaggccctgtctgagaagagcgcccctgaggtgacagcccctggggccccagcctacagagtgctgatggagcagctgacctctgtgtctgaggagctggatgtgaggaaggaggaggtgctgatcctgcggagccagctggtgtcccagaaggaggccatccagcccaaggatgacaagaacaccatgacagacagcaccatcctgctggaggatgtgcagaagatgaaggacaagggggagatcgcccaggcctacatcggcctgaaggagaccaacagaagcagcgccctggactaccacgagctgaatgaagatggagagctgtggctggtgtatgagggcctgaagcaggccaaccggctgctggagagccagctgcagagccagaagaggagccatgaaaatgaggccgaggccctgcggggggagatccagagcctgaaggaggagaacaaccggcagcagcagctgctggcccagaacctgcagctgcccccagaggccagaattgaggccagcctgcagcacgagatcacccggctgaccaatgaaaacctggacctgatggagcagctggagaagcaggacaagacagtgaggaagctgaagaagcagctgaaggtgtttgccaagaagatcggggagctggaggtgggccagatggagaacatcagccctggccagatcattgatgagcccatccggcctgtgaacatccccaggaaggagaaggacttccagggcatgctggagtacaagaaggaggatgagcagaagctggtgaagaacctgatcctggagctgaagccccggggcgtggccgtgaacctgatccctggcctgcctgcctacatcctcttcatgtgtgtgagacatgctgactacctgaatgatgaccagaaggtgcgcagcctgctgaccagcaccatcaacagcatcaagaaggtgctgaagaagagaggagatgactttgaaacagtgtccttctggctgagcaacacctgccgcttcctgcactgcctgaagcagtacagcggggaggagggcttcatgaagcacaacaccagccggcagaatgagcactgcctgaccaactttgacctggccgagtaccggcaggtgctgagtgacctggccatccagatctaccagcagctggtgcgggtgctggagaacatcctgcagcccatgattgtgtctggcatgctggagcacgagaccatccagggcgtgtctggagtgaagcccaccggcctgaggaagaggaccagcagcattgctgatgagggcacctacaccctggacagcatcctgcggcagctgaacagcttccacagcgtgatgtgccagcacggcatggaccctgagctgatcaagcaggtggtgaagcagatgttctacatcatcggggccatcaccctgaacaacctgctgctgaggaaggacatgtgctcctggagcaagggcatgcagatccgctacaacgtgtcccagctggaggagtggctgcgggacaagaacctgatgaacagcggggccaaggagaccctggagcccctcatccaggccgcccagctgctgcaggtgaagaagaagacagatgatgatgctgaggccatctgcagcatgtgcaatgccctgaccacagcccagatcgtgaaggtgctgaacctgtacacccctgtgaatgaatttgaggagcgggtgtctgtgtccttcatccgcaccatccagatgaggctgcgggacaggaaggacagcccccagctgctgatggatgccaagcacatcttccctgtgaccttccccttcaaccccagcagcctggccctggagaccatccagatcccagccagcctgggcctgggcttcatcagccgggtgtag

SEQ ID NO: 160834 - DNA, 5559 bp, Artificial Sequence
  Description of Artificial Sequence: Synthetic coding sequence
atggccgccagcgagctgtacaccaagtttgcccgggtgtggatcccagaccctgaggaggtgtggaagtctgctgagctgctgaaggactacaagccaggggacaaggtgctgctgctgcacctggaggagggcaaggacctggagtaccacctggaccccaagaccaaggagctgccccacctgagaaatccagacatcctggtgggagaaaatgacctgacagccctgagctacctgcacgagcctgctgtgctgcacaacctgcgggtgcgcttcatcgacagcaagctgatctacacctactgcggcatcgtgctggtggccatcaacccctatgagcagctgcccatctatggagaggacatcatcaatgcctacagcggccagaacatgggagacatggacccccacatctttgctgtggccgaggaggcctacaagcagatggccagagatgaaagaaaccagagcatcatcgtgtctggagagagcggggccggcaagacagtgtctgccaagtatgccatgagatactttgccaccgtgtctggcagcgccagcgaggccaacgtggaggagaaggtgctggccagcaaccccatcatggagagcattggaaatgccaagaccaccagaaatgacaacagcagcagatttgggaagtacatcgagatcggctttgacaagcgctaccgcatcattggagccaacatgaggacctacctgctggagaagagccgggtggtgttccaggccgaggaggagaggaactaccacatcttctaccagctgtgtgccagcgccaagctgcctgagttcaagatgctgcggctgggcaatgctgacaacttcaactacaccaagcagggcggcagccctgtgattgagggcgtggatgatgccaaggagatggcccacacccggcaggcctgcaccctgctgggcatcagcgagagccaccagatgggcatcttccgcatcctggccggcatcctgcacctgggcaatgtgggcttcaccagcagagatgctgacagctgcaccatcccccccaagcatgagcccctgtgcatcttctgtgagctgatgggcgtggactatgaggagatgtgccactggctgtgccacaggaagctggccacagccacagagacctacatcaagcccatcagcaagctgcaggccaccaatgccagagatgccctggccaagcacatctatgccaagctgttcaactggatcgtggacaacgtgaaccaggccctgcacagcgctgtgaagcagcacagcttcatcggcgtgctggacatctacggctttgagacctttgagatcaacagctttgagcagttctgcatcaactatgccaatgagaagctgcagcagcagttcaacatgcacgtgttcaagctggagcaggaggagtacatgaaggagcagatcccctggaccctgattgacttctatgacaaccagccctgcatcaacctgattgagagcaagctgggcatcctggacctgctggatgaggagtgcaagatgcccaagggcacagatgacacctgggcccagaagctgtacaacacccacctgaacaagtgtgccctgtttgagaagccccggctgagcaacaaggccttcatcatccagcactttgctgacaaggtggagtaccagtgtgagggcttcctggagaagaacaaggacacagtgtttgaggagcagatcaaggtgctgaagagcagcaagttcaagatgctgcctgagctgttccaggatgatgagaaggccatcagccccaccagcgccaccagcagcggccgcacccccctgaccaggaccccagccaagcccaccaagggccggcccggccagatggccaaggagcacaagaagacagtgggccaccagttcaggaacagcctgcacctgctgatggagaccctgaatgccaccaccccccactacgtgcgctgcatcaagcccaatgacttcaagttccccttcacctttgatgagaagagagctgtgcagcagctgcgggcctgtggggtgctggagaccatccgcatctctgctgctggcttccccagccgctggacctaccaggagttcttcagccgctacagagtgctgatgaagcagaaggatgtgctgagtgacaggaagcagacctgcaagaatgtgctggagaagctgatcctggacaaggacaagtaccagtttgggaagaccaagatcttcttccgggccggccaggtggcctacctggagaagctgcgggctgacaagctgcgggccgcctgcatccgcatccagaagaccatccggggctggctgctgaggaagaagtacctgaggatgaggaaggccgccatcaccatgcagagatatgtgcggggctaccaggcccgctgctacgccaagttcctgcggaggaccaaggccgccaccatcatccagaagtactggaggatgtatgtggtgagaagacgctacaagatcagaagagctgccaccatcgtgctgcagagctacctgcggggcttcctggccaggaaccgctacaggaagatcctgcgggagcacaaggccgtcatcatccagaagagggtgcggggctggctggcccggacccactacaagaggtccatgcacgccatcatctacctgcagtgctgcttccggaggatgatggccaagcgggagctgaagaagctgaagattgaggcccggtctgtggagcgctacaagaagctgcacatcggcatggagaacaagatcatgcagctgcagaggaaggtggatgagcagaacaaggactacaagtgcctggtggagaagctgaccaacctggagggcatctacaacagcgagacagagaagctgcggagtgacctggagcggctgcagctgtctgaggaggaggccaaggtggccaccggccgggtgctgagcctgcaggaggagatcgccaagctgaggaaggacctggagcagaccaggtctgagaagaagtgcatcgaggagcacgccgaccgctacaagcaggagacagagcagctggtgagcaacctgaaggaggagaacaccctgctgaagcaggagaaggaggccctgaaccacagaattgtgcagcaggccaaggagatgacagagaccatggagaagaagctggtggaggagaccaagcagctggagctggacctgaatgatgagcggctgcgctaccagaacctgctgaatgagttcagccggctggaggagagatatgatgacctgaaggaggagatgaccctgatggtgcacgtgcccaagccaggccacaagaggacagacagcacccacagcagcaatgaaagtgagtacatcttcagcagcgagattgctgagatggaggacatccccagcaggacagaggagcccagcgagaagaaggtgcccctggacatgagcctcttcctgaagctgcagaagagggtgacagagctggagcaggagaagcaggtgatgcaggatgagctggacaggaaggaggagcaggtgctgcggagcaaggccaaggaggaggagcggccccagatcagaggagctgagctggagtatgagagcctgaagaggcaggagctggagagcgagaacaagaagctgaagaatgagctgaatgagctgaggaaggccctgtctgagaagagcgcccctgaggtgacagcccctggggccccagcctacagagtgctgatggagcagctgacctctgtgtctgaggagctggatgtgaggaaggaggaggtgctgatcctgcggagccagctggtgtcccagaaggaggccatccagcccaagaacaccatgacagacagcaccatcctgctggaggatgtgcagaagatgaaggacaagggggagatcgcccaggcctacatcggcctgaaggagaccaacagaagcagcgccctggactaccacgagctgaatgaagatggagagctgtggctggtgtatgagggcctgaagcaggccaaccggctgctggagagccagctgcagagccagaagaggagccatgaaaatgaagctgaggccctgcggggggagatccagagcctgaaggaggagaacaaccggcagcagcagctgctggcccagaacctgcagctgcccccagaggcccgcatcgaggccagcctgcagcacgagatcacccggctgaccaatgaaaacctggacctgatggagcagctggagaagcaggacaagacagtgaggaagctgaagaagcagctgaaggtgtttgccaagaagattggagagctggaggtgggccagatggagaacatcagccctggccagatcattgatgagcccatccggcctgtgaacatccccaggaaggagaaggacttccagggcatgctggagtacaagaaggaggatgagcagaagctggtgaagaacctgatcctggagctgaagccccggggcgtggccgtgaacctgatccctggcctgcctgcctacatcctcttcatgtgtgtgagacatgctgactacctgaatgatgaccagaaggtgcgcagcctgctgaccagcaccatcaacagcatcaagaaggtgctgaagaagagaggagatgactttgagaccgtgtccttctggctgagcaacacctgccgcttcctgcactgcctgaagcagtacagcggggaggagggcttcatgaagcacaacaccagccggcagaatgagcactgcctgaccaactttgacctggccgagtaccggcaggtgctgagtgacctggccatccagatctaccagcagctggtgcgggtgctggagaacatcctgcagcccatgattgtgtctggcatgctggagcacgagaccatccagggcgtgtctggagtgaagcccaccggcctgaggaagaggaccagcagcattgctgatgagggcacctacaccctggacagcatcctgcggcagctgaacagcttccacagcgtgatgtgccagcacggcatggaccctgagctgatcaagcaggtggtgaagcagatgttctacatcattggagccatcaccctgaacaacctgctgctgaggaaggacatgtgctcctggagcaagggcatgcagatccgctacaacgtgtcccagctggaggagtggctgcgggacaagaacctgatgaacagcggggccaaggagaccctggagcccctcatccaggccgcccagctgctgcaggtgaagaagaagacagatgatgatgctgaggccatctgcagcatgtgcaatgccctgaccacagcccagatcgtgaaggtgctgaacctgtacacccctgtgaatgaatttgaggagcgggtgtctgtgtccttcatccgcaccatccagatgaggctgcgggacaggaaggacagcccccagctgctgatggatgccaagcacatcttccctgtgaccttccccttcaaccccagcagcctggccctggagaccatccagatcccagccagcctgggcctgggcttcatcagccgggtgtag

SEQ ID NO: 160835 - DNA, 4377 bp, Artificial Sequence
  Description of Artificial Sequence: Synthetic coding sequence
atgtgccactggctgtgccacaggaagctggccacagccacagagacctacatcaagcccatcagcaagctgcaggccaccaatgccagagatgccctggccaagcacatctatgccaagctgttcaactggatcgtggacaacgtgaaccaggccctgcacagcgctgtgaagcagcacagcttcatcggcgtgctggacatctacggctttgagacctttgagatcaacagctttgagcagttctgcatcaactatgccaatgagaagctgcagcagcagttcaacatgcacgtgttcaagctggagcaggaggagtacatgaaggagcagatcccctggaccctgattgacttctatgacaaccagccctgcatcaacctgattgagagcaagctgggcatcctggacctgctggatgaggagtgcaagatgcccaagggcacagatgacacctgggcccagaagctgtacaacacccacctgaacaagtgtgccctgtttgagaagccccggctgagcaacaaggccttcatcatccagcactttgctgacaaggtggagtaccagtgtgagggcttcctggagaagaacaaggacacagtgtttgaggagcagatcaaggtgctgaagagcagcaagttcaagatgctgcctgagctgttccaggatgatgagaaggccatcagccccaccagcgccaccagcagcggccgcacccccctgaccaggaccccagccaagcccaccaagggccggcccggccagatggccaaggagcacaagaagacagtgggccaccagttcaggaacagcctgcacctgctgatggagaccctgaatgccaccaccccccactacgtgcgctgcatcaagcccaatgacttcaagttccccttcacctttgatgagaagagagctgtgcagcagctgcgggcctgtggggtgctggagaccatccgcatctctgctgctggcttccccagccgctggacctaccaggagttcttcagccgctacagagtgctgatgaagcagaaggatgtgctgagtgacaggaagcagacctgcaagaatgtgctggagaagctgatcctggacaaggacaagtaccagtttgggaagaccaagatcttcttccgggccggccaggtggcctacctggagaagctgcgggctgacaagctgcgggccgcctgcatccgcatccagaagaccatccggggctggctgctgaggaagaagtacctgaggatgaggaaggccgccatcaccatgcagagatatgtgcggggctaccaggcccgctgctacgccaagttcctgcggaggaccaaggccgccaccatcatccagaagtactggaggatgtatgtggtgagaagacgctacaagatcagaagagctgccaccatcgtgctgcagagctacctgcggggcttcctggccaggaaccgctacaggaagatcctgcgggagcacaaggccgtcatcatccagaagagggtgcggggctggctggcccggacccactacaagaggtccatgcacgccatcatctacctgcagtgctgcttccggaggatgatggccaagcgggagctgaagaagctgaagattgaggcccggtctgtggagcgctacaagaagctgcacatcggcatggagaacaagatcatgcagctgcagaggaaggtggatgagcagaacaaggactacaagtgcctggtggagaagctgaccaacctggagggcatctacaacagcgagacagagaagctgcggagtgacctggagcggctgcagctgtctgaggaggaggccaaggtggccaccggccgggtgctgagcctgcaggaggagatcgccaagctgaggaaggacctggagcagaccaggtctgagaagaagtgcatcgaggagcacgccgaccgctacaagcaggagacagagcagctggtgagcaacctgaaggaggagaacaccctgctgaagcaggagaaggaggccctgaaccacagaattgtgcagcaggccaaggagatgacagagaccatggagaagaagctggtggaggagaccaagcagctggagctggacctgaatgatgagcggctgcgctaccagaacctgctgaatgagttcagccggctggaggagagatatgatgacctgaaggaggagatgaccctgatggtgcacgtgcccaagccaggccacaagaggacagacagcacccacagcagcaatgaaagtgagtacatcttcagcagcgagattgctgagatggaggacatccccagcaggacagaggagcccagcgagaagaaggtgcccctggacatgagcctcttcctgaagctgcagaagagggtgacagagctggagcaggagaagcaggtgatgcaggatgagctggacaggaaggaggagcaggtgctgcggagcaaggccaaggaggaggagcggccccagatcagaggagctgagctggagtatgagagcctgaagaggcaggagctggagagcgagaacaagaagctgaagaatgagctgaatgagctgaggaaggccctgtctgagaagagcgcccctgaggtgacagcccctggggccccagcctacagagtgctgatggagcagctgacctctgtgtctgaggagctggatgtgaggaaggaggaggtgctgatcctgcggagccagctggtgtcccagaaggaggccatccagcccaagctgcacgagaacaccatgacagacagcaccatcctgctggaggatgtgcagaagatgaaggacaagggggagatcgcccaggcctacatcggcctgaaggagaccaaccggctgctggagagccagctgcagagccagaagaggagccatgaaaatgaagctgaggccctgcggggggagatccagagcctgaaggaggagaacaaccggcagcagcagctgctggcccagaacctgcagctgcccccagaggcccgcatcgaggccagcctgcagcacgagatcacccggctgaccaatgaaaacctggacctgatggagcagctggagaagcaggacaagacagtgaggaagctgaagaagcagctgaaggtgtttgccaagaagattggagagctggaggtgggccagatggagaacatcagccctggccagatcattgatgagcccatccggcctgtgaacatccccaggaaggagaaggacttccagggcatgctggagtacaagaaggaggatgagcagaagctggtgaagaacctgatcctggagctgaagccccggggcgtggccgtgaacctgatccctggcctgcctgcctacatcctcttcatgtgtgtgagacatgctgactacctgaatgatgaccagaaggtgcgcagcctgctgaccagcaccatcaacagcatcaagaaggtgctgaagaagagaggagatgactttgagaccgtgtccttctggctgagcaacacctgccgcttcctgcactgcctgaagcagtacagcggggaggagggcttcatgaagcacaacaccagccggcagaatgagcactgcctgaccaactttgacctggccgagtaccggcaggtgctgagtgacctggccatccagatctaccagcagctggtgcgggtgctggagaacatcctgcagcccatgattgtgtctggcatgctggagcacgagaccatccagggcgtgtctggagtgaagcccaccggcctgaggaagaggaccagcagcattgctgatgagggcacctacaccctggacagcatcctgcggcagctgaacagcttccacagcgtgatgtgccagcacggcatggaccctgagctgatcaagcaggtggtgaagcagatgttctacatcattggagccatcaccctgaacaacctgctgctgaggaaggacatgtgctcctggagcaagggcatgcagatccgctacaacgtgtcccagctggaggagtggctgcgggacaagaacctgatgaacagcggggccaaggagaccctggagcccctcatccaggccgcccagctgctgcaggtgaagaagaagacagatgatgatgctgaggccatctgcagcatgtgcaatgccctgaccacagcccagatcgtgaaggtgctgaacctgtacacccctgtgaatgaatttgaggagcgggtgtctgtgtccttcatccgcaccatccagatgaggctgcgggacaggaaggacagcccccagctgctgatggatgccaagcacatcttccctgtgaccttccccttcaaccccagcagcctggccctggagaccatccagatcccagccagcctgggcctgggcttcatcagccgggtgtag

SEQ ID NO: 160836 - DNA, 5562 bp, Artificial Sequence
  Description of Artificial Sequence: Synthetic coding sequence
atggccgccagcgagctgtacaccaagtttgcccgggtgtggatcccagaccctgaggaggtgtggaagtctgctgagctgctgaaggactacaagccaggggacaaggtgctgctgctgcacctggaggagggcaaggacctggagtaccacctggaccccaagaccaaggagctgccccacctgagaaatccagacatcctggtgggagaaaatgacctgacagccctgagctacctgcacgagcctgctgtgctgcacaacctgcgggtgcgcttcatcgacagcaagctgatctacacctactgcggcatcgtgctggtggccatcaacccctatgagcagctgcccatctatggagaggacatcatcaatgcctacagcggccagaacatgggagacatggacccccacatctttgctgtggccgaggaggcctacaagcagatggccagagatgaaagaaaccagagcatcatcgtgtctggagagagcggggccggcaagacagtgtctgccaagtatgccatgagatactttgccaccgtgtctggcagcgccagcgaggccaacgtggaggagaaggtgctggccagcaaccccatcatggagagcattggaaatgccaagaccaccagaaatgacaacagcagcagatttgggaagtacatcgagatcggctttgacaagcgctaccgcatcattggagccaacatgaggacctacctgctggagaagagccgggtggtgttccaggccgaggaggagaggaactaccacatcttctaccagctgtgtgccagcgccaagctgcctgagttcaagatgctgcggctgggcaatgctgacaacttcaactacaccaagcagggcggcagccctgtgattgagggcgtggatgatgccaaggagatggcccacacccggcaggcctgcaccctgctgggcatcagcgagagccaccagatgggcatcttccgcatcctggccggcatcctgcacctgggcaatgtgggcttcaccagcagagatgctgacagctgcaccatcccccccaagcatgagcccctgtgcatcttctgtgagctgatgggcgtggactatgaggagatgtgccactggctgtgccacaggaagctggccacagccacagagacctacatcaagcccatcagcaagctgcaggccaccaatgccagagatgccctggccaagcacatctatgccaagctgttcaactggatcgtggacaacgtgaaccaggccctgcacagcgctgtgaagcagcacagcttcatcggcgtgctggacatctacggctttgagacctttgagatcaacagctttgagcagttctgcatcaactatgccaatgagaagctgcagcagcagttcaacatgcacgtgttcaagctggagcaggaggagtacatgaaggagcagatcccctggaccctgattgacttctatgacaaccagccctgcatcaacctgattgagagcaagctgggcatcctggacctgctggatgaggagtgcaagatgcccaagggcacagatgacacctgggcccagaagctgtacaacacccacctgaacaagtgtgccctgtttgagaagccccggctgagcaacaaggccttcatcatccagcactttgctgacaaggtggagtaccagtgtgagggcttcctggagaagaacaaggacacagtgtttgaggagcagatcaaggtgctgaagagcagcaagttcaagatgctgcctgagctgttccaggatgatgagaaggccatcagccccaccagcgccaccagcagcggccgcacccccctgaccaggaccccagccaagcccaccaagggccggcccggccagatggccaaggagcacaagaagacagtgggccaccagttcaggaacagcctgcacctgctgatggagaccctgaatgccaccaccccccactacgtgcgctgcatcaagcccaatgacttcaagttccccttcacctttgatgagaagagagctgtgcagcagctgcgggcctgtggggtgctggagaccatccgcatctctgctgctggcttccccagccgctggacctaccaggagttcttcagccgctacagagtgctgatgaagcagaaggatgtgctgagtgacaggaagcagacctgcaagaatgtgctggagaagctgatcctggacaaggacaagtaccagtttgggaagaccaagatcttcttccgggccggccaggtggcctacctggagaagctgcgggctgacaagctgcgggccgcctgcatccgcatccagaagaccatccggggctggctgctgaggaagaagtacctgaggatgaggaaggccgccatcaccatgcagagatatgtgcggggctaccaggcccgctgctacgccaagttcctgcggaggaccaaggccgccaccatcatccagaagtactggaggatgtatgtggtgagaagacgctacaagatcagaagagctgccaccatcgtgctgcagagctacctgcggggcttcctggccaggaaccgctacaggaagatcctgcgggagcacaaggccgtcatcatccagaagagggtgcggggctggctggcccggacccactacaagaggtccatgcacgccatcatctacctgcagtgctgcttccggaggatgatggccaagcgggagctgaagaagctgaagattgaggcccggtctgtggagcgctacaagaagctgcacatcggcatggagaacaagatcatgcagctgcagaggaaggtggatgagcagaacaaggactacaagtgcctggtggagaagctgaccaacctggagggcatctacaacagcgagacagagaagctgcggagtgacctggagcggctgcagctgtctgaggaggaggccaaggtggccaccggccgggtgctgagcctgcaggaggagatcgccaagctgaggaaggacctggagcagaccaggtctgagaagaagtgcatcgaggagcacgccgaccgctacaagcaggagacagagcagctggtgagcaacctgaaggaggagaacaccctgctgaagcaggagaaggaggccctgaaccacagaattgtgcagcaggccaaggagatgacagagaccatggagaagaagctggtggaggagaccaagcagctggagctggacctgaatgatgagcggctgcgctaccagaacctgctgaatgagttcagccggctggaggagagatatgatgacctgaaggaggagatgaccctgatggtgcacgtgcccaagccaggccacaagaggacagacagcacccacagcagcaatgaaagtgagtacatcttcagcagcgagattgctgagatggaggacatccccagcaggacagaggagcccagcgagaagaaggtgcccctggacatgagcctcttcctgaagctgcagaagagggtgacagagctggagcaggagaagcaggtgatgcaggatgagctggacaggaaggaggagcaggtgctgcggagcaaggccaaggaggaggagcggccccagatcagaggagctgagctggagtatgagagcctgaagaggcaggagctggagagcgagaacaagaagctgaagaatgagctgaatgagctgaggaaggccctgtctgagaagagcgcccctgaggtgacagcccctggggccccagcctacagagtgctgatggagcagctgacctctgtgtctgaggagctggatgtgaggaaggaggaggtgctgatcctgcggagccagctggtgtcccagaaggaggccatccagcccaaggatgacaagaacaccatgacagacagcaccatcctgctggaggatgtgcagaagatgaaggacaagggggagatcgcccaggcctacatcggcctgaaggagaccaaccggctgctggagagccagctgcagagccagaagaggagccatgaaaatgaagctgaggccctgcggggggagatccagagcctgaaggaggagaacaaccggcagcagcagctgctggcccagaacctgcagctgcccccagaggcccgcatcgaggccagcctgcagcacgagatcacccggctgaccaatgaaaacctgtactttgaggagctgtatgcagatgaccccaagaagtaccagagctaccgcatcagcctgtacaagaggatgattgacctgatggagcagctggagaagcaggacaagacagtgaggaagctgaagaagcagctgaaggtgtttgccaagaagatcggggagctggaggtgggccagatggagaacatcagccctggccagatcattgatgagcccatccggcctgtgaacatccccaggaaggagaaggacttccagggcatgctggagtacaagaaggaggatgagcagaagctggtgaagaacctgatcctggagctgaagccccggggcgtggccgtgaacctgatccctggcctgcctgcctacatcctcttcatgtgtgtgagacatgctgactacctgaatgatgaccagaaggtgcgcagcctgctgaccagcaccatcaacagcatcaagaaggtgctgaagaagagaggagatgactttgaaacagtgtccttctggctgagcaacacctgccgcttcctgcactgcctgaagcagtacagcggggaggagggcttcatgaagcacaacaccagccggcagaatgagcactgcctgaccaactttgacctggccgagtaccggcaggtgctgagtgacctggccatccagatctaccagcagctggtgcgggtgctggagaacatcctgcagcccatgattgtgtctggcatgctggagcacgagaccatccagggcgtgtctggagtgaagcccaccggcctgaggaagaggaccagcagcattgctgatgagggcacctacaccctggacagcatcctgcggcagctgaacagcttccacagcgtgatgtgccagcacggcatggaccctgagctgatcaagcaggtggtgaagcagatgttctacatcatcggggccatcaccctgaacaacctgctgctgaggaaggacatgtgctcctggagcaagggcatgcagatccgctacaacgtgtcccagctggaggagtggctgcgggacaagaacctgatgaacagcggggccaaggagaccctggagcccctcatccaggccgcccagctgctgcaggtgaagaagaagacagatgatgatgctgaggccatctgcagcatgtgcaatgccctgaccacagcccagatcgtgaaggtgctgaacctgtacacccctgtgaatgaatttgaggagcgggtgtctgtgtccttcatccgcaccatccagatgaggctgcgggacaggaaggacagcccccagctgctgatggatgccaagcacatcttccctgtgaccttccccttcaaccccagcagcctggccctggagaccatccagatcccagccagcctgggcctgggcttcatcagccgggtgtag

SEQ ID NO: 160837 - DNA, 5547 bp, Artificial Sequence
  Description of Artificial Sequence: Synthetic coding sequence
atgtctgtgggggagctgtacagccagtgcaccagggtgtggatcccagaccctgatgaggtgtggaggtctgctgagctgaccaaggactacaaggagggggacaagagcctgcagctgcggctggaggatgagaccatcctggagtaccccattgatgtgcagaggaaccagctgcccttcctgagaaatccagacatcctggtgggagaaaatgacctgacagccctgagctacctgcacgagcctgctgtgctgcacaacctgaaggtgcgcttcctggagagcaaccacatctacacctactgcggcatcgtgctggtggccatcaacccctatgagcagctgcccatctacggccaggacgtcatctacacctacagcggccagaacatgggagacatggacccccacatctttgctgtggccgaggaggcctacaagcagatggccagagatgagaagaaccagagcatcatcgtgtctggagagagcggggccggcaagacagtgtctgccaagtatgccatgagatactttgccaccgtgggcggcagcgccagcgagaccaacatcgaggagaaggtgctggccagcagccccatcatggaggccatcggaaatgccaagaccaccagaaatgacaacagcagcagatttgggaagtacatccagatcggctttgacaagcgctaccacatcattggagccaacatgaggacctacctgctggagaagagccgggtggtgttccaggctgatgatgaaagaaactaccacatcttctaccagctgtgtgccgctgctggcctgcctgagttcaaggagctggccctgaccagcgctgaggacttcttctacaccagccagggcggggacaccagcattgagggcgtggatgatgctgaagattttgagaagacccggcaggccttcaccctgctgggcgtgaaggagagccaccagatgagcatcttcaagatcatcgccagcatcctgcacctgggctctgtggccatccaggccgagagagatggagacagctgcagcatcagcccccaggatgtgtacctgagcaacttctgccgcctgctgggcgtggagcacagccagatggagcactggctgtgccacaggaagctggtgaccaccagcgagacctacgtgaagaccatgagcctgcagcaggtgatcaatgccagaaatgccctggccaagcacatctatgcccagctgtttggctggatcgtggagcacatcaacaaggccctgcacaccagcctgaagcagcacagcttcatcggcgtgctggacatctacggctttgagacctttgaggtgaacagctttgagcagttctgcatcaactatgccaatgagaagctgcagcagcagttcaacagccacgtgttcaagctggagcaggaggagtacatgaaggagcagatcccctggaccctgattgacttctatgacaaccagccctgcatcgacctgattgaggccaagctgggcatcctggacctgctggatgaggagtgcaaggtgcccaagggcacagaccagaactgggcccagaagctgtatgacagacacagcagcagccagcacttccagaagcccaggatgagcaacacagccttcatcatcgtgcactttgctgacaaggtggagtacctgagtgatggcttcctggagaagaacagagacacagtgtatgaggagcagatcaacatcctgaaggccagcaagttccccctggtggccgacctcttccatgatgacaaggaccctgtgcctgccaccacccctgggaagggcagcagcagcaagatctctgtgcgcagcgcccggccccccatgaaggtgagcaacaaggagcacaagaagacagtgggccaccagttccgcaccagcctgcacctgctgatggagaccctgaatgccaccaccccccactacgtgcgctgcatcaagcccaatgatgagaagctgcccttccactttgaccccaagagagctgtgcagcagctgcgggcctgtggggtgctggagaccatccgcatctctgctgctggctaccccagccgctgggcctaccatgacttcttcaaccgctacagagtgctggtgaagaagcgggagctggccaacacagacaagaaggccatctgccgctctgtgctggagaacctgatcaaggaccctgacaagttccagtttggaagaaccaagatcttcttccgggccggccaggtggcctacctggagaagctgcgggctgacaagttcagaacagccaccatcatgatccagaagacagtgcggggctggctgcagaaggtgaagtaccaccggctgaagggggccaccctgaccctgcagcgctactgccggggccacctggcccggcggctggccgagcacctgcggcgcatccgggctgctgtggtgctgcagaagcactacaggatgcagagggcccggcaggcctaccagagggtgcggcgggctgctgtggtgatccaggccttcacccgggccatgtttgtgcggaggacctaccggcaggtgctgatggagcacaaggccaccaccatccagaagcacgtgcggggctggatggcccggcggcacttccagaggctgagagatgctgccatcgtcatccagtgtgccttcaggatgctgaaggcccggcgggagctgaaggccctgcgcatcgaggcccggtctgctgagcacctgaagaggctgaatgtgggcatggagaacaaggtggtgcagctgcagaggaagattgatgagcagaacaaggagttcaagaccctgtctgagcagctgtctgtgaccaccagcacctacaccatggaggtggagcggctgaagaaggagctggtgcactaccagcagagccctggagaggacaccagcctgcggctgcaggaggaggtggagagcctgaggacagagctgcagagggcccacagcgagaggaagatcctggaggatgcccacagccgggagaaggatgagctgaggaagagggtggccgacctggagcaggagaatgccctgctgaaggatgagaaggagcagctgaacaaccagatcctgtgccagagcaaggatgaatttgcccagaacagcgtgaaggagaacctgatgaagaaggagctggaggaggagaggagccgctaccagaacctggtgaaggagtacagccagctggagcagagatatgacaacctgagagatgagatgaccatcatcaagcagaccccaggccacagaagaaaccccagcaaccagagcagcctggagagtgacagcaactaccccagcatcagcaccagcgagattggagacacagaagatgccctgcagcaggtggaggagatcggcctggagaaggccgccatggacatgaccgtcttcctgaagctgcagaagagggtgcgggagctggagcaggagaggaagaagctgcaggtgcagctggagaagcgggagcagcaggacagcaagaaggtgcaggccgagcccccccagacagacatcgacctggaccccaatgctgacctggcctacaacagcctgaagaggcaggagctggagagcgagaacaagaagctgaagaatgacctgaatgagctgaggaaggctgtggccgaccaggccacccagaacaacagcagccacggcagcccagacagctacagcctgctgctgaaccagctgaagctggcccacgaggagctggaggtgaggaaggaggaggtgctgatcctgcggacccagatcgtgtctgctgaccagaggcggctggccggcagaaatgctgagcccaacatcaatgcccggagctcctggcccaacagcgagaagcacgtggaccaggaggatgccatcgaggcctaccacggcgtgtgccagaccaacagcaagacagaggactggggctacctgaatgaagatggagagctgggcctggcctaccagggcctgaagcaggtggcccggctgctggaggcccagctgcaggcccagagcctggagcacgaggaggaggtggagcacctgaaggcccagctggaggccctgaaggaggagatggacaagcagcagcagaccttctgccagaccctgctgctgagccctgaggcccaggtggagtttggagtgcagcaggagatcagccggctgaccaatgaaaacctggacctgaaggagctggtggagaagctggagaagaatgaaaggaagctgaagaagcagctgaagatctacatgaagaaggcccaggacctggaggccgcccaggccctggcccagagcgagaggaagagacatgagctgaaccggcaggtgacagtgcagaggaaggagaaggacttccagggcatgctggagtaccacaaggaggatgaggccctgctgatccggaacctggtgacagacctgaagccccagatgctgagcggcaccgtgccctgcctgcctgcctacatcctgtacatgtgcatcagacatgctgactacaccaatgatgacctgaaggtgcacagcctgctgaccagcaccatcaatggcatcaagaaggtgctgaagaagcacaatgatgactttgagatgaccagcttctggctgagcaacacctgccgcctgctgcactgcctgaagcagtacagcggagatgagggcttcatgacccagaacacagccaagcagaatgagcactgcctgaagaactttgacctgacagagtaccggcaggtgctgagtgacctgagcatccagatctaccagcagctgatcaagattgctgagggcgtgctgcagcccatgattgtgtctgccatgctggagaatgaaagcatccagggcctgtctggagtgaagcccaccggctacaggaagaggagcagctccatggctgatggagacaacagctactgcctggaggccatcatccggcagatgaatgccttccacacagtgatgtgtgaccagggcctggaccctgagatcatcctgcaggtgttcaagcagctgttctacatgatcaatgctgtgaccctgaacaacctgctgctgaggaaggatgtgtgctcctggagcacaggcatgcagctgcgctacaacatcagccagctggaggagtggctgcggggcaggaacctgcaccagagcggggctgtgcagaccatggagcccctcatccaggccgcccagctgctgcagctgaagaagaagacccaggaggatgctgaggccatctgcagcctgtgcaccagcctgagcacccagcagatcgtgaagatcctgaacctgtacacccccctgaatgaatttgaggagcgggtgacagtggccttcatccgcaccatccaggcccagctgcaggagagaaatgacccccagcagctgctgctggatgccaagcacatgtttcctgtgctcttccccttcaaccccagcagcctgaccatggacagcatccacatcccagcctgcctgaacctggagttcctgaatgaggtgtag

SEQ ID NO: 160838 - DNA, 2892 bp, Artificial Sequence
  Description of Artificial Sequence: Synthetic coding sequence
atggagcacaaggccaccaccatccagaagcacgtgcggggctggatggcccggcggcacttccagaggctgagagatgctgccatcgtcatccagtgtgccttcaggatgctgaaggcccggcgggagctgaaggccctgagaattgaggcccggtctgctgagcacctgaagaggctgaatgtgggcatggagaacaaggtggtgcagctgcagaggaagattgatgagcagaacaaggagttcaagaccctgtctgagcagctgtctgtgaccaccagcacctacaccatggaggtggagcggctgaagaaggagctggtgcactaccagcagagccctggagaggacaccagcctgcggctgcaggaggaggtggagagcctgaggacagagctgcagagggcccacagcgagaggaagatcctggaggatgcccacagccgggagaaggatgagctgaggaagagggtggccgacctggagcaggagaatgccctgctgaaggatgagaaggagcagctgaacaaccagatcctgtgccagagcaaggatgaatttgcccagaacagcgtgaaggagaacctgatgaagaaggagctggaggaggagaggagccgctaccagaacctggtgaaggagtacagccagctggagcagagatatgacaacctgagagatgagatgaccatcatcaagcagaccccaggccacagaagaaaccccagcaaccagagcagcctggagagtgacagcaactaccccagcatcagcaccagcgagatcggggacacagaagatgccctgcagcaggtggaggagatcggcctggagaaggccgccatggacatgacagtgttcctgaagctgcagaagagggtgcgggagctggagcaggagaggaagaagctgcaggtgcagctggagaagcgggagcagcaggacagcaagaaggtgcaggccgagcccccccagacagacatcgacctggaccccaatgctgacctggcctacaacagcctgaagaggcaggagctggagagcgagaacaagaagctgaagaatgacctgaatgagctgaggaaggctgtggccgaccaggccacccagaacaacagcagccacggcagcccagacagctacagcctgctgctgaaccagctgaagctggcccacgaggagctggaggtgaggaaggaggaggtgctgatcctgcggacccagatcgtgtctgctgaccagaggcggctggccggcagaaatgctgagcccaacatcaatgcccggagctcctggcccaacagcgagaagcacgtggaccaggaggatgccatcgaggcctaccatggagtgtgccagaccaaccggctgctggaggcccagctgcaggcccagagcctggagcacgaggaggaggtggagcacctgaaggcccagctggaggccctgaaggaggagatggacaagcagcagcagaccttctgccagaccctgctgctgagccctgaggcccaggtggagtttggagtgcagcaggagatcagccggctgaccaatgaaaacctggacctgaaggagctggtggagaagctggagaagaatgaaaggaagctgaagaagcagctgaagatctacatgaagaaggcccaggacctggaggccgcccaggccctggcccagagcgagaggaagagacatgagctgaaccggcaggtgacagtgcagaggaaggagaaggacttccagggcatgctggagtaccacaaggaggatgaggccctgctgatccggaacctggtgacagacctgaagccccagatgctgtctggaacagtgccctgcctgcctgcctacatcctgtacatgtgcatcagacatgctgactacaccaatgatgacctgaaggtgcacagcctgctgaccagcaccatcaatggcatcaagaaggtgctgaagaagcacaatgatgactttgagatgaccagcttctggctgagcaacacctgccgcctgctgcactgcctgaagcagtacagcggagatgagggcttcatgacccagaacacagccaagcagaatgagcactgcctgaagaactttgacctgacagagtaccggcaggtgctgagtgacctgagcatccagatctaccagcagctgatcaagattgctgagggcgtgctgcagcccatgattgtgtctgccatgctggagaatgaaagcatccagggcctgagcggcgtgaagcccaccggctacaggaagaggagcagctccatggctgatggagacaacagctactgcctggaggccatcatccggcagatgaatgccttccacacagtgatgtgtgaccagggcctggaccctgagatcatcctgcaggtgttcaagcagctgttctacatgatcaatgctgtgaccctgaacaacctgctgctgaggaaggatgtgtgctcctggagcacaggcatgcagctgcgctacaacatcagccagctggaggagtggctgcggggcaggaacctgcaccagagcggggctgtgcagaccatggagcccctcatccaggccgcccagctgctgcagctgaagaagaagacccaggaggatgctgaggccatctgcagcctgtgcaccagcctgagcacccagcagatcgtgaagatcctgaacctgtacacccccctgaatgaatttgaggagcgggtgacagtggccttcatccgcaccatccaggcccagctgcaggagagaaatgacccccagcagctgctgctggatgccaagcacatgtttcctgtgctcttccccttcaaccccagcagcctgaccatggacagcatccacatcccagcctgcctgaacctggagttcctgaatgaggtgtag

SEQ ID NO: 160839 - DNA, 2163 bp, Artificial Sequence
  Description of Artificial Sequence: Synthetic coding sequence
atgcactggcctgtgacccgggagtgcaccagggtgtggatcccagaccctgatgaggtgtggaggtctgctgagctgaccaaggactacaaggagggggacaagagcctgcagctgcggctggaggatgagaccatcctggagtaccccattgatgtgcagaggaaccagctgcccttcctgaggaacccagacatcctggtgggggagaatgacctgacagccctgagctacctgcacgagcctgctgtgctgcacaacctgaaggtgcgcttcctggagagcaaccacatctacacctactgcggcatcgtgctggtggccatcaacccctatgagcagctgcccatctacggccaggatgtgatctacacctacagcggccagaacatgggagacatggacccccacatctttgctgtggccgaggaggcctacaagcagatggccagagatgagaagaaccagagcatcatcgtgtctggagagagcggggccggcaagacagtgtctgccaagtatgccatgagatactttgccaccgtgggcggcagcgccagcgagaccaacatcgaggagaaggtgctggccagcagccccatcatggaggccatcggaaatgccaagaccaccagaaatgacaacagcagcagatttgggaagtacatccagattggatttgacaagcgctaccacatcatcggggccaacatgaggacctacctgctggagaagagccgggtggtgttccaggctgatgatgagaggaactaccacatcttctaccagctgtgtgccgccgccggcctgcctgagttcaaggagctggccctgaccagcgctgaggacttcttctacaccagccagggcggggacaccagcattgaaggagtggatgatgctgaggactttgagaagacccggcaggccttcaccctgctgggcgtgaaggagagccaccagatgagcatcttcaagatcatcgccagcatcctgcacctgggctctgtggccatccaggccgagagagatggagacagctgcagcatcagcccccaggatgtgtacctgagcaacttctgccgcctgctgggcgtggagcacagccagatggagcactggctgtgccacaggaagctggtgaccaccagcgagacctacgtgaagaccatgagcctgcagcaggtgatcaatgccagaaatgccctggccaagcacatctatgcccagctgtttggctggatcgtggagcacatcaacaaggccctgcacaccagcctgaagcagcacagcttcatcggcgtgctggacatctacggctttgagacctttgaggtgaacagctttgagcagttctgcatcaactatgccaatgagaagctgcagcagcagttcaacagccacgtgttcaagctggagcaggaggagtacatgaaggagcagatcccctggaccctgattgacttctatgacaaccagccctgcatcgacctgattgaggccaagctgggcatcctggacctgctggatgaggagtgcaaggtgcccaagggcacagaccagaactgggcccagaagctgtatgacagacacagcagcagccagcacttccagaagcccaggatgagcaacacagccttcatcatcgtgcactttgctgacaaggtggagtacctgagtgatggcttcctggagaagaacagagacacagtgtatgaggagcagatcaacatcctgaaggccagcaagttccccctggtggccgacctcttccatgatgacaaggaccctgtgcctgccaccaccccaggcaagggcagcagcagcaagatctctgtgcgcagcgcccggccccccatgaaggtgagcaacaaggagcacaagaagacagtgggccaccagttccgcaccagcctgagcacccagcagatcgtgaagatcctgaacctgtacacccccctgaatgaatttgaggagcgggtgacagtggccttcatccgcaccatccaggcccagctgcaggagagaaatgacccccagcagctgctgctggatgccaagcacatgtttcctgtgctcttccccttcaaccccagcagcctgaccatggacagcatccacatcccagcctgcctgaacctggagttcctgaatgaggtgtag

SEQ ID NO: 160840 - DNA, 5229 bp, Artificial Sequence
  Description of Artificial Sequence: Synthetic coding sequence
atggctgtggccgagctgtacacccagtacaacagagtgtggatcccagaccctgaggaggtgtggaagtctgctgagatcgccaaggactacagagtgggggacaaggtgctgcggctgctgctggaggatggaacagagctggactacagcgtgaaccctgagagcctgccccccctgagaaatccagacatcctggtgggagaaaatgacctgacagccctgagctacctgcacgagcctgctgtgctgcacaacctgcgcatccgctttgctgagagcaagctgatctacacctacagcggcatcatcctggtggccatgaacccctacaagcagctgcccatctatggagatgccatcatccacgcctacagcggccagaacatgggagacatggacccccacatctttgctgtggccgaggaggcctacaagcagatggccaggaacaacagaaaccagagcatcatcgtgtctggagagagcggggccggcaagacagtgtctgcccgctatgccatgagatactttgccaccgtgtccaagagcggcagcaatgcccacgtggaggacaaggtgctggccagcaaccccatcacagaagctgtgggcaatgccaagaccaccagaaatgacaacagcagcagatttgggaagtacacagagatcagctttgatgagcagaaccagatcattggagccaacatgagcacctacctgctggagaagagccgggtggtgttccagagtgaaaatgaaagaaactaccacatcttctaccagctgtgtgccagcgcccagcagagcgagttcaagcacctgaagctgggcagcgctgaggagttcaactacaccaggatgggcggcaacacagtcatcgagggcgtgaatgacagagctgagatggtggagacccagaagaccttcaccctgctgggcttcaaggaggacttccagatggatgtgttcaagatcctggccgccatcctgcacctgggcaatgtgcagatcacagctgtgggcaatgaaagaagctctgtgtctgaagatgacagccacctgaaggtgttctgtgagctgctgggcctggagagcggccgggtggcccagtggctgtgcaacaggaagatcgtgaccagcagcgagaccgtggtgaagcccatgacccggccccaggccgtgaatgccagagatgccctggccaagaagatctatgcccacctgtttgacttcatcgtggagcgcatcaaccaggccctgcagttcagcggcaagcagcacaccttcatcggcgtgctggacatctacggctttgagacctttgatgtgaacagctttgagcagttctgcatcaactatgccaatgagaagctgcagcagcagttcaacatgcacgtgttcaagctggagcaggaggagtacatgaaggaggacatcccctggaccctgattgacttctatgacaaccagcccgtcatcgacctgattgaggccaagatgggcatcctggagctgctggatgaggagtgcctgctgccccatggaacagatgagaactggctgcagaagctgtacaacaactttgtgaacagaaaccccctgtttgagaagcccaggatgagcaacaccagctttgtgatccagcactttgctgacaaggtggagtacaagtgtgagggcttcctggagaagaacagagacacagtgtatgacatgctggtggagatcctgcgggccagcaagttccacctgtgtgccaacttcttccaggagaaccccaccccacccagccccttcggctccatgatcaccgtgaagagcgccaagcaggtgatcaagcccaacagcaagcacttccgcaccaccgtgggcagcaagttccgcagcagcctgtacctgctgatggagaccctgaatgccaccaccccccactacgtgcgctgcatcaagcccaatgatgagaagctgccctttgaatttgacagcaagagaattgtgcagcagctgcgggcctgtggggtgctggagaccatccgcatcagcgcccagagctaccccagccgctggacctacatcgagttctacagccgctatggcatcctgatgaccaagcaggagctgtccttcagtgacaagaaggaggtgtgcaaggtggtgctgcacaggctcatccaggacagcaaccagtaccagtttgggaagaccaagatcttcttccgggccggccaggtggcctacctggagaagctgcggctggacaagctgcggcagagctgtgtgatggtgcagaagcacatgaggggctggctgcagaggaagaagttcctgcgggagcggcgggccgccctgatcatccagcagtacttccggggccagcagacagtgaggaaggccatcacagctgtggccctgaaggaggcctgggccgccatcatcatccagaagcactgccggggctacctggtgcgcagcctgtaccagctgatccgcatggccaccatcaccatgcaggcctacagccggggcttcctggcccggcggcgctacaggaagatgctggaggagcacaaggctgtgatcctgcagaagtatgcccgggcctggctggcccggcggcgcttccagagcatcagaagatttgtgctgaacatccagctgacctacagagtgcagaggctgcagaagaagctggaggaccagaacaaggagaaccacggcctggtggagaagctgaccagcctggccgccctgcgggctggagatgtggagaagatccagaagctggaggccgagctggagaaggccgccacccacagaagaaattatgaggagaagggcaagcgctacagagatgctgtggaggagaagctggccaagctgcagaagcacaacagcgagctggagacccagaaggagcagatccagctgaagctgcaggagaagacagaggagctgaaggagaagatggacaacctgaccaagcagctgtttgatgatgtgcagaaggaggagcggcagaggatgctgctggagaagagctttgagctgaagacccaggactatgagaagcagatccagagcctgaaggaggagatcaaggccctgaaggatgagaagatgcagctgcagcacctggtggagggggagcacgtgaccagtgatggcctgaaggccgaggtggcccggctgagcaagcaggtgaagaccatcagcgagtttgagaaggagattgagctgctgcaggcccagaagattgatgtggagaagcacgtgcagagccagaagcgggagatgagggagaagatgtctgagatcaccaagcagctgctggagagctatgacattgaagatgtgcgcagccggctgtctgtggaggacctggagcacctgaatgaagatggagagctgtggtttgcctatgagggcctgaagaaggccaccagggtgctggagagccacttccagagccagaaggactgctatgagaaggagattgaggccctgaacttcaaggtggtgcacctgagccaggagatcaaccacctgcagaagctgttccgggaggagaatgacatcaatgaaagcatcagacatgaggtgacccggctgaccagcgagaacatgatgatcccagacttcaagcagcagatcagcgagctggagaagcagaagcaggacctggagatccggctgaatgagcaggccgagaagatgaagggcaagctggaggagctgagcaaccagctgcacaggagccaggaggaggagggcacccagaggaaggccctggaggcccagaatgagatccacaccaaggagaaggagaagctgattgacaagatccaggagatgcaggaggccagtgaccacctgaagaagcagtttgaaacagagagcgaggtgaagtgcaacttccggcaggaggccagccggctgaccctggagaacagagacctggaggaggagctggacatgaaggacagagtcatcaagaagctgcaggaccaggtgaagaccctgagcaagaccatcggcaaggccaatgatgtgcacagcagcagcggccccaaggagtacctgggcatgctgcagtacaagagagaagatgaggccaagctgatccagaacctgatcctggacctgaagccccggggcgtggtggtgaacatgatccctggcctgcctgcccacatcctcttcatgtgtgtgcgctatgctgacagcctgaatgatgccaacatgctgaagagcctgatgaacagcaccatcaatggcatcaagcaggtggtgaaggagcacctggaggactttgagatgctgtccttctggctgagcaacacctgccacttcctgaactgcctgaagcagtacagcggggaggaggagttcatgaagcacaacagcccccagcagaacaagaactgcctgaacaactttgacctgtctgagtaccggcagatcctgagtgatgtggccatccgcatctaccaccagttcatcatcatcatggagaagaacatccagcccatcatcgtgcccggcatgctggagtatgagagcctgcagggcatcagcggcctgaagcccaccggcttcaggaagaggagcagcagcattgatgacacagatggctacaccatgacctctgtgctgcagcagctgagctacttctacaccaccatgtgccagaatggcctggaccctgagctggtgcggcaggccgtgaagcagctgttcttcctgattggagctgtgaccctgaacagcctcttcctgaggaaggacatgtgcagctgcaggaagggcatgcagatccgctgcaacatctcctacctggaggagtggctgaaggacaagaacctgcagaacagcctggccaaggagaccctggagcccctgagccaggccgcctggctgctgcaggtgaagaagaccacagacagtgatgccaaggagatctatgagcgctgcaccagcctgtctgctgtgcagatcatcaagatcctgaacagctacacccccattgatgactttgagaagagggtgacccccagctttgtgaggaaggtgcaggccctgctgaacagccgggaggacagcagccagctgatgctggacaccaagtacctgttccaggtgaccttccccttcacccccagcccccacgccctggagatgatccagatccccagcagcttcaagctgggcttcctgaaccggctgtag

SEQ ID NO: 160841 - DNA, 1122 bp, Artificial Sequence
  Description of Artificial Sequence: Synthetic coding sequence
atgcccagcagcacccccacagctggccgcacctgggccatctggacccacacctacctgccctggcagaagaggcacaccagccgctggccagatggcaagtctgaggcccaggacctggacctgctgaccctgtacctgaacctgtactgcatcaccccagctgctgcccctgagctgccccccctgtatgtgtttgtgtgtgagctggacagccagagggcccccatccctggcagtgatgcctacaatgaaggagctggaggagcctacatgaggaacaacagaaaccagagcatcatcgtgtctggagagagcggggccggcaagacagtgtctgcccgctatgccatgagatactttgccaccgtgtccaagagcggcagcaatgcccacgtggaggacaaggtgctggccagcaaccccatcacagaggccgtgggcaatgccaagaccaccagaaatgacaacagcagcagatttgggaagtacacagagatcagctttgatgagcagaaccagatcatcggggccaacatgagcacctacctgctggagaagagccgggtggtgttccagagtgaaaatgaaagaaactaccacatcttctaccagctgtgtgccagcgcccagcagagcgagttcaagcacctgaagctgggcagcgctgaggagttcaactacaccaggatgggcggcaacacagtgattgaaggagtgaatgacagagctgagatggtggagacccagaagaccttcaccctgctgggcttcaaggaggacttccagatggatgtgttcaagatcctggccgccatcctgcacctgggcaatgtgcagatcacagctgtgggcaatgaaagaagctctgtgtctgaagatgacagccacctgaaggtgttctgtgagctgctgggcctggagagcggccgggtggcccagtggctgtgcaacaggaagatcgtgaccagcagcgagaccgtggtgaagcccatgacccggccccaggccgtgaatgccagagatgccctggccaagaagatctatgcccacctgtttgacttcatcgtggagcgcatcaaccaggccctgcagttctctgtgctgaagcccctgatgtag

SEQ ID NO: 160842 - DNA, 321 bp, Artificial Sequence
  Description of Artificial Sequence: Synthetic coding sequence
atgaacccctacaagcagctgcccatctatggagatgccatcatccacgcctacagcggccagaacatgggagacatggacccccacatctttgctgtggccgaggaggcctacaagcagatggccaggaacaacagaaaccagagcatcatcgtgtctggagagagcggggccggcaagacagtgtctgcccgctatgccatgagatactttgccaccgtgtccaagagcggcagcaatgcccacgtggaggacaaggtgctggccagcaaccccatcacagaggccgtgggcaatgccaagaccaccagaaatgactag

SEQ ID NO: 160843 - DNA, 1293 bp, Artificial Sequence
  Description of Artificial Sequence: Synthetic coding sequence
atggctgtggccgagctgtacacccagtacaacagagtgtggatcccagaccctgaggaggtgtggaagtctgctgagatcgccaaggactacagagtgggggacaaggtgctgcggctgctgctggaggatggaacagagctggactacagcgtgaaccctgagagcctgccccccctgagaaatccagacatcctggtgggagaaaatgacctgacagccctgagctacctgcacgagcctgctgtgctgcacaacctgcgcatccgctttgctgagagcaagctgatctacacctacagcggcatcatcctggtggccatgaacccctacaagcagctgcccatctatggagatgccatcatccacgcctacagcggccagaacatgggagacatggacccccacatctttgctgtggccgaggaggcctacaagcagatggccaggaacaacagaaaccagagcatcatcgtgtctggagagagcggggccggcaagacagtgtctgcccgctatgccatgagatactttgccaccgtgtccaagagcggcagcaatgcccacgtggaggacaaggtgctggccagcaaccccatcacagaagctgtgggcaatgccaagaccaccagaaatgacaacagcagcagatttgggaagtacacagagatcagctttgatgagcagaaccagatcattggagccaacatgagcacctacctgctggagaagagccgggtggtgttccagagtgaaaatgaaagaaactaccacatcttctaccagctgtgtgccagcgcccagcagagcgagttcaagcacctgaagctgggcagcgctgaggagttcaactacaccaggatgggcggcaacacagtcatcgagggcgtgaatgacagagctgagatggtggagacccagaagaccttcaccctgctgggcttcaaggaggacttccagatggatgtgttcaagatcctggccgccatcctgcacctgggcaatgtgcagatcacagctgtgggcaatgaaagaagctctgtgtctgaagatgacagccacctgaaggtgttctgtgagctgctgggcctggagagcggccgggtggcccagtggctgtgcaacaggaagatcgtgaccagcagcgagaccgtggtgaagcccatgacccggccccaggccgtgaatgccagagatgccctggccaagaagatctatgcccacctgtttgacttcatcgtggagcgcatcaaccaggccctgcagttctctgtgctgaagcccctgatgtag

SEQ ID NO: 160844 - DNA, 810 bp, Artificial Sequence
  Description of Artificial Sequence: Synthetic coding sequence
atggctgtggccgagctgtacacccagtacaacagagtgtggatcccagaccctgaggaggtgtggaagtctgctgagatcgccaaggactacagagtgggggacaaggtgctgcggctgctgctggaggatggaacagagctggactacagcgtgaaccctgagagcctgccccccctgagaaatccagacatcctggtgggagaaaatgacctgacagccctgagctacctgcacgagcctgctgtgctgcacaacctgcgcatccgctttgctgagagcaagctgatctacacctacagcggcatcatcctggtggccatgaacccctacaagcagctgcccatctatggagatgccatcatccacgcctacagcggccagaacatgggagacatggacccccacatctttgctgtggccgaggaggcctacaagcagatggccaggaacaacagaaaccagagcatcatcgtgtctggagagagcggggccggcaagacagtgtctgcccgctatgccatgagatactttgccaccgtgtccaagagcggcagcaatgcccacgtggaggacaaggtgctggccagcaaccccatcacagaagctgtgggcaatgccaagaccaccagaaatgacaacagcagcagatttgggaagtacacagagatcagctttgatgagcagaaccagatcattggagccaacatgagcacctacctgctggagaagagccgggtggtgttccagggcgtgcccaagaacctgatcatccaggagtgggaggccatcctgagcctgcgggtgtag

SEQ ID NO: 160845 - DNA, 3762 bp, Artificial Sequence
  Description of Artificial Sequence: Synthetic coding sequence
atggaggatggcaagcctgtgtgggccccccaccccacagatggcttccagatgggcaacatcgtggacatcggccctgacagcctgaccatcgagcccctgaaccagaagggcaagaccttcctggccctgatcaaccaggtgtttcctgctgaggaggacagcaagaaggatgtggaggacaactgcagcctgatgtacctgaatgaggccaccctgctgcacaacatcaaggtgcgctacagcaaggaccgcatctacacctacgtggccaacatcctgattgctgtgaacccctactttgacatccccaagatctacagcagcgaggccatcaagagctaccagggcaagagcctgggcacccggcccccccacgtgtttgccatcgctgacaaggccttccgggacatgaaggtgctgaagatgagccagagcatcatcgtgtctggagagagcggggccggcaagacagagaacaccaagtttgtgctgcgctacctgacagagagctatggcaccggccaggacattgatgaccgcatcgtggaggccaaccccctgctggaggcctttggaaatgccaagacagtgaggaacaacaacagcagcagatttgggaagtttgtggagatccacttcaatgagaagagctctgtggtgggcggctttgtgagccactacctgctggagaagagccgcatctgtgtgcagggcaaggaggagaggaactaccacatcttctaccgcctgtgtgccggggccagcgaggacatccgggagaagctgcacctgagcagcccagacaacttccgctacctgaacagaggctgcacccgctactttgccaacaaggagacagacaagcagatcctgcagaacaggaagagccctgagtacctgaaggccggctccatgaaggaccccctgctggatgaccacggggacttcatccgcatgtgcacagccatgaagaagattggcctggatgatgaggagaagctggacctcttccgggtggtggccggcgtgctgcacctgggcaacatcgactttgaggaggccggcagcaccagcggcggctgcaacctgaagaacaagagcgcccagagcctggagtactgtgccgagctgctgggcctggaccaggatgacctgcgggtgtccctgaccaccagggtgatgctgaccacagctgggggcaccaagggcaccgtcatcaaggtgcccctgaaggtggagcaggccaacaatgccagagatgccctggccaagacagtgtacagccacctgtttgaccacgtggtgaacagagtgaaccagtgcttcccctttgagaccagcagctacttcatcggcgtgctggacattgctggctttgagtactttgagcacaacagctttgagcagttctgcatcaactactgcaatgagaagctgcagcagttcttcaatgaaagaatcctgaaggaggagcaggagctgtaccagaaggagggcctgggcgtgaatgaggtgcactacgtggacaaccaggactgcatcgacctgattgaggccaagctggtgggcatcctggacatcctggatgaggagaaccggctgccccagcccagcgaccagcacttcaccagcgctgtgcaccagaagcacaaggaccacttccggctgaccatccccaggaagagcaagctggccgtgcacaggaacatcagagatgatgagggcttcatcatccgccactttgctggagctgtgtgctatgagaccacccagtttgtggagaagaacaatgatgccctgcacatgagcctggagagcctcatctgtgagagccgggacaagttcatccgggagctgtttgagagcagcaccaacaacaacaaggacaccaagcagaaggccggcaagctgtccttcatctctgtgggcaacaagttcaagacccagctgaacctgctgctggacaagctgcggagcactggagccagcttcatccgctgcatcaagcccaacctgaagatgaccagccaccactttgagggcgcccagatcctgagccagctgcagtgcagcggcatggtgtctgtgctggacctgatgcagggcggctaccccagccgggccagcttccacgagctgtacaacatgtacaagaagtacatgccagacaagctggcccggctggaccccaggctcttctgcaaggccctcttcaaggccctgggcctgaatgaaaatgactacaagtttggcctgaccaaggtgttcttccggcctgggaagtttgctgagtttgaccagatcatgaagagtgaccctgaccacctggccgagctggtgaagagggtgaaccactggctgacctgcagccgctggaagaaggtgcagtggtgcagcctgagcgtcatcaagctgaagaacaagatcaagtacagagctgaggcctgcatcaagatgcagaagaccatccgcatgtggctgtgcaagagaagacacaagcccagaattgatggcctggtgaaggtgggcaccctgaagaagaggctggacaagttcaatgaggtggtgtctgtgctgaaggatggcaagccagagatgaacaagcagatcaagaacctggagatcagcattgacaccctgatggccaagatcaagagcaccatgatgacccaggagcagatccagaaggagtatgatgccctggtgaagagcagcgaggagctgctgagcgccctgcagaagaagaagcagcaggaggaggaggccgagcggctgcggcgcatccaggaggagatggagaaggagaggaagagaagagaggaggatgagaagagaagaaggaaggaggaggaggagaggaggatgaagctggagatggaggccaagaggaagcaggaggaggaggagaggaagaagagagaagatgatgagaagaggatccaggccgaggtggaggcccagctggcccggcagaaggaggaggagagccagcagcaggccgtgctggagcaggagcggcgggaccgggagctggccctgcgcatcgcccagagcgaggccgagctgatcagtgatgaggcccaggccgacctggccctgcggcggggccctgctgtgctggccaccaaggctgctgctggcaccaagaagtatgacctgagcaagtggaagtatgcagagctgcgggacaccatcaacaccagctgtgacatcgagctgctggccgcctgccgggaggagttccaccggcggctgaaggtgtaccacgcctggaagagcaagaacaagaagaggaacacagaaacagagcagagggcccccaagtctgtgacagattatgcccagcagaacccagctgcccagatcccagcccggcagcgggagattgagatgaaccggcagcagcgcttcttccgcatccccttcatccggcctgctgaccagtacaaggacccccagagcaagaagaagggctggtggtacgcccactttgatggcccctggatcgcccggcagatggagctgcacccagacaagccacccatcctgctggtggccggcaaggatgacatggagatgtgtgagctgaacctggaggagaccggcctgaccaggaagagaggagctgagatcctgccccggcagtttgaggagatctgggagcgctgtggcggcatccagtacctgcagaatgccatcgagagccggcaggcccggcccacctacgccacagccatgctgcagagcctgctgaagtag

SEQ ID NO: 160846 - DNA, 3858 bp, Artificial Sequence
  Description of Artificial Sequence: Synthetic coding sequence
atggaggatggcaagcctgtgtgggccccccaccccacagatggcttccagatgggcaacatcgtggacatcggccctgacagcctgaccatcgagcccctgaaccagaagggcaagaccttcctggccctgatcaaccaggtgtttcctgctgaggaggacagcaagaaggatgtggaggacaactgcagcctgatgtacctgaatgaggccaccctgctgcacaacatcaaggtgcgctacagcaaggaccgcatctacacctacgtggccaacatcctgattgctgtgaacccctactttgacatccccaagatctacagcagcgaggccatcaagagctaccagggcaagagcctgggcacccggcccccccacgtgtttgccatcgctgacaaggccttccgggacatgaaggtgctgaagatgagccagagcatcatcgtgtctggagagagcggggccggcaagacagagaacaccaagtttgtgctgcgctacctgacagagagctatggcaccggccaggacattgatgaccgcatcgtggaggccaaccccctgctggaggcctttggaaatgccaagacagtgaggaacaacaacagcagcagatttgggaagtttgtggagatccacttcaatgagaagagctctgtggtgggcggctttgtgagccactacctgctggagaagagccgcatctgtgtgcagggcaaggaggagaggaactaccacatcttctaccgcctgtgtgccggggccagcgaggacatccgggagaagctgcacctgagcagcccagacaacttccgctacctgaacagaggctgcacccgctactttgccaacaaggagacagacaagcagatcctgcagaacaggaagagccctgagtacctgaaggccggctccatgaaggaccccctgctggatgaccacggggacttcatccgcatgtgcacagccatgaagaagattggcctggatgatgaggagaagctggacctcttccgggtggtggccggcgtgctgcacctgggcaacatcgactttgaggaggccggcagcaccagcggcggctgcaacctgaagaacaagagcgcccagagcctggagtactgtgccgagctgctgggcctggaccaggatgacctgcgggtgtccctgaccaccagggtgatgctgaccacagctgggggcaccaagggcaccgtcatcaaggtgcccctgaaggtggagcaggccaacaatgccagagatgccctggccaagacagtgtacagccacctgtttgaccacgtggtgaacagagtgaaccagtgcttcccctttgagaccagcagctacttcatcggcgtgctggacattgctggctttgagtactttgagcacaacagctttgagcagttctgcatcaactactgcaatgagaagctgcagcagttcttcaatgaaagaatcctgaaggaggagcaggagctgtaccagaaggagggcctgggcgtgaatgaggtgcactacgtggacaaccaggactgcatcgacctgattgaggccaagctggtgggcatcctggacatcctggatgaggagaaccggctgccccagcccagcgaccagcacttcaccagcgctgtgcaccagaagcacaaggaccacttccggctgaccatccccaggaagagcaagctggccgtgcacaggaacatcagagatgatgagggcttcatcatccgccactttgctggagctgtgtgctatgagaccacccagtttgtggagaagaacaatgatgccctgcacatgagcctggagagcctcatctgtgagagccgggacaagttcatccgggagctgtttgagagcagcaccaacaacaacaaggacaccaagcagaaggccggcaagctgtccttcatctctgtgggcaacaagttcaagacccagctgaacctgctgctggacaagctgcggagcactggagccagcttcatccgctgcatcaagcccaacctgaagatgaccagccaccactttgagggcgcccagatcctgagccagctgcagtgcagcggcatggtgtctgtgctggacctgatgcagggcggctaccccagccgggccagcttccacgagctgtacaacatgtacaagaagtacatgccagacaagctggcccggctggaccccaggctcttctgcaaggccctcttcaaggccctgggcctgaatgaaaatgactacaagtttggcctgaccaaggtgttcttccggcctgggaagtttgctgagtttgaccagatcatgaagagtgaccctgaccacctggccgagctggtgaagagggtgaaccactggctgacctgcagccgctggaagaaggtgcagtggtgcagcctgagcgtcatcaagctgaagaacaagatcaagtacagagctgaggcctgcatcaagatgcagaagaccatccgcatgtggctgtgcaagagaagacacaagcccagaattgatggcctggtgaaggtgggcaccctgaagaagaggctggacaagttcaatgaggtggtgtctgtgctgaaggatggcaagccagagatgaacaagcagatcaagaacctggagatcagcattgacaccctgatggccaagatcaagagcaccatgatgacccaggagcagatccagaaggagtatgatgccctggtgaagagcagcgaggagctgctgagcgccctgcagaagaagaagcagcaggaggaggaggccgagcggctgcggcgcatccaggaggagatggagaaggagaggaagagaagagaggaggatgagaagagaagaaggaaggaggaggaggagaggaggatgaagctggagatggaggccaagaggaagcaggaggaggaggagaggaagaagagagaagatgatgagaagaggatccaggccgaggtggaggcccagctggcccggcagaaggaggaggagagccagcagcaggccgtgctggagcaggagcggcgggaccgggagctggccctgcgcatcgcccagagcgaggccgagctgatcagtgatgaggcccaggccgacctggccctgcggagaaatgatggcacccggcccaagatgaccccagagcagatggccaaggagatgtctgagttcctgagccggggccctgctgtgctggccaccaaggctgctgctggcaccaagaagtatgacctgagcaagtggaagtatgcagagctgcgggacaccatcaacaccagctgtgacatcgagctgctggccgcctgccgggaggagttccaccggcggctgaaggtgtaccacgcctggaagagcaagaacaagaagaggaacacagaaacagagcagagggcccccaagtctgtgacagattatgactttgcccccttcctgaacaacagcccccagcagaacccagctgcccagatcccagcccggcagcgggagattgagatgaaccggcagcagcgcttcttccgcatccccttcatccggcctgctgaccagtacaaggacccccagagcaagaagaagggctggtggtacgcccactttgatggcccctggatcgcccggcagatggagctgcacccagacaagccacccatcctgctggtggccggcaaggatgacatggagatgtgtgagctgaacctggaggagaccggcctgaccaggaagagaggagctgagatcctgccccggcagtttgaggagatctgggagcgctgtggcggcatccagtacctgcagaatgccatcgagagccggcaggcccggcccacctacgccacagccatgctgcagagcctgctgaagtag

SEQ ID NO: 160847 - DNA, 3861 bp, Artificial Sequence
  Description of Artificial Sequence: Synthetic coding sequence
atggaggatggcaagcctgtgtgggccccccaccccacagatggcttccagatgggcaacatcgtggacatcggccctgacagcctgaccatcgagcccctgaaccagaagggcaagaccttcctggccctgatcaaccaggtgtttcctgctgaggaggacagcaagaaggatgtggaggacaactgcagcctgatgtacctgaatgaggccaccctgctgcacaacatcaaggtgcgctacagcaaggaccgcatctacacctacgtggccaacatcctgattgctgtgaacccctactttgacatccccaagatctacagcagcgaggccatcaagagctaccagggcaagagcctgggcacccggcccccccacgtgtttgccatcgctgacaaggccttccgggacatgaaggtgctgaagatgagccagagcatcatcgtgtctggagagagcggggccggcaagacagagaacaccaagtttgtgctgcgctacctgacagagagctatggcaccggccaggacattgatgaccgcatcgtggaggccaaccccctgctggaggcctttggaaatgccaagacagtgaggaacaacaacagcagcagatttgggaagtttgtggagatccacttcaatgagaagagctctgtggtgggcggctttgtgagccactacctgctggagaagagccgcatctgtgtgcagggcaaggaggagaggaactaccacatcttctaccgcctgtgtgccggggccagcgaggacatccgggagaagctgcacctgagcagcccagacaacttccgctacctgaacagaggctgcacccgctactttgccaacaaggagacagacaagcagatcctgcagaacaggaagagccctgagtacctgaaggccggctccatgaaggaccccctgctggatgaccacggggacttcatccgcatgtgcacagccatgaagaagattggcctggatgatgaggagaagctggacctcttccgggtggtggccggcgtgctgcacctgggcaacatcgactttgaggaggccggcagcaccagcggcggctgcaacctgaagaacaagagcgcccagagcctggagtactgtgccgagctgctgggcctggaccaggatgacctgcgggtgtccctgaccaccagggtgatgctgaccacagctgggggcaccaagggcaccgtcatcaaggtgcccctgaaggtggagcaggccaacaatgccagagatgccctggccaagacagtgtacagccacctgtttgaccacgtggtgaacagagtgaaccagtgcttcccctttgagaccagcagctacttcatcggcgtgctggacattgctggctttgagtactttgagcacaacagctttgagcagttctgcatcaactactgcaatgagaagctgcagcagttcttcaatgaaagaatcctgaaggaggagcaggagctgtaccagaaggagggcctgggcgtgaatgaggtgcactacgtggacaaccaggactgcatcgacctgattgaggccaagctggtgggcatcctggacatcctggatgaggagaaccggctgccccagcccagcgaccagcacttcaccagcgctgtgcaccagaagcacaaggaccacttccggctgaccatccccaggaagagcaagctggccgtgcacaggaacatcagagatgatgagggcttcatcatccgccactttgctggagctgtgtgctatgagaccacccagtttgtggagaagaacaatgatgccctgcacatgagcctggagagcctcatctgtgagagccgggacaagttcatccgggagctgtttgagagcagcaccaacaacaacaaggacaccaagcagaaggccggcaagctgtccttcatctctgtgggcaacaagttcaagacccagctgaacctgctgctggacaagctgcggagcactggagccagcttcatccgctgcatcaagcccaacctgaagatgaccagccaccactttgagggcgcccagatcctgagccagctgcagtgcagcggcatggtgtctgtgctggacctgatgcagggcggctaccccagccgggccagcttccacgagctgtacaacatgtacaagaagtacatgccagacaagctggcccggctggaccccaggctcttctgcaaggccctcttcaaggccctgggcctgaatgaaaatgactacaagtttggcctgaccaaggtgttcttccggcctgggaagtttgctgagtttgaccagatcatgaagagtgaccctgaccacctggccgagctggtgaagagggtgaaccactggctgacctgcagccgctggaagaaggtgcagtggtgcagcctgagcgtcatcaagctgaagaacaagatcaagtacagagctgaggcctgcatcaagatgcagaagaccatccgcatgtggctgtgcaagagaagacacaagcccagaattgatggcctggtgaaggtgggcaccctgaagaagaggctggacaagttcaatgaggtggtgtctgtgctgaaggatggcaagccagagatgaacaagcagatcaagaacctggagatcagcattgacaccctgatggccaagatcaagagcaccatgatgacccaggagcagatccagaaggagtatgatgccctggtgaagagcagcgaggagctgctgagcgccctgcagaagaagaagcagcaggaggaggaggccgagcggctgcggcgcatccaggaggagatggagaaggagaggaagagaagagaggaggatgagaagagaagaaggaaggaggaggaggagaggaggatgaagctggagatggaggccaagaggaagcaggaggaggaggagaggaagaagagagaagatgatgagaagaggatccaggccgaggtggaggcccagctggcccggcagaaggaggaggagagccagcagcaggccgtgctggagcaggagcggcgggaccgggagctggccctgcgcatcgcccagagcgaggccgagctgatcagtgatgaggcccaggccgacctggccctgcggcgctacctggacagctaccctgtgaccagcaagaatgatggcacccggcccaagatgaccccagagcagatggccaaggagatgtctgagttcctgagccggggccctgctgtgctggccaccaaggctgctgctggcaccaagaagtatgacctgagcaagtggaagtatgcagagctgcgggacaccatcaacaccagctgtgacatcgagctgctggccgcctgccgggaggagttccaccggcggctgaaggtgtaccacgcctggaagagcaagaacaagaagaggaacacagaaacagagcagagggcccccaagtctgtgacagattatgcccagcagaacccagctgcccagatcccagcccggcagcgggagattgagatgaaccggcagcagcgcttcttccgcatccccttcatccggcctgctgaccagtacaaggacccccagagcaagaagaagggctggtggtacgcccactttgatggcccctggatcgcccggcagatggagctgcacccagacaagccacccatcctgctggtggccggcaaggatgacatggagatgtgtgagctgaacctggaggagaccggcctgaccaggaagagaggagctgagatcctgccccggcagtttgaggagatctgggagcgctgtggcggcatccagtacctgcagaatgccatcgagagccggcaggcccggcccacctacgccacagccatgctgcagagcctgctgaagtag

SEQ ID NO: 160848 - DNA, 3789 bp, Artificial Sequence
  Description of Artificial Sequence: Synthetic coding sequence
atggaggatggcaagcctgtgtgggccccccaccccacagatggcttccagatgggcaacatcgtggacatcggccctgacagcctgaccatcgagcccctgaaccagaagggcaagaccttcctggccctgatcaaccaggtgtttcctgctgaggaggacagcaagaaggatgtggaggacaactgcagcctgatgtacctgaatgaggccaccctgctgcacaacatcaaggtgcgctacagcaaggaccgcatctacacctacgtggccaacatcctgattgctgtgaacccctactttgacatccccaagatctacagcagcgaggccatcaagagctaccagggcaagagcctgggcacccggcccccccacgtgtttgccatcgctgacaaggccttccgggacatgaaggtgctgaagatgagccagagcatcatcgtgtctggagagagcggggccggcaagacagagaacaccaagtttgtgctgcgctacctgacagagagctatggcaccggccaggacattgatgaccgcatcgtggaggccaaccccctgctggaggcctttggaaatgccaagacagtgaggaacaacaacagcagcagatttgggaagtttgtggagatccacttcaatgagaagagctctgtggtgggcggctttgtgagccactacctgctggagaagagccgcatctgtgtgcagggcaaggaggagaggaactaccacatcttctaccgcctgtgtgccggggccagcgaggacatccgggagaagctgcacctgagcagcccagacaacttccgctacctgaacagaggctgcacccgctactttgccaacaaggagacagacaagcagatcctgcagaacaggaagagccctgagtacctgaaggccggctccatgaaggaccccctgctggatgaccacggggacttcatccgcatgtgcacagccatgaagaagattggcctggatgatgaggagaagctggacctcttccgggtggtggccggcgtgctgcacctgggcaacatcgactttgaggaggccggcagcaccagcggcggctgcaacctgaagaacaagagcgcccagagcctggagtactgtgccgagctgctgggcctggaccaggatgacctgcgggtgtccctgaccaccagggtgatgctgaccacagctgggggcaccaagggcaccgtcatcaaggtgcccctgaaggtggagcaggccaacaatgccagagatgccctggccaagacagtgtacagccacctgtttgaccacgtggtgaacagagtgaaccagtgcttcccctttgagaccagcagctacttcatcggcgtgctggacattgctggctttgagtactttgagcacaacagctttgagcagttctgcatcaactactgcaatgagaagctgcagcagttcttcaatgaaagaatcctgaaggaggagcaggagctgtaccagaaggagggcctgggcgtgaatgaggtgcactacgtggacaaccaggactgcatcgacctgattgaggccaagctggtgggcatcctggacatcctggatgaggagaaccggctgccccagcccagcgaccagcacttcaccagcgctgtgcaccagaagcacaaggaccacttccggctgaccatccccaggaagagcaagctggccgtgcacaggaacatcagagatgatgagggcttcatcatccgccactttgctggagctgtgtgctatgagaccacccagtttgtggagaagaacaatgatgccctgcacatgagcctggagagcctcatctgtgagagccgggacaagttcatccgggagctgtttgagagcagcaccaacaacaacaaggacaccaagcagaaggccggcaagctgtccttcatctctgtgggcaacaagttcaagacccagctgaacctgctgctggacaagctgcggagcactggagccagcttcatccgctgcatcaagcccaacctgaagatgaccagccaccactttgagggcgcccagatcctgagccagctgcagtgcagcggcatggtgtctgtgctggacctgatgcagggcggctaccccagccgggccagcttccacgagctgtacaacatgtacaagaagtacatgccagacaagctggcccggctggaccccaggctcttctgcaaggccctcttcaaggccctgggcctgaatgaaaatgactacaagtttggcctgaccaaggtgttcttccggcctgggaagtttgctgagtttgaccagatcatgaagagtgaccctgaccacctggccgagctggtgaagagggtgaaccactggctgacctgcagccgctggaagaaggtgcagtggtgcagcctgagcgtcatcaagctgaagaacaagatcaagtacagagctgaggcctgcatcaagatgcagaagaccatccgcatgtggctgtgcaagagaagacacaagcccagaattgatggcctggtgaaggtgggcaccctgaagaagaggctggacaagttcaatgaggtggtgtctgtgctgaaggatggcaagccagagatgaacaagcagatcaagaacctggagatcagcattgacaccctgatggccaagatcaagagcaccatgatgacccaggagcagatccagaaggagtatgatgccctggtgaagagcagcgaggagctgctgagcgccctgcagaagaagaagcagcaggaggaggaggccgagcggctgcggcgcatccaggaggagatggagaaggagaggaagagaagagaggaggatgagaagagaagaaggaaggaggaggaggagaggaggatgaagctggagatggaggccaagaggaagcaggaggaggaggagaggaagaagagagaagatgatgagaagaggatccaggccgaggtggaggcccagctggcccggcagaaggaggaggagagccagcagcaggccgtgctggagcaggagcggcgggaccgggagctggccctgcgcatcgcccagagcgaggccgagctgatcagtgatgaggcccaggccgacctggccctgcggcggggccctgctgtgctggccaccaaggctgctgctggcaccaagaagtatgacctgagcaagtggaagtatgcagagctgcgggacaccatcaacaccagctgtgacatcgagctgctggccgcctgccgggaggagttccaccggcggctgaaggtgtaccacgcctggaagagcaagaacaagaagaggaacacagaaacagagcagagggcccccaagtctgtgacagattatgactttgcccccttcctgaacaacagcccccagcagaacccagctgcccagatcccagcccggcagcgggagattgagatgaaccggcagcagcgcttcttccgcatccccttcatccggcctgctgaccagtacaaggacccccagagcaagaagaagggctggtggtacgcccactttgatggcccctggatcgcccggcagatggagctgcacccagacaagccacccatcctgctggtggccggcaaggatgacatggagatgtgtgagctgaacctggaggagaccggcctgaccaggaagagaggagctgagatcctgccccggcagtttgaggagatctgggagcgctgtggcggcatccagtacctgcagaatgccatcgagagccggcaggcccggcccacctacgccacagccatgctgcagagcctgctgaagtag

SEQ ID NO: 160849 - DNA, 3888 bp, Artificial Sequence
  Description of Artificial Sequence: Synthetic coding sequence
atggaggatggcaagcctgtgtgggccccccaccccacagatggcttccagatgggcaacatcgtggacatcggccctgacagcctgaccatcgagcccctgaaccagaagggcaagaccttcctggccctgatcaaccaggtgtttcctgctgaggaggacagcaagaaggatgtggaggacaactgcagcctgatgtacctgaatgaggccaccctgctgcacaacatcaaggtgcgctacagcaaggaccgcatctacacctacgtggccaacatcctgattgctgtgaacccctactttgacatccccaagatctacagcagcgaggccatcaagagctaccagggcaagagcctgggcacccggcccccccacgtgtttgccatcgctgacaaggccttccgggacatgaaggtgctgaagatgagccagagcatcatcgtgtctggagagagcggggccggcaagacagagaacaccaagtttgtgctgcgctacctgacagagagctatggcaccggccaggacattgatgaccgcatcgtggaggccaaccccctgctggaggcctttggaaatgccaagacagtgaggaacaacaacagcagcagatttgggaagtttgtggagatccacttcaatgagaagagctctgtggtgggcggctttgtgagccactacctgctggagaagagccgcatctgtgtgcagggcaaggaggagaggaactaccacatcttctaccgcctgtgtgccggggccagcgaggacatccgggagaagctgcacctgagcagcccagacaacttccgctacctgaacagaggctgcacccgctactttgccaacaaggagacagacaagcagatcctgcagaacaggaagagccctgagtacctgaaggccggctccatgaaggaccccctgctggatgaccacggggacttcatccgcatgtgcacagccatgaagaagattggcctggatgatgaggagaagctggacctcttccgggtggtggccggcgtgctgcacctgggcaacatcgactttgaggaggccggcagcaccagcggcggctgcaacctgaagaacaagagcgcccagagcctggagtactgtgccgagctgctgggcctggaccaggatgacctgcgggtgtccctgaccaccagggtgatgctgaccacagctgggggcaccaagggcaccgtcatcaaggtgcccctgaaggtggagcaggccaacaatgccagagatgccctggccaagacagtgtacagccacctgtttgaccacgtggtgaacagagtgaaccagtgcttcccctttgagaccagcagctacttcatcggcgtgctggacattgctggctttgagtactttgagcacaacagctttgagcagttctgcatcaactactgcaatgagaagctgcagcagttcttcaatgaaagaatcctgaaggaggagcaggagctgtaccagaaggagggcctgggcgtgaatgaggtgcactacgtggacaaccaggactgcatcgacctgattgaggccaagctggtgggcatcctggacatcctggatgaggagaaccggctgccccagcccagcgaccagcacttcaccagcgctgtgcaccagaagcacaaggaccacttccggctgaccatccccaggaagagcaagctggccgtgcacaggaacatcagagatgatgagggcttcatcatccgccactttgctggagctgtgtgctatgagaccacccagtttgtggagaagaacaatgatgccctgcacatgagcctggagagcctcatctgtgagagccgggacaagttcatccgggagctgtttgagagcagcaccaacaacaacaaggacaccaagcagaaggccggcaagctgtccttcatctctgtgggcaacaagttcaagacccagctgaacctgctgctggacaagctgcggagcactggagccagcttcatccgctgcatcaagcccaacctgaagatgaccagccaccactttgagggcgcccagatcctgagccagctgcagtgcagcggcatggtgtctgtgctggacctgatgcagggcggctaccccagccgggccagcttccacgagctgtacaacatgtacaagaagtacatgccagacaagctggcccggctggaccccaggctcttctgcaaggccctcttcaaggccctgggcctgaatgaaaatgactacaagtttggcctgaccaaggtgttcttccggcctgggaagtttgctgagtttgaccagatcatgaagagtgaccctgaccacctggccgagctggtgaagagggtgaaccactggctgacctgcagccgctggaagaaggtgcagtggtgcagcctgagcgtcatcaagctgaagaacaagatcaagtacagagctgaggcctgcatcaagatgcagaagaccatccgcatgtggctgtgcaagagaagacacaagcccagaattgatggcctggtgaaggtgggcaccctgaagaagaggctggacaagttcaatgaggtggtgtctgtgctgaaggatggcaagccagagatgaacaagcagatcaagaacctggagatcagcattgacaccctgatggccaagatcaagagcaccatgatgacccaggagcagatccagaaggagtatgatgccctggtgaagagcagcgaggagctgctgagcgccctgcagaagaagaagcagcaggaggaggaggccgagcggctgcggcgcatccaggaggagatggagaaggagaggaagagaagagaggaggatgagaagagaagaaggaaggaggaggaggagaggaggatgaagctggagatggaggccaagaggaagcaggaggaggaggagaggaagaagagagaagatgatgagaagaggatccaggccgaggtggaggcccagctggcccggcagaaggaggaggagagccagcagcaggccgtgctggagcaggagcggcgggaccgggagctggccctgcgcatcgcccagagcgaggccgagctgatcagtgatgaggcccaggccgacctggccctgcggcgctacctggacagctaccctgtgaccagcaagaatgatggcacccggcccaagatgaccccagagcagatggccaaggagatgtctgagttcctgagccggggccctgctgtgctggccaccaaggctgctgctggcaccaagaagtatgacctgagcaagtggaagtatgcagagctgcgggacaccatcaacaccagctgtgacatcgagctgctggccgcctgccgggaggagttccaccggcggctgaaggtgtaccacgcctggaagagcaagaacaagaagaggaacacagaaacagagcagagggcccccaagtctgtgacagattatgactttgcccccttcctgaacaacagcccccagcagaacccagctgcccagatcccagcccggcagcgggagattgagatgaaccggcagcagcgcttcttccgcatccccttcatccggcctgctgaccagtacaaggacccccagagcaagaagaagggctggtggtacgcccactttgatggcccctggatcgcccggcagatggagctgcacccagacaagccacccatcctgctggtggccggcaaggatgacatggagatgtgtgagctgaacctggaggagaccggcctgaccaggaagagaggagctgagatcctgccccggcagtttgaggagatctgggagcgctgtggcggcatccagtacctgcagaatgccatcgagagccggcaggcccggcccacctacgccacagccatgctgcagagcctgctgaagtag

SEQ ID NO: 160850 - DNA, 525 bp, Artificial Sequence
  Description of Artificial Sequence: Synthetic coding sequence
aagaggcgggaggaggatgagaagagaagaaggaaggaggaggaggagaggaggatgaagctggagatggaggccaagaggaagcaggaggaggaggagaggaagaagcgggaggatgatgagaagaggatccaggccgaggtggaggcccagctggcccggcagaaggaggaggagagccagcagcaggccgtgctggagcaggagcggcgggaccgggagctggccctgagaattgcccagagcgaggccgagctgatcagtgatgaggcccaggccgacctggccctgcggagcctggacagctaccctgtgaccagcaagaatgatggcacccggcccaagatgaccccaggccctgctgtgctggccaccaaggctgctgctggcaccaagaagtatgacctgagcaagtggaagtatgcagagctgcgggacaccatcaacaccagctgtgacatcgagctgctggccgcctgccgggaggagttccaccggcggctgaaggtgtaccacgcctggtag

SEQ ID NO: 160851 - DNA, 6276 bp, Artificial Sequence
  Description of Artificial Sequence: Synthetic coding sequence
gccctgctgcagaagggggaccacgtgtggatggacctgcggctgggccaggagtttgatgtgcccatcggggctgtggtgaagctgtgtgacagcggccaggtgcaggtggtggatgatgaagataatgagcactggatcagcccccagaatgccacccacatcaagcccatgcaccccacctctgtgcacggcgtggaggacatgatccggctgggggacctgaatgaggccggcatcctgaggaacctgctgatccgctacagagaccacctgatctacacctacacaggcagcatcctggtggccgtgaacccctaccagctgctgagcatctacagccctgagcacatccggcagtacaccaacaagaagatcggggagatgccaccccacatctttgccatcgctgacaactgctacttcaacatgaagaggaacagccgggaccagtgctgcatcatcagcggggagagcggggccggcaagacagagagcaccaagctgatcctgcagttcctggccgccatcagcggccagcacagctggattgagcagcaggtgctggaggccacccccatcctggaggcctttggaaatgccaagaccatcagaaatgacaacagcagcagatttgggaagtacatcgacatccacttcaacaagagaggagccatcgagggcgccaagattgagcagtacctgctggagaagagccgggtgtgccggcaggccctggatgaaagaaactaccacgtgttctactgcatgctggagggcatgtctgaggaccagaagaagaagctgggcctgggccaggccagtgactacaactacctggccatggtgaaccccccagacctgatgagctgcctgaccagcaggaccctcatcaccagaggagaaacagtgtccacccccctgagccgggagcaggccctggatgtgagagatgcctttgtgaagggcatctacggccgcctgtttgtgtggatcgtggacaagatcaatgctgccatctacaagccacccagccaggatgtgaagaacagccgccgcagcatcggcctgctggacatctttggatttgagaactttgctgtgaacagctttgagcagctgtgcatcaactttgccaatgagcacctgcagcagttctttgtgcgccacgtgttcaagctggagcaggaggagtatgacctggagagcattgactggctgcacatcgagttcacagacaaccaggatgccctggacatgattgccaacaagcccatgaacatcatcagcctgattgatgaggagagcaagttccccaagttcctggagaagaacagagacaccctgcacggggacatcatccagctggtgcacagcagcaggaacaagttcatcaagcagatcttccaggctgatgtggccatgggcgctgagaccaggaagaggagccccaccctgagcagccagttcaagaggagcctggagctgctgatgaggaccctgggcgcctgccagcccttctttgtgcgctgcatcaagcccaatgagttcaagaagcccatgctgtttgacagacacctgtgtgtgcggcagctgcgctacagcggcatgatggagaccatccgcatccggcgggccggctaccccatccgctacagctttgtggagtttgtggagcgctacagagtgctgctgcccggggtgaagccagcctacaagcagggcgacctgcggggcacctgccagaggatggccgaggccgtgctgggcacccatgatgactggcagatcggcaagaccaagatcttcctgaaggaccaccacgacatgctgctggaggtggagcgggacaaggccatcacagacagagtcatcctgctgcagaaggtgatccggggcttcaaggacaggagcaacttcctgaagctgaagaatgctgccaccctcatccagaggcactggaggggccacaactgcaggaagaactacggcctgatgaggctgggcttcctgcggctgcaggccctgcacaggagcaggaagctgcaccagcagtaccgcctggcccggcagaggatcatccagttccaggcccgctgccgggcctacctggtgaggaaggccttccgccaccggctgtgggccgtgctgactgtgcaggcctatgcccggggcatgattgcccggcggctgcaccagaggctgcgggcagagtacctgtggaggctggaggccgagaagatgaggctggccgaggaggagaagctgaggaaggagatgtctgccaagaaggccaaggaggaggccgagaggaagcaccaggagcggctggcccagctggccagagaagatgctgagcgggagctgaaggagaaggaggccgcccggaggaagaaggagctgctggagcagatggagcgggcccggcatgagcctgtgaaccacagcgacatggtggacaagatgtttggcttcctgggcaccagcggcggcctgcccggccaggagggccaggcccccagcggctttgaggacctggagcggggccggcgggagatggtggaggaggacctggatgctgccctgcccctgcctgatgaagatgaggaggacctgtctgagtacaagtttgccaagtttgctgccacctacttccagggcaccaccacccacagctacacccggcggcccctgaagcagcccctgctgtaccatgatgatgaaggagaccagctggccgccctggccgtgtggatcaccatcctgcgcttcatgggagacctgcctgagcccaagtaccacacagccatgtctgatggcagcgagaagatccctgtgatgaccaagatctatgagaccctgggcaagaagacctacaagcgggagctgcaggccctgcagggcgagggggaggcccagctgcctgagggccagaagaagagctctgtgcgccacaagctggtgcacctgaccctgaagaagaagagcaagctgacagaggaggtgaccaagaggctgcatgatggagagagcacagtgcagggcaacagcatgctggaggaccggcccaccagcaacctggagaagctgcacttcatcattggaaatggcatcctgcggcctgccctgagagatgagatctactgccagatcagcaagcagctgacccacaaccccagcaagagcagctatgcccggggctggatcctggtgtccctgtgtgtgggctgctttgcccccagcgagaagtttgtgaagtacctgaggaacttcatccatggaggccccccaggctacgccccctactgtgaggagcggctgcggaggacctttgtgaatggcaccaggacccagcccccatcctggctggagctgcaggccaccaagagcaagaagcccatcatgctgcctgtgaccttcatggatggcaccaccaagaccctgctgacagacagcgccaccacagccaaggagctgtgcaatgccctggccgacaagatcagcctgaaggacagatttggcttcagcctgtacatcgccctgtttgacaaggtgagcagcctgggcagcggcagtgaccacgtgatggatgccatcagccagtgtgagcagtatgccaaggagcagggcgcccaggagagaaatgccccctggaggctcttcttcaggaaggaggtgttcaccccctggcacagccccagtgaagataatgtggccaccaacctgatctaccagcaggtggtgcggggcgtgaagtttggagagtaccgctgtgagaaggaggatgacctggccgagctggccagccagcagtactttgtggactatggcagcgagatgatcctggagcggctgctgaacctggtgcccacctacatcccagaccgggagatcacccccctgaagaccctggagaagtgggcccagctggccatcgccgcccacaagaagggcatctatgcccagaggagaacagatgcccagaaggtgaaggaggatgtggtgtcctatgcccgcttcaagtggcccctgctcttcagccgcttctatgaggcctacaagttcagcggccccagcctgcccaagaatgatgtgattgtggccgtgaactggacaggagtgtactttgtggatgagcaggagcaggtgctgctggagctgtccttccctgagatcatggctgtgagcagcagccgggagtgccgggtgtggctgagcctgggctgcagcgacctgggctgtgccgccccccacagcggctgggccggcctgaccccagctggcccctgcagcccctgctggagctgccgcggggccaagaccacagcccccagcttcaccctggccaccatcaagggagatgagtacaccttcaccagcagcaatgctgaggacatccgggacctggtggtgaccttcctggagggcctgaggaagaggagcaaatatgtggtggccctgcaggacaaccccaacccagctggggaggagagcggcttcctgagctttgccaagggggacctgatcatcctggaccatgacacaggagagcaggtgatgaacagcggctgggccaacggcatcaatgaaagaaccaagcagagaggagacttccccacagacagcgtgtatgtgatgcccaccgtgaccatgccaccccgggagatcgtggccctggtgaccatgaccccagaccagaggcaggatgtggtgcggctgctgcagctgaggacagctgagcctgaggtgcgggccaagccctacaccctggaggagttctcctatgactacttccggcccccacccaagcacaccctgagccgggtgatggtgtccaaggcccggggcaaggaccggctgtggagccacacccgggagcccctgaagcaggccctgctgaagaagctgctgggcagcgaggagctgagccaggaggcctgcctggccttcatcgctgtgctgaagtacatgggagactaccccagcaagaggaccaggtctgtgaatgagctgacagaccagatctttgagggccccctgaaggccgagcccctgaaggatgaggcctacgtgcagatcctgaagcagctgacagacaaccacatccgctacagcgaggagcggggctgggagctgctgtggctgtgcaccggcctcttcccccccagcaacatcctgctgccccacgtgcagcgcttcctgcagagcaggaagcactgccccctggccatcgactgcctgcagaggctgcagaaggccctgagaaatggcagcaggaagtacccaccccacctggtggaggtggaggccatccagcacaagaccacccagatcttccacaaggtgtacttcccagatgacacagatgaggcctttgaggtggagagcagcaccaaggccaaggacttctgccagaacatcgccacccggctgctgctgaagagcagcgagggcttcagcctgtttgtgaagattgctgacaaggtgctgtctgtgcctgaaaatgacttcttctttgattttgtgcgccacctgacagactggatcaagaaggcccggcccatcaaggatggcatcgtgcccagcctgacctaccaggtgttcttcatgaagaagctgtggaccaccaccgtgcctgggaaggaccccatggctgacagcatcttccactactaccaggagctgcccaagtacctgcggggctaccacaagtgcacccgggaggaggtgctgcagctgggcgccctgatctacagagtgaagtttgaggaggacaagagctacttccccagcatccccaagctgctgcgggagctggtgccccaggacctgatccggcaggtgtccccagatgactggaagaggagcatcgtggcctacttcaacaagcatgctgggaagagcaaggaggaggccaagctggccttcctgaagctgatcttcaagtggcccaccttcggcagcgccttctttgaggtgaagcagaccacagagcccaacttccctgagatcctgctgattgccatcaacaagtatggagtgtccctgattgaccccaagaccaaggacatcctgaccacccaccccttcaccaagatcagcaactggagcagcggcaacacctacttccacatcaccatcggcaacctggtgcggggcagcaagctgctgtgtgagaccagcctgggctacaagatggatgacctgctgaccagctacatcagccagatgctgacagccatgagcaagcagaggggcagccgcagcggcaagtag

SEQ ID NO: 160852 - DNA, 6555 bp, Artificial Sequence
  Description of Artificial Sequence: Synthetic coding sequence
gccctgctgcagaagggggaccacgtgtggatggacctgcggctgggccaggagtttgatgtgcccatcggggctgtggtgaagctgtgtgacagcggccaggtgcaggtggtggatgatgaagataatgagcactggatcagcccccagaatgccacccacatcaagcccatgcaccccacctctgtgcacggcgtggaggacatgatccggctgggggacctgaatgaggccggcatcctgaggaacctgctgatccgctacagagaccacctgatctacacctacacaggcagcatcctggtggccgtgaacccctaccagctgctgagcatctacagccctgagcacatccggcagtacaccaacaagaagatcggggagatgccaccccacatctttgccatcgctgacaactgctacttcaacatgaagaggaacagccgggaccagtgctgcatcatcagcggggagagcggggccggcaagacagagagcaccaagctgatcctgcagttcctggccgccatcagcggccagcacagctggattgagcagcaggtgctggaggccacccccatcctggaggcctttggaaatgccaagaccatcagaaatgacaacagcagcagatttgggaagtacatcgacatccacttcaacaagagaggagccatcgagggcgccaagattgagcagtacctgctggagaagagccgggtgtgccggcaggccctggatgaaagaaactaccacgtgttctactgcatgctggagggcatgtctgaggaccagaagaagaagctgggcctgggccaggccagtgactacaactacctggccatgggcaactgcatcacctgtgagggccgggtggacagccaggagtatgccaacatccgcagcgccatgaaggtgctgatgttcacagacacagagaactgggagatcagcaagctgctggccgccatcctgcacctgggcaacctgcagtatgaggcccggacctttgagaacctggatgcctgtgaggtgctcttcagccccagcctggccacagctgccagcctgctggaggtgaaccccccagacctgatgagctgcctgaccagcaggaccctcatcaccagaggagagaccgtgtccacccccctgagccgggagcaggccctggatgtgagagatgcctttgtgaagggcatctacggccgcctgtttgtgtggatcgtggacaagatcaatgctgccatctacaagccacccagccaggatgtgaagaacagcagaagaagcatcggcctgctggacatcttcggctttgaaaattttgctgtgaacagctttgagcagctgtgcatcaactttgccaatgagcacctgcagcagttctttgtgagacatgtgttcaagctggagcaggaggagtatgacctggagagcattgactggctgcacatcgagttcacagacaaccaggatgccctggacatgattgccaacaagcccatgaacatcatcagcctgattgatgaggagagcaagttccccaagggcacagacaccaccatgctgcacaagctgaacagccagcacaagctgaatgccaactacatcccccccaagaacaaccacgagacccagtttggcatcaaccactttgctggcatcgtgtactatgagacccagggcttcctggagaagaacagagacaccctgcatggagacatcatccagctggtgcacagcagcaggaacaagttcatcaagcagatcttccaggctgatgtggccatgggcgctgagaccaggaagaggagccccaccctgagcagccagttcaagaggagcctggagctgctgatgaggaccctgggcgcctgccagcccttctttgtgcgctgcatcaagcccaatgagttcaagaagcccatgctgtttgacagacacctgtgtgtgcggcagctgcgctacagcggcatgatggagaccatccgcatcagaagagctggctaccccatccgctacagctttgtggagtttgtggagcgctacagagtgctgctgcccggggtgaagccagcctacaagcagggcgacctgcggggcacctgccagaggatggccgaggccgtgctgggcacccatgatgactggcagatcggcaagaccaagatcttcctgaaggaccaccacgacatgctgctggaggtggagcgggacaaggccatcacagacagagtcatcctgctgcagaaggtgatccggggcttcaaggacaggagcaacttcctgaagctgaagaatgctgccaccctcatccagaggcactggaggggccacaactgcaggaagaactacggcctgatgaggctgggcttcctgcggctgcaggccctgcacaggagcaggaagctgcaccagcagtaccgcctggcccggcagaggatcatccagttccaggcccgctgccgggcctacctggtgaggaaggccttccgccaccggctgtgggccgtgctgactgtgcaggcctatgcccggggcatgattgcccggcggctgcaccagaggctgcgggcagagtacctgtggaggctggaggccgagaagatgaggctggccgaggaggagaagctgaggaaggagatgtctgccaagaaggccaaggaggaggccgagaggaagcaccaggagcggctggcccagctggcccgggaggatgctgagcgggagctgaaggagaaggaggccgcccggaggaagaaggagctgctggagcagatggagcgggcccggcatgagcctgtgaaccacagcgacatggtggacaagatgtttggcttcctgggcaccagcggcggcctgcccggccaggagggccaggcccccagcggctttgaggacctggagcggggcagaagagagatggtggaggaggacctggatgctgccctgcccctgcctgatgaagatgaggaggacctgtctgagtacaagtttgccaagtttgctgccacctacttccagggcaccaccacccacagctacacccggcggcccctgaagcagcccctgctgtaccatgatgatgaaggagaccagctggccgccctggccgtgtggatcaccatcctgcgcttcatgggagacctgcctgagcccaagtaccacacagccatgtctgatggcagcgagaagatccctgtgatgaccaagatctatgagaccctgggcaagaagacctacaagcgggagctgcaggccctgcagggcgagggggaggtgaccaagaggctgcatgatggagagagcacagtgcagggcaacagcatgctggaggaccggcccaccagcaacctggagaagctgcacttcatcattggaaatggcatcctgcggcctgccctgagagatgagatctactgccagatcagcaagcagctgacccacaaccccagcaagagcagctatgcccggggctggatcctggtgtccctgtgtgtgggctgctttgcccccagcgagaagtttgtgaagtacctgaggaacttcatccacggcggccccccaggctacgccccctactgtgaggagcggctgcggaggacctttgtgaatggcaccaggacccagccccccagctggctggagctgcaggccaccaagagcaagaagcccatcatgctgcctgtgaccttcatggatggcaccaccaagaccctgctgacagattctgccaccacagccaaggagctgtgcaatgccctggccgacaagatcagcctgaaggaccgcttcggcttcagcctgtacatcgccctgtttgacaaggtgagcagcctgggcagcggcagtgaccacgtgatggatgccatcagccagtgtgagcagtatgccaaggagcagggcgcccaggagagaaatgccccctggaggctcttcttcaggaaggaggtgttcaccccctggcacagccccagcgaggacaacgtggccaccaacctgatctaccagcaggtggtgcggggcgtgaagtttggagagtaccgctgtgagaaggaggatgacctggccgagctggccagccagcagtactttgtggactatggcagcgagatgatcctggagcggctgctgaacctggtgcccacctacatcccagaccgggagatcacccccctgaagaccctggagaagtgggcccagctggccatcgccgcccacaagaagggcatctatgcccagaggagaacagatgcccagaaggtgaaggaggatgtggtgtcctatgcccgcttcaagtggcccctgctcttcagccgcttctatgaggcctacaagttcagcggccccagcctgcccaagaatgatgtgattgtggccgtgaactggacaggagtgtactttgtggatgagcaggagcaggtgctgctggagctgtccttccctgagatcatggctgtgagcagcagcagagaatgtcgggtgtggctgagcctgggctgcagcgacctgggctgtgccgccccccacagcggctgggccggcctgaccccagctggcccctgcagcccctgctggagctgccgcggggccaagaccacagcccccagcttcaccctggccaccatcaagggagatgagtacaccttcaccagcagcaatgctgaggacatccgggacctggtggtgaccttcctggagggcctgaggaagaggagcaaatatgtggtggccctgcaggacaaccccaacccagctggggaggagagcggcttcctgagctttgccaagggggacctgatcatcctggaccatgacaccggggagcaggtgatgaacagcggctgggccaacggcatcaatgaaagaaccaagcagagaggagacttccccacagattctgtgtatgtgatgcccaccgtgaccatgccaccccgggagatcgtggccctggtgaccatgaccccagaccagaggcaggatgtggtgcggctgctgcagctgaggacagctgagcctgaggtgcgggccaagccctacaccctggaggagttctcctatgactacttccggcccccacccaagcacaccctgagccgggtgatggtgtccaaggcccggggcaaggaccggctgtggagccacacccgggagcccctgaagcaggccctgctgaagaagctgctgggcagcgaggagctgagccaggaggcctgcctggccttcatcgctgtgctgaagtacatgggagactaccccagcaagaggaccaggtctgtgaatgagctgacagaccagatctttgagggccccctgaaggccgagcccctgaaggatgaggcctacgtgcagatcctgaagcagctgacagacaaccacatccgctacagcgaggagcggggctgggagctgctgtggctgtgcaccggcctcttcccccccagcaacatcctgctgccccacgtgcagcgcttcctgcagagcaggaagcactgccccctggccatcgactgcctgcagaggctgcagaaggccctgagaaatggcagcaggaagtacccaccccacctggtggaggtggaggccatccagcacaagaccacccagatcttccacaaggtgtacttcccagatgacacagatgaggcctttgaggtggagagcagcaccaaggccaaggacttctgccagaacatcgccacccggctgctgctgaagagcagcgagggcttcagcctgtttgtgaagattgctgacaaggtgctgtctgtgcctgaaaatgacttcttctttgattttgtgcgccacctgacagactggatcaagaaggcccggcccatcaaggatggcatcgtgcccagcctgacctaccaggtgttcttcatgaagaagctgtggaccaccaccgtgcctgggaaggaccccatggctgacagcatcttccactactaccaggagctgcccaagtacctgcggggctaccacaagtgcacccgggaggaggtgctgcagctgggcgccctgatctacagagtgaagtttgaggaggacaagagctacttccccagcatccccaagctgctgcgggagctggtgccccaggacctgatccggcaggtgtccccagatgactggaagaggagcatcgtggcctacttcaacaagcacgccggcaagagcaaggaggaggccaagctggccttcctgaagctgatcttcaagtggcccacctttggaagtgccttctttgaggtgaagcagaccacagagcccaacttccctgagatcctgctgattgccatcaacaagtatggagtgtccctgattgaccccaagaccaaggacatcctgaccacccaccccttcaccaagatcagcaactggagcagcggcaacacctacttccacatcaccatcggcaacctggtgcggggcagcaagctgctgtgtgagaccagcctgggctacaagatggatgacctgctgaccagctacatcagccagatgctgacagccatgagcaagcagaggggcagccgcagcggcaagtag

SEQ ID NO: 160853 - DNA, 3609 bp, Artificial Sequence
  Description of Artificial Sequence: Synthetic coding sequence
gccctgctgcagaagggggaccacgtgtggatggacctgcggctgggccaggagtttgatgtgcccatcggggctgtggtgaagctgtgtgacagcggccaggtgcaggtggtggatgatgaagataatgagcactggatcagcccccagaatgccacccacatcaagcccatgcaccccacctctgtgcacggcgtggaggacatgatccggctgggggacctgaatgaggccggcatcctgaggaacctgctgatccgctacagagaccacctgatctacacctacacaggcagcatcctggtggccgtgaacccctaccagctgctgagcatctacagccctgagcacatccggcagtacaccaacaagaagatcggggagatgccaccccacatctttgccatcgctgacaactgctacttcaacatgaagaggaacagccgggaccagtgctgcatcatcagcggggagagcggggccggcaagacagagagcaccaagctgatcctgcagttcctggccgccatcagcggccagcacagctggattgagcagcaggtgctggaggccacccccatcctggaggcctttggaaatgccaagaccatcagaaatgacaacagcagcagatttgggaagtacatcgacatccacttcaacaagagaggagccatcgagggcgccaagattgagcagtacctgctggagaagagccgggtgtgccggcaggccctggatgaaagaaactaccacgtgttctactgcatgctggagggcatgtctgaggaccagaagaagaagctgggcctgggccaggccagtgactacaactacctggccatgggcaactgcatcacctgtgagggccgggtggacagccaggagtatgccaacatccgcagcgccatgaaggtgctgatgttcacagacacagagaactgggagatcagcaagctgctggccgccatcctgcacctgggcaacctgcagtatgaggcccggacctttgagaacctggatgcctgtgaggtgctcttcagccccagcctggccacagctgccagcctgctggaggtgaaccccccagacctgatgagctgcctgaccagcaggaccctcatcaccagaggagagaccgtgtccacccccctgagccgggagcaggccctggatgtgagagatgcctttgtgaagggcatctacggccgcctgtttgtgtggatcgtggacaagatcaatgctgccatctacaagccacccagccaggatgtgaagaacagcagaagaagcatcggcctgctggacatcttcggctttgaaaattttgctgtgaacagctttgagcagctgtgcatcaactttgccaatgagcacctgcagcagttctttgtgagacatgtgttcaagctggagcaggaggagtatgacctggagagcattgactggctgcacatcgagttcacagacaaccaggatgccctggacatgattgccaacaagcccatgaacatcatcagcctgattgatgaggagagcaagttccccaagggcacagacaccaccatgctgcacaagctgaacagccagcacaagctgaatgccaactacatcccccccaagaacaaccacgagacccagtttggcatcaaccactttgctggcatcgtgtactatgagacccagggcttcctggagaagaacagagacaccctgcatggagacatcatccagctggtgcacagcagcaggaacaagttcatcaagcagatcttccaggctgatgtggccatgggcgctgagaccaggaagaggagccccaccctgagcagccagttcaagaggagcctggagctgctgatgaggaccctgggcgcctgccagcccttctttgtgcgctgcatcaagcccaatgagttcaagaagcccatgctgtttgacagacacctgtgtgtgcggcagctgcgctacagcggcatgatggagaccatccgcatcagaagagctggctaccccatccgctacagctttgtggagtttgtggagcgctacagagtgctgctgcccggggtgaagccagcctacaagcagggcgacctgcggggcacctgccagaggatggccgaggccgtgctgggcacccatgatgactggcagatcggcaagaccaagatcttcctgaaggaccaccacgacatgctgctggaggtggagcgggacaaggccatcacagacagagtcatcctgctgcagaaggtgatccggggcttcaaggacaggagcaacttcctgaagctgaagaatgctgccaccctcatccagaggcactggaggggccacaactgcaggaagaactacggcctgatgaggctgggcttcctgcggctgcaggccctgcacaggagcaggaagctgcaccagcagtaccgcctggcccggcagaggatcatccagttccaggcccgctgccgggcctacctggtgaggaaggccttccgccaccggctgtgggccgtgctgactgtgcaggcctatgcccggggcatgattgcccggcggctgcaccagaggctgcgggcagagtacctgtggaggctggaggccgagaagatgaggctggccgaggaggagaagctgaggaaggagatgtctgccaagaaggccaaggaggaggccgagaggaagcaccaggagcggctggcccagctggcccgggaggatgctgagcgggagctgaaggagaaggaggccgcccggaggaagaaggagctgctggagcagatggagcgggcccggcatgagcctgtgaaccacagcgacatggtggacaagatgtttggcttcctgggcaccagcggcggcctgcccggccaggagggccaggcccccagcggctttgaggacctggagcggggcagaagagagatggtggaggaggacctggatgctgccctgcccctgcctgatgaagatgaggaggacctgtctgagtacaagtttgccaagtttgctgccacctacttccagggcaccaccacccacagctacacccggcggcccctgaagcagcccctgctgtaccatgatgatgaaggagaccagctggccgccctggccgtgtggatcaccatcctgcgcttcatgggagacctgcctgagcccaagtaccacacagccatgtctgatggcagcgagaagatccctgtgatgaccaagatctatgagaccctgggcaagaagacctacaagcgggagctgcaggccctgcagggcgagggggaggtgctgcaggcccagctgcctgagggccagaagaagagctctgtgcgccacaagctggtgcacctgaccctgaagaagaagagcaagctgacagaggaggtgaccaagaggctgcatgatggagagagcacagtgcagggcaacagcatgctggaggaccggcccaccagcaacctggagaagctgcacttcatcattggaaatggcatcctgcggcctgccctgcggtctgtgcccccagagagcctgctggtggccgagtggtgcctgtgccagcccagcaagaggctgagccaggcccctggctttggatttgctgccagctag

SEQ ID NO: 160854 - DNA, 6645 bp, Artificial Sequence
  Description of Artificial Sequence: Synthetic coding sequence
gccctgctgcagaagggggaccacgtgtggatggacctgcggctgggccaggagtttgatgtgcccatcggggctgtggtgaagctgtgtgacagcggccaggtgcaggtggtggatgatgaagataatgagcactggatcagcccccagaatgccacccacatcaagcccatgcaccccacctctgtgcacggcgtggaggacatgatccggctgggggacctgaatgaggccggcatcctgaggaacctgctgatccgctacagagaccacctgatctacacctacacaggcagcatcctggtggccgtgaacccctaccagctgctgagcatctacagccctgagcacatccggcagtacaccaacaagaagatcggggagatgccaccccacatctttgccatcgctgacaactgctacttcaacatgaagaggaacagccgggaccagtgctgcatcatcagcggggagagcggggccggcaagacagagagcaccaagctgatcctgcagttcctggccgccatcagcggccagcacagctggattgagcagcaggtgctggaggccacccccatcctggaggcctttggaaatgccaagaccatcagaaatgacaacagcagcagatttgggaagtacatcgacatccacttcaacaagagaggagccatcgagggcgccaagattgagcagtacctgctggagaagagccgggtgtgccggcaggccctggatgaaagaaactaccacgtgttctactgcatgctggagggcatgtctgaggaccagaagaagaagctgggcctgggccaggccagtgactacaactacctggccatgggcaactgcatcacctgtgagggccgggtggacagccaggagtatgccaacatccgcagcgccatgaaggtgctgatgttcacagacacagagaactgggagatcagcaagctgctggccgccatcctgcacctgggcaacctgcagtatgaggcccggacctttgagaacctggatgcctgtgaggtgctcttcagccccagcctggccacagctgccagcctgctggaggtgaaccccccagacctgatgagctgcctgaccagcaggaccctcatcaccagaggagagaccgtgtccacccccctgagccgggagcaggccctggatgtgagagatgcctttgtgaagggcatctacggccgcctgtttgtgtggatcgtggacaagatcaatgctgccatctacaagccacccagccaggatgtgaagaacagcagaagaagcatcggcctgctggacatcttcggctttgaaaattttgctgtgaacagctttgagcagctgtgcatcaactttgccaatgagcacctgcagcagttctttgtgagacatgtgttcaagctggagcaggaggagtatgacctggagagcattgactggctgcacatcgagttcacagacaaccaggatgccctggacatgattgccaacaagcccatgaacatcatcagcctgattgatgaggagagcaagttccccaagggcacagacaccaccatgctgcacaagctgaacagccagcacaagctgaatgccaactacatcccccccaagaacaaccacgagacccagtttggcatcaaccactttgctggcatcgtgtactatgagacccagggcttcctggagaagaacagagacaccctgcatggagacatcatccagctggtgcacagcagcaggaacaagttcatcaagcagatcttccaggctgatgtggccatgggcgctgagaccaggaagaggagccccaccctgagcagccagttcaagaggagcctggagctgctgatgaggaccctgggcgcctgccagcccttctttgtgcgctgcatcaagcccaatgagttcaagaagcccatgctgtttgacagacacctgtgtgtgcggcagctgcgctacagcggcatgatggagaccatccgcatcagaagagctggctaccccatccgctacagctttgtggagtttgtggagcgctacagagtgctgctgcccggggtgaagccagcctacaagcagggcgacctgcggggcacctgccagaggatggccgaggccgtgctgggcacccatgatgactggcagatcggcaagaccaagatcttcctgaaggaccaccacgacatgctgctggaggtggagcgggacaaggccatcacagacagagtcatcctgctgcagaaggtgatccggggcttcaaggacaggagcaacttcctgaagctgaagaatgctgccaccctcatccagaggcactggaggggccacaactgcaggaagaactacggcctgatgaggctgggcttcctgcggctgcaggccctgcacaggagcaggaagctgcaccagcagtaccgcctggcccggcagaggatcatccagttccaggcccgctgccgggcctacctggtgaggaaggccttccgccaccggctgtgggccgtgctgactgtgcaggcctatgcccggggcatgattgcccggcggctgcaccagaggctgcgggcagagtacctgtggaggctggaggccgagaagatgaggctggccgaggaggagaagctgaggaaggagatgtctgccaagaaggccaaggaggaggccgagaggaagcaccaggagcggctggcccagctggcccgggaggatgctgagcgggagctgaaggagaaggaggccgcccggaggaagaaggagctgctggagcagatggagcgggcccggcatgagcctgtgaaccacagcgacatggtggacaagatgtttggcttcctgggcaccagcggcggcctgcccggccaggagggccaggcccccagcggctttgaggacctggagcggggcagaagagagatggtggaggaggacctggatgctgccctgcccctgcctgatgaagatgaggaggacctgtctgagtacaagtttgccaagtttgctgccacctacttccagggcaccaccacccacagctacacccggcggcccctgaagcagcccctgctgtaccatgatgatgaaggagaccagctggccgccctggccgtgtggatcaccatcctgcgcttcatgggagacctgcctgagcccaagtaccacacagccatgtctgatggcagcgagaagatccctgtgatgaccaagatctatgagaccctgggcaagaagacctacaagcgggagctgcaggccctgcagggcgagggggaggcccagctgcctgagggccagaagaagagctctgtgcgccacaagctggtgcacctgaccctgaagaagaagagcaagctgacagaggaggtgaccaagaggctgcatgatggagagagcacagtgcagggcaacagcatgctggaggaccggcccaccagcaacctggagaagctgcacttcatcattggaaatggcatcctgcggcctgccctgagagatgagatctactgccagatcagcaagcagctgacccacaaccccagcaagagcagctatgcccggggctggatcctggtgtccctgtgtgtgggctgctttgcccccagcgagaagtttgtgaagtacctgaggaacttcatccacggcggccccccaggctacgccccctactgtgaggagcggctgcggaggacctttgtgaatggcaccaggacccagccccccagctggctggagctgcaggccaccaagagcaagaagcccatcatgctgcctgtgaccttcatggatggcaccaccaagaccctgctgacagattctgccaccacagccaaggagctgtgcaatgccctggccgacaagatcagcctgaaggaccgcttcggcttcagcctgtacatcgccctgtttgacaaggtgagcagcctgggcagcggcagtgaccacgtgatggatgccatcagccagtgtgagcagtatgccaaggagcagggcgcccaggagagaaatgccccctggaggctcttcttcaggaaggaggtgttcaccccctggcacagccccagcgaggacaacgtggccaccaacctgatctaccagcaggtggtgcggggcgtgaagtttggagagtaccgctgtgagaaggaggatgacctggccgagctggccagccagcagtactttgtggactatggcagcgagatgatcctggagcggctgctgaacctggtgcccacctacatcccagaccgggagatcacccccctgaagaccctggagaagtgggcccagctggccatcgccgcccacaagaagggcatctatgcccagaggagaacagatgcccagaaggtgaaggaggatgtggtgtcctatgcccgcttcaagtggcccctgctcttcagccgcttctatgaggcctacaagttcagcggccccagcctgcccaagaatgatgtgattgtggccgtgaactggacaggagtgtactttgtggatgagcaggagcaggtgctgctggagctgtccttccctgagatcatggctgtgagcagcagcagagaatgtcgggtgtggctgagcctgggctgcagcgacctgggctgtgccgccccccacagcggctgggccggcctgaccccagctggcccctgcagcccctgctggagctgccgcggggccaagaccacagcccccagcttcaccctggccaccatcaagggagatgagtacaccttcaccagcagcaatgctgaggacatccgggacctggtggtgaccttcctggagggcctgaggaagaggagcaaatatgtggtggccctgcaggacaaccccaacccagctggggaggagagcggcttcctgagctttgccaagggggacctgatcatcctggaccatgacaccggggagcaggtgatgaacagcggctgggccaacggcatcaatgaaagaaccaagcagagaggagacttccccacagattctgtgtatgtgatgcccaccgtgaccatgccaccccgggagatcgtggccctggtgaccatgaccccagaccagaggcaggatgtggtgcggctgctgcagctgaggacagctgagcctgaggtgcgggccaagccctacaccctggaggagttctcctatgactacttccggcccccacccaagcacaccctgagccgggtgatggtgtccaaggcccggggcaaggaccggctgtggagccacacccgggagcccctgaagcaggccctgctgaagaagctgctgggcagcgaggagctgagccaggaggcctgcctggccttcatcgctgtgctgaagtacatgggagactaccccagcaagaggaccaggtctgtgaatgagctgacagaccagatctttgagggccccctgaaggccgagcccctgaaggatgaggcctacgtgcagatcctgaagcagctgacagacaaccacatccgctacagcgaggagcggggctgggagctgctgtggctgtgcaccggcctcttcccccccagcaacatcctgctgccccacgtgcagcgcttcctgcagagcaggaagcactgccccctggccatcgactgcctgcagaggctgcagaaggccctgagaaatggcagcaggaagtacccaccccacctggtggaggtggaggccatccagcacaagaccacccagatcttccacaaggtgtacttcccagatgacacagatgaggcctttgaggtggagagcagcaccaaggccaaggacttctgccagaacatcgccacccggctgctgctgaagagcagcgagggcttcagcctgtttgtgaagattgctgacaaggtgctgtctgtgcctgaaaatgacttcttctttgattttgtgcgccacctgacagactggatcaagaaggcccggcccatcaaggatggcatcgtgcccagcctgacctaccaggtgttcttcatgaagaagctgtggaccaccaccgtgcctgggaaggaccccatggctgacagcatcttccactactaccaggagctgcccaagtacctgcggggctaccacaagtgcacccgggaggaggtgctgcagctgggcgccctgatctacagagtgaagtttgaggaggacaagagctacttccccagcatccccaagctgctgcgggagctggtgccccaggacctgatccggcaggtgtccccagatgactggaagaggagcatcgtggcctacttcaacaagcacgccggcaagagcaaggaggaggccaagctggccttcctgaagctgatcttcaagtggcccacctttggaagtgccttctttgaggtgaagcagaccacagagcccaacttccctgagatcctgctgattgccatcaacaagtatggagtgtccctgattgaccccaagaccaaggacatcctgaccacccaccccttcaccaagatcagcaactggagcagcggcaacacctacttccacatcaccatcggcaacctggtgcggggcagcaagctgctgtgtgagaccagcctgggctacaagatggatgacctgctgaccagctacatcagccagatgctgacagccatgagcaagcagaggggcagccgcagcggcaagtag

SEQ ID NO: 160855 - DNA, 6648 bp, Artificial Sequence
  Description of Artificial Sequence: Synthetic coding sequence
atggtgatcctgcagcagggcgaccacgtgtggatggacctgcggctgggccaggagtttgatgtgcccatcggggctgtggtgaagctgtgtgacagcggccaggtgcaggtggtggatgatgaggacaatgagcactggatcagcccccagaatgccacccacatcaagcccatgcaccccacctctgtgcatggagtggaggacatgatccggctgggggacctgaatgaagctggcatcctgaggaacctgctgatccgctacagagaccacctgatctacacctacacaggcagcatcctggtggccgtgaacccctaccagctgctgagcatctacagccctgagcacatccggcagtacaccaacaagaagattggagagatgccaccccacatctttgccatcgctgacaactgctacttcaacatgaagaggaacagccgggaccagtgctgcatcatctctggagagagcggggccggcaagacagagagcaccaagctgatcctgcagttcctggccgccatcagcggccagcacagctggattgagcagcaggtgctggaggccacccccatcctggaggcctttggaaatgccaagaccatcagaaatgacaacagcagcagatttgggaagtacatcgacatccacttcaacaagagaggagccattgaaggagccaagattgagcagtacctgctggagaagagccgggtgtgccggcaggccctggatgagaggaactaccacgtgttctactgcatgctggagggcatgtctgaggaccagaagaagaagctgggcctgggccaggccagtgactacaactacctggccatgggcaactgcatcacctgtgagggccgggtggacagccaggagtatgccaacatccgcagcgccatgaaggtgctgatgttcacagacacagagaactgggagatcagcaagctgctggccgccatcctgcacctgggcaacctgcagtatgaggcccggacctttgagaacctggatgcctgtgaggtgctcttcagccccagcctggccacagctgccagcctgctggaggtgaaccccccagacctgatgagctgcctgaccagcaggaccctcatcaccagaggagaaacagtgtccacccccctgagccgggagcaggccctggatgtgagagatgcctttgtgaagggcatctacggccgcctgtttgtgtggatcgtggacaagatcaatgctgccatctacaagccacccagccaggatgtgaagaacagccgccgcagcatcggcctgctggacatctttggatttgagaactttgctgtgaacagctttgagcagctgtgcatcaactttgccaatgagcacctgcagcagttctttgtgcgccacgtgttcaagctggagcaggaggagtatgacctggagagcattgactggctgcacatcgagttcacagacaaccaggatgccctggacatgattgccaacaagcccatgaacatcatcagcctgattgatgaggagagcaagttccccaagggcacagacaccaccatgctgcacaagctgaacagccagcacaagctgaatgccaactacatcccccccaagaacaaccacgagacccagtttggcatcaaccactttgctggcatcgtgtactatgagacccagggcttcctggagaagaacagagacaccctgcacggggacatcatccagctggtgcacagcagcaggaacaagttcatcaagcagatcttccaggctgatgtggccatgggcgctgagaccaggaagaggagccccaccctgagcagccagttcaagaggagcctggagctgctgatgaggaccctgggcgcctgccagcccttctttgtgcgctgcatcaagcccaatgagttcaagaagcccatgctgtttgacagacacctgtgtgtgcggcagctgcgctacagcggcatgatggagaccatccgcatccggcgggccggctaccccatccgctacagctttgtggagtttgtggagcgctacagagtgctgctgcccggggtgaagccagcctacaagcagggcgacctgcggggcacctgccagaggatggccgaggccgtgctgggcacccatgatgactggcagatcggcaagaccaagatcttcctgaaggaccaccacgacatgctgctggaggtggagcgggacaaggccatcacagacagagtcatcctgctgcagaaggtgatccggggcttcaaggacaggagcaacttcctgaagctgaagaatgctgccaccctcatccagaggcactggaggggccacaactgcaggaagaactacggcctgatgaggctgggcttcctgcggctgcaggccctgcacaggagcaggaagctgcaccagcagtaccgcctggcccggcagaggatcatccagttccaggcccgctgccgggcctacctggtgaggaaggccttccgccaccggctgtgggccgtgctgactgtgcaggcctatgcccggggcatgattgcccggcggctgcaccagaggctgcgggcagagtacctgtggaggctggaggccgagaagatgaggctggccgaggaggagaagctgaggaaggagatgtctgccaagaaggccaaggaggaggccgagaggaagcaccaggagcggctggcccagctggccagagaagatgctgagcgggagctgaaggagaaggaggccgcccggaggaagaaggagctgctggagcagatggagcgggcccggcatgagcctgtgaaccacagcgacatggtggacaagatgtttggcttcctgggcaccagcggcggcctgcccggccaggagggccaggcccccagcggctttgaggacctggagcggggccggcgggagatggtggaggaggacctggatgctgccctgcccctgcctgatgaagatgaggaggacctgtctgagtacaagtttgccaagtttgctgccacctacttccagggcaccaccacccacagctacacccggcggcccctgaagcagcccctgctgtaccatgatgatgaaggagaccagctggccgccctggccgtgtggatcaccatcctgcgcttcatgggagacctgcctgagcccaagtaccacacagccatgtctgatggcagcgagaagatccctgtgatgaccaagatctatgagaccctgggcaagaagacctacaagcgggagctgcaggccctgcagggcgagggggaggcccagctgcctgagggccagaagaagagctctgtgcgccacaagctggtgcacctgaccctgaagaagaagagcaagctgacagaggaggtgaccaagaggctgcatgatggagagagcacagtgcagggcaacagcatgctggaggaccggcccaccagcaacctggagaagctgcacttcatcattggaaatggcatcctgcggcctgccctgagagatgagatctactgccagatcagcaagcagctgacccacaaccccagcaagagcagctatgcccggggctggatcctggtgtccctgtgtgtgggctgctttgcccccagcgagaagtttgtgaagtacctgaggaacttcatccatggaggccccccaggctacgccccctactgtgaggagcggctgcggaggacctttgtgaatggcaccaggacccagcccccatcctggctggagctgcaggccaccaagagcaagaagcccatcatgctgcctgtgaccttcatggatggcaccaccaagaccctgctgacagacagcgccaccacagccaaggagctgtgcaatgccctggccgacaagatcagcctgaaggacagatttggcttcagcctgtacatcgccctgtttgacaaggtgagcagcctgggcagcggcagtgaccacgtgatggatgccatcagccagtgtgagcagtatgccaaggagcagggcgcccaggagagaaatgccccctggaggctcttcttcaggaaggaggtgttcaccccctggcacagccccagtgaagataatgtggccaccaacctgatctaccagcaggtggtgcggggcgtgaagtttggagagtaccgctgtgagaaggaggatgacctggccgagctggccagccagcagtactttgtggactatggcagcgagatgatcctggagcggctgctgaacctggtgcccacctacatcccagaccgggagatcacccccctgaagaccctggagaagtgggcccagctggccatcgccgcccacaagaagggcatctatgcccagaggagaacagatgcccagaaggtgaaggaggatgtggtgtcctatgcccgcttcaagtggcccctgctcttcagccgcttctatgaggcctacaagttcagcggccccagcctgcccaagaatgatgtgattgtggccgtgaactggacaggagtgtactttgtggatgagcaggagcaggtgctgctggagctgtccttccctgagatcatggctgtgagcagcagccgggagtgccgggtgtggctgagcctgggctgcagcgacctgggctgtgccgccccccacagcggctgggccggcctgaccccagctggcccctgcagcccctgctggagctgccgcggggccaagaccacagcccccagcttcaccctggccaccatcaagggagatgagtacaccttcaccagcagcaatgctgaggacatccgggacctggtggtgaccttcctggagggcctgaggaagaggagcaaatatgtggtggccctgcaggacaaccccaacccagctggggaggagagcggcttcctgagctttgccaagggggacctgatcatcctggaccatgacacaggagagcaggtgatgaacagcggctgggccaacggcatcaatgaaagaaccaagcagagaggagacttccccacagacagcgtgtatgtgatgcccaccgtgaccatgccaccccgggagatcgtggccctggtgaccatgaccccagaccagaggcaggatgtggtgcggctgctgcagctgaggacagctgagcctgaggtgcgggccaagccctacaccctggaggagttctcctatgactacttccggcccccacccaagcacaccctgagccgggtgatggtgtccaaggcccggggcaaggaccggctgtggagccacacccgggagcccctgaagcaggccctgctgaagaagctgctgggcagcgaggagctgagccaggaggcctgcctggccttcatcgctgtgctgaagtacatgggagactaccccagcaagaggaccaggtctgtgaatgagctgacagaccagatctttgagggccccctgaaggccgagcccctgaaggatgaggcctacgtgcagatcctgaagcagctgacagacaaccacatccgctacagcgaggagcggggctgggagctgctgtggctgtgcaccggcctcttcccccccagcaacatcctgctgccccacgtgcagcgcttcctgcagagcaggaagcactgccccctggccatcgactgcctgcagaggctgcagaaggccctgagaaatggcagcaggaagtacccaccccacctggtggaggtggaggccatccagcacaagaccacccagatcttccacaaggtgtacttcccagatgacacagatgaggcctttgaggtggagagcagcaccaaggccaaggacttctgccagaacatcgccacccggctgctgctgaagagcagcgagggcttcagcctgtttgtgaagattgctgacaaggtgctgtctgtgcctgaaaatgacttcttctttgattttgtgcgccacctgacagactggatcaagaaggcccggcccatcaaggatggcatcgtgcccagcctgacctaccaggtgttcttcatgaagaagctgtggaccaccaccgtgcctgggaaggaccccatggctgacagcatcttccactactaccaggagctgcccaagtacctgcggggctaccacaagtgcacccgggaggaggtgctgcagctgggcgccctgatctacagagtgaagtttgaggaggacaagagctacttccccagcatccccaagctgctgcgggagctggtgccccaggacctgatccggcaggtgtccccagatgactggaagaggagcatcgtggcctacttcaacaagcatgctgggaagagcaaggaggaggccaagctggccttcctgaagctgatcttcaagtggcccaccttcggcagcgccttctttgaggtgaagcagaccacagagcccaacttccctgagatcctgctgattgccatcaacaagtatggagtgtccctgattgaccccaagaccaaggacatcctgaccacccaccccttcaccaagatcagcaactggagcagcggcaacacctacttccacatcaccatcggcaacctggtgcggggcagcaagctgctgtgtgagaccagcctgggctacaagatggatgacctgctgaccagctacatcagccagatgctgacagccatgagcaagcagaggggcagccgcagcggcaagtag

SEQ ID NO: 160856 - DNA, 3537 bp, Artificial Sequence
  Description of Artificial Sequence: Synthetic coding sequence
atggtgatcctgcagcagggcgaccacgtgtggatggacctgcggctgggccaggagtttgatgtgcccatcggggctgtggtgaagctgtgtgacagcggccaggtgcaggtggtggatgatgaggacaatgagcactggatcagcccccagaatgccacccacatcaagcccatgcaccccacctctgtgcatggagtggaggacatgatccggctgggggacctgaatgaagctggcatcctgaggaacctgctgatccgctacagagaccacctgatctacacctacacaggcagcatcctggtggccgtgaacccctaccagctgctgagcatctacagccctgagcacatccggcagtacaccaacaagaagattggagagatgccaccccacatctttgccatcgctgacaactgctacttcaacatgaagaggaacagccgggaccagtgctgcatcatctctggagagagcggggccggcaagacagagagcaccaagctgatcctgcagttcctggccgccatcagcggccagcacagctggattgagcagcaggtgctggaggccacccccatcctggaggcctttggaaatgccaagaccatcagaaatgacaacagcagcagatttgggaagtacatcgacatccacttcaacaagagaggagccattgaaggagccaagattgagcagtacctgctggagaagagccgggtgtgccggcaggccctggatgagaggaactaccacgtgttctactgcatgctggagggcatgtctgaggaccagaagaagaagctgggcctgggccaggccagtgactacaactacctggccatgggcaactgcatcacctgtgagggccgggtggacagccaggagtatgccaacatccgcagcgccatgaaggtgctgatgttcacagacacagagaactgggagatcagcaagctgctggccgccatcctgcacctgggcaacctgcagtatgaggcccggacctttgagaacctggatgcctgtgaggtgctcttcagccccagcctggccacagctgccagcctgctggaggtgaaccccccagacctgatgagctgcctgaccagcaggaccctcatcaccagaggagaaacagtgtccacccccctgagccgggagcaggccctggatgtgagagatgcctttgtgaagggcatctacggccgcctgtttgtgtggatcgtggacaagatcaatgctgccatctacaagccacccagccaggatgtgaagaacagccgccgcagcatcggcctgctggacatctttggatttgagaactttgctgtgaacagctttgagcagctgtgcatcaactttgccaatgagcacctgcagcagttctttgtgcgccacgtgttcaagctggagcaggaggagtatgacctggagagcattgactggctgcacatcgagttcacagacaaccaggatgccctggacatgattgccaacaagcccatgaacatcatcagcctgattgatgaggagagcaagttccccaagggcacagacaccaccatgctgcacaagctgaacagccagcacaagctgaatgccaactacatcccccccaagaacaaccacgagacccagtttggcatcaaccactttgctggcatcgtgtactatgagacccagggcttcctggagaagaacagagacaccctgcacggggacatcatccagctggtgcacagcagcaggaacaagttcatcaagcagatcttccaggctgatgtggccatgggcgctgagaccaggaagaggagccccaccctgagcagccagttcaagaggagcctggagctgctgatgaggaccctgggcgcctgccagcccttctttgtgcgctgcatcaagcccaatgagttcaagaagcccatgctgtttgacagacacctgtgtgtgcggcagctgcgctacagcggcatgatggagaccatccgcatccggcgggccggctaccccatccgctacagctttgtggagtttgtggagcgctacagagtgctgctgcccggggtgaagccagcctacaagcagggcgacctgcggggcacctgccagaggatggccgaggccgtgctgggcacccatgatgactggcagatcggcaagaccaagatcttcctgaaggaccaccacgacatgctgctggaggtggagcgggacaaggccatcacagacagagtcatcctgctgcagaaggtgatccggggcttcaaggacaggagcaacttcctgaagctgaagaatgctgccaccctcatccagaggcactggaggggccacaactgcaggaagaactacggcctgatgaggctgggcttcctgcggctgcaggccctgcacaggagcaggaagctgcaccagcagtaccgcctggcccggcagaggatcatccagttccaggcccgctgccgggcctacctggtgaggaaggccttccgccaccggctgtgggccgtgctgactgtgcaggcctatgcccggggcatgattgcccggcggctgcaccagaggctgcgggcagagtacctgtggaggctggaggccgagaagatgaggctggccgaggaggagaagctgaggaaggagatgtctgccaagaaggccaaggaggaggccgagaggaagcaccaggagcggctggcccagctggccagagaagatgctgagcgggagctgaaggagaaggaggccgcccggaggaagaaggagctgctggagcagatggagcgggcccggcatgagcctgtgaaccacagcgacatggtggacaagatgtttggcttcctgggcaccagcggcggcctgcccggccaggagggccaggcccccagcggctttgaggacctggagcggggccggcgggagatggtggaggaggacctggatgctgccctgcccctgcctgatgaagatgaggaggacctgtctgagtacaagtttgccaagtttgctgccacctacttccagggcaccaccacccacagctacacccggcggcccctgaagcagcccctgctgtaccatgatgatgaaggagaccagctggccgccctggccgtgtggatcaccatcctgcgcttcatgggagacctgcctgagcccaagtaccacacagccatgtctgatggcagcgagaagatccctgtgatgaccaagatctatgagaccctgggcaagaagacctacaagcgggagctgcaggccctgcagggcgagggggaggcccagctgcctgagggccagaagaagagctctgtgcgccacaagctggtgcacctgaccctgaagaagaagagcaagctgacagaggaggtgaccaagaggctgcatgatggagagagcacagtgcagggcaacagcatgctggaggaccggcccaccagcaacctggagaagctgcacttcatcattggaaatggcatcctgcggcctgccctgcggtctgtgcctgggggcggggacacccgggcctag

SEQ ID NO: 160857 - DNA, 6528 bp, Artificial Sequence
  Description of Artificial Sequence: Synthetic coding sequence
atggtgatcctgcagcagggcgaccacgtgtggatggacctgcggctgggccaggagtttgatgtgcccatcggggctgtggtgaagctgtgtgacagcggccaggtgcaggtggtggatgatgaggacaatgagcactggatcagcccccagaatgccacccacatcaagcccatgcaccccacctctgtgcatggagtggaggacatgatccggctgggggacctgaatgaagctggcatcctgaggaacctgctgatccgctacagagaccacctgatctacacctacacaggcagcatcctggtggccgtgaacccctaccagctgctgagcatctacagccctgagcacatccggcagtacaccaacaagaagattggagagatgccaccccacatctttgccatcgctgacaactgctacttcaacatgaagaggaacagccgggaccagtgctgcatcatctctggagagagcggggccggcaagacagagagcaccaagctgatcctgcagttcctggccgccatcagcggccagcacagctggattgagcagcaggtgctggaggccacccccatcctggaggcctttggaaatgccaagaccatcagaaatgacaacagcagcagatttgggaagtacatcgacatccacttcaacaagagaggagccattgaaggagccaagattgagcagtacctgctggagaagagccgggtgtgccggcaggccctggatgagaggaactaccacgtgttctactgcatgctggagggcatgtctgaggaccagaagaagaagctgggcctgggccaggccagtgactacaactacctggccatgggcaactgcatcacctgtgagggccgggtggacagccaggagtatgccaacatccgcagcgccatgaaggtgctgatgttcacagacacagagaactgggagatcagcaagctgctggccgccatcctgcacctgggcaacctgcagtatgaggcccggacctttgagaacctggatgcctgtgaggtgctcttcagccccagcctggccacagctgccagcctgctggaggtgaaccccccagacctgatgagctgcctgaccagcaggaccctcatcaccagaggagaaacagtgtccacccccctgagccgggagcaggccctggatgtgagagatgcctttgtgaagggcatctacggccgcctgtttgtgtggatcgtggacaagatcaatgctgccatctacaagccacccagccaggatgtgaagaacagccgccgcagcatcggcctgctggacatctttggatttgagaactttgctgtgaacagctttgagcagctgtgcatcaactttgccaatgagcacctgcagcagttctttgtgcgccacgtgttcaagctggagcaggaggagtatgacctggagagcattgactggctgcacatcgagttcacagacaaccaggatgccctggacatgattgccaacaagcccatgaacatcatcagcctgattgatgaggagagcaagttccccaagggcacagacaccaccatgctgcacaagctgaacagccagcacaagctgaatgccaactacatcccccccaagaacaaccacgagacccagtttggcatcaaccactttgctggcatcgtgtactatgagacccagggcttcctggagaagaacagagacaccctgcacggggacatcatccagctggtgcacagcagcaggaacaagttcatcaagcagatcttccaggctgatgtggccatgggcgctgagaccaggaagaggagccccaccctgagcagccagttcaagaggagcctggagctgctgatgaggaccctgggcgcctgccagcccttctttgtgcgctgcatcaagcccaatgagttcaagaagcccatgctgtttgacagacacctgtgtgtgcggcagctgcgctacagcggcatgatggagaccatccgcatccggcgggccggctaccccatccgctacagctttgtggagtttgtggagcgctacagagtgctgctgcccggggtgaagccagcctacaagcagggcgacctgcggggcacctgccagaggatggccgaggccgtgctgggcacccatgatgactggcagatcggcaagaccaagatcttcctgaaggaccaccacgacatgctgctggaggtggagcgggacaaggccatcacagacagagtcatcctgctgcagaaggtgatccggggcttcaaggacaggagcaacttcctgaagctgaagaatgctgccaccctcatccagaggcactggaggggccacaactgcaggaagaactacggcctgatgaggctgggcttcctgcggctgcaggccctgcacaggagcaggaagctgcaccagcagtaccgcctggcccggcagaggatcatccagttccaggcccgctgccgggcctacctggtgaggaaggccttccgccaccggctgtgggccgtgctgactgtgcaggcctatgcccggggcatgattgcccggcggctgcaccagaggctgcgggcagagtacctgtggaggctggaggccgagaagatgaggctggccgaggaggagaagctgaggaaggagatgtctgccaagaaggccaaggaggaggccgagaggaagcaccaggagcggctggcccagctggccagagaagatgctgagcgggagctgaaggagaaggaggccgcccggaggaagaaggagctgctggagcagatggagcgggcccggcatgagcctgtgaaccacagcgacatggtggacaagatgtttggcttcctgggcaccagcggcggcctgcccggccaggagggccaggcccccagcggctttgaggacctggagcggggccggcgggagatggtggaggaggacctggatgctgccctgcccctgcctgatgaagatgaggaggacctgtctgagtacaagtttgccaagtttgctgccacctacttccagggcaccaccacccacagctacacccggcggcccctgaagcagcccctgctgtaccatgatgatgaaggagaccagctggccgccctggccgtgtggatcaccatcctgcgcttcatgggagacctgcctgagcccaagtaccacacagccatgtctgatggcagcgagaagatccctgtgatgaccaagatctatgagaccctgggcaagaagacctacaagcgggagctgcaggccctgcagggcgagggggaggcccagctgcctgagggccagaagaagagctctgtgcgccacaagctggtgcacctgaccctgaagaagaagagcaagctgacagaggaggtgaccaagaggctgcatgatggagagagcacagtgcagggcaacagcatgctggaggaccggcccaccagcaacctggagaagctgcacttcatcattggaaatggcatcctgcggcctgccctgagagatgagatctactgccagatcagcaagcagctgacccacaaccccagcaagagcagctatgcccggggctggatcctggtgtccctgtgtgtgggctgctttgcccccagcgagaagtttgtgaagtacctgaggaacttcatccatggaggccccccaggctacgccccctactgtgaggagcggctgcggaggacctttgtgaatggcaccaggacccagcccccatcctggctggagctgcaggccaccaagagcaagaagcccatcatgctgcctgtgaccttcatggatggcaccaccaagaccctgctgacagacagcgccaccacagccaaggagctgtgcaatgccctggccgacaagatcagcctgaaggacagatttggcttcagcctgtacatcgccctgtttgacaaggtgagcagcctgggcagcggcagtgaccacgtgatggatgccatcagccagtgtgagcagtatgccaaggagcagggcgcccaggagagaaatgccccctggaggctcttcttcaggaaggaggtgttcaccccctggcacagccccagtgaagataatgtggccaccaacctgatctaccagcaggtggtgcggggcgtgaagtttggagagtaccgctgtgagaaggaggatgacctggccgagctggccagccagcagtactttgtggactatggcagcgagatgatcctggagcggctgctgaacctggtgcccacctacatcccagaccgggagatcacccccctgaagaccctggagaagtgggcccagctggccatcgccgcccacaagaagggcatctatgcccagaggagaacagatgcccagaaggtgaaggaggatgtggtgtcctatgcccgcttcaagtggcccctgctcttcagccgcttctatgaggcctacaagttcagcggccccagcctgcccaagaatgatgtgattgtggccgtgaactggacaggagtgtactttgtggatgagcaggagcaggtgctgctggagctgtccttccctgagatcatggctgtgagcagcagcagaggagccaagaccacagcccccagcttcaccctggccaccatcaagggagatgagtacaccttcaccagcagcaatgctgaggacatccgggacctggtggtgaccttcctggagggcctgaggaagaggagcaaatatgtggtggccctgcaggacaaccccaacccagctggggaggagagcggcttcctgagctttgccaagggggacctgatcatcctggaccatgacacaggagagcaggtgatgaacagcggctgggccaacggcatcaatgaaagaaccaagcagagaggagacttccccacagacagcgtgtatgtgatgcccaccgtgaccatgccaccccgggagatcgtggccctggtgaccatgaccccagaccagaggcaggatgtggtgcggctgctgcagctgaggacagctgagcctgaggtgcgggccaagccctacaccctggaggagttctcctatgactacttccggcccccacccaagcacaccctgagccgggtgatggtgtccaaggcccggggcaaggaccggctgtggagccacacccgggagcccctgaagcaggccctgctgaagaagctgctgggcagcgaggagctgagccaggaggcctgcctggccttcatcgctgtgctgaagtacatgggagactaccccagcaagaggaccaggtctgtgaatgagctgacagaccagatctttgagggccccctgaaggccgagcccctgaaggatgaggcctacgtgcagatcctgaagcagctgacagacaaccacatccgctacagcgaggagcggggctgggagctgctgtggctgtgcaccggcctcttcccccccagcaacatcctgctgccccacgtgcagcgcttcctgcagagcaggaagcactgccccctggccatcgactgcctgcagaggctgcagaaggccctgagaaatggcagcaggaagtacccaccccacctggtggaggtggaggccatccagcacaagaccacccagatcttccacaaggtgtacttcccagatgacacagatgaggcctttgaggtggagagcagcaccaaggccaaggacttctgccagaacatcgccacccggctgctgctgaagagcagcgagggcttcagcctgtttgtgaagattgctgacaaggtgctgtctgtgcctgaaaatgacttcttctttgattttgtgcgccacctgacagactggatcaagaaggcccggcccatcaaggatggcatcgtgcccagcctgacctaccaggtgttcttcatgaagaagctgtggaccaccaccgtgcctgggaaggaccccatggctgacagcatcttccactactaccaggagctgcccaagtacctgcggggctaccacaagtgcacccgggaggaggtgctgcagctgggcgccctgatctacagagtgaagtttgaggaggacaagagctacttccccagcatccccaagctgctgcgggagctggtgccccaggacctgatccggcaggtgtccccagatgactggaagaggagcatcgtggcctacttcaacaagcatgctgggaagagcaaggaggaggccaagctggccttcctgaagctgatcttcaagtggcccaccttcggcagcgccttctttgagcagaccacagagcccaacttccctgagatcctgctgattgccatcaacaagtatggagtgtccctgattgaccccaagaccaaggacatcctgaccacccaccccttcaccaagatcagcaactggagcagcggcaacacctacttccacatcaccatcggcaacctggtgcggggcagcaagctgctgtgtgagaccagcctgggctacaagatggatgacctgctgaccagctacatcagccagatgctgacagccatgagcaagcagaggggcagccgcagcggcaagtag

SEQ ID NO: 160858 - DNA, 2532 bp, Artificial Sequence
  Description of Artificial Sequence: Synthetic coding sequence
ggcctgtctgtgcagtggctgctggatggcctggcctgcttctttgccagcctgcacgtgcccctgggccgggtgcagctgcacgccagcgcccggggcatccaggagaaggaggatgacctggccgagctggccagccagcagtactttgtggactatggcagcgagatgatcctggagcggctgctgaacctggtgcccacctacatcccagaccgggagatcacccccctgaagaccctggagaagtgggcccagctggccatcgccgcccacaagaagggcatctatgcccagaggagaacagatgcccagaaggtgaaggaggatgtggtgtcctatgcccgcttcaagtggcccctgctcttcagccgcttctatgaggcctacaagttcagcggccccagcctgcccaagaatgatgtgattgtggccgtgaactggacaggagtgtactttgtggatgagcaggagcaggtgctgctggagctgtccttccctgagatcatggctgtgagcagcagcagaggagccaagaccacagcccccagcttcaccctggccaccatcaagggagatgagtacaccttcaccagcagcaatgctgaggacatccgggacctggtggtgaccttcctggagggcctgaggaagaggagcaaatatgtggtggccctgcaggacaaccccaacccagctggggaggagagcggcttcctgagctttgccaagggggacctgatcatcctggaccatgacaccggggagcaggtgatgaacagcggctgggccaacggcatcaatgaaagaaccaagcagagaggagacttccccacagattctgtgtatgtgatgcccaccgtgaccatgccaccccgggagatcgtggccctggtgaccatgaccccagaccagaggcaggatgtggtgcggctgctgcagctgaggacagctgagcctgaggtgcgggccaagccctacaccctggaggagttctcctatgactacttccggcccccacccaagcacaccctgagccgggtgatggtgtccaaggcccggggcaaggaccggctgtggagccacacccgggagcccctgaagcaggccctgctgaagaagctgctgggcagcgaggagctgagccaggaggcctgcctggccttcatcgctgtgctgaagtacatgggagactaccccagcaagaggaccaggtctgtgaatgagctgacagaccagatctttgagggccccctgaaggccgagcccctgaaggatgaggcctacgtgcagatcctgaagcagctgacagacaaccacatccgctacagcgaggagcggggctgggagctgctgtggctgtgcaccggcctcttcccccccagcaacatcctgctgccccacgtgcagcgcttcctgcagagcaggaagcactgccccctggccatcgactgcctgcagaggctgcagaaggccctgagaaatggcagcaggaagtacccaccccacctggtggaggtggaggccatccagcacaagaccacccagatcttccacaaggtgtacttcccagatgacacagatgaggcctttgaggtggagagcagcaccaaggccaaggacttctgccagaacatcgccacccggctgctgctgaagagcagcgagggcttcagcctgtttgtgaagattgctgacaaggtgctgtctgtgcctgaaaatgacttcttctttgattttgtgcgccacctgacagactggatcaagaaggcccggcccatcaaggatggcatcgtgcccagcctgacctaccaggtgttcttcatgaagaagctgtggaccaccaccgtgcctgggaaggaccccatggctgacagcatcttccactactaccaggagctgcccaagtacctgcggggctaccacaagtgcacccgggaggaggtgctgcagctgggcgccctgatctacagagtgaagtttgaggaggacaagagctacttccccagcatccccaagctgctgcgggagctggtgccccaggacctgatccggcaggtgtccccagatgactggaagaggagcatcgtggcctacttcaacaagcacgccggcaagagcaaggaggaggccaagctggccttcctgaagctgatcttcaagtggcccacctttggaagtgccttctttgaggtgaaggtgcaccacggcctgctgcgggcagaggaggagggcaacagagccctgatcaagcaccgggacagcagcctgggcctgtgggagcgggccatggccctggacacctgccctggagagggccggcgggccgcccccagcgccctgagccagctgtctgtgctggccggcgtgtcccctggggaccggggcacccggcgcagcagcgcctggcagtggaggcagacctgcaagcaggccggcgtgatggaggatggcctgtgcagcgacacaggagagcccagcccccgctggcagagcagcggcggcagcgctggctgtgagaaggccagctag

SEQ ID NO: 160859 - DNA, 4167 bp, Artificial Sequence
  Description of Artificial Sequence: Synthetic coding sequence
atgaggctgggcttcctgcggctgcaggccctgcacaggagcaggaagctgcaccagcagtaccgcctggcccggcagaggatcatccagttccaggcccgctgccgggcctacctggtgaggaaggccttccgccaccggctgtgggccgtgctgactgtgcaggcctatgcccggggcatgattgcccggcggctgcaccagaggctgcgggcagagtacctgtggaggctggaggccgagaagatgaggctggccgaggaggagaagctgaggaaggagatgtctgccaagaaggccaaggaggaggccgagaggaagcaccaggagcggctggcccagctggcccgggaggatgctgagcgggagctgaaggagaaggaggccgcccggaggaagaaggagctgctggagcagatggagcgggcccggcatgagcctgtgaaccacagcgacatggtggacaagatgtttggcttcctgggcaccagcggcggcctgcccggccaggagggccaggcccccagcggctttgaggacctggagcggggcagaagagagatggtggaggaggacctggatgctgccctgcccctgcctgatgaagatgaggaggacctgtctgagtacaagtttgccaagtttgctgccacctacttccagggcaccaccacccacagctacacccggcggcccctgaagcagcccctgctgtaccatgatgatgaaggagaccagctggccgccctggccgtgtggatcaccatcctgcgcttcatgggagacctgcctgagcccaagtaccacacagccatgtctgatggcagcgagaagatccctgtgatgaccaagatctatgagaccctgggcaagaagacctacaagcgggagctgcaggccctgcagggcgagggggaggcccagctgcctgagggccagaagaagagctctgtgcgccacaagctggtgcacctgaccctgaagaagaagagcaagctgacagaggaggtgaccaagaggctgcatgatggagagagcacagtgcagggcaacagcatgctggaggaccggcccaccagcaacctggagaagctgcacttcatcattggaaatggcatcctgcggcctgccctgagagatgagatctactgccagatcagcaagcagctgacccacaaccccagcaagagcagctatgcccggggctggatcctggtgtccctgtgtgtgggctgctttgcccccagcgagaagtttgtgaagtacctgaggaacttcatccacggcggccccccaggctacgccccctactgtgaggagcggctgcggaggacctttgtgaatggcaccaggacccagccccccagctggctggagctgcaggccaccaagagcaagaagcccatcatgctgcctgtgaccttcatggatggcaccaccaagaccctgctgacagattctgccaccacagccaaggagctgtgcaatgccctggccgacaagatcagcctgaaggaccgcttcggcttcagcctgtacatcgccctgtttgacaaggtgagcagcctgggcagcggcagtgaccacgtgatggatgccatcagccagtgtgagcagtatgccaaggagcagggcgcccaggagagaaatgccccctggaggctcttcttcaggaaggaggtgttcaccccctggcacagccccagcgaggacaacgtggccaccaacctgatctaccagcaggtggtgcggggcgtgaagtttggagagtaccgctgtgagaaggaggatgacctggccgagctggccagccagcagtactttgtggactatggcagcgagatgatcctggagcggctgctgaacctggtgcccacctacatcccagaccgggagatcacccccctgaagaccctggagaagtgggcccagctggccatcgccgcccacaagaagggcatctatgcccagaggagaacagatgcccagaaggtgaaggaggatgtggtgtcctatgcccgcttcaagtggcccctgctcttcagccgcttctatgaggcctacaagttcagcggccccagcctgcccaagaatgatgtgattgtggccgtgaactggacaggagtgtactttgtggatgagcaggagcaggtgctgctggagctgtccttccctgagatcatggctgtgagcagcagcagaggagccaagaccacagcccccagcttcaccctggccaccatcaagggagatgagtacaccttcaccagcagcaatgctgaggacatccgggacctggtggtgaccttcctggagggcctgaggaagaggagcaaatatgtggtggccctgcaggacaaccccaacccagctggggaggagagcggcttcctgagctttgccaagggggacctgatcatcctggaccatgacaccggggagcaggtgatgaacagcggctgggccaacggcatcaatgaaagaaccaagcagagaggagacttccccacagattctgtgtatgtgatgcccaccgtgaccatgccaccccgggagatcgtggccctggtgaccatgaccccagaccagaggcaggatgtggtgcggctgctgcagctgaggacagctgagcctgaggtgcgggccaagccctacaccctggaggagttctcctatgactacttccggcccccacccaagcacaccctgagccgggtgatggtgtccaaggcccggggcaaggaccggctgtggagccacacccgggagcccctgaagcaggccctgctgaagaagctgctgggcagcgaggagctgagccaggaggcctgcctggccttcatcgctgtgctgaagtacatgggagactaccccagcaagaggaccaggtctgtgaatgagctgacagaccagatctttgagggccccctgaaggccgagcccctgaaggatgaggcctacgtgcagatcctgaagcagctgacagacaaccacatccgctacagcgaggagcggggctgggagctgctgtggctgtgcaccggcctcttcccccccagcaacatcctgctgccccacgtgcagcgcttcctgcagagcaggaagcactgccccctggccatcgactgcctgcagaggctgcagaaggccctgagaaatggcagcaggaagtacccaccccacctggtggaggtggaggccatccagcacaagaccacccagatcttccacaaggtgtacttcccagatgacacagatgaggcctttgaggtggagagcagcaccaaggccaaggacttctgccagaacatcgccacccggctgctgctgaagagcagcgagggcttcagcctgtttgtgaagattgctgacaaggtgctgtctgtgcctgaaaatgacttcttctttgattttgtgcgccacctgacagactggatcaagaaggcccggcccatcaaggatggcatcgtgcccagcctgacctaccaggtgttcttcatgaagaagctgtggaccaccaccgtgcctgggaaggaccccatggctgacagcatcttccactactaccaggagctgcccaagtacctgcggggctaccacaagtgcacccgggaggaggtgctgcagctgggcgccctgatctacagagtgaagtttgaggaggacaagagctacttccccagcatccccaagctgctgcgggagctggtgccccaggacctgatccggcaggtgtccccagatgactggaagaggagcatcgtggcctacttcaacaagcacgccggcaagagcaaggaggaggccaagctggccttcctgaagctgatcttcaagtggcccacctttggaagtgccttctttgaggtgaagcagaccacagagcccaacttccctgagatcctgctgattgccatcaacaagtatggagtgtccctgattgaccccaagaccaaggacatcctgaccacccaccccttcaccaagatcagcaactggagcagcggcaacacctacttccacatcaccatcggcaacctggtgcggggcagcaagctgctgtgtgagaccagcctgggctacaagatggatgacctgctgaccagctacatcagccagatgctgacagccatgagcaagcagaggggcagccgcagcggcaagtag

SEQ ID NO: 160860 - DNA, 2580 bp, Artificial Sequence
  Description of Artificial Sequence: Synthetic coding sequence
atgggcaggaagctggacctgagcggcctgacagatgatgaaacagaacatgtgctgcaggtggtgcagagggacttcaacctgaggaagaaggaggaggagcggctgtctgagctgaagcagaagctggatgaggagggcagcaaatgttccatcctgagcaagcaccagcagtttgtggagcactgctgcatgcgctgctgcagccccttcaccttcctggtgaacaccaagaggcagtgtggggactgcaagttcaacgtgtgcaagagctgctgcagctaccagaagcatgagaaggcctgggtgtgctgcgtgtgccagcaggcccggctgctgcgggcccagagcctggagtggttctacaacaacgtgaagagccgcttcaagcgcttcggcagcgccaaggtgctgaagaacctgtacaggaagcaccggctggagagcggggcctgctttgacatcctgggcggcagcctgtttgagagcaacctggagaatgaaggcagcatcagcggcagtgacagcaccttctaccggcagagcgagggccacagcgtgatggacaccctggccgtggccctgcgggtggccgaggaggccatcgaggaggccatcagcaaggccgaggcctacggggacagcctggacaagcagaatgaggccagctacctgcgggaccacaaggaggagctgacagaggagctggccaccaccatcctgcagaagatcatcaggaagcagaagagcaagtctgagcagcaggtggaggaggagcccggctggccccacccccagagctgcagcaccaaggtggctgatgagggcaccagcgccagccctgggggctaccgggccccagctgccctgtggaggagccagagcgccttcagcatcaccggggaggaggccctgaagaccccacctgtggaggcccccagccggcagccccgggaccagggccagcaccccagggctgagagcgccctgcccagctggaagtctgtggaccggctggatgagaccaacctggcccctgtgctgcagagcccagatggcaactgggtggccctgaaggatggagcccccccacccacccggctgctggccaagcccaagagcggcaccttccaggccctggaggtggccagctctgtggccagcgcctatgatgagatgggcagtgacagtgaagaagattttgactggagcgaggccctgagcaagctgtgccccaggagccgggccctgcccaggaacccccagccccagcccacccaggcccagagcagtgaccagggccccatcgccgccagccccagcagcgccctgagccccaaccctgaggccatgtgcagcgacagcgagaccagcagcgctggcagcagccgggaggtgggccaccaggcccggctgtcctggctgcagaggaaggcccccagaaatcctgctgctgagaagatgaggctgcatggagagctggatgtgaacttcaacccccagctggccagccgggagaccagtgacagcagcgagcctgaggaggccccccacaccacagaccggcgggcccggcgctggaggcgggcccggctgggcagcgaggagcccagcaaggagcccagcagccccagcgcccagctgcgggacctggacacccaccaggtgtctgatgacctgtctgaaacagacatcagcaatgaggcccgggacccccagaccctgacagacaccacagaggagaagagaagaaaccggctgtatgagctggccatgaagatgtctgagaaggagaccagcagtggagaggaccaggagagcgagcccaagacagaaagtgagaaccagaaggagagcctgagcagcgaggacaacagccagagcgtgcaggaggagctgaagaagaagttctctgctgtgtccctgtgcaacatcagcacagaggtgctgaaggtgatcaatgccacagaggagctgattgctggcagcacaggcccctgggagagcccccaggtgcccccagaccggcagaagggcatgttcccccggggcacagaccaggtgcggctggatgagcagctgaccagcctggaggagaatgtgtacctggccgccggcaccgtgtatggcctggagacccagctgacagagctggaggatgctgcccgctgcatccacagcggcacagatgagacccacctggccgacctggaggaccaggtggccacagctgctgcccaggtgcaccacgccgagctgcagatcagtgacatcgagagccgcatcagcgccctgaccatcgccggcctgaacatcgccccctgtgtgcgcttcaccaggagaagagaccagaagcagaggacccaggtgcagaccatcgacaccagccggcagcagaggaggaagctgcctgcccctcctgtgaaggccgagaagattgagaccagctctgtgaccaccatcaagaccttcaaccacaacttcatcctgcagggcagcagcaccaacagaaccaaggagaggaagggcaccaccaaggacctgatggagcccgccctggagagcgctgtgatgtactag

SEQ ID NO: 160861 - DNA, 2313 bp, Artificial Sequence
  Description of Artificial Sequence: Synthetic coding sequence
atgaggaaggccgccagcgctgccagcagccgcagcaccagcagcctgtggagcacagctgcctgtgccgccgcccggcccagccccagcagcagcaccccatctgcctctgtggagatcgccaacagcatgtctgcccgggctgctgcccccaccaggagcaccaagaggcctggcagcgctgccagcgccagcaagaggggcggcagcctgtttgagagcaacctggagaatgaaggcagcatcagcggcagtgacagcaccttctaccggcagagcgagggccacagcgtgatggacaccctggccgtggccctgcgggtggccgaggaggccatcgaggaggccatcagcaaggccgaggcctatggagacagcctggacaagcagaatgaggccagctacctgcgggaccacaaggaggagctgacagaggagctggccaccaccatcctgcagaagatcatcaggaagcagaagagcaagtctgagcagcaggtggaggaggagcccggctggccccacccccagagctgcagcaccaaggtggctgatgagggcaccagcgccagccctgggggctaccgggccccagctgccctgtggaggagccagagcgccttcagcatcactggagaggaggccctgaagaccccacctgtggaggcccccagccggcagccccgggaccagggccagcaccccagggctgagagcgccctgcccagctggaagtctgtggaccggctggatgagaccaacctggcccctgtgctgcagagcccagatggcaactgggtggccctgaaggatggagcccccccacccacccggctgctggccaagcccaagagcggcaccttccaggccctggaggtggccagctctgtggccagcgcctatgatgagatgggcagtgacagcgaggaggactttgactggagcgaggccctgagcaagctgtgccccaggagccgggccctgcccaggaacccccagccccagcccacccaggcccagagcagtgaccagggccccatcgccgccagccccagcagcgccctgagccccaaccctgaggccatgtgcagcgacagcgagaccagcagcgctggcagcagccgggaggtgggccaccaggcccggctgtcctggctgcagaggaaggcccccaggaacccagctgctgagaagatgaggctgcacggggagctggatgtgaacttcaacccccagctggccagccgggagaccagtgacagcagcgagcctgaggaggccccccacaccacagacagaagagcccggcgctggaggcgggcccggctgggcagcgaggagcccagcaaggagcccagcagccccagcgcccagctgcgggacctggacacccaccaggtgtctgatgacctgtctgaaacagacatcagcaatgaggcccgggacccccagaccctgacagacaccacagaggagaagagaagaaaccggctgtatgagctggccatgaagatgtctgagaaggagaccagcagcggggaggaccaggagagcgagcccaagacagaaagtgagaaccagaaggagagcctgagcagcgaggacaacagccagagcgtgcaggaggagctgaagaagaagttctctgctgtgtccctgtgcaacatcagcacagaggtgctgaaggtgatcaatgccacagaggagctgattgctggcagcacaggcccctgggagagcccccaggtgcccccagaccggcagaagggcatgttcccccggggcacagaccaggtgcggctggatgagcagctgaccagcctggaggagaatgtgtacctggccgccggcaccgtgtatggcctggagacccagctgacagagctggaggatgctgcccgctgcatccacagcggcacagatgagacccacctggccgacctggaggaccaggtggccacagctgctgcccaggtgcaccacgccgagctgcagatcagtgacatcgagagccgcatcagcgccctgaccatcgccggcctgaacatcgccccctgtgtgcgcttcacccggcggcgggaccagaagcagaggacccaggtgcagaccatcgacaccagccggcagcagaggaggaagctgcctgcccctcctgtgaaggccgagaagattgagaccagctctgtgaccaccatcaagaccttcaaccacaacttcatcctgcagggcagcagcaccaacagaaccaaggagaggaagggcaccaccaaggacctgatggagcccgccctggagagcgctgtgatgtactag

SEQ ID NO: 160862 - DNA, 2580 bp, Artificial Sequence; identical to SEQ ID NO: 160860
  Description of Artificial Sequence: Synthetic coding sequence

SEQ ID NO: 160863 - DNA, 2019 bp, Artificial Sequence
  Description of Artificial Sequence: Synthetic coding sequence
atggacaccctggccgtggccctgcgggtggccgaggaggccatcgaggaggccatcagcaaggccgaggcctatggagacagcctggacaagcagaatgaggccagctacctgcgggaccacaaggaggagctgacagaggagctggccaccaccatcctgcagaagatcatcaggaagcagaagagcaagtctgagcagcaggtggaggaggagcccggctggccccacccccagagctgcagcaccaaggtggctgatgagggcaccagcgccagccctgggggctaccgggccccagctgccctgtggaggagccagagcgccttcagcatcactggagaggaggccctgaagaccccacctgtggaggcccccagccggcagccccgggaccagggccagcaccccagggctgagagcgccctgcccagctggaagtctgtggaccggctggatgagaccaacctggcccctgtgctgcagagcccagatggcaactgggtggccctgaaggatggagcccccccacccacccggctgctggccaagcccaagagcggcaccttccaggccctggaggtggccagctctgtggccagcgcctatgatgagatgggcagtgacagcgaggaggactttgactggagcgaggccctgagcaagctgtgccccaggagccgggccctgcccaggaacccccagccccagcccacccaggcccagagcagtgaccagggccccatcgccgccagccccagcagcgccctgagccccaaccctgaggccatgtgcagcgacagcgagaccagcagcgctggcagcagccgggaggtgggccaccaggcccggctgtcctggctgcagaggaaggcccccaggaacccagctgctgagaagatgaggctgcacggggagctggatgtgaacttcaacccccagctggccagccgggagaccagtgacagcagcgagcctgaggaggccccccacaccacagacagaagagcccggcgctggaggcgggcccggctgggcagcgaggagcccagcaaggagcccagcagccccagcgcccagctgcgggacctggacacccaccaggtgtctgatgacctgtctgaaacagacatcagcaatgaggcccgggacccccagaccctgacagacaccacagaggagaagagaagaaaccggctgtatgagctggccatgaagatgtctgagaaggagaccagcagcggggaggaccaggagagcgagcccaagacagaaagtgagaaccagaaggagagcctgagcagcgaggacaacagccagagcgtgcaggaggagctgaagaagaagttctctgctgtgtccctgtgcaacatcagcacagaggtgctgaaggtgatcaatgccacagaggagctgattgctggcagcacaggcccctgggagagcccccaggtgcccccagaccggcagaagggcatgttcccccggggcacagaccaggtgcggctggatgagcagctgaccagcctggaggagaatgtgtacctggccgccggcaccgtgtatggcctggagacccagctgacagagctggaggatgctgcccgctgcatccacagcggcacagatgagacccacctggccgacctggaggaccaggtggccacagctgctgcccaggtgcaccacgccgagctgcagatcagtgacatcgagagccgcatcagcgccctgaccatcgccggcctgaacatcgccccctgtgtgcgcttcacccggcggcgggaccagaagcagaggacccaggtgcagaccatcgacaccagccggcagcagaggaggaagctgcctgcccctcctgtgaaggccgagaagattgagaccagctctgtgaccaccatcaagaccttcaaccacaacttcatcctgcagggcagcagcaccaacagaaccaaggagaggaagggcaccaccaaggacctgatggagcccgccctggagagcgctgtgatgtactag

SEQ ID NO: 160864 - DNA, 2886 bp, Artificial Sequence
  Description of Artificial Sequence: Synthetic coding sequence
atgaagtacctgctgaacttcatcggccagggccctgccacctacggccccttctgtgccgagcggctgcggaggacctacgccaatggagtgcgggcagagccccccacctggctggagctgcaggccgtgaagagcaagaagcacatccccatccaggtgatcctggccaccggggagagcctgactgtgcctgtggacagcgccagcaccagccgggagatgtgcatgcacatcgcccacaagcagggcctgagtgaccacctgggcttcagcctgcaggtggccgtgtatgacaagttctggagcctgggcagcggccgggaccacatgatggatgccatcgcccgctgtgagcagatggcccaggagcggggggagagccagaggcagagcccctggaggatctacttcaggaaggagttcttcaccccctggcatgacagcagagaagatcctgtgtccacagagctgatctaccggcaggtgctgcggggcgtgtggagcggggagtacagctttgagaaggaggaggagctggtggagctgctggcccggcactgctacgtgcagctgggcgccagcgctgagagcaaggctgtgcaggagctgctgcccagctgcatcccccacaagctgtaccgcaccaagcccccagaccgctgggccagcctggtgacagctgcctgtgccaaggccccctacacccagaagcaggtgacccccctggccgtgcgggagcaggtggtggatgctgcccggctgcagtggcccctgctcttcagccggctgtttgaagtcatcaccctgagcgccttcaccctgcccagcctgctggcccggcccccaccagcccaggatgctggccctgctggagaagatgctgctggcaccctcttcccccggggccacggcagcggccaccagcaggtgcgggccctgcgggaggacctcttcctgcacacagagccccaccccccagcccctggccgcacagcccacgaggtgctgcactggggcatcacccgctgcaccggcagcttcagcctgaagcccaggagcaccaggaagggccagggctctgtgcagcccctggccggcacctacctggagggcagcttcctgtgccacggccgggagctggtggcctggagggtgcaggtggtgtgggagggggacaagggccagtgcctggccggggctgacccccacagccacggcagcccctggatcagcctgaccggcaacttctccatgccctttgggaagagcacccagcagagcggcacctgcatcagcggcctgtgccaggtgtacagcggccaccacagccccctggccaccagccccaggagcacagacagcatcacccacagcgcagatgagaggatgagcaagctgaagcacgccgaggtgcgctggctgcgggtgtccacctggcagagccggcagctgatcagcgccctgacctttgctgtgtccctgcgctgccactgcaccccagccaccagcctgagcgcccacagccagccccacacctgggccgcccccctgagcgccagcgagcggcccaccgtggtgtctggcctggtgctggccctggccgagcagctgtgtgtgctgatccgctggaggggcctgctggtgaccctgtccttcatcagccgggaggcccagggcggccagaggctgctgctgagcaccatgcatgaggagtatgaatttgtgagccccagctctgtggccatcgccgagctggtggccctcttcctggagggcctgaaggagaggagcatctttgccatggccctgcaggacaggaaggccacagatgacaccaccctgctggccttcaagaagggggacctgctggtgctgaccaagaagcagggcctgctggccagcgagaactggaccctgggccagaatgacagaacaggcaagacaggcctggtgcccatggcctgcctgtacaccatccccaccgtgaccaagcccagcgcccagctgctgagcctgctggccatgagccctgagaagaggaagctggccgcccaggagggccagttcacagagcccaggcctgaggagccccccaaggagaagctgcacaccctggaggagttctcctatgagttcttccgggcccctgagaaggacatggtgtccatggctgtgctgcccctggcccgggcccggggccacctgtgggcctacagctgtgagcccctgcggcagcccctgctgaagagggtgcacgccaacgtggacctgtgggacatcgcctgccagatctttgccacccccatcctgcgctacatgggagactaccccagccggcaggcctggcccaccctggagctgacagaccagatcttcaccctggccctgcagcacccagccctgcaggatgaggtgtactgccagatcctgaagcagctgacccacaacagcaacagacacagcgaggagcggggctggcagctgctgtggctgtgcaccggcctcttcccccccagcaagggcctgctgccccacgcccagaagttcatcgacacccggcggggcaagctgctggccccagactgcagccgccgcatccagaaggtgctgaggacaggccccaggaagcagcccccccaccaggtggaggtggaggccgctgagcagaatgtgagccgcatctgccacaagatctacttccccaatgacaccagcgagatgctggaggtggtggccaacaccagggtgagagatgtgtgtgacagcatcgccacccggctgcagctggcctcctgggagggctgcagcctcttcatcaagatcagtgacaaggtgatcagccagaaggagggggacttcttctttgacagcctgcgggagtag

SEQ ID NO: 160865 - DNA, 6354 bp, Artificial Sequence
  Description of Artificial Sequence: Synthetic coding sequence
atgagcggcttccggctgggggaccacgtgtggctggagccccccagcacccacaagacaggagtggccatcggcggcatcatcaaggaggccaagccaggcaaggtgctggtggaggatgatgagggcaaggagcactggatccgggcagaagattttggagtgctgagccccatgcaccccaacagcgtgcagggcgtggatgacatgatccggctgggggacctgaatgaagctggcatggtgcacaacctgctgatccgctaccagcagcacaagatctacacctacacaggcagcatcctggtggccgtgaaccccttccaggtgctgcccctgtacaccctggagcaggtgcagctgtactacagccgccacatgggagagctgccccctcatgtgtttgccatcgccaacaactgctacttctccatgaagaggaacaagagggaccagtgctgcatcatctctggagagagcggggccggcaagacagagaccaccaagctgatcctgcagttcctggccaccatcagcggccagcacagctggattgagcagcaggtgctggaggccaaccccatcctggaggcctttggaaatgccaagaccatcagaaatgacaacagcagcagatttgggaagtacatcgacatctacttcaaccccagcggcgtgattgaaggagcccgcatcgagcagttcctgctggagaagagccgggtgtgccggcaggcccctgaggagaggaactaccacatcttctactgcatgctgatgggcgtgtctgctgaggacaagcagctgctgagcctgggcacccccagcgagtaccactacctgaccatgggcaactgcaccagctgtgagggcctgaatgatgccaaggactatgcccacatccgcagcgccatgaagatcctgcagttcagtgacagcgagagctgggatgtgatcaagctgctggccgccatcctgcacctgggcaatgtgggcttcatggcctctgtgtttgagaacctggatgccagtgatgtgatggagaccccagccttccccaccgtgatgaagctgctggaggtgcagcaccaggagctgcgggactgcctgatcaagcacaccatcctgatccggggggagtttgtgaccaggagcctgaacatcgcccaggccgctgacagaagagatgcctttgtgaagggcatctacggccacctgttcctgtggatcgtgaagaagatcaatgctgccatcttcaccccaccagcccaggaccccaagaatgtgcggcgggccatcggcctgctggacatctttggatttgagaactttgagaacaacagctttgagcagctgtgcatcaactttgccaatgagcacctgcagcagttctttgtgcagcacgtgttcaccatggagcaggaggagtacagaagtgagaacatctcctgggactacatccactacacagacaaccggcccaccctggacctgctggccctgaagcccatgagcatcatcagcctgctggatgaggagagccgcttcccccagggcacagacctgaccatgctgcagaagctgaacagcgtgcacgccaacaacaaggccttcctgcagcccaagaacatccatgatgccaggtttggaattgcccactttgctggggaggtgtactaccaggccgagggcttcctggagaagaacagagatgtgctgagcacagacatcctgaccctggtgtacagcagcaagaacaagttcctgcgggagatcttcaacctggagctggccgagaccaagctgggccacggcaccatccggcaggccaaggccggcaaccacctgttcaagtctgctgacagcaacaagaggcccagcaccctgggcagccagttcaagcagagcctggaccagctgatgaagatcctgaccaactgccagccctacttcatccgctgcatcaagcccaatgagtacaagaagcccctgctgtttgaccgggagctgtgcctgcggcagctgcgctacagcggcatgatggagaccgtgcacatcaggaagagcggcttccccatccgctacacctttgaggagttcagccagcgcttcggcgtgctgctgcccaatgccatgaggatgcagctgcagggcaagctgcggcagatgaccctgggcatcacagatgtgtggctgaggacagacaaggactggaaggccggcaagaccaagatcttcctgcgggaccaccaggacaccctgctggaggtgcagaggagccaggtgctggaccgggccgccctgagcatccagaaggtgctgcggggctaccgctacaggaaggagttcctgcggcagaggagagctgctgtgaccctgcaggcctggtggaggggctactgcaacagaagaaacttcaagctgatcctggtgggctttgagcggctgcaggccatcgcccggagccagcccctggcccggcagtaccaggccatgaggcagaggacagtgcagctgcaggccctgtgccggggctacctggtgcggcagcaggtgcaggccaagagaagagctgtggtggtgatccaggcccacgcccggggcatggccgcccggaggaacttccagcagaggaaggccaatgcccccctggtgatcccagctgagggccagaagagccagggcgccctgcctgccaagaagaggaggagcatctatgacacagtgacagacacagagatggtggagaaggtgtttggcttcctgcctgccatgattggaggccaggagggccaggccagcccccactttgaggacctggagagcaagacccagaagctgctggaggtggacctggacacagtgcccatggccgaggagccagaagaagatgtggatggcctggccgagtacaccttccccaagtttgctgtgacctacttccagaagagcgccagccacacccacatcagaagacccctgcgctaccccctgctgtaccatgaagatgacacagactgcctggccgccctggtgatctggaatgtcatcctgcgcttcatgggagacctgcctgagcctgtgctgtatgcccggagcagccagcagggcagctctgtgatgaggcagatccatgacaccctgggccgggagcacggggcccaggtgccccagcacagccgcagcgcccaggtggccagccagctgaacattggagaggaggccctggagccagatggcctgggcgctgaccggcccatgagcaacctggagaaggtgcacttcatcgtgggctacgccatcctgcggcccagcctgagagatgagatctactgccagatctgcaagcagctgtctgagaacttcaagaccagcagcctggcccggggctggatcctgctgagcctgtgcctgggctgcttcccccccagcgagcgcttcatgaagtacctgctgaacttcatcggccagggccctgccacctacggccccttctgtgccgagcggctgcggaggacctacgccaacggggtgcgggcagagccccccacctggctggagctgcaggccgtgaagagcaagaagcacatccccatccaggtgatcctggccactggagagagcctgactgtgcctgtggacagcgccagcaccagccgggagatgtgcatgcacatcgcccacaagcagggcctgagtgaccacctgggcttcagcctgcaggtggccgtgtatgacaagttctggagcctgggcagcggccgggaccacatgatggatgccatcgcccgctgtgagcagatggcccaggagcggggggagagccagaggcagagcccctggaggatctacttcaggaaggagttcttcaccccctggcatgacagccgggaggaccctgtgtccacagagctgatctaccggcaggtgctgcggggcgtgtggagcggggagtacagctttgagaaggaggaggagctggtggagctgctggcccggcactgctacgtgcagctgggcgccagcgctgagagcaaggctgtgcaggagctgctgcccagctgcatcccccacaagctgtaccgcaccaagcccccagaccgctgggccagcctggtgacagctgcctgtgccaaggccccctacacccagaagcaggtgacccccctggccgtgcgggagcaggtggtggatgctgcccggctgcagtggcccctgctcttcagccggctgtttgaggtgatcaccctgagcggcccccggctgcccaagacccagctgatcctggccgtgaactggaagggcctgtgcttcctggaccagcaggagaagatgctgctggagctgtccttccctgaggtgatgggcctggccaccaaccgggaggcccagggcggccagaggctgctgctgagcaccatgcatgaggagtatgaatttgtgagccccagctctgtggccatcgccgagctggtggccctcttcctggagggcctgaaggagaggagcatctttgccatggccctgcaggacaggaaggccacagatgacaccaccctgctggccttcaagaagggggacctgctggtgctgaccaagaagcagggcctgctggccagcgagaactggaccctgggccagaatgacagaacaggcaagacaggcctggtgcccatggcctgcctgtacaccatccccaccgtgaccaagcccagcgcccagctgctgagcctgctggccatgagccctgagaagaggaagctggccgcccaggagggccagttcacagagcccaggcctgaggagccccccaaggagaagctgcacaccctggaggagttctcctatgagttcttccgggcccctgagaaggacatggtgtccatggctgtgctgcccctggcccgggcccggggccacctgtgggcctacagctgtgagcccctgcggcagcccctgctgaagagggtgcacgccaacgtggacctgtgggacatcgcctgccagatctttgccacccccatcctgcgctacatgggagactaccccagccggcaggcctggcccaccctggagctgacagaccagatcttcaccctggccctgcagcacccagccctgcaggatgaggtgtactgccagatcctgaagcagctgacccacaacagcaacagacattctgaggagcggggctggcagctgctgtggctgtgcaccggcctcttcccccccagcaagggcctgctgccccacgcccagaagttcatcgacacccggcggggcaagctgctggccccagactgcagccgccgcatccagaaggtgctgaggacaggccccaggaagcagcccccccaccaggtggaggtggaggccgctgagcagaatgtgagccgcatctgccacaagatctacttccccaatgacaccagcgagatgctggaggtggtggccaacaccagggtgagagatgtgtgtgacagcatcgccacccggctgcagctggcctcctgggagggctgcagcctcttcatcaagatcagtgacaaggtgatcagccagaaggagggggacttcttctttgacagcctgcgggaggtgtctgactgggtgaagaagaacaagccccagaaggagggcgcccctgtgaccctgccctaccaggtgtacttcatgaggaagctgtggctgaacatcagccctgggaaggatgtgaatgctgacaccatcctgcactaccaccaggagctgcccaagtacctgcggggcttccacaagtgcagccgggaggatgccatccacctggccggcctcatctacaaggcccagttcaacaatgacaggagccagctggcctctgtgcccaagatcctgcgggagctggtgcctgagaacctgacccggctgatgagcagcgaggagtggaagaagagcatcctgctggcctatgacaagcacaaggacaagacagtggaggaggccaaggtggccttcctgaagtggatctgccgctggcccaccttcggcagcgccttctttgaggtgaagcagaccagcgagcccagctacccagatgtgatcctgattgccatcaacagacatggagtgctgctgatccaccccaagaccaaggacctgctgaccacctaccccttcaccaagatcagctcctggagcagcggcagcacctacttccacatggccctgggcagcctgggccggggcagccggctgctgtgtgagaccagcctgggctacaagatggatgacctgctgaccagctatgtgcagcagctgctgagcgccatgaacaagcagaggggcagcaaggccccagccctggccagcacctag

SEQ ID NO: 160866 - DNA, 6351 bp, Artificial Sequence
  Description of Artificial Sequence: Synthetic coding sequence
atgagcggcttccggctgggggaccacgtgtggctggagccccccagcacccacaagacaggagtggccatcggcggcatcatcaaggaggccaagccaggcaaggtgctggtggaggatgatgagggcaaggagcactggatccgggcagaagattttggagtgctgagccccatgcaccccaacagcgtgcagggcgtggatgacatgatccggctgggggacctgaatgaagctggcatggtgcacaacctgctgatccgctaccagcagcacaagatctacacctacacaggcagcatcctggtggccgtgaaccccttccaggtgctgcccctgtacaccctggagcaggtgcagctgtactacagccgccacatgggagagctgccccctcatgtgtttgccatcgccaacaactgctacttctccatgaagaggaacaagagggaccagtgctgcatcatctctggagagagcggggccggcaagacagagaccaccaagctgatcctgcagttcctggccaccatcagcggccagcacagctggattgagcagcaggtgctggaggccaaccccatcctggaggcctttggaaatgccaagaccatcagaaatgacaacagcagcagatttgggaagtacatcgacatctacttcaaccccagcggcgtgattgaaggagcccgcatcgagcagttcctgctggagaagagccgggtgtgccggcaggcccctgaggagaggaactaccacatcttctactgcatgctgatgggcgtgtctgctgaggacaagcagctgctgagcctgggcacccccagcgagtaccactacctgaccatgggcaactgcaccagctgtgagggcctgaatgatgccaaggactatgcccacatccgcagcgccatgaagatcctgcagttcagtgacagcgagagctgggatgtgatcaagctgctggccgccatcctgcacctgggcaatgtgggcttcatggcctctgtgtttgagaacctggatgccagtgatgtgatggagaccccagccttccccaccgtgatgaagctgctggaggtgcagcaccaggagctgcgggactgcctgatcaagcacaccatcctgatccggggggagtttgtgaccaggagcctgaacatcgcccaggccgctgacagaagagatgcctttgtgaagggcatctacggccacctgttcctgtggatcgtgaagaagatcaatgctgccatcttcaccccaccagcccaggaccccaagaatgtgcggcgggccatcggcctgctggacatctttggatttgagaactttgagaacaacagctttgagcagctgtgcatcaactttgccaatgagcacctgcagcagttctttgtgcagcacgtgttcaccatggagcaggaggagtacagaagtgagaacatctcctgggactacatccactacacagacaaccggcccaccctggacctgctggccctgaagcccatgagcatcatcagcctgctggatgaggagagccgcttcccccagggcacagacctgaccatgctgcagaagctgaacagcgtgcacgccaacaacaaggccttcctgcagcccaagaacatccatgatgccaggtttggaattgcccactttgctggggaggtgtactaccaggccgagggcttcctggagaagaacagagatgtgctgagcacagacatcctgaccctggtgtacagcagcaagaacaagttcctgcgggagatcttcaacctggagctggccgagaccaagctgggccacggcaccatccggcaggccaaggccggcaaccacctgttcaagtctgctgacagcaacaagaggcccagcaccctgggcagccagttcaagcagagcctggaccagctgatgaagatcctgaccaactgccagccctacttcatccgctgcatcaagcccaatgagtacaagaagcccctgctgtttgaccgggagctgtgcctgcggcagctgcgctacagcggcatgatggagaccgtgcacatcaggaagagcggcttccccatccgctacacctttgaggagttcagccagcgcttcggcgtgctgctgcccaatgccatgaggatgcagctgcagggcaagctgcggcagatgaccctgggcatcacagatgtgtggctgaggacagacaaggactggaaggccggcaagaccaagatcttcctgcgggaccaccaggacaccctgctggaggtgcagaggagccaggtgctggaccgggccgccctgagcatccagaaggtgctgcggggctaccgctacaggaaggagttcctgcggcagaggagagctgctgtgaccctgcaggcctggtggaggggctactgcaacagaagaaacttcaagctgatcctggtgggctttgagcggctgcaggccatcgcccggagccagcccctggcccggcagtaccaggccatgaggcagaggacagtgcagctgcaggccctgtgccggggctacctggtgcggcagcaggtgcaggccaagagaagagctgtggtggtgatccaggcccacgcccggggcatggccgcccggaggaacttccagcagaggaaggccaatgcccccctggtgatcccagctgagggccagaagagccagggcgccctgcctgccaagaagaggaggagcatctatgacacagtgacagacacagagatggtggagaaggtgtttggcttcctgcctgccatgattggaggccaggagggccaggccagcccccactttgaggacctggagagcaagacccagaagctgctggaggtggacctggacacagtgcccatggccgaggagccagaagaagatgtggatggcctggccgagtacaccttccccaagtttgctgtgacctacttccagaagagcgccagccacacccacatcagaagacccctgcgctaccccctgctgtaccatgaagatgacacagactgcctggccgccctggtgatctggaatgtcatcctgcgcttcatgggagacctgcctgagcctgtgctgtatgcccggagcagccagcagggcagctctgtgatgaggcagatccatgacaccctgggccgggagcacggggcccaggtgccccagcacagccgcagcgcccaggtggccagccagctgaacattggagaggaggccctggagccagatggcctgggcgctgaccggcccatgagcaacctggagaaggtgcacttcatcgtgggctacgccatcctgcggcccagcctgagagatgagatctactgccagatctgcaagcagctgtctgagaacttcaagaccagcagcctggcccggggctggatcctgctgagcctgtgcctgggctgcttcccccccagcgagcgcttcatgaagtacctgctgaacttcatcggccagggccctgccacctacggccccttctgtgccgagcggctgcggaggacctacgccaacggggtgcgggcagagccccccacctggctggagctgcaggccgtgaagagcaagaagcacatccccatccaggtgatcctggccactggagagagcctgactgtgcctgtggacagcgccagcaccagccgggagatgtgcatgcacatcgcccacaagcagggcctgagtgaccacctgggcttcagcctgcaggtggccgtgtatgacaagttctggagcctgggcagcggccgggaccacatgatggatgccatcgcccgctgtgagcagatggcccaggagcggggggagagccagaggcagagcccctggaggatctacttcaggaaggagttcttcaccccctggcatgacagccgggaggaccctgtgtccacagagctgatctaccggcaggtgctgcggggcgtgtggagcggggagtacagctttgagaaggaggaggagctggtggagctgctggcccggcactgctacgtgcagctgggcgccagcgctgagagcaaggctgtgcaggagctgctgcccagctgcatcccccacaagctgtaccgcaccaagcccccagaccgctgggccagcctggtgacagctgcctgtgccaaggccccctacacccagaagcaggtgacccccctggccgtgcgggagcaggtggtggatgctgcccggctgcagtggcccctgctcttcagccggctgtttgaggtgatcaccctgagcggcccccggctgcccaagacccagctgatcctggccgtgaactggaagggcctgtgcttcctggaccagcaggagaagatgctgctggagctgtccttccctgaggtgatgggcctggccaccaaccgggaggcccagggcggccagaggctgctgctgagcaccatgcatgaggagtatgaatttgtgagccccagctctgtggccatcgccgagctggtggccctcttcctggagggcctgaaggagaggagcatctttgccatggccctgcaggacaggaaggccacagatgacaccaccctgctggccttcaagaagggggacctgctggtgctgaccaagaagcagggcctgctggccagcgagaactggaccctgggccagaatgacagaacaggcaagacaggcctggtgcccatggcctgcctgtacaccatccccaccgtgaccaagcccagcgcccagctgctgagcctgctggccatgagccctgagaagaggaagctggccgcccaggagggccagttcacagagcccaggcctgaggagccccccaaggagaagctgcacaccctggaggagttctcctatgagttcttccgggcccctgagaaggacatggtgtccatggctgtgctgcccctggcccgggcccggggccacctgtgggcctacagctgtgagcccctgcggcagcccctgctgaagagggtgcacgccaacgtggacctgtgggacatcgcctgccagatctttgtggccatcctgcgctacatgggagactaccccagccggcaggcctggcccaccctggagctgacagaccagatcttcaccctggccctgcagcacccagccctgcaggatgaggtgtactgccagatcctgaagcagctgacccacaacagcaacagacacagcgaggagcggggctggcagctgctgtggctgtgcaccggcctcttcccccccagcaagggcctgctgccccacgcccagaagttcatcgacacccggcggggcaagctgctggccccagactgcagccgccgcatccagaaggtgctgaggacaggccccaggaagcagcccccccaccaggtggaggtggaggccgctgagcagaatgtgagccgcatctgccacaagatctacttccccaatgacaccagcgagatgctggaggtggtggccaacaccagggtgagagatgtgtgtgacagcatcgccacccggctgcagctggcctcctgggagggctgcagcctcttcatcaagatcagtgacaaggtgatcagccagaaggagggggacttcttctttgacagcctgcgggaggtgtctgactgggtgaagaagaacaagccccagaaggagggcgcccctgtgaccctgccctaccaggtgtacttcatgaggaagctgtggctgaacatcagccctgggaaggatgtgaatgctgacaccatcctgcactaccaccaggagctgcccaagtacctgcggggcttccacaagtgcagcagagaagatgccatccacctggccggcctcatctacaaggcccagttcaacaatgacaggagccagctggcctctgtgcccaagatcctgcgggagctggtgcctgagaacctgacccggctgatgagcagcgaggagtggaagaagagcatcctgctggcctatgacaagcacaaggacaagacagtggaggaggccaaggtggccttcctgaagtggatctgccgctggcccacctttggaagtgccttctttgaggtgaagcagaccagcgagcccagctacccagatgtgatcctgattgccatcaacagacatggagtgctgctgatccaccccaagaccaaggacctgctgaccacctaccccttcaccaagatcagctcctggagcagcggcagcacctacttccacatggccctgggcagcctgggccggggcagccggctgctgtgtgagaccagcctgggctacaagatggatgacctgctgaccagctatgtgcagcagctgctgagcgccatgaacaagcagaggggcagcaaggccccagccctggccagcacctag

SEQ ID NO: 160867 - DNA, 6351 bp, Artificial Sequence; identical to SEQ ID NO: 160866
  Description of Artificial Sequence: Synthetic coding sequence

SEQ ID NO: 160868 - DNA, 4248 bp, Artificial Sequence
  Description of Artificial Sequence: Synthetic coding sequence
atgccagaccagtttgaccaggccgtggtgctgaaccagctgcgctacagcggcatgctggagaccgtgcgcatcaggaaggccggctatgctgtgagaagacccttccaggacttctacaagcgctacaaggtgctgatgaggaacctggccctgcctgaagatgtgcggggcaagtgcaccagcctgctgcagctgtatgatgccagcaacagcgagtggcagctgggcaagaccaaggtgttcctgcgggagagcctggagcagaagctggagaagaggcgggaggaggaggtgtcccatgctgccatggtgatccgggcccacgtgctgggcttcctggccaggaagcagtacaggaaggtgctgtactgtgtggtgatcatccagaagaactaccgggccttcctgctgcggcggcgcttcctgcacctgaagaaggccgccatcgtgttccagaagcagctgcggggccagatcgcccggcgggtgtaccggcagctgctggccgagaagcgggagcaggaggagaagaagaagcaggaggaggaggagaagaagaagcgggaggaggaggagcgggagcgggagcgggagcggcgggaggccgagctgcgggcccagcaggaggaggagaccaggaagcagcaggagctggaggccctgcagaagagccagaaggaggccgagctgacccgggagctggagaagcagaaggagaacaagcaggtggaggagatcctgcggctggagaaggagattgaggacctgcagaggatgaaggagcagcaggagctgagcctgacagaggccagcctgcagaagctgcaggagcggcgggaccaggagctgcggcggctggaggaggaggcctgccgggccgcccaggagttcctggagagcctgaactttgatgaaattgatgaatgtgtgaggaacatcgagaggagcctgtctgtgggcagcgagttcagcagcgagctggccgagagcgcctgtgaggagaagcccaacttcaacttcagccagccctacccagaggaggaggtggatgagggctttgaagcagatgatgatgccttcaaggacagccccaaccccagcgagcacggccacagcgaccagaggaccagcggcatccgcaccagtgatgacagcagcgaggaggacccctacatgaatgacacagtggtgcccaccagccccagcgctgacagcacagtgctgctggcccccagcgtgcaggacagcggcagcctgcacaacagcagcagtggagagagcacctactgcatgccccagaatgctggggacctgcccagcccagatggagactatgactatgaccaggatgattatgaagatggagccatcaccagcggcagctctgtgaccttcagcaacagctatggcagccagtggagcccagactaccgctgcagcgtgggcacctacaacagcagcggggcctaccgcttcagcagcgagggcgcccagagcagctttgaagattctgaagaagattttgacagcagatttgacacagatgatgagctgagctaccgccgggacagcgtgtacagctgtgtgaccctgccctacttccacagcttcctgtacatgaagggcggcctgatgaacagctggaagaggcgctggtgtgtgctgaaggatgagaccttcctgtggttccgcagcaagcaggaggccctgaagcagggctggctgcacaagaagggcggcggcagcagcaccctgagcagaagaaactggaagaagcgctggtttgtgctgcggcagagcaagctgatgtactttgaaaatgacagcgaggagaagctgaagggcaccgtggaggtgaggacagccaaggagatcatcgacaacaccaccaaggaaaatggcatcgacatcatcatggctgacaggaccttccacctgattgctgagagcccagaagatgccagccagtggttctctgtgctgagccaggtgcacgccagcacagaccaggagatccaggagatgcatgatgagcaggccaacccccagaatgctgtgggcaccctggatgtgggcctgattgattctgtgtgtgccagtgacagcccagaccggcccaacagctttgtgatcatcacagccaacagagtgctgcactgcaatgctgacaccccagaggagatgcaccactggatcaccctgctgcagaggagcaagggggacaccagggtggagggccaggagttcatcgtgcggggctggctgcacaaggaggtgaagaacagccccaagatgagcagcctgaagctgaagaagcgctggtttgtgctgacccacaacagcctggactactacaagagcagcgagaagaatgccctgaagctgggcaccctggtgctgaacagcctgtgcagcgtggtgcccccagatgagaagatcttcaaggagaccggctactggaatgtgacagtgtatggcaggaagcactgctaccgcctgtacaccaagctgctgaatgaggccacccgctggagcagcgccatccagaatgtgacagacaccaaggcccccatcgacacccccacccagcagctgatccaggacatcaaggagaactgcctgaacagtgatgtggtggagcagatctacaagaggaaccccatcctgcgctacacccaccaccccctgcacagccccctgctgcccctgccctacggggacatcaacctgaacctgctgaaggacaagggctacaccaccctgcaggatgaggccatcaagatcttcaacagcctgcagcagctggagagcatgtctgaccccatccccatcatccagggcatcctgcagacaggccatgacctgcggcccctgagagatgagctgtactgccagctgatcaagcagaccaacaaggtgccccaccctggctctgtgggcaacctgtacagctggcagatcctgacctgcctgagctgcaccttcctgcccagccggggcatcctgaagtacctgaagttccacctgaagaggatccgggagcagtttcctggcagcgagatggagaagtatgccctcttcacctatgagagcctgaagaagaccaagtgccgggagtttgtgcccagcagagatgaaattgaggccctgatccaccggcaggagatgaccagcacagtgtactgccacggcggcggcagctgcaagatcaccatcaacagccacaccacagctggggaggtggtggagaagctgatccggggcctggccatggaggacagcaggaacatgtttgccctgtttgagtacaatggacatgtggacaaggccatcgagagcaggacagtggtggctgatgtgctggccaagtttgagaagctggccgccaccagcgaggtgggggacctgccctggaagttctacttcaagctgtactgcttcctggacacagacaacgtgcccaaggacagcgtggagtttgccttcatgtttgagcaggcccatgaagctgtgatccacggccaccacccagcccctgaggagaacctgcaggtgctggccgccctgcggctgcagtacctgcagggcgactacaccctgcatgctgccatcccccccctggaggaggtgtacagcctgcagaggctgaaggcccgcatcagccagagcaccaagaccttcaccccctgtgagcggctggagaagaggaggaccagcttcctggagggcaccctgcggcgctccttcagaacaggctctgtggtgcggcagaaggtggaggaggagcagatgctggacatgtggatcaaggaggaggtgagcagcgcccgggccagcatcatcgacaagtggaggaagttccagggcatgaaccaggagcaggccatggccaagtacatggccctgatcaaggagtggccaggctacggcagcaccctgtttgatgtggagtgcaaggagggcggcttcccccaggagctgtggctgggcgtgtctgcagatgctgtgtctgtgtacaagagaggagagggccggcccctggaggtgttccagtatgagcacatcctgagctttggagcccccctggccaacacctacaagatcgtggtggatgagcgggagctgctgtttgagaccagcgaggtggtggatgtggccaagctgatgaaggcctacatctccatgattgtgaagaagcgctacagcaccaccaggtctgccagcagccagggcagcagcaggtag

SEQ ID NO: 160869 - DNA, 4248 bp, Artificial Sequence; identical to SEQ ID NO: 160868
  Description of Artificial Sequence: Synthetic coding sequence

SEQ ID NO: 160870 - DNA, 4194 bp, Artificial Sequence
  Description of Artificial Sequence: Synthetic coding sequence
atgctggagaccgtgcgcatcaggaaggccggctatgctgtgagaagacccttccaggacttctacaagcgctacaaggtgctgatgaggaacctggccctgcctgaagatgtgcggggcaagtgcaccagcctgctgcagctgtatgatgccagcaacagcgagtggcagctgggcaagaccaaggtgttcctgcgggagagcctggagcagaagctggagaagaggcgggaggaggaggtgtcccatgctgccatggtgatccgggcccacgtgctgggcttcctggccaggaagcagtacaggaaggtgctgtactgtgtggtgatcatccagaagaactaccgggccttcctgctgcggcggcgcttcctgcacctgaagaaggccgccatcgtgttccagaagcagctgcggggccagatcgcccggcgggtgtaccggcagctgctggccgagaagcgggagcaggaggagaagaagaagcaggaggaggaggagaagaagaagcgggaggaggaggagcgggagcgggagcgggagcggcgggaggccgagctgcgggcccagcaggaggaggagaccaggaagcagcaggagctggaggccctgcagaagagccagaaggaggccgagctgacccgggagctggagaagcagaaggagaacaagcaggtggaggagatcctgcggctggagaaggagattgaggacctgcagaggatgaaggagcagcaggagctgagcctgacagaggccagcctgcagaagctgcaggagcggcgggaccaggagctgcggcggctggaggaggaggcctgccgggccgcccaggagttcctggagagcctgaactttgatgaaattgatgaatgtgtgaggaacatcgagaggagcctgtctgtgggcagcgagttcagcagcgagctggccgagagcgcctgtgaggagaagcccaacttcaacttcagccagccctacccagaggaggaggtggatgagggctttgaagcagatgatgatgccttcaaggacagccccaaccccagcgagcacggccacagcgaccagaggaccagcggcatccgcaccagtgatgacagcagcgaggaggacccctacatgaatgacacagtggtgcccaccagccccagcgctgacagcacagtgctgctggcccccagcgtgcaggacagcggcagcctgcacaacagcagcagtggagagagcacctactgcatgccccagaatgctggggacctgcccagcccagatggagactatgactatgaccaggatgattatgaagatggagccatcaccagcggcagctctgtgaccttcagcaacagctatggcagccagtggagcccagactaccgctgcagcgtgggcacctacaacagcagcggggcctaccgcttcagcagcgagggcgcccagagcagctttgaagattctgaagaagattttgacagcagatttgacacagatgatgagctgagctaccgccgggacagcgtgtacagctgtgtgaccctgccctacttccacagcttcctgtacatgaagggcggcctgatgaacagctggaagaggcgctggtgtgtgctgaaggatgagaccttcctgtggttccgcagcaagcaggaggccctgaagcagggctggctgcacaagaagggcggcggcagcagcaccctgagcagaagaaactggaagaagcgctggtttgtgctgcggcagagcaagctgatgtactttgaaaatgacagcgaggagaagctgaagggcaccgtggaggtgaggacagccaaggagatcatcgacaacaccaccaaggaaaatggcatcgacatcatcatggctgacaggaccttccacctgattgctgagagcccagaagatgccagccagtggttctctgtgctgagccaggtgcacgccagcacagaccaggagatccaggagatgcatgatgagcaggccaacccccagaatgctgtgggcaccctggatgtgggcctgattgattctgtgtgtgccagtgacagcccagaccggcccaacagctttgtgatcatcacagccaacagagtgctgcactgcaatgctgacaccccagaggagatgcaccactggatcaccctgctgcagaggagcaagggggacaccagggtggagggccaggagttcatcgtgcggggctggctgcacaaggaggtgaagaacagccccaagatgagcagcctgaagctgaagaagcgctggtttgtgctgacccacaacagcctggactactacaagagcagcgagaagaatgccctgaagctgggcaccctggtgctgaacagcctgtgcagcgtggtgcccccagatgagaagatcttcaaggagaccggctactggaatgtgacagtgtatggcaggaagcactgctaccgcctgtacaccaagctgctgaatgaggccacccgctggagcagcgccatccagaatgtgacagacaccaaggcccccatcgacacccccacccagcagctgatccaggacatcaaggagaactgcctgaacagtgatgtggtggagcagatctacaagaggaaccccatcctgcgctacacccaccaccccctgcacagccccctgctgcccctgccctacggggacatcaacctgaacctgctgaaggacaagggctacaccaccctgcaggatgaggccatcaagatcttcaacagcctgcagcagctggagagcatgtctgaccccatccccatcatccagggcatcctgcagacaggccatgacctgcggcccctgagagatgagctgtactgccagctgatcaagcagaccaacaaggtgccccaccctggctctgtgggcaacctgtacagctggcagatcctgacctgcctgagctgcaccttcctgcccagccggggcatcctgaagtacctgaagttccacctgaagaggatccgggagcagtttcctggcagcgagatggagaagtatgccctcttcacctatgagagcctgaagaagaccaagtgccgggagtttgtgcccagcagagatgaaattgaggccctgatccaccggcaggagatgaccagcacagtgtactgccacggcggcggcagctgcaagatcaccatcaacagccacaccacagctggggaggtggtggagaagctgatccggggcctggccatggaggacagcaggaacatgtttgccctgtttgagtacaatggacatgtggacaaggccatcgagagcaggacagtggtggctgatgtgctggccaagtttgagaagctggccgccaccagcgaggtgggggacctgccctggaagttctacttcaagctgtactgcttcctggacacagacaacgtgcccaaggacagcgtggagtttgccttcatgtttgagcaggcccatgaagctgtgatccacggccaccacccagcccctgaggagaacctgcaggtgctggccgccctgcggctgcagtacctgcagggcgactacaccctgcatgctgccatcccccccctggaggaggtgtacagcctgcagaggctgaaggcccgcatcagccagagcaccaagaccttcaccccctgtgagcggctggagaagaggaggaccagcttcctggagggcaccctgcggcgctccttcagaacaggctctgtggtgcggcagaaggtggaggaggagcagatgctggacatgtggatcaaggaggaggtgagcagcgcccgggccagcatcatcgacaagtggaggaagttccagggcatgaaccaggagcaggccatggccaagtacatggccctgatcaaggagtggccaggctacggcagcaccctgtttgatgtggagtgcaaggagggcggcttcccccaggagctgtggctgggcgtgtctgcagatgctgtgtctgtgtacaagagaggagagggccggcccctggaggtgttccagtatgagcacatcctgagctttggagcccccctggccaacacctacaagatcgtggtggatgagcgggagctgctgtttgagaccagcgaggtggtggatgtggccaagctgatgaaggcctacatctccatgattgtgaagaagcgctacagcaccaccaggtctgccagcagccagggcagcagcaggtag

SEQ ID NO: 160871 - DNA, 6177 bp, Artificial Sequence
  Description of Artificial Sequence: Synthetic coding sequence
atggacaacttcttcacagagggcaccagggtgtggctgagagaaaatggccagcacttccccagcacagtgaacagctgtgccgagggcatcgtggtgttcagaacagattatggccaggtgttcacctacaagcagagcaccatcacccaccagaaggtgacagccatgcaccccaccaatgaggagggcgtggatgacatggccagcctgacagagctgcatggaggcagcatcatgtacaacctcttccagcgctacaagaggaaccagatctacacctacatcggcagcatcctggcctctgtgaacccctaccagcccatcgccggcctgtatgagcccgccaccatggagcagtacagcagaagacacctgggggagctgcccccccacatctttgccatcgccaatgaatgctaccgctgcctgtggaagagacatgacaaccagtgcatcctgatcagcggggagagcggggccggcaagacagagagcaccaagctgatcctgaagttcctgagcgtcatcagccagcagagcctggagctgagcctgaaggagaagaccagctgtgtggagcgggccatcctggagagcagccccatcatggaggcctttggaaatgccaagacagtgtacaacaacaacagcagcagatttgggaagtttgtgcagctgaacatctgccagaagggcaacatccagggcggccgcatcgtggactacctgctggagaagaacagagtggtgcggcagaaccctggagagaggaactaccacatcttctacgccctgctggccggcctggagcacgaggagcgggaggagttctacctgagcaccccagagaactaccactacctgaaccagagcggctgtgtggaggacaagaccatcagtgaccaggagagcttccgggaggtgatcacagccatggatgtgatgcagttcagcaaggaggaggtgcgggaggtgtcccggctgctggccggcatcctgcacctgggcaacatcgagttcatcacagctgggggcgcccaggtgtccttcaagacagccctgggccgctctgctgagctgctgggcctggaccccacccagctgacagatgccctgacccagaggtccatgttcctgcggggggaggagatcctgacccccctgaatgtgcagcaggccgtggacagccgggacagcctggccatggccctgtatgcctgctgctttgagtgggtgatcaagaagatcaacagccgcatcaagggaaatgaagacttcaagagcatcggcatcctggacatcttcggctttgaaaattttgaggtgaaccactttgagcagttcaacatcaactatgccaatgagaagctgcaggagtacttcaacaagcacatcttcagcctggagcagctggagtacagccgggagggcctggtgtgggaggacatcgactggattgacaatggagaatgtctggacctgattgagaagaagctgggcctgctggccctgatcaatgaggagagccacttcccccaggccacagacagcaccctgctggagaagctgcacagccagcacgccaacaaccacttctacgtgaagccccgggtggccgtgaacaactttggagtgaagcactacgccggggaggtgcagtatgatgtgcggggcatcctggagaagaacagagacaccttcagagatgacctgctgaacctgctgcgggagagcagatttgacttcatctatgacctgtttgagcacgtgagcagcaggaacaaccaggacaccctgaagtgtggcagcaagcacagaagacccaccgtgagcagccagttcaaggacagcctgcacagcctgatggccaccctgagcagcagcaaccccttctttgtgcgctgcatcaagcccaacatgcagaagatgccagaccagtttgaccaggccgtggtgctgaaccagctgcgctacagcggcatgctggagaccgtgcgcatcaggaaggccggctatgctgtgcggcggcccttccaggacttctacaagcgctacaaggtgctgatgaggaacctggccctgcctgaagatgtgcggggcaagtgcaccagcctgctgcagctgtatgatgccagcaacagcgagtggcagctgggcaagaccaaggtgttcctgcgggagagcctggagcagaagctggagaagagaagagaggaggaggtgtcccatgctgccatggtgatccgggcccacgtgctgggcttcctggccaggaagcagtacaggaaggtgctgtactgtgtggtgatcatccagaagaactaccgggccttcctgctgcggcggcgcttcctgcacctgaagaaggccgccatcgtgttccagaagcagctgcggggccagatcgccaggagagtgtaccggcagctgctggccgagaagcgggagcaggaggagaagaagaagcaggaggaggaggagaagaagaagcgggaggaggaggagcgggagcgggagcgggagcggcgggaggccgagctgcgggcccagcaggaggaggagaccaggaagcagcaggagctggaggccctgcagaagagccagaaggaggccgagctgacccgggagctggagaagcagaaggagaacaagcaggtggaggagatcctgcggctggagaaggagattgaggacctgcagaggatgaaggagcagcaggagctgagcctgacagaggccagcctgcagaagctgcaggagcggcgggaccaggagctgcggcggctggaggaggaggcctgcagagctgcccaggagttcctggagagcctgaactttgatgaaattgatgaatgtgtgagaaatattgaaagaagcctgtctgtgggcagcgagttcagcagcgagctggccgagagcgcctgtgaggagaagcccaacttcaacttcagccagccctacccagaggaggaggtggatgagggctttgaagcagatgatgatgccttcaaggacagccccaaccccagcgagcacggccacagcgaccagaggaccagcggcatccgcaccagtgatgacagcagcgaggaggacccctacatgaatgacacagtggtgcccaccagccccagcgctgacagcacagtgctgctggcccccagcgtgcaggacagcggcagcctgcacaacagcagcagcggggagagcacctactgcatgccccagaatgctggggacctgcccagcccagatggagactatgactatgaccaggatgattatgaagatggagccatcaccagcggcagctctgtgaccttcagcaacagctatggcagccagtggagcccagactaccgctgcagcgtgggcacctacaacagcagcggggcctaccgcttcagcagcgagggcgcccagagcagctttgaggacagcgaggaggactttgacagcagatttgacacagatgatgagctgagctacagaagagacagcgtgtacagctgtgtgaccctgccctacttccacagcttcctgtacatgaagggcggcctgatgaacagctggaagaggcgctggtgtgtgctgaaggatgagaccttcctgtggttccgcagcaagcaggaggccctgaagcagggctggctgcacaagaagggcggcggcagcagcaccctgagcagaagaaactggaagaagcgctggtttgtgctgcggcagagcaagctgatgtactttgaaaatgattctgaggagaagctgaagggcaccgtggaggtgaggacagccaaggagatcatcgacaacaccaccaaggaaaatggaattgacatcatcatggctgacaggaccttccacctgattgctgagagcccagaagatgccagccagtggttctctgtgctgagccaggtgcacgccagcacagaccaggagatccaggagatgcatgatgagcaggccaacccccagaatgctgtgggcaccctggatgtgggcctgattgacagcgtgtgtgccagtgacagcccagaccggcccaacagctttgtgatcatcacagccaacagagtgctgcactgcaatgctgacaccccagaggagatgcaccactggatcaccctgctgcagaggagcaaaggagacaccagggtggagggccaggagttcatcgtgcggggctggctgcacaaggaggtgaagaacagccccaagatgagcagcctgaagctgaagaagcgctggtttgtgctgacccacaacagcctggactactacaagagcagcgagaagaatgccctgaagctgggcaccctggtgctgaacagcctgtgcagcgtggtgcccccagatgagaagatcttcaaggagaccggctactggaatgtgacagtgtatggcaggaagcactgctaccgcctgtacaccaagctgctgaatgaggccacccgctggagcagcgccatccagaatgtgacagacaccaaggcccccatcgacacccccacccagcagctgatccaggacatcaaggagaactgcctgaacagtgatgtggtggagcagatctacaagaggaaccccatcctgcgctacacccaccaccccctgcacagccccctgctgcccctgccctatggagacatcaacctgaacctgctgaaggacaagggctacaccaccctgcaggatgaggccatcaagatcttcaacagcctgcagcagctggagagcatgtctgaccccatccccatcatccagggcatcctgcagacaggccatgacctgcggcccctgagagatgagctgtactgccagctgatcaagcagaccaacaaggtgccccaccctggctctgtgggcaacctgtacagctggcagatcctgacctgcctgagctgcaccttcctgcccagccggggcatcctgaagtacctgaagttccacctgaagaggatccgggagcagtttcctggcagcgagatggagaagtatgccctcttcacctatgagagcctgaagaagaccaagtgccgggagtttgtgcccagcagagatgaaattgaggccctgatccaccggcaggagatgaccagcacagtgtactgccacggcggcggcagctgcaagatcaccatcaacagccacaccacagctggggaggtggtggagaagctgatccggggcctggccatggaggacagcaggaacatgtttgccctgtttgagtacaacggccacgtggacaaggccatcgagagcaggacagtggtggctgatgtgctggccaagtttgagaagctggccgccaccagcgaggtgggggacctgccctggaagttctacttcaagctgtactgcttcctggacacagacaacgtgcccaaggacagcgtggagtttgccttcatgtttgagcaggcccacgaggccgtcatccacggccaccacccagcccctgaggagaacctgcaggtgctggccgccctgcggctgcagtacctgcagggcgactacaccctgcacgccgccatcccccccctggaggaggtgtacagcctgcagaggctgaaggcccgcatcagccagagcaccaagaccttcaccccctgtgagcggctggagaagaggaggaccagcttcctggagggcaccctgcggcgctccttcagaactggatctgtggtgcggcagaaggtggaggaggagcagatgctggacatgtggatcaaggaggaggtgtcctctgcccgggccagcatcatcgacaagtggaggaagttccagggcatgaaccaggagcaggccatggccaagtacatggccctgatcaaggagtggccaggctacggcagcaccctgtttgatgtggagtgcaaggagggcggcttcccccaggagctgtggctgggcgtgtctgcagatgctgtgtctgtgtacaagagaggagagggccggcccctggaggtgttccagtatgagcacatcctgagctttggagcccccctggccaacacctacaagatcgtggtggatgagcgggagctgctgtttgagaccagcgaggtggtggatgtggccaagctgatgaaggcctacatctccatgattgtgaagaagcgctacagcaccaccaggtctgccagcagccagggcagcagcaggtag

SEQ ID NO: 160872 - DNA, 4194 bp, Artificial Sequence; identical to SEQ ID NO: 160870
  Description of Artificial Sequence: Synthetic coding sequence

SEQ ID NO: 160873 - DNA, 552 bp, Artificial Sequence
  Description of Artificial Sequence: Synthetic coding sequence
atggagaatggagctgtgtacagccccaccacagaagaagatcctggccctgcccggggccccaggagcggcctggccgcctacttcttcatgggccgcctgcccctgctgcggcgggtgctgaagggcctgcagctgctgctgagcctgctggccttcatctgtgaggaggtggtgtcccagtgcaccctgtgtggcggcctgtacttctttgaatttgtgtcctgcagcgccttcctgctgagcctgctgatcctgattgtgtactgcacccccttctatgaaagagtggacaccaccaaggtgaagagcagtgacttctacatcaccctgggcaccggctgtgtgttcctgctggccagcatcatctttgtgtccacccatgacaggaccagcgctgagattgctgccatcgtgtttggcttcatcgccagcttcatgttcctgctggacttcatcaccatgctgtatgagaagaggcaggagagccagctgaggaagccagagaacaccaccagggctgaggccctgacagagcccctgaatgcctag

SEQ ID NO: 160874 - DNA, 1437 bp, Artificial Sequence
  Description of Artificial Sequence: Synthetic coding sequence
atgctggagtttgcccagaagtacttccgggacccccagaggcggccccaggacggcctgcggctgaagagcaaggagccccgggagagcaggaccctggaggacatgctgtgcttcaccaagacccccctgcaggagagcctgattgagctgagtgacagcagcctgagcaagatggccacagacatgttcctggccgtgatgaggttcatgggagatgcccccctgaagggccagagcgacctggatgtgctgtgcaacctgctgaagctgtgtggggaccacgaggtgatgagagatgagtgctactgccaggtggtgaagcagatcacagacaacaccagcagcaagcaggacagctgccagaggggctggaggctgctgtacatcgtgacagcctaccacagctgcagcgaggtgctgcacccccacctgacccgcttcctgcaggatgtgtccaggaccccaggcctgcccttccagggcatcgccaaggcctgtgagcagaacctgcagaagaccctgcgctttggaggccgcctggagctgcccagcagcattgagctgcgggccatgctggccggccgcagcagcaagaggcagctgttcctgctgcccggcggcctggagcggcacctgaagatcaagacctgcaccgtggccctggatgtggtggaggagatctgtgccgagatggccctgaccaggcctgaggccttcaatgaatatgtgatctttgtggtgaccaacagaggccagcacgtgtgccccctgagccggcgggcctacatcctggatgtggccagcgagatggagcaggtggatggcggctacatgctgtggttcagaagagtgctgtgggaccagcccctgaagtttgaaaatgagctgtatgtgaccatgcactacaaccaggtgctgcctgactacctgaagggcctcttcagctctgtgcctgccagccggcccagcgagcagctgctgcagcaggtgtccaagctggccagcctgcagcaccgggccaaggaccacttctacctgcccagcgtgcgggaggtgcaggagtacatcccagcccagctgtaccgcaccacagctggcagcacctggctgaacctggtgtcccagcaccggcagcagacccaggccctgagcccccaccaggcccgggcccagttcctgggcctgctgagcgccctgcccatgtttggcagcagcttcttcttcatccagagctgcagcaacattgctgtgcctgccccctgcatcctggccatcaaccacaacggcctgaacttcctgagcacagagacccacgtgtctggcctgagcctggccctgcccagcccccccagcgtgccctggagccccacccccagcaagaggcccaggcctcctgctgctgaggcccagttccactgcctgccccccagctag

SEQ ID NO: 160875 - DNA, 555 bp, Artificial Sequence
  Description of Artificial Sequence: Synthetic coding sequence
atgaacatgctgagcagcctgagccccaccgtggtgctgcctgactacctgaagggcctcttcagctctgtgcctgccagccggcccagcgagcagctgctgcagcaggtgtccaagctggccagcctgcagcaccgggccaaggaccacttctacctgcccagcgtgcgggaggtgcaggagtacatcccagcccagctgtaccgcaccacagctggcagcacctggctgaacctggtgtcccagcaccggcagcagacccaggccctgagcccccaccaggcccgggcccagttcctgggcctgctgagcgccctgcccatgtttggcagcagcttcttcttcatccagagctgcagcaacattgctgtgcctgccccctgcatcctggccatcaaccacaacggcctgaacttcctgagcacagagacccacgtgtctggcctgagcctggccctgcccagcccccccagcgtgccctggagccccacccccagcaagaggcccaggcctcctgctgctgaggcccagttccactgcctgccccccagctag

SEQ ID NO: 160876 - DNA, 735 bp, Artificial Sequence
  Description of Artificial Sequence: Synthetic coding sequence
atgagagatgagtgctactgccaggtggtgaagcagatcacagacaacaccagcagcaagcaggacagctgccagaggggctggaggctgctgtacatcgtgacagcctaccacagctgcagcgaggtgctgcacccccacctgacccgcttcctgcaggatgtgtccaggaccccaggcctgcccttccagggcatcgccaaggcctgtgagcagaacctgcagaagaccctgcgctttggaggccgcctggagctgcccagcagcattgagctgcgggccatgctggccggccgcagcagcaagaggcagctgttcctgctgcccggcggcctggagcggcacctgaagatcaagacctgcaccgtggccctggatgtggtggaggagatctgtgccgagatggccctgaccaggcctgaggccttcaatgaatatgtgatctttgtggtgaccaacagaggaggcaagagccgcagcaccagccagcccagcagcacagtgcagaggcaggcccggcccggcagcacctggagcgccagcacaggcagccgccacagaagaagtgcccccaccaggcctgtgcccagcttctgggccagcagcgccccctacctgtgcagcgccccacccagcagcagcagcagagctgctgccaccctgctgtgccagcccctggccagcctgcccagcaccaccatggccagcaccttcagcgcccagaggctgatgtag

SEQ ID NO: 160877 - DNA, 429 bp, Artificial Sequence
  Description of Artificial Sequence: Synthetic coding sequence
atggtgaagggcggccaggaggccggcggccagctgcgggtgctgcgggcctacagctttgctgacatcctgtttgtgaccatgcccagccagaacatgctggagttcaacctggccagcgagaaggtgatcctcttcagcgcccgggcccaccaggtgaagaccctggtggatgacttcatcctggagctgaagaaggacagcgactatgtggtggccgtgaggaacttcctgcctgaggaccctgccctgctggccttccacaagggggacatcatccacctgcagcccctggagcccccccgggtgggctacagcgctggctgtgtggtgcggaggaaggtggtgtacctggaggagctgcggcggcggggccctgactttggagtgtgccccaggacctggaaccccatccggggggccagctag

SEQ ID NO: 160878 - DNA, 6165 bp, Artificial Sequence
  Description of Artificial Sequence: Synthetic coding sequence
atgttcaacctgatgaagaaggacaaggacaaggatggcggcaggaaggagaagaaggagaagaaggagaagaaggagaggatgtctgctgctgagctgcggagcctggaggagatgagcctgcggcggggcttcttcaacctgaacagaagcagcaagcgggagagcaagacccggctggagatcagcaaccccatccccatcaaggtggccagcggcagtgacctgcacctgacagacatcgacagcgacagcaacagaggcagcgtcatcctggacagcggccacctgagcacagccagcagcagtgatgacctgaagggggaggagggcagcttccggggctctgtgctgcagagagctgccaagtttggcagcctggccaagcagaacagccagatgattgtgaagcgcttctccttcagccagaggagcagagatgaaagtgccagcgagaccagcaccccatctgagcacagcgctgcccccagcccccaggtggaggtgaggaccctggagggccagctggtgcagcaccctggccctggcatccccaggcctggccacaggagccgggcccctgagctggtgaccaagaagtttcctgtggacctgcggctgccccctgtggtgcccctgcccccacccaccctgcgggagctggagctgcagaggcggcccaccggggactttggcttcagcctgcggaggaccaccatgctggaccggggccctgagggccaggcctgcagaagagtggtgcactttgctgagcctggagctggcaccaaggacctggccctgggcctggtgcctggggaccggctggtggagatcaatggccacaacgtggagagcaagagcagagatgagatcgtggagatgatccggcagagcggggacagcgtgcggctgaaggtgcagcccatccctgagctgtctgagctgagccgctcctggctgcggtctggagagggcccccggcgggagcccagtgatgccaagacagaggagcagattgctgctgaggaggcctggaatgaaacagagaaggtgtggctggtgcacagagatggcttcagcctggccagccagctgaagtctgaggagctgaacctgcctgagggcaaggtgcgggtgaagctggaccatgatggagccatcctggatgtggatgaagatgatgtggagaaggccaatgcccccagctgtgaccggctggaggacctggccagcctggtgtacctgaatgaatcttctgtgctgcacaccctgcggcagagatatggagccagcctgctgcacacctacgccggccccagcctgctggtgctgggccccaggggggccccagctgtgtacagcgagaaggtgatgcacatgttcaagggctgccggcgggaggacatggccccccacatctatgctgtggcccagacagcctaccgggccatgctgatgagccggcaggaccagagcatcatcctgctgggcagcagcggcagcggcaagaccaccagctgccagcacctggtgcagtacctggccaccatcgccggcatcagcggcaacaaggtgttttctgtggagaagtggcaggccctgtacaccctgctggaggccttcggcaacagccccaccatcatcaatggaaatgccacccgcttcagccagatcctgagcctggactttgaccaggccggccaggtggccagcgccagcatccagaccatgctgctggagaagctgcgggtggcccggcggcctgccagcgaggccaccttcaacgtgttctactacctgctggcctgtggagatggcaccctgaggacagagctgcacctgaaccacctggccgagaacaacgtgtttggcatcgtgcccctggccaagccagaggagaagcagaaggccgcccagcagttcagcaagctgcaggccgccatgaaggtgctgggcatcagcccagatgagcagaaggcctgctggttcatcctggccgccatctaccacctgggcgctgctggggccaccaaggtgcacagcacagctggcaggaagcagtttgcccggcatgagtgggcccagaaggccgcctacctgctgggctgcagcctggaggagctgagcagcgccatcttcaagcaccagcacaagggcggcaccctgcagaggagcaccagcttccggcagggccctgaggagagcggcctgggagatggcaccggccccaagctgagcgccctggagtgcctggagggcatggctgctggcctgtacagcgagctgttcaccctgctggtgtccctggtgaacagagccctgaagagcagccagcacagcctgtgcagcatgatgattgtggacaccccaggcttccagaaccctgagcagggcggcagcgcccggggggccagctttgaggagctgtgccacaactacacccaggaccggctgcagaggctcttccacgagaggacctttgtgcaggagctggagcgctacaaggaggagaacatcgagctggcctttgatgacctggagcccccaacagatgacagcgtggccgctgtggaccaggccagccaccagagcctggtgcgcagcctggccaggacagatgaggcccggggcctgctgtggctgctggaggaggaggccctggtgcctggggccagcgaggacaccctgctggagcggctcttctcctactacggcccccaggagggggacaagaagggccagagccccctgctgcacagcagcaagccccaccacttcctgctgggccacagccacggcaccaactgggtggagtacaacgtgacaggctggctgaactacaccaagcagaacccagccacccagaatgccccccggctgctgcaggacagccagaagaagatcatcagcaacctcttcctgggccgggccggcagcgccaccgtgctgagcggcagcattgctggcctggagggcggcagccagctggccctgcggcgggccacctccatgaggaagaccttcaccaccggcatggctgctgtgaagaagaagagcctgtgcatccagatgaagctgcaggtggatgccctgattgacaccatcaagaagagcaagctgcactttgtgcactgcttcctgcctgtggccgagggctgggccggggagcccaggtctgccagcagccggcgggtgagcagcagcagcgagctggacctgcccagcggggaccactgtgaggccggcctgctgcagctggatgtgcccctgctgcggacccagctgcggggcagccggctgctggatgccatgaggatgtaccggcagggctacccagaccacatggtgttttctgagttcagaagaagatttgatgtgctggccccccacctgaccaagaagcacggcaggaactacatcgtggtggatgagcggcgggctgtggaggagctgctggagtgcctggacctggagaagagcagctgctgcatgggcctgagcagggtcttcttccgggccggcaccctggcccggctggaggagcagagagatgagcagaccagcaggaacctgaccctcttccaggccgcctgccggggctacctggcccggcagcacttcaagaagaggaagatccaggacctggccatccgctgtgtgcagaagaacatcaagaagaacaagggcgtgaaggactggccctggtggaagctgttcaccaccgtgcggcccctgattgaggtgcagctgtctgaggagcagatccggaacaaggatgaggagatccagcagctgcggagcaagctggagaaggccgagaaggagagaaatgagctgcggctgaacagcgaccggctggagagccgcatcagcgagctgaccagcgagctgacagatgagaggaacacaggagagagcgccagccagctgctggatgctgagacagctgagcggctgcgggcagagaaggagatgaaggagctgcagacccagtatgatgccctgaagaagcagatggaggtgatggagatggaggtgatggaggcccggctcatccgggctgctgagatcaatggagaggtggatgatgatgatgctggaggagagtggaggctgaagtatgaaagagctgtgcgggaggtggacttcaccaagaagaggctgcagcaggagtttgaggacaagctggaggtggagcagcagaacaagaggcagctggagcggcggctgggggacctgcaggccgacagcgaggagagccagagggccctgcagcagctgaagaagaagtgccagaggctgacagctgagctgcaggacaccaagctgcacctggagggccagcaggtgaggaaccacgagctggagaagaagcagaggagatttgattctgagctgagccaggcccacgaggaggcccagcgggagaagctgcagcgggagaagctgcagcgggagaaggacatgctgctggccgaggccttcagcctgaagcagcagctggaggagaaggacatggacattgctggcttcacccagaaggtggtgtccctggaggccgagctgcaggacatcagcagccaggagagcaaggatgaggccagcctggccaaggtgaagaagcagctgcgggacctggaggccaaggtgaaggaccaggaggaggagctggatgagcaggccggcaccatccagatgctggagcaggccaagctgcggctggagatggagatggagaggatgaggcagacccacagcaaggagatggagagcagagatgaggaggtggaggaggcccggcagagctgccagaagaagctgaagcagatggaggtgcagctggaggaggagtatgaggacaagcagaaggtgctgcgggagaagcgggagctggagggcaagctggccaccctgagtgaccaggtgaacagaagagactttgagagcgagaagaggctgaggaaggacctgaagaggaccaaggccctgctggctgatgcccagctgatgctggaccacctgaagaacagcgcccccagcaagcgggagatcgcccagctgaagaaccagctggaggagagcgagttcacctgtgccgctgctgtgaaggccaggaaggccatggaggtggagattgaggacctgcacctgcagattgatgacatcgccaaggccaagacagccctggaggagcagctgagccggctgcagcgggagaagaatgagatccagaaccggctggaggaggaccaggaggacatgaatgagctgatgaagaagcacaaggctgctgtggcccaggccagccgggacctggcccagatcaatgacctgcaggcccagctggaggaggccaacaaggagaagcaggagctgcaggagaagctgcaggccctgcagagccaggtggagttcctggagcagagcatggtggacaagagcctggtgtcccggcaggaggccaagatccgggagctggagacccggctggagtttgagaggacccaggtgaagaggctggagagcctggccagccggctgaaggagaacatggagaagctgacagaggagcgggaccagagaattgctgctgagaaccgggagaaggagcagaacaagaggctgcagaggcagctgcgggacaccaaggaggagatgggagagctggccaggaaggaggccgaggccagcaggaagaagcatgagctggagatggacctggagagcctggaggccgccaaccagagcctgcaggccgacctgaagctggccttcaagagaattggagacctgcaggccgccattgaagatgagatggagagtgatgaaaatgaagacctgatcaacagcctgcaggacatggtgaccaagtaccagaagaggaagaacaagctggagggggacagtgatgtggacagcgagctggaggacagagtggatggagtgaagtcctggctgagcaagaacaagggccccagcaaggccgccagtgatgatggcagcctgaagagcagcagccccaccagctactggaagagcctggccccagacagaagtgatgatgaacatgaccccctggacaacaccagccggccccgctacagccacagctacctgagtgacagcgacacagaggccaagctgacagagaccaatgcctag

SEQ ID NO: 160879 - DNA, 6009 bp, Artificial Sequence
  Description of Artificial Sequence: Synthetic coding sequence
atgttcaacctgatgaagaaggacaaggacaaggatggcggcaggaaggagaagaaggagaagaaggagaagaaggagaggatgtctgctgctgagctgcggagcctggaggagatgagcctgcggcggggcttcttcaacctgaacagaagcagcaagcgggagagcaagacccggctggagatcagcaaccccatccccatcaaggtggccagcggcagtgacctgcacctgacagacatcgacagcgacagcaacagaggcagcgtcatcctggacagcggccacctgagcacagccagcagcagtgatgacctgaagggggaggagggcagcttccggggctctgtgctgcagagagctgccaagtttggcagcctggccaagcagaacagccagatgattgtgaagcgcttctccttcagccagaggagcagagatgaaagtgccagcgagaccagcaccccatctgagcacagcgctgcccccagcccccaggtggaggtgaggaccctggagggccagctggtgcagcaccctggccctggcatccccaggcctggccacaggagccgggcccctgagctggtgaccaagaagtttcctgtggacctgcggctgccccctgtggtgcccctgcccccacccaccctgcgggagctggagctgcagaggcggcccaccggggactttggcttcagcctgcggaggaccaccatgctggaccggggccctgagggccaggcctgcagaagagtggtgcactttgctgagcctggagctggcaccaaggacctggccctgggcctggtgcctggggaccggctggtggagatcaatggccacaacgtggagagcaagagcagagatgagatcgtggagatgatccggcagagcggggacagcgtgcggctgaaggtgcagcccatccctgagctgtctgagctgagccgctcctggctgcggtctggagagggcccccggcgggagcccagtgatgccaagacagaggagcagattgctgctgaggaggcctggaatgaaacagagaaggtgtggctggtgcacagagatggcttcagcctggccagccagctgaagtctgaggagctgaacctgcctgagggcaaggtgcgggtgaagctggaccatgatggagccatcctggatgtggatgaagatgatgtggagaaggccaatgcccccagctgtgaccggctggaggacctggccagcctggtgtacctgaatgaatcttctgtgctgcacaccctgcggcagagatatggagccagcctgctgcacacctacgccggccccagcctgctggtgctgggccccaggggggccccagctgtgtacagcgagaaggtgatgcacatgttcaagggctgccggcgggaggacatggccccccacatctatgctgtggcccagacagcctaccgggccatgctgatgagccggcaggaccagagcatcatcctgctgggcagcagcggcagcggcaagaccaccagctgccagcacctggtgcagtacctggccaccatcgccggcatcagcggcaacaaggtgttttctgtggagaagtggcaggccctgtacaccctgctggaggccttcggcaacagccccaccatcatcaatggaaatgccacccgcttcagccagatcctgagcctggactttgaccaggccggccaggtggccagcgccagcatccagaccatgctgctggagaagctgcgggtggcccggcggcctgccagcgaggccaccttcaacgtgttctactacctgctggcctgtggagatggcaccctgaggacagagctgcacctgaaccacctggccgagaacaacgtgtttggcatcgtgcccctggccaagccagaggagaagcagaaggccgcccagcagttcagcaagctgcaggccgccatgaaggtgctgggcatcagcccagatgagcagaaggcctgctggttcatcctggccgccatctaccacctgggcgctgctggggccaccaaggtgcacagcacagctggcaggaagcagtttgcccggcatgagtgggcccagaaggccgcctacctgctgggctgcagcctggaggagctgagcagcgccatcttcaagcaccagcacaagggcggcaccctgcagaggagcaccagcttccggcagggccctgaggagagcggcctgggagatggcaccggccccaagctgagcgccctggagtgcctggagggcatggctgctggcctgtacagcgagctgttcaccctgctggtgtccctggtgaacagagccctgaagagcagccagcacagcctgtgcagcatgatgattgtggacaccccaggcttccagaaccctgagcagggcggcagcgcccggggggccagctttgaggagctgtgccacaactacacccaggaccggctgcagaggctcttccacgagaggacctttgtgcaggagctggagcgctacaaggaggagaacatcgagctggcctttgatgacctggagcccccaacagatgacagcgtggccgctgtggaccaggccagccaccagagcctggtgcgcagcctggccaggacagatgaggcccggggcctgctgtggctgctggaggaggaggccctggtgcctggggccagcgaggacaccctgctggagcggctcttctcctactacggcccccaggagggggacaagaagggccagagccccctgctgcacagcagcaagccccaccacttcctgctgggccacagccacggcaccaactgggtggagtacaacgtgacaggctggctgaactacaccaagcagaacccagccacccagaatgccccccggctgctgcaggacagccagaagaagatcatcagcaacctcttcctgggccgggccggcagcgccaccgtgctgagcggcagcattgctggcctggagggcggcagccagctggccctgcggcgggccacctccatgaggaagaccttcaccaccggcatggctgctgtgaagaagaagagcctgtgcatccagatgaagctgcaggtggatgccctgattgacaccatcaagaagagcaagctgcactttgtgcactgcttcctgcctgtggccgagggctgggccggggagcccaggtctgccagcagccggcgggtgagcagcagcagcgagctggacctgcccagcggggaccactgtgaggccggcctgctgcagctggatgtgcccctgctgcggacccagctgcggggcagccggctgctggatgccatgaggatgtaccggcagggctacccagaccacatggtgttttctgagttcagaagaagatttgatgtgctggccccccacctgaccaagaagcacggcaggaactacatcgtggtggatgagcggcgggctgtggaggagctgctggagtgcctggacctggagaagagcagctgctgcatgggcctgagcagggtcttcttccgggccggcaccctggcccggctggaggagcagagagatgagcagaccagcaggaacctgaccctcttccaggccgcctgccggggctacctggcccggcagcacttcaagaagaggaagatccaggacctggccatccgctgtgtgcagaagaacatcaagaagaacaagggcgtgaaggactggccctggtggaagctgttcaccaccgtgcggcccctgattgaggtgcagctgtctgaggagcagatccggaacaaggatgaggagatccagcagctgcggagcaagctggagaaggccgagaaggagagaaatgagctgcggctgaacagcgaccggctggagagccgcatcagcgagctgaccagcgagctgacagatgagaggaacacaggagagagcgccagccagctgctggatgctgagacagctgagcggctgcgggcagagaaggagatgaaggagctgcagacccagtatgatgccctgaagaagcagatggaggtgatggagatggaggtgatggaggcccggctcatccgggctgctgagatcaatggagaggtggatgatgatgatgctggaggagagtggaggctgaagtatgaaagagctgtgcgggaggtggacttcaccaagaagaggctgcagcaggagtttgaggacaagctggaggtggagcagcagaacaagaggcagctggagcggcggctgggggacctgcaggccgacagcgaggagagccagagggccctgcagcagctgaagaagaagtgccagaggctgacagctgagctgcaggacaccaagctgcacctggagggccagcaggtgaggaaccacgagctggagaagaagcagaggagatttgattctgagctgagccaggcccacgaggaggcccagcgggagaagctgcagcgggagaagctgcagcgggagaaggacatgctgctggccgaggccttcagcctgaagcagcagctggaggagaaggacatggacattgctggcttcacccagaaggtggtgtccctggaggccgagctgcaggacatcagcagccaggagagcaaggatgaggccagcctggccaaggtgaagaagcagctgcgggacctggaggccaaggtgaaggaccaggaggaggagctggatgagcaggccggcaccatccagatgctggagcagctgaagcagatggaggtgcagctggaggaggagtatgaggacaagcagaaggtgctgcgggagaagcgggagctggagggcaagctggccaccctgagtgaccaggtgaacagaagagactttgaaagtgagaagaggctgaggaaggacctgaagaggaccaaggccctgctggctgatgcccagctgatgctggaccacctgaagaacagcgcccccagcaagcgggagatcgcccagctgaagaaccagctggaggagagcgagttcacctgtgccgctgctgtgaaggccaggaaggccatggaggtggagattgaggacctgcacctgcagattgatgacatcgccaaggccaagacagccctggaggagcagctgagccggctgcagcgggagaagaatgagatccagaaccggctggaggaggaccaggaggacatgaatgagctgatgaagaagcacaaggctgctgtggcccaggccagccgggacctggcccagatcaatgacctgcaggcccagctggaggaggccaacaaggagaagcaggagctgcaggagaagctgcaggccctgcagagccaggtggagttcctggagcagagcatggtggacaagagcctggtgtcccggcaggaggccaagatccgggagctggagacccggctggagtttgagaggacccaggtgaagaggctggagagcctggccagccggctgaaggagaacatggagaagctgacagaggagcgggaccagagaattgctgctgaaaatcgggagaaggagcagaacaagaggctgcagaggcagctgcgggacaccaaggaggagatgggagagctggccaggaaggaggccgaggccagcaggaagaagcatgagctggagatggacctggagagcctggaggccgccaaccagagcctgcaggccgacctgaagctggccttcaagagaattggagacctgcaggccgccattgaagatgagatggagagtgatgaaaatgaagatctcatcaacagcgagggggacagtgatgtggacagcgagctggaggacagagtggatggagtgaagtcctggctgagcaagaacaagggccccagcaaggccgccagtgatgatggcagcctgaagagcagcagccccaccagctactggaagagcctggccccagacagaagtgatgatgaacatgaccccctggacaacaccagccggccccgctacagccacagctacctgagtgacagcgacacagaggccaagctgacagagaccaatgcctag

SEQ ID NO: 160880 - DNA, 4929 bp, Artificial Sequence
  Description of Artificial Sequence: Synthetic coding sequence
atggagggccccaggaccaccaagctggagggcagcagcaaggagggcagcggccccagccgcagcccccagccccccaccagccccatccccccagagaccagccagagggcccggagccctgcccccaccctggccatgaatggacctggggccgccacagctgagggcctgtctgaggaggccccagctgtgtacagcgagaaggtgatgcacatgttcaagggctgccggcgggaggacatggccccccacatctatgctgtggcccagacagcctaccgggccatgctgatgagccggcaggaccagagcatcatcctgctgggcagcagcggcagcggcaagaccaccagctgccagcacctggtgcagtacctggccaccatcgccggcatcagcggcaacaaggtgttttctgtggagaagtggcaggccctgtacaccctgctggaggccttcggcaacagccccaccatcatcaatggaaatgccacccgcttcagccagatcctgagcctggactttgaccaggccggccaggtggccagcgccagcatccagaccatgctgctggagaagctgcgggtggcccggcggcctgccagcgaggccaccttcaacgtgttctactacctgctggcctgtggagatggcaccctgaggacagagctgcacctgaaccacctggccgagaacaacgtgtttggcatcgtgcccctggccaagccagaggagaagcagaaggccgcccagcagttcagcaagctgcaggccgccatgaaggtgctgggcatcagcccagatgagcagaaggcctgctggttcatcctggccgccatctaccacctgggcgctgctggggccaccaaggaggccgctgaggccggcaggaagcagtttgcccggcatgagtgggcccagaaggccgcctacctgctgggctgcagcctggaggagctgagcagcgccatcttcaagcaccagcacaagggcggcaccctgcagaggagcaccagcttccggcagggccctgaggagagcggcctgggagatggcaccggccccaagctgagcgccctggagtgcctggagggcatggctgctggcctgtacagcgagctgttcaccctgctggtgtccctggtgaacagagccctgaagagcagccagcacagcctgtgcagcatgatgattgtggacaccccaggcttccagaaccctgagcagggcggcagcgcccggggggccagctttgaggagctgtgccacaactacacccaggaccggctgcagaggctcttccacgagaggacctttgtgcaggagctggagcgctacaaggaggagaacatcgagctggcctttgatgacctggagcccccaacagatgacagcgtggccgctgtggaccaggccagccaccagagcctggtgcgcagcctggccaggacagatgaggcccggggcctgctgtggctgctggaggaggaggccctggtgcctggggccagcgaggacaccctgctggagcggctcttctcctactacggcccccaggagggggacaagaagggccagagccccctgctgcacagcagcaagccccaccacttcctgctgggccacagccacggcaccaactgggtggagtacaacgtgacaggctggctgaactacaccaagcagaacccagccacccagaatgccccccggctgctgcaggacagccagaagaagatcatcagcaacctcttcctgggccgggccggcagcgccaccgtgctgagcggcagcattgctggcctggagggcggcagccagctggccctgcggcgggccacctccatgaggaagaccttcaccaccggcatggctgctgtgaagaagaagagcctgtgcatccagatgaagctgcaggtggatgccctgattgacaccatcaagaagagcaagctgcactttgtgcactgcttcctgcctgtggccgagggctgggccggggagcccaggtctgccagcagccggcgggtgagcagcagcagcgagctggacctgcccagcggggaccactgtgaggccggcctgctgcagctggatgtgcccctgctgcggacccagctgcggggcagccggctgctggatgccatgaggatgtaccggcagggctacccagaccacatggtgttttctgagttcagaagaagatttgatgtgctggccccccacctgaccaagaagcacggcaggaactacatcgtggtggatgagcggcgggctgtggaggagctgctggagtgcctggacctggagaagagcagctgctgcatgggcctgagcagggtcttcttccgggccggcaccctggcccggctggaggagcagagagatgagcagaccagcaggaacctgaccctcttccaggccgcctgccggggctacctggcccggcagcacttcaagaagaggaagatccaggacctggccatccgctgtgtgcagaagaacatcaagaagaacaagggcgtgaaggactggccctggtggaagctgttcaccaccgtgcggcccctgattgaggtgcagctgtctgaggagcagatccggaacaaggatgaggagatccagcagctgcggagcaagctggagaaggccgagaaggagagaaatgagctgcggctgaacagcgaccggctggagagccgcatcagcgagctgaccagcgagctgacagatgagaggaacacaggagagagcgccagccagctgctggatgctgagacagctgagcggctgcgggcagagaaggagatgaaggagctgcagacccagtatgatgccctgaagaagcagatggaggtgatggagatggaggtgatggaggcccggctcatccgggctgctgagatcaatggagaggtggatgatgatgatgctggaggagagtggaggctgaagtatgaaagagctgtgcgggaggtggacttcaccaagaagaggctgcagcaggagtttgaggacaagctggaggtggagcagcagaacaagaggcagctggagcggcggctgggggacctgcaggccgacagcgaggagagccagagggccctgcagcagctgaagaagaagtgccagaggctgacagctgagctgcaggacaccaagctgcacctggagggccagcaggtgaggaaccacgagctggagaagaagcagaggagatttgattctgagctgagccaggcccacgaggaggcccagcgggagaagctgcagcgggagaagctgcagcgggagaaggacatgctgctggccgaggccttcagcctgaagcagcagctggaggagaaggacatggacattgctggcttcacccagaaggtggtgtccctggaggccgagctgcaggacatcagcagccaggagagcaaggatgaggccagcctggccaaggtgaagaagcagctgcgggacctggaggccaaggtgaaggaccaggaggaggagctggatgagcaggccaagctgcggctggagatggagatggagaggatgaggcagacccacagcaaggagatggagagcagagatgaggaggtggaggaggcccggcagagctgccagaagaagctgaagcagatggaggtgcagctggaggaggagtatgaggacaagcagaaggtgctgcgggagaagcgggagctggagggcaagctggccaccctgagtgaccaggtgaacagaagagactttgaaagtgagaagaggctgaggaaggacctgaagaggaccaaggccctgctggctgatgcccagctgatgctggaccacctgaagaacagcgcccccagcaagcgggagatcgcccagctgaagaaccagctggaggagagcgagttcacctgtgccgctgctgtgaaggccaggaaggccatggaggtggagattgaggacctgcacctgcagattgatgacatcgccaaggccaagacagccctggaggagcagctgagccggctgcagcgggagaagaatgagatccagaaccggctggaggaggaccaggaggacatgaatgagctgatgaagaagcacaaggctgctgtggcccaggccagccgggacctggcccagatcaatgacctgcaggcccagctggaggaggccaacaaggagaagcaggagctgcaggagaagctgcaggccctgcagagccaggtggagttcctggagcagagcatggtggacaagagcctggtgtcccggcaggaggccaagatccgggagctggagacccggctggagtttgagaggacccaggtgaagaggctggagagcctggccagccggctgaaggagaacatggagaagctgacagaggagcgggaccagagaattgctgctgaaaatcgggagaaggagcagaacaagaggctgcagaggcagctgcgggacaccaaggaggagatgggagagctggccaggaaggaggccgaggccagcaggaagaagcatgagctggagatggacctggagagcctggaggccgccaaccagagcctgcaggccgacctgaagctggccttcaagagaattggagacctgcaggccgccattgaagatgagatggagagtgatgaaaatgaagatctcatcaacagcgagggggacagtgatgtggacagcgagctggaggacagagtggatggagtgaagtcctggctgagcaagaacaagggccccagcaaggccgccagtgatgatggcagcctgaagagcagcagccccaccagctactggaagagcctggccccagacagaagtgatgatgaacatgaccccctggacaacaccagccggccccgctacagccacagctacctgagtgacagcgacacagaggccaagctgacagagaccaatgcctag

SEQ ID NO: 160881 - DNA, 6165 bp, Artificial Sequence
  Description of Artificial Sequence: Synthetic coding sequence
atgttcaacctgatgaagaaggacaaggacaaggatggcggcaggaaggagaagaaggagaagaaggagaagaaggagaggatgtctgctgctgagctgcggagcctggaggagatgagcctgcggcggggcttcttcaacctgaacagaagcagcaagcgggagagcaagacccggctggagatcagcaaccccatccccatcaaggtggccagcggcagtgacctgcacctgacagacatcgacagcgacagcaacagaggcagcgtcatcctggacagcggccacctgagcacagccagcagcagtgatgacctgaagggggaggagggcagcttccggggctctgtgctgcagagagctgccaagtttggcagcctggccaagcagaacagccagatgattgtgaagcgcttctccttcagccagaggagcagagatgaaagtgccagcgagaccagcaccccatctgagcacagcgctgcccccagcccccaggtggaggtgaggaccctggagggccagctggtgcagcaccctggccctggcatccccaggcctggccacaggagccgggcccctgagctggtgaccaagaagtttcctgtggacctgcggctgccccctgtggtgcccctgcccccacccaccctgcgggagctggagctgcagaggcggcccaccggggactttggcttcagcctgcggaggaccaccatgctggaccggggccctgagggccaggcctgcagaagagtggtgcactttgctgagcctggagctggcaccaaggacctggccctgggcctggtgcctggggaccggctggtggagatcaatggccacaacgtggagagcaagagcagagatgagatcgtggagatgatccggcagagcggggacagcgtgcggctgaaggtgcagcccatccctgagctgtctgagctgagccgctcctggctgcggtctggagagggcccccggcgggagcccagtgatgccaagacagaggagcagattgctgctgaggaggcctggaatgaaacagagaaggtgtggctggtgcacagagatggcttcagcctggccagccagctgaagtctgaggagctgaacctgcctgagggcaaggtgcgggtgaagctggaccatgatggagccatcctggatgtggatgaagatgatgtggagaaggccaatgcccccagctgtgaccggctggaggacctggccagcctggtgtacctgaatgaatcttctgtgctgcacaccctgcggcagagatatggagccagcctgctgcacacctacgccggccccagcctgctggtgctgggccccaggggggccccagctgtgtacagcgagaaggtgatgcacatgttcaagggctgccggcgggaggacatggccccccacatctatgctgtggcccagacagcctaccgggccatgctgatgagccggcaggaccagagcatcatcctgctgggcagcagcggcagcggcaagaccaccagctgccagcacctggtgcagtacctggccaccatcgccggcatcagcggcaacaaggtgttttctgtggagaagtggcaggccctgtacaccctgctggaggccttcggcaacagccccaccatcatcaatggaaatgccacccgcttcagccagatcctgagcctggactttgaccaggccggccaggtggccagcgccagcatccagaccatgctgctggagaagctgcgggtggcccggcggcctgccagcgaggccaccttcaacgtgttctactacctgctggcctgtggagatggcaccctgaggacagagctgcacctgaaccacctggccgagaacaacgtgtttggcatcgtgcccctggccaagccagaggagaagcagaaggccgcccagcagttcagcaagctgcaggccgccatgaaggtgctgggcatcagcccagatgagcagaaggcctgctggttcatcctggccgccatctaccacctgggcgctgctggggccaccaaggaggccgctgaggccggcaggaagcagtttgcccggcatgagtgggcccagaaggccgcctacctgctgggctgcagcctggaggagctgagcagcgccatcttcaagcaccagcacaagggcggcaccctgcagaggagcaccagcttccggcagggccctgaggagagcggcctgggagatggcaccggccccaagctgagcgccctggagtgcctggagggcatggctgctggcctgtacagcgagctgttcaccctgctggtgtccctggtgaacagagccctgaagagcagccagcacagcctgtgcagcatgatgattgtggacaccccaggcttccagaaccctgagcagggcggcagcgcccggggggccagctttgaggagctgtgccacaactacacccaggaccggctgcagaggctcttccacgagaggacctttgtgcaggagctggagcgctacaaggaggagaacatcgagctggcctttgatgacctggagcccccaacagatgacagcgtggccgctgtggaccaggccagccaccagagcctggtgcgcagcctggccaggacagatgaggcccggggcctgctgtggctgctggaggaggaggccctggtgcctggggccagcgaggacaccctgctggagcggctcttctcctactacggcccccaggagggggacaagaagggccagagccccctgctgcacagcagcaagccccaccacttcctgctgggccacagccacggcaccaactgggtggagtacaacgtgacaggctggctgaactacaccaagcagaacccagccacccagaatgccccccggctgctgcaggacagccagaagaagatcatcagcaacctcttcctgggccgggccggcagcgccaccgtgctgagcggcagcattgctggcctggagggcggcagccagctggccctgcggcgggccacctccatgaggaagaccttcaccaccggcatggctgctgtgaagaagaagagcctgtgcatccagatgaagctgcaggtggatgccctgattgacaccatcaagaagagcaagctgcactttgtgcactgcttcctgcctgtggccgagggctgggccggggagcccaggtctgccagcagccggcgggtgagcagcagcagcgagctggacctgcccagcggggaccactgtgaggccggcctgctgcagctggatgtgcccctgctgcggacccagctgcggggcagccggctgctggatgccatgaggatgtaccggcagggctacccagaccacatggtgttttctgagttcagaagaagatttgatgtgctggccccccacctgaccaagaagcacggcaggaactacatcgtggtggatgagcggcgggctgtggaggagctgctggagtgcctggacctggagaagagcagctgctgcatgggcctgagcagggtcttcttccgggccggcaccctggcccggctggaggagcagagagatgagcagaccagcaggaacctgaccctcttccaggccgcctgccggggctacctggcccggcagcacttcaagaagaggaagatccaggacctggccatccgctgtgtgcagaagaacatcaagaagaacaagggcgtgaaggactggccctggtggaagctgttcaccaccgtgcggcccctgattgaggtgcagctgtctgaggagcagatccggaacaaggatgaggagatccagcagctgcggagcaagctggagaaggccgagaaggagagaaatgagctgcggctgaacagcgaccggctggagagccgcatcagcgagctgaccagcgagctgacagatgagaggaacacaggagagagcgccagccagctgctggatgctgagacagctgagcggctgcgggcagagaaggagatgaaggagctgcagacccagtatgatgccctgaagaagcagatggaggtgatggagatggaggtgatggaggcccggctcatccgggctgctgagatcaatggagaggtggatgatgatgatgctggaggagagtggaggctgaagtatgaaagagctgtgcgggaggtggacttcaccaagaagaggctgcagcaggagtttgaggacaagctggaggtggagcagcagaacaagaggcagctggagcggcggctgggggacctgcaggccgacagcgaggagagccagagggccctgcagcagctgaagaagaagtgccagaggctgacagctgagctgcaggacaccaagctgcacctggagggccagcaggtgaggaaccacgagctggagaagaagcagaggagatttgattctgagctgagccaggcccacgaggaggcccagcgggagaagctgcagcgggagaagctgcagcgggagaaggacatgctgctggccgaggccttcagcctgaagcagcagctggaggagaaggacatggacattgctggcttcacccagaaggtggtgtccctggaggccgagctgcaggacatcagcagccaggagagcaaggatgaggccagcctggccaaggtgaagaagcagctgcgggacctggaggccaaggtgaaggaccaggaggaggagctggatgagcaggccggcaccatccagatgctggagcaggccaagctgcggctggagatggagatggagaggatgaggcagacccacagcaaggagatggagagcagagatgaggaggtggaggaggcccggcagagctgccagaagaagctgaagcagatggaggtgcagctggaggaggagtatgaggacaagcagaaggtgctgcgggagaagcgggagctggagggcaagctggccaccctgagtgaccaggtgaacagaagagactttgagagcgagaagaggctgaggaaggacctgaagaggaccaaggccctgctggctgatgcccagctgatgctggaccacctgaagaacagcgcccccagcaagcgggagatcgcccagctgaagaaccagctggaggagagcgagttcacctgtgccgctgctgtgaaggccaggaaggccatggaggtggagattgaggacctgcacctgcagattgatgacatcgccaaggccaagacagccctggaggagcagctgagccggctgcagcgggagaagaatgagatccagaaccggctggaggaggaccaggaggacatgaatgagctgatgaagaagcacaaggctgctgtggcccaggccagccgggacctggcccagatcaatgacctgcaggcccagctggaggaggccaacaaggagaagcaggagctgcaggagaagctgcaggccctgcagagccaggtggagttcctggagcagagcatggtggacaagagcctggtgtcccggcaggaggccaagatccgggagctggagacccggctggagtttgagaggacccaggtgaagaggctggagagcctggccagccggctgaaggagaacatggagaagctgacagaggagcgggaccagagaattgctgctgagaaccgggagaaggagcagaacaagaggctgcagaggcagctgcgggacaccaaggaggagatgggagagctggccaggaaggaggccgaggccagcaggaagaagcatgagctggagatggacctggagagcctggaggccgccaaccagagcctgcaggccgacctgaagctggccttcaagagaattggagacctgcaggccgccattgaagatgagatggagagtgatgaaaatgaagacctgatcaacagcctgcaggacatggtgaccaagtaccagaagaggaagaacaagctggagggggacagtgatgtggacagcgagctggaggacagagtggatggagtgaagtcctggctgagcaagaacaagggccccagcaaggccgccagtgatgatggcagcctgaagagcagcagccccaccagctactggaagagcctggccccagacagaagtgatgatgaacatgaccccctggacaacaccagccggccccgctacagccacagctacctgagtgacagcgacacagaggccaagctgacagagaccaatgcctag

SEQ ID NO: 160882 - DNA, 2808 bp, Artificial Sequence
  Description of Artificial Sequence: Synthetic coding sequence
atgaggatgtaccggcagggctacccagaccacatggtgttttctgagttcagaagaagatttgatgtgctggccccccacctgaccaagaagcacggcaggaactacatcgtggtggatgagcggcgggctgtggaggagctgctggagtgcctggacctggagaagagcagctgctgcatgggcctgagcagggtcttcttccgggccggcaccctggcccggctggaggagcagagagatgagcagaccagcaggaacctgaccctcttccaggccgcctgccggggctacctggcccggcagcacttcaagaagaggaagatccaggacctggccatccgctgtgtgcagaagaacatcaagaagaacaagggcgtgaaggactggccctggtggaagctgttcaccaccgtgcggcccctgattgaggtgcagctgtctgaggagcagatccggaacaaggatgaggagatccagcagctgcggagcaagctggagaaggccgagaaggagagaaatgagctgcggctgaacagcgaccggctggagagccgcatcagcgagctgaccagcgagctgacagatgagaggaacacaggagagagcgccagccagctgctggatgctgagacagctgagcggctgcgggcagagaaggagatgaaggagctgcagacccagtatgatgccctgaagaagcagatggaggtgatggagatggaggtgatggaggcccggctcatccgggctgctgagatcaatggagaggtggatgatgatgatgctggaggagagtggaggctgaagtatgaaagagctgtgcgggaggtggacttcaccaagaagaggctgcagcaggagtttgaggacaagctggaggtggagcagcagaacaagaggcagctggagcggcggctgggggacctgcaggccgacagcgaggagagccagagggccctgcagcagctgaagaagaagtgccagaggctgacagctgagctgcaggacaccaagctgcacctggagggccagcaggtgaggaaccacgagctggagaagaagcagaggagatttgattctgagctgagccaggcccacgaggaggcccagcgggagaagctgcagcgggagaagctgcagcgggagaaggacatgctgctggccgaggccttcagcctgaagcagcagctggaggagaaggacatggacattgctggcttcacccagaaggtggtgtccctggaggccgagctgcaggacatcagcagccaggagagcaaggatgaggccagcctggccaaggtgaagaagcagctgcgggacctggaggccaaggtgaaggaccaggaggaggagctggatgagcaggccggcaccatccagatgctggagcaggccaagctgcggctggagatggagatggagaggatgaggcagacccacagcaaggagatggagagcagagatgaggaggtggaggaggcccggcagagctgccagaagaagctgaagcagatggaggtgcagctggaggaggagtatgaggacaagcagaaggtgctgcgggagaagcgggagctggagggcaagctggccaccctgagtgaccaggtgaacagaagagactttgagagcgagaagaggctgaggaaggacctgaagaggaccaaggccctgctggctgatgcccagctgatgctggaccacctgaagaacagcgcccccagcaagcgggagatcgcccagctgaagaaccagctggaggagagcgagttcacctgtgccgctgctgtgaaggccaggaaggccatggaggtggagattgaggacctgcacctgcagattgatgacatcgccaaggccaagacagccctggaggagcagctgagccggctgcagcgggagaagaatgagatccagaaccggctggaggaggaccaggaggacatgaatgagctgatgaagaagcacaaggctgctgtggcccaggccagccgggacctggcccagatcaatgacctgcaggcccagctggaggaggccaacaaggagaagcaggagctgcaggagaagctgcaggccctgcagagccaggtggagttcctggagcagagcatggtggacaagagcctggtgtcccggcaggaggccaagatccgggagctggagacccggctggagtttgagaggacccaggtgaagaggctggagagcctggccagccggctgaaggagaacatggagaagctgacagaggagcgggaccagagaattgctgctgagaaccgggagaaggagcagaacaagaggctgcagaggcagctgcgggacaccaaggaggagatgggagagctggccaggaaggaggccgaggccagcaggaagaagcatgagctggagatggacctggagagcctggaggccgccaaccagagcctgcaggccgacctgaagctggccttcaagagaattggagacctgcaggccgccattgaagatgagatggagagtgatgaaaatgaagacctgatcaacagcgagggggacagtgatgtggacagcgagctggaggacagagtggatggagtgaagtcctggctgagcaagaacaagggccccagcaaggccgccagtgatgatggcagcctgaagagcagcagccccaccagctactggaagagcctggccccagacagaagtgatgatgaacatgaccccctggacaacaccagccggccccgctacagccacagctacctgagtgacagcgacacagaggccaagctgacagagaccaatgcctag

SEQ ID NO: 160883 - DNA, 6120 bp, Artificial Sequence
  Description of Artificial Sequence: Synthetic coding sequence
atgttcaacctgatgaagaaggacaaggacaaggatggcggcaggaaggagaagaaggagaagaaggagaagaaggagaggatgtctgctgctgagctgcggagcctggaggagatgagcctgcggcggggcttcttcaacctgaacagaagcagcaagcgggagagcaagacccggctggagatcagcaaccccatccccatcaaggtggccagcggcagtgacctgcacctgacagacatcgacagcgacagcaacagaggcagcgtcatcctggacagcggccacctgagcacagccagcagcagtgatgacctgaagggggaggagggcagcttccggggctctgtgctgcagagagctgccaagtttggcagcctggccaagcagaacagccagatgattgtgaagcgcttctccttcagccagaggagcagagatgaaagtgccagcgagaccagcaccccatctgagcacagcgctgcccccagcccccaggtggaggtgaggaccctggagggccagctggtgcagcaccctggccctggcatccccaggcctggccacaggagccgggcccctgagctggtgaccaagaagtttcctgtggacctgcggctgccccctgtggtgcccctgcccccacccaccctgcgggagctggagctgcagaggcggcccaccggggactttggcttcagcctgcggaggaccaccatgctggaccggggccctgagggccaggcctgcagaagagtggtgcactttgctgagcctggagctggcaccaaggacctggccctgggcctggtgcctggggaccggctggtggagatcaatggccacaacgtggagagcaagagcagagatgagatcgtggagatgatccggcagagcggggacagcgtgcggctgaaggtgcagcccatccctgagctgtctgagctgagccgctcctggctgcggtctggagagggcccccggcgggagcccagtgatgccaagacagaggagcagattgctgctgaggaggcctggaatgaaacagagaaggtgtggctggtgcacagagatggcttcagcctggccagccagctgaagtctgaggagctgaacctgcctgagggcaaggtgcgggtgaagctggaccatgatggagccatcctggatgtggatgaagatgatgtggagaaggccaatgcccccagctgtgaccggctggaggacctggccagcctggtgtacctgaatgaatcttctgtgctgcacaccctgcggcagagatatggagccagcctgctgcacacctacgccggccccagcctgctggtgctgggccccaggggggccccagctgtgtacagcgagaaggtgatgcacatgttcaagggctgccggcgggaggacatggccccccacatctatgctgtggcccagacagcctaccgggccatgctgatgagccggcaggaccagagcatcatcctgctgggcagcagcggcagcggcaagaccaccagctgccagcacctggtgcagtacctggccaccatcgccggcatcagcggcaacaaggtgttttctgtggagaagtggcaggccctgtacaccctgctggaggccttcggcaacagccccaccatcatcaatggaaatgccacccgcttcagccagatcctgagcctggactttgaccaggccggccaggtggccagcgccagcatccagaccatgctgctggagaagctgcgggtggcccggcggcctgccagcgaggccaccttcaacgtgttctactacctgctggcctgtggagatggcaccctgaggacagagctgcacctgaaccacctggccgagaacaacgtgtttggcatcgtgcccctggccaagccagaggagaagcagaaggccgcccagcagttcagcaagctgcaggccgccatgaaggtgctgggcatcagcccagatgagcagaaggcctgctggttcatcctggccgccatctaccacctgggcgctgctggggccaccaaggaggccgctgaggccggcaggaagcagtttgcccggcatgagtgggcccagaaggccgcctacctgctgggctgcagcctggaggagctgagcagcgccatcttcaagcaccagcacaagggcggcaccctgcagaggagcaccagcttccggcagggccctgaggagagcggcctgggagatggcaccggccccaagctgagcgccctggagtgcctggagggcatggctgctggcctgtacagcgagctgttcaccctgctggtgtccctggtgaacagagccctgaagagcagccagcacagcctgtgcagcatgatgattgtggacaccccaggcttccagaaccctgagcagggcggcagcgcccggggggccagctttgaggagctgtgccacaactacacccaggaccggctgcagaggctcttccacgagaggacctttgtgcaggagctggagcgctacaaggaggagaacatcgagctggcctttgatgacctggagcccccaacagatgacagcgtggccgctgtggaccaggccagccaccagagcctggtgcgcagcctggccaggacagatgaggcccggggcctgctgtggctgctggaggaggaggccctggtgcctggggccagcgaggacaccctgctggagcggctcttctcctactacggcccccaggagggggacaagaagggccagagccccctgctgcacagcagcaagccccaccacttcctgctgggccacagccacggcaccaactgggtggagtacaacgtgacaggctggctgaactacaccaagcagaacccagccacccagaatgccccccggctgctgcaggacagccagaagaagatcatcagcaacctcttcctgggccgggccggcagcgccaccgtgctgagcggcagcattgctggcctggagggcggcagccagctggccctgcggcgggccacctccatgaggaagaccttcaccaccggcatggctgctgtgaagaagaagagcctgtgcatccagatgaagctgcaggtggatgccctgattgacaccatcaagaagagcaagctgcactttgtgcactgcttcctgcctgtggccgagggctgggccggggagcccaggtctgccagcagccggcgggtgagcagcagcagcgagctggacctgcccagcggggaccactgtgaggccggcctgctgcagctggatgtgcccctgctgcggacccagctgcggggcagccggctgctggatgccatgaggatgtaccggcagggctacccagaccacatggtgttttctgagttcagaagaagatttgatgtgctggccccccacctgaccaagaagcacggcaggaactacatcgtggtggatgagcggcgggctgtggaggagctgctggagtgcctggacctggagaagagcagctgctgcatgggcctgagcagggtcttcttccgggccggcaccctggcccggctggaggagcagagagatgagcagaccagcaggaacctgaccctcttccaggccgcctgccggggctacctggcccggcagcacttcaagaagaggaagatccaggacctggccatccgctgtgtgcagaagaacatcaagaagaacaagggcgtgaaggactggccctggtggaagctgttcaccaccgtgcggcccctgattgaggtgcagctgtctgaggagcagatccggaacaaggatgaggagatccagcagctgcggagcaagctggagaaggccgagaaggagagaaatgagctgcggctgaacagcgaccggctggagagccgcatcagcgagctgaccagcgagctgacagatgagaggaacacaggagagagcgccagccagctgctggatgctgagacagctgagcggctgcgggcagagaaggagatgaaggagctgcagacccagtatgatgccctgaagaagcagatggaggtgatggagatggaggtgatggaggcccggctcatccgggctgctgagatcaatggagaggtggatgatgatgatgctggaggagagtggaggctgaagtatgaaagagctgtgcgggaggtggacttcaccaagaagaggctgcagcaggagtttgaggacaagctggaggtggagcagcagaacaagaggcagctggagcggcggctgggggacctgcaggccgacagcgaggagagccagagggccctgcagcagctgaagaagaagtgccagaggctgacagctgagctgcaggacaccaagctgcacctggagggccagcaggtgaggaaccacgagctggagaagaagcagaggagatttgattctgagctgagccaggcccacgaggaggcccagcgggagaagctgcagcgggagaagctgcagcgggagaaggacatgctgctggccgaggccttcagcctgaagcagcagctggaggagaaggacatggacattgctggcttcacccagaaggtggtgtccctggaggccgagctgcaggacatcagcagccaggagagcaaggatgaggccagcctggccaaggtgaagaagcagctgcgggacctggaggccaaggtgaaggaccaggaggaggagctggatgagcaggccggcaccatccagatgctggagcaggccaagctgcggctggagatggagatggagaggatgaggcagacccacagcaaggagatggagagcagagatgaggaggtggaggaggcccggcagagctgccagaagaagctgaagcagatggaggtgcagctggaggaggagtatgaggacaagcagaaggtgctgcgggagaagcgggagctggagggcaagctggccaccctgagtgaccaggtgaacagaagagactttgagagcgagaagaggctgaggaaggacctgaagaggaccaaggccctgctggctgatgcccagctgatgctggaccacctgaagaacagcgcccccagcaagcgggagatcgcccagctgaagaaccagctggaggagagcgagttcacctgtgccgctgctgtgaaggccaggaaggccatggaggtggagattgaggacctgcacctgcagattgatgacatcgccaaggccaagacagccctggaggagcagctgagccggctgcagcgggagaagaatgagatccagaaccggctggaggaggaccaggaggacatgaatgagctgatgaagaagcacaaggctgctgtggcccaggccagccgggacctggcccagatcaatgacctgcaggcccagctggaggaggccaacaaggagaagcaggagctgcaggagaagctgcaggccctgcagagccaggtggagttcctggagcagagcatggtggacaagagcctggtgtcccggcaggaggccaagatccgggagctggagacccggctggagtttgagaggacccaggtgaagaggctggagagcctggccagccggctgaaggagaacatggagaagctgacagaggagcgggaccagagaattgctgctgagaaccgggagaaggagcagaacaagaggctgcagaggcagctgcgggacaccaaggaggagatgggagagctggccaggaaggaggccgaggccagcaggaagaagcatgagctggagatggacctggagagcctggaggccgccaaccagagcctgcaggccgacctgaagctggccttcaagagaattggagacctgcaggccgccattgaagatgagatggagagtgatgaaaatgaagacctgatcaacagcgagggggacagtgatgtggacagcgagctggaggacagagtggatggagtgaagtcctggctgagcaagaacaagggccccagcaaggccgccagtgatgatggcagcctgaagagcagcagccccaccagctactggaagagcctggccccagacagaagtgatgatgaacatgaccccctggacaacaccagccggccccgctacagccacagctacctgagtgacagcgacacagaggccaagctgacagagaccaatgcctag

SEQ ID NO: 160884 - DNA, 6009 bp, Artificial Sequence
  Description of Artificial Sequence: Synthetic coding sequence
atgttcaacctgatgaagaaggacaaggacaaggatggcggcaggaaggagaagaaggagaagaaggagaagaaggagaggatgtctgctgctgagctgcggagcctggaggagatgagcctgcggcggggcttcttcaacctgaacagaagcagcaagcgggagagcaagacccggctggagatcagcaaccccatccccatcaaggtggccagcggcagtgacctgcacctgacagacatcgacagcgacagcaacagaggcagcgtcatcctggacagcggccacctgagcacagccagcagcagtgatgacctgaagggggaggagggcagcttccggggctctgtgctgcagagagctgccaagtttggcagcctggccaagcagaacagccagatgattgtgaagcgcttctccttcagccagaggagcagagatgaaagtgccagcgagaccagcaccccatctgagcacagcgctgcccccagcccccaggtggaggtgaggaccctggagggccagctggtgcagcaccctggccctggcatccccaggcctggccacaggagccgggcccctgagctggtgaccaagaagtttcctgtggacctgcggctgccccctgtggtgcccctgcccccacccaccctgcgggagctggagctgcagaggcggcccaccggggactttggcttcagcctgcggaggaccaccatgctggaccggggccctgagggccaggcctgcagaagagtggtgcactttgctgagcctggagctggcaccaaggacctggccctgggcctggtgcctggggaccggctggtggagatcaatggccacaacgtggagagcaagagcagagatgagatcgtggagatgatccggcagagcggggacagcgtgcggctgaaggtgcagcccatccctgagctgtctgagctgagccgctcctggctgcggtctggagagggcccccggcgggagcccagtgatgccaagacagaggagcagattgctgctgaggaggcctggaatgaaacagagaaggtgtggctggtgcacagagatggcttcagcctggccagccagctgaagtctgaggagctgaacctgcctgagggcaaggtgcgggtgaagctggaccatgatggagccatcctggatgtggatgaagatgatgtggagaaggccaatgcccccagctgtgaccggctggaggacctggccagcctggtgtacctgaatgaatcttctgtgctgcacaccctgcggcagagatatggagccagcctgctgcacacctacgccggccccagcctgctggtgctgggccccaggggggccccagctgtgtacagcgagaaggtgatgcacatgttcaagggctgccggcgggaggacatggccccccacatctatgctgtggcccagacagcctaccgggccatgctgatgagccggcaggaccagagcatcatcctgctgggcagcagcggcagcggcaagaccaccagctgccagcacctggtgcagtacctggccaccatcgccggcatcagcggcaacaaggtgttttctgtggagaagtggcaggccctgtacaccctgctggaggccttcggcaacagccccaccatcatcaatggaaatgccacccgcttcagccagatcctgagcctggactttgaccaggccggccaggtggccagcgccagcatccagaccatgctgctggagaagctgcgggtggcccggcggcctgccagcgaggccaccttcaacgtgttctactacctgctggcctgtggagatggcaccctgaggacagagctgcacctgaaccacctggccgagaacaacgtgtttggcatcgtgcccctggccaagccagaggagaagcagaaggccgcccagcagttcagcaagctgcaggccgccatgaaggtgctgggcatcagcccagatgagcagaaggcctgctggttcatcctggccgccatctaccacctgggcgctgctggggccaccaaggaggccgctgaggccggcaggaagcagtttgcccggcatgagtgggcccagaaggccgcctacctgctgggctgcagcctggaggagctgagcagcgccatcttcaagcaccagcacaagggcggcaccctgcagaggagcaccagcttccggcagggccctgaggagagcggcctgggagatggcaccggccccaagctgagcgccctggagtgcctggagggcatggctgctggcctgtacagcgagctgttcaccctgctggtgtccctggtgaacagagccctgaagagcagccagcacagcctgtgcagcatgatgattgtggacaccccaggcttccagaaccctgagcagggcggcagcgcccggggggccagctttgaggagctgtgccacaactacacccaggaccggctgcagaggctcttccacgagaggacctttgtgcaggagctggagcgctacaaggaggagaacatcgagctggcctttgatgacctggagcccccaacagatgacagcgtggccgctgtggaccaggccagccaccagagcctggtgcgcagcctggccaggacagatgaggcccggggcctgctgtggctgctggaggaggaggccctggtgcctggggccagcgaggacaccctgctggagcggctcttctcctactacggcccccaggagggggacaagaagggccagagccccctgctgcacagcagcaagccccaccacttcctgctgggccacagccacggcaccaactgggtggagtacaacgtgacaggctggctgaactacaccaagcagaacccagccacccagaatgccccccggctgctgcaggacagccagaagaagatcatcagcaacctcttcctgggccgggccggcagcgccaccgtgctgagcggcagcattgctggcctggagggcggcagccagctggccctgcggcgggccacctccatgaggaagaccttcaccaccggcatggctgctgtgaagaagaagagcctgtgcatccagatgaagctgcaggtggatgccctgattgacaccatcaagaagagcaagctgcactttgtgcactgcttcctgcctgtggccgagggctgggccggggagcccaggtctgccagcagccggcgggtgagcagcagcagcgagctggacctgcccagcggggaccactgtgaggccggcctgctgcagctggatgtgcccctgctgcggacccagctgcggggcagccggctgctggatgccatgaggatgtaccggcagggctacccagaccacatggtgttttctgagttcagaagaagatttgatgtgctggccccccacctgaccaagaagcacggcaggaactacatcgtggtggatgagcggcgggctgtggaggagctgctggagtgcctggacctggagaagagcagctgctgcatgggcctgagcagggtcttcttccgggccggcaccctggcccggctggaggagcagagagatgagcagaccagcaggaacctgaccctcttccaggccgcctgccggggctacctggcccggcagcacttcaagaagaggaagatccaggacctggccatccgctgtgtgcagaagaacatcaagaagaacaagggcgtgaaggactggccctggtggaagctgttcaccaccgtgcggcccctgattgaggtgcagctgtctgaggagcagatccggaacaaggatgaggagatccagcagctgcggagcaagctggagaaggccgagaaggagagaaatgagctgcggctgaacagcgaccggctggagagccgcatcagcgagctgaccagcgagctgacagatgagaggaacacaggagagagcgccagccagctgctggatgctgagacagctgagcggctgcgggcagagaaggagatgaaggagctgcagacccagtatgatgccctgaagaagcagatggaggtgatggagatggaggtgatggaggcccggctcatccgggctgctgagatcaatggagaggtggatgatgatgatgctggaggagagtggaggctgaagtatgaaagagctgtgcgggaggtggacttcaccaagaagaggctgcagcaggagtttgaggacaagctggaggtggagcagcagaacaagaggcagctggagcggcggctgggggacctgcaggccgacagcgaggagagccagagggccctgcagcagctgaagaagaagtgccagaggctgacagctgagctgcaggacaccaagctgcacctggagggccagcaggtgaggaaccacgagctggagaagaagcagaggagatttgattctgagctgagccaggcccacgaggaggcccagcgggagaagctgcagcgggagaagctgcagcgggagaaggacatgctgctggccgaggccttcagcctgaagcagcagctggaggagaaggacatggacattgctggcttcacccagaaggtggtgtccctggaggccgagctgcaggacatcagcagccaggagagcaaggatgaggccagcctggccaaggtgaagaagcagctgcgggacctggaggccaaggtgaaggaccaggaggaggagctggatgagcaggccggcaccatccagatgctggagcagctgaagcagatggaggtgcagctggaggaggagtatgaggacaagcagaaggtgctgcgggagaagcgggagctggagggcaagctggccaccctgagtgaccaggtgaacagaagagactttgaaagtgagaagaggctgaggaaggacctgaagaggaccaaggccctgctggctgatgcccagctgatgctggaccacctgaagaacagcgcccccagcaagcgggagatcgcccagctgaagaaccagctggaggagagcgagttcacctgtgccgctgctgtgaaggccaggaaggccatggaggtggagattgaggacctgcacctgcagattgatgacatcgccaaggccaagacagccctggaggagcagctgagccggctgcagcgggagaagaatgagatccagaaccggctggaggaggaccaggaggacatgaatgagctgatgaagaagcacaaggctgctgtggcccaggccagccgggacctggcccagatcaatgacctgcaggcccagctggaggaggccaacaaggagaagcaggagctgcaggagaagctgcaggccctgcagagccaggtggagttcctggagcagagcatggtggacaagagcctggtgtcccggcaggaggccaagatccgggagctggagacccggctggagtttgagaggacccaggtgaagaggctggagagcctggccagccggctgaaggagaacatggagaagctgacagaggagcgggaccagagaattgctgctgaaaatcgggagaaggagcagaacaagaggctgcagaggcagctgcgggacaccaaggaggagatgggagagctggccaggaaggaggccgaggccagcaggaagaagcatgagctggagatggacctggagagcctggaggccgccaaccagagcctgcaggccgacctgaagctggccttcaagagaattggagacctgcaggccgccattgaagatgagatggagagtgatgaaaatgaagatctcatcaacagcgagggggacagtgatgtggacagcgagctggaggacagagtggatggagtgaagtcctggctgagcaagaacaagggccccagcaaggccgccagtgatgatggcagcctgaagagcagcagccccaccagctactggaagagcctggccccagacagaagtgatgatgaacatgaccccctggacaacaccagccggccccgctacagccacagctacctgagtgacagcgacacagaggccaagctgacagagaccaatgcctag

SEQ ID NO: 160885 - DNA, 2808 bp, Artificial Sequence; identical to SEQ ID NO: 160882
  Description of Artificial Sequence: Synthetic coding sequence

SEQ ID NO: 160886 - DNA, 963 bp, Artificial Sequence
  Description of Artificial Sequence: Synthetic coding sequence
atgacctttgtgctgctgagcagcagccagctggaggagcagctgagccggctgcagcgggagaagaatgagatccagaaccggctggaggaggaccaggaggacatgaatgagctgatgaagaagcacaaggctgctgtggcccaggccagccgggacctggcccagatcaatgacctgcaggcccagctggaggaggccaacaaggagaagcaggagctgcaggagaagctgcaggccctgcagagccaggtggagttcctggagcagagcatggtggacaagagcctggtgtcccggcaggaggccaagatccgggagctggagacccggctggagtttgagaggacccaggtgaagaggctggagagcctggccagccggctgaaggagaacatggagaagctgacagaggagcgggaccagagaattgctgctgaaaatcgggagaaggagcagaacaagaggctgcagaggcagctgcgggacaccaaggaggagatgggagagctggccaggaaggaggccgaggccagcaggaagaagcatgagctggagatggacctggagagcctggaggccgccaaccagagcctgcaggccgacctgaagctggccttcaagagaattggagacctgcaggccgccattgaagatgagatggagagtgatgaaaatgaagatctcatcaacagcgagggggacagtgatgtggacagcgagctggaggacagagtggatggagtgaagtcctggctgagcaagaacaagggccccagcaaggccgccagtgatgatggcagcctgaagagcagcagccccaccagctactggaagagcctggccccagacagaagtgatgatgaacatgaccccctggacaacaccagccggccccgctacagccacagctacctgagtgacagcgacacagaggccaagctgacagagaccaatgcctag

SEQ ID NO: 160887 - DNA, 7704 bp, Artificial Sequence
  Description of Artificial Sequence: Synthetic coding sequence
atggccatcagcagccggctggccctgtgggagcagaagatccgggaggaggacaagagccccccacccagcagccccccacccctcttcagcgtcatccctgggggcttcatcaagcagctggtgcggggcacagagaaggaggccaaggaggcccggcagaggaagcagctggccgtggccagccctgagcgggagatccctgagatcagcatcagccagcccaacagcaagagcagcagcggcaccaggagcggcagccagcagatcagccaggatgaccagagcagcagccctggcagcagtgacatcctgggcaaggagagcgagggcagccgcagcccagaccctgagcagatgaccagcatcaacggggagaaggcccaggagctgggcagcagcgccacccccaccaagaagacagtgcccttcaagaggggcgtgagaagaggagatgtgctgctgatggtggccaagctggaccctgacagcgccaagccagagaagacccacccccatgatgccccaccctgcaagaccagccccccagccacagacaccgggaaggagaagaagggggagaccagcaggaccccctgtggcagccaggccagcacagagatcctggcccccaaggccgagaagaccaggactggaggcctgggggaccccggccagggcaccgtggccctgaagaagggggaggagggccagagcatcgtgggcaagggcctgggcacccccaagaccacagagctgaaggaggccgagccccagggcaaggaccggcagggcacccggccccaggcccagggccctggagagggcgtgcggcctgggaaggccgagaaggagggcgctgagcccaccaacacagtggagaagggaaatgtgtccaaggatgtgggcagcgagggcaagcacgtgcggccccagatccctggcaggaagtggggcggcttcctgggccgccgcagcaagtgggatggcccccagaacaagaaggacaaggagggcgtgctgctgagcaaggccgagaagacaggagagccccagacccagatggagaagaccagccaggtgcagggcgagctgggagatgacctgaggatgggagagaaggccggggagctgcggagcaccaccgggaaggccggggagagctgggacaagaaggagaagatgggccagccccagggcaagtctggaaatgctggggaggcccggagccagacagagaagggctgtgaggcccccaaggaggtgtccaccatggtggagagccctgctgcccctgggaagggcggctggccaggcagccggggccaggaggccgaggagccctgcagcagagctggagatggagctggggccctggagacagagctggagggccccagccagcctgccctggagaaggatgctgagcggccccgcatcagaaaagaaaaccaggacggccctgccccccaggaggagggcaaaggaggccagagccgggacagcgaccaggccccagaagatcgctggtatgaagctgagaaggtgtggctggcccagaaggatggcttcaccctggccaccgtgctgaagccagatgagggcacagctgacctgcctgctggccgggtgcggctgtggattgatgctgacaagaccatcacagaggtggatgaggagcacgtgcaccgggccaaccccccagagctggaccaggtggaggacctggccagcctcatctctgtgaatgaatcttctgtgctgaacaccctgctgcagcgctacaaggcccagctgctgcacacctgcaccggccctgacctgattgtgctgcagccccggggccccagcgtgcccagcgctgggaaggtgcccaagggcagaagagatggcctgcctgcccacatcggctccatggcccagagggcctactgggccctgctgaaccagaggcgggaccagagcatcgtggccctgggctggagcggggccggcaagaccacctgctgtgagcaggtgctggagcacctggtgggcatggccggctctgtggatggccgggtgtctgtggagaagatccgggccaccttcaccgtgctgcgggcctttggatctgtgtccatggcccacagccgcagcgccacccgcttctccatggtgatgagcctggacttcaatgccaccggccgcatcacagctgcccagctgcagaccatgctgctggagaagagccgggtggcccggcagcctgagggggagagcaacttcctggtgttcagccagatgctggccggcctggacctggacctgaggacagagctgaacctgcaccagatggctgacagcagcagctttggcatgggcgtgtggagcaagccagaggacaagcagaaggctgctgctgcctttgcccagctgcagggcgccatggagatgctgggcatcagcgagagcgagcagagagctgtgtggagggtgctggccgccatctaccacctgggcgccgccggggcctgcaaggtgggcaggaagcagttcatgagatttgagtgggccaactatgctgctgaggccctgggctgtgaatatgaggagctgaacacagccaccttcaagcaccacctgcggcagatcatccagcagatgaccttcggccccagccgctggggcctggaggatgaggagaccagcagcggcctgaagatgactggagtggactgtgtggagggcatggccagcggcctgtaccaggagctgtttgctgctgtggtgtccctcatcaacagaagcttcagcagccaccacctgtccatggccagcatcatggtggtggacagccctggcttccagaaccccaggcaccagggcaaggaccgggccgccacctttgaggagctgtgccacaactatgcccacgagcggctgcagctgctcttctaccagaggacctttgtgtccaccctgcagcgctaccaggaggagggcgtgcctgtgcagtttgacctgcctgaccccagccctggcaccaccgtggccgtggtggaccagaaccccagccaggtgcggctgcctgctgggggcggggcccaggatgcccggggcctcttctgggtgctggatgaggaggtgcacgtggagggcagcagtgacagcgtggtgctggagcggctgtgtgccgcctttgagaagaagggggccggcacagagggcagcagcgccctgcggacctgtgagcagcccctgcagtgtgagatcttccaccagctgggctgggaccctgtgcgctatgacctgaccggctggctgcaccgggccaagcccaacctgagcgccctggatgccccccaggtgctgcaccagagcaagcgggaggagctgcggagcctcttccaggcccgggccaagctgccccctgtgtgcagagctgtggccggcctggagggcaccagccagcaggccctgcagaggagcaggatggtgcggaggacctttgccagcagcctggccgctgtgcggaggaaggccccctgcagccagatcaagctgcagatggatgccctgacctccatgatcaagaggagccggctgcacttcatccactgcctggtgcccaaccctgtggtggagagccgcagcggccaggagagccccccaccaccccagcccggccgggacaagccaggagctgggggccccctggccctggacatcccagccctgcgggtgcagctggccggcttccacatcctggaggccctgcggctgcacaggacaggctatgctgaccacatgggcctgacccgcttccggcggcagttccaggtgctggatgcccccctgctgaagaagctgatgagcaccagcgagggcattgatgagaggaaggctgtggaggagctgctggagaccctggacctggagaagaaggctgtggccgtgggccacagccaggtgttcctgaaggccggggtcatcagccggctggagaagcagcgggagaagctggtgtcccagagcatcgtgctcttccaggccgcctgcaagggcttcctgagccggcaggagttcaagaagctgaagatccggcggctggccgcccagtgcatccagaagaatgtggccgtgttcctggccgtgaaggactggccctggtggcagctgctgggcagcctgcagcccctgctgagcgccaccatcggcacagagcagctgcgggccaaggaggaggagctgaccaccctgcggaggaagctggagaagtctgagaagctgagaaatgagctgcggcagaacacagacctgctggagagcaagattgctgacctgaccagtgacctggctgatgagcgcttcaagggagatgtggcctgccaggtgctggagagcgagagagctgagcggctgcaggccttccgggaggtgcaggagctgaagagcaagcatgagcaggtgcagaagaagctgggagatgtgaacaagcagctggaggaggcccagcagaagatccagctgaatgacctggagaggaaccccaccggcggcgcagatgagtggcagatgagatttgactgtgcccagatggagaatgagttcctgaggaagaggctgcagcagtgtgaggagcggctggacagcgagctgacagccaggaaggagctggagcagaagctgggggagctgcagagcgcctatgatggagccaagaagatggcccaccagctgaagaggaagtgccaccacctgacctgtgacctggaggacacctgtgtgctgctggagaaccagcagagcaggaaccacgagctggagaagaagcagaagaagtttgacctgcagctggcccaggccctgggggagagcgtgtttgagaagggcctgcgggagaaggtgacccaggagaacacctctgtgcgctgggagctgggccagctgcagcagcagctgaagcagaaggagcaggaggccagccagctgaagcagcaggtggagatgctgcaggaccacaagcgggagctgctgggcagccccagcctgggggagaactgtgtggccggcctgaaggagcggctgtggaagctggagagcagcgccctggagcagcagaagatccagagccagcaggagaacaccatcaagcagctggagcagctgcggcagagatttgagctggagattgaaagaatgaagcagatgcaccagaaggaccgggaggaccaggaggaggagctggaggatgtgcggcagagctgccagaagaggctgcaccagctggagatgcagctggagcaggagtatgaggagaagcagatggtgctgcacgagaagcaggacctggagggcctcatcggcaccctgtgtgaccagatcggccaccgggactttgatgtggagaagaggctgcggcgggacctgcggaggacccacgccctgctgagtgatgtgcagctgctgctgggcaccatggaggatggcaagacctctgtgtccaaggaggagctggagaaggtgcacagccagctggagcagagcgaggccaagtgtgaggaggccctgaagacccagaaggtgctgacagctgacctggagagcatgcacagcgagctggagaacatgaccaggaacaagagcctggtggatgagcagctgtaccgcctgcagtttgagaaggctgacctgctgaagagaattgatgaggaccaggatgacctgaatgagctgatgcagaagcacaaggacctgattgcccagagcgctgctgacatcggccagatccaggagctgcagctgcagctggaggaggccaagaaggagaagcacaagctgcaggagcagctgcaggtggcccagatgagaattgagtacctggagcagagcacagtggaccgggccatcgtgtcccggcaggaggccgtcatctgtgacctggagaacaagacagagttccagaaggtgcagatcaagagatttgaggtgctggtgatccggctgcgggacagcctcatcaagatgggagaggagctgagccaggccgccaccagcgagagccagcagcgggagagcagccagtactaccagaggcggctggaggagctgaaggctgacatggaggagctggtgcagcgggaggccgaggccagccgccgctgcatggagctggagaagtatgtggaggagctggccgctgtgcggcagaccctgcagacagacctggagaccagcatcagaagaattgctgacctgcaggccgccctggaggaggtggccagcagtgacagcgacacagagagcgtgcagacagctgtggactgtggcagcagcggcaggaaggagatggacaacgtgtccatcctgagcagccagcctgagggcagcctgcagagctggctgagctgcaccctgagcctggccacagacaccatgaggacccccagccggcagagcgccaccagcagccgcatcctgagcccccgcatcaatgaggaggccggggacacagagaggacccagagcgccctggccctgagccgggcccggagcaccaacgtgcacagcaagaccagcggggacaagcctgtgagcccccactttgtgcggcggcagaagtactgccactttggagatggagaggtgctggccgtgcagaggaagagcacagagcggctggagcccgccagcagccccctggccagccgcagcaccaacaccagccccctgagccgggagaagctgcccagccccagcgctgccctgtctgaatttgtggagggcctgcggaggaagagggcccagaggggccagggcagcaccctgggcctggaggactggcccaccctgcccatctaccagaccaccggggccagcaccctgcggcggggccgggccggcagtgatgagggcaacctgagcctgcgggtgggcgccaagagccccctggagattgaaggagctgctgggggcctgctgcggagcaccagcctgaagtgcatcagcagtgatggagtgggcggcaccaccctgctgcctgagaagagcaagacccagttcagcagctgtgagagcctgctggagagccggcccagcatgggcaggaagctgagcagccccaccaccccccgggacatgctgctgagccccaccctgcggccccggcggcgctgcctggagagctctgtggatgatgctggctgcccagacctgggcaaggagcccctggtgttccagaaccggcagtttgcccacctgatggaggagcccctgggcagtgaccccttctcctggaagctgcccagcctggactatgaaaggaagaccaaggtggactttgatgacttcctgcctgccatcaggaagccccagacccccaccagcctggccggcagcgccaagggcggccaggacggcagccagaggagcagcatccactttgaaacagaggaggccaacagaagcttcctgagcggcatcaagaccatcctgaagaagagccctgagcccaaggaggaccctgcccacctgagtgacagcagcagcagcagcggcagcatcgtgtccttcaagtctgctgacagcatcaagagccggcccggcatcccccggctggccggagatggaggagagaggaccagccctgagcggcgggagcccggcaccggcaggaaggatgatgatgtggccagcatcatgaagaagtacctgcagaagtag

SEQ ID NO: 160888 - DNA, 7707 bp, Artificial Sequence
  Description of Artificial Sequence: Synthetic coding sequence
atggccatcagcagccggctggccctgtgggagcagaagatccgggaggaggacaagagccccccacccagcagccccccacccctcttcagcgtcatccctgggggcttcatcaagcagctggtgcggggcacagagaaggaggccaaggaggcccggcagaggaagcagctggccgtggccagccctgagcgggagatccctgagatcagcatcagccagcccaacagcaagagcagcagcggcaccaggagcggcagccagcagatcagccaggatgaccagagcagcagccctggcagcagtgacatcctgggcaaggagagcgagggcagccgcagcccagaccctgagcagatgaccagcatcaacggggagaaggcccaggagctgggcagcagcgccacccccaccaagaagacagtgcccttcaagaggggcgtgagaagaggagatgtgctgctgatggtggccaagctggaccctgacagcgccaagccagagaagacccacccccatgatgccccaccctgcaagaccagccccccagccacagacaccgggaaggagaagaagggggagaccagcaggaccccctgtggcagccaggccagcacagagatcctggcccccaaggccgagaagaccaggactggaggcctgggggaccccggccagggcaccgtggccctgaagaagggggaggagggccagagcatcgtgggcaagggcctgggcacccccaagaccacagagctgaaggaggccgagccccagggcaaggaccggcagggcacccggccccaggcccagggccctggagagggcgtgcggcctgggaaggccgagaaggagggcgctgagcccaccaacacagtggagaagggaaatgtgtccaaggatgtgggcagcgagggcaagcacgtgcggccccagatccctggcaggaagtggggcggcttcctgggccgccgcagcaagtgggatggcccccagaacaagaaggacaaggagggcgtgctgctgagcaaggccgagaagacaggagagccccagacccagatggagaagaccagccaggtgcagggcgagctgggagatgacctgaggatgggagagaaggccggggagctgcggagcaccaccgggaaggccggggagagctgggacaagaaggagaagatgggccagccccagggcaagtctggaaatgctggggaggcccggagccagacagagaagggctgtgaggcccccaaggaggtgtccaccatggtggagagccctgctgcccctgggaagggcggctggccaggcagccggggccaggaggccgaggagccctgcagcagagctggagatggagctggggccctggagacagagctggagggccccagccagcctgccctggagaaggatgctgagcggccccgcatcagaaaagaaaaccaggacggccctgccccccaggaggagggcaaaggaggccagagccgggacagcgaccaggccccagaagatcgctggtatgaagctgagaaggtgtggctggcccagaaggatggcttcaccctggccaccgtgctgaagccagatgagggcacagctgacctgcctgctggccgggtgcggctgtggattgatgctgacaagaccatcacagaggtggatgaggagcacgtgcaccgggccaaccccccagagctggaccaggtggaggacctggccagcctcatctctgtgaatgaatcttctgtgctgaacaccctgctgcagcgctacaaggcccagctgctgcacacctgcaccggccctgacctgattgtgctgcagccccggggccccagcgtgcccagcgctgggaaggtgcccaagggcagaagagatggcctgcctgcccacatcggctccatggcccagagggcctactgggccctgctgaaccagaggcgggaccagagcatcgtggccctgggctggagcggggccggcaagaccacctgctgtgagcaggtgctggagcacctggtgggcatggccggctctgtggatggccgggtgtctgtggagaagatccgggccaccttcaccgtgctgcgggcctttggatctgtgtccatggcccacagccgcagcgccacccgcttctccatggtgatgagcctggacttcaatgccaccggccgcatcacagctgcccagctgcagaccatgctgctggagaagagccgggtggcccggcagcctgagggggagagcaacttcctggtgttcagccagatgctggccggcctggacctggacctgaggacagagctgaacctgcaccagatggctgacagcagcagctttggcatgggcgtgtggagcaagccagaggacaagcagaaggctgctgctgcctttgcccagctgcagggcgccatggagatgctgggcatcagcgagagcgagcagagagctgtgtggagggtgctggccgccatctaccacctgggcgccgccggggcctgcaaggtgggcaggaagcagttcatgagatttgagtgggccaactatgctgctgaggccctgggctgtgaatatgaggagctgaacacagccaccttcaagcaccacctgcggcagatcatccagcagatgaccttcggccccagccgctggggcctggaggatgaggagaccagcagcggcctgaagatgactggagtggactgtgtggagggcatggccagcggcctgtaccaggagctgtttgctgctgtggtgtccctcatcaacagaagcttcagcagccaccacctgtccatggccagcatcatggtggtggacagccctggcttccagaaccccaggcaccagggcaaggaccgggccgccacctttgaggagctgtgccacaactatgcccacgagcggctgcagctgctcttctaccagaggacctttgtgtccaccctgcagcgctaccaggaggagggcgtgcctgtgcagtttgacctgcctgaccccagccctggcaccaccgtggccgtggtggaccagaaccccagccagcaggtgcggctgcctgctgggggcggggcccaggatgcccggggcctcttctgggtgctggatgaggaggtgcacgtggagggcagcagtgacagcgtggtgctggagcggctgtgtgccgcctttgagaagaagggagctggaacagagggcagcagcgccctgcggacctgtgagcagcccctgcagtgtgagatcttccaccagctgggctgggaccctgtgcgctatgacctgaccggctggctgcaccgggccaagcccaacctgagcgccctggatgccccccaggtgctgcaccagagcaagcgggaggagctgcggagcctcttccaggcccgggccaagctgccccctgtgtgcagagctgtggccggcctggagggcaccagccagcaggccctgcagaggagcaggatggtgcggaggacctttgccagcagcctggccgctgtgcggaggaaggccccctgcagccagatcaagctgcagatggatgccctgacctccatgatcaagaggagccggctgcacttcatccactgcctggtgcccaaccctgtggtggagagccgcagcggccaggagagccccccaccaccccagcccggccgggacaagccaggggccggcggccccctggccctggacatcccagccctgcgggtgcagctggccggcttccacatcctggaggccctgcggctgcacaggacaggctacgccgaccacatgggcctgacccgcttccggcggcagttccaggtgctggatgcccccctgctgaagaagctgatgagcaccagcgagggcattgatgagaggaaggctgtggaggagctgctggagaccctggacctggagaagaaggctgtggccgtgggccacagccaggtgttcctgaaggccggggtcatcagccggctggagaagcagcgggagaagctggtgtcccagagcatcgtgctcttccaggccgcctgcaagggcttcctgagccggcaggagttcaagaagctgaagatccggcggctggccgcccagtgcatccagaagaatgtggccgtgttcctggccgtgaaggactggccctggtggcagctgctgggcagcctgcagcccctgctgagcgccaccatcggcacagagcagctgcgggccaaggaggaggagctgaccaccctgcggaggaagctggagaagtctgagaagctgagaaatgagctgcggcagaacacagacctgctggagagcaagattgctgacctgaccagtgacctggctgatgagcgcttcaagggagatgtggcctgccaggtgctggagagcgagcgggcagagcggctgcaggccttccgggaggtgcaggagctgaagagcaagcatgagcaggtgcagaagaagctgggagatgtgaacaagcagctggaggaggcccagcagaagatccagctgaatgacctggagaggaaccccactggaggagcagatgagtggcagatgagatttgactgtgcccagatggagaatgagttcctgaggaagaggctgcagcagtgtgaggagcggctggacagcgagctgacagccaggaaggagctggagcagaagctgggggagctgcagagcgcctatgatggagccaagaagatggcccaccagctgaagaggaagtgccaccacctgacctgtgacctggaggacacctgtgtgctgctggagaaccagcagagcagaaatcatgagctggagaagaagcagaagaagtttgacctgcagctggcccaggccctgggggagagcgtgtttgagaagggcctgcgggagaaggtgacccaggagaacacctctgtgcgctgggagctgggccagctgcagcagcagctgaagcagaaggagcaggaggccagccagctgaagcagcaggtggagatgctgcaggaccacaagcgggagctgctgggcagccccagcctgggggagaactgtgtggccggcctgaaggagcggctgtggaagctggagagcagcgccctggagcagcagaagatccagagccagcaggagaacaccatcaagcagctggagcagctgcggcagagatttgagctggagattgaaagaatgaagcagatgcaccagaaggaccgggaggaccaggaggaggagctggaggatgtgcggcagagctgccagaagaggctgcaccagctggagatgcagctggagcaggagtatgaggagaagcagatggtgctgcacgagaagcaggacctggagggcctgattggcaccctgtgtgaccagatcggccaccgggactttgatgtggagaagaggctgcggcgggacctgcggaggacccacgccctgctgagtgatgtgcagctgctgctgggcaccatggaggatggcaagacctctgtgtccaaggaggagctggagaaggtgcacagccagctggagcagagcgaggccaagtgtgaggaggccctgaagacccagaaggtgctgacagctgacctggagagcatgcacagcgagctggagaacatgaccaggaacaagagcctggtggatgagcagctgtaccgcctgcagtttgagaaggctgacctgctgaagagaattgatgaggaccaggatgacctgaatgagctgatgcagaagcacaaggacctgattgcccagagcgctgctgacatcggccagatccaggagctgcagctgcagctggaggaggccaagaaggagaagcacaagctgcaggagcagctgcaggtggcccagatgagaattgagtacctggagcagagcacagtggaccgggccatcgtgtcccggcaggaggccgtcatctgtgacctggagaacaagacagagttccagaaggtgcagatcaagagatttgaggtgctggtgatccggctgcgggacagcctcatcaagatgggagaggagctgagccaggccgccaccagcgagagccagcagcgggagagcagccagtactaccagaggcggctggaggagctgaaggctgacatggaggagctggtgcagcgggaggccgaggccagccgccgctgcatggagctggagaagtatgtggaggagctggccgctgtgcggcagaccctgcagacagacctggagaccagcatcagaagaattgctgacctgcaggccgccctggaggaggtggccagcagtgacagcgacacagaatctgtgcagacagctgtggactgtggcagcagcggcaggaaggagatggacaacgtgtccatcctgagcagccagcctgagggcagcctgcagagctggctgagctgcaccctgagcctggccacagacaccatgaggacccccagccggcagagcgccaccagcagccgcatcctgagcccccgcatcaatgaggaggccggggacacagagaggacccagagcgccctggccctgagccgggcccggagcaccaacgtgcacagcaagaccagcggggacaagcctgtgagcccccactttgtgcggcggcagaagtactgccactttggagatggagaggtgctggccgtgcagaggaagagcacagagcggctggagcccgccagcagccccctggccagccgcagcaccaacaccagccccctgagccgggagaagctgcccagccccagcgctgccctgtctgaatttgtggagggcctgcggaggaagagggcccagaggggccagggcagcaccctgggcctggaggactggcccaccctgcccatctaccagaccactggagccagcaccctgcggcggggccgggccggcagtgatgagggcaacctgagcctgcgggtgggcgccaagagccccctggagattgagggcgccgccggcggcctgctgcggagcaccagcctgaagtgcatcagcagtgatggagtgggcggcaccaccctgctgcctgagaagagcaagacccagttcagcagctgtgagagcctgctggagagccggcccagcatgggcaggaagctgagcagccccaccaccccccgggacatgctgctgagccccaccctgcggccccggcggcgctgcctggagagctctgtggatgatgctggctgcccagacctgggcaaggagcccctggtgttccagaaccggcagtttgcccacctgatggaggagcccctgggcagtgaccccttctcctggaagctgcccagcctggactatgaaaggaagaccaaggtggactttgatgacttcctgcctgccatcaggaagccccagacccccaccagcctggccggcagcgccaagggcggccaggacggcagccagaggagcagcatccactttgaaacagaggaggccaacagaagcttcctgagcggcatcaagaccatcctgaagaagagccctgagcccaaggaggaccctgcccacctgagtgacagcagcagcagcagcggcagcatcgtgtccttcaagtctgctgacagcatcaagagcaggcctggcatcccccggctggccggagatggaggagagaggaccagccctgagcggcgggagcccggcactggaaggaaggatgatgatgtggccagcatcatgaagaagtacctgcagaagtag

SEQ ID NO: 160889 - DNA, 7704 bp, Artificial Sequence; identical to SEQ ID NO: 160887
  Description of Artificial Sequence: Synthetic coding sequence

SEQ ID NO: 160890 - DNA, 603 bp, Artificial Sequence
  Description of Artificial Sequence: Synthetic coding sequence
atgggcaacagcaagagcggggccctgagcaaggagatcctggaggagctgcagctgaacaccaagttcagcgaggaggagctgtgctcctggtaccagagcttcctgaaggactgccccaccggccgcatcacccagcagcagttccagagcatctatgccaagttcttcccagacacagaccccaaggcctatgcccagcacgtgttccgcagctttgacagcaacctggatggcaccctggacttcaaggagtatgtgattgccctgcacatgaccacagctgggaagaccaaccagaagctggagtgggccttcagcctgtatgatgtggatggaaatggcaccatcagcaagaatgaggtgctggagatcgtgatggccatcttcaagatgatcaccccagaagatgtgaagctgctgcctgatgatgagaacaccccagagaagagagctgagaagatctggaagtactttgggaagaatgatgatgacaagctgacagagaaggagttcatcgagggcaccctggccaacaaggagatcctgcggctcatccagtttgagccccagaaggtgaaggagaagatgaagaatgcctag

SEQ ID NO: 160891 - DNA, 1884 bp, Artificial Sequence
  Description of Artificial Sequence: Synthetic coding sequence
atgagcagtgacagcgagatggccatctttggagaggccgcccccttcctgaggaagtctgagcgggagagaattgaggcccagaacaagccctttgatgccaagacctctgtgtttgtggtggaccccaaggagagctttgtgaaggccaccgtgcagagccgggagggcggcaaggtgacagccaagacagaggccggggccaccgtgacagtgaaggatgaccaggtgttccccatgaacccccccaagtatgacaagattgaggacatggccatgatgacccacctgcacgagcctgctgtgctgtacaacctgaaggagagatatgctgcctggatgatctacacctacagcggcctcttctgtgtgacagtgaacccctacaagtggctgcctgtgtacaatgctgaggtggtgacagcctaccggggcaagaagaggcaggaggccccaccccacatcttcagcatcagtgacaatgcctaccagttcatgctgacagaccgggagaaccagagcatcctgatcaccggggagagcggggccggcaagacagtgaacaccaagagggtcatccagtactttgccaccatcgctgtgactggagagaagaagaaggaggaggtgaccagcggcaagatgcagggcaccctggaggaccagatcatcagcgccaaccccctgctggaggcctttggaaatgccaagacagtgagaaatgacaacagcagcagatttgggaagttcatccgcatccacttcggcaccaccgggaagctggccagcgctgacatcgagacctacctgctggagaagagccgggtgaccttccagctgaaggccgagaggagctaccacatcttctaccagatcatgagcaacaagaagccagacctgattgagatgctgctgatcaccaccaacccctatgactatgcctttgtgtcccagggcgagatcaccgtgcccagcattgatgaccaggaggagctgatggccacagattctgccatcgagatcctgggcttcaccagtgatgagcgggtgtccatctacaagctgaccggggctgtgatgcactacggcaacatgaagttcaagcagaagcagcgggaggagcaggccgagccagatggaacagaggtggccgacaaggccgcctacctgcagaacctgaacagcgctgacctgctgaaggccctgtgctacccccgggtgaaggtgggcaatgaatatgtgaccaagggccagacagtgcagcaggtgtacaatgctgtgggcgccctggccaaggctgtgtatgacaagatgttcctgtggatggtgacccgcatcaaccagcagctggacaccaagcagccccgggccaacagcgaggtggcccagtggaggaccaagtatgaaacagatgccatccagaggacagaggagctggaggaggccaagaagaagctggcccagaggctgcaggatgctgaggagcacgtggaggccgtgaatgccaagtgtgccagcctggagaagaccaagcagaggctgcagaatgaggtggaggacctgatgattgatgtggagaggaccaatgctgcctgtgccgccctggacaagaagcagaggaactttgacaagatcctggccgagtggaagcagaagtgtgaggagacccacgccgagctggaggccagccagaaggagagccgcagcctgagcacagagctgttcaagatcaagaatgcctatgaggagagcctggaccagctggagaccctgaagcgggagaacaagaacctgcagcaggagatcagtgacctgacagagcagattgctgagggcggcaagagaattcatgagctggagaagatcaagaagcaggtggagtag

SEQ ID NO: 160892 - DNA, 5919 bp, Artificial Sequence
  Description of Artificial Sequence: Synthetic coding sequence
atggcccagaagggccagctgagtgatgatgagaagttcctgtttgtggacaagaacttcatcaacagccctgtggcccaggccgactgggccgccaagaggctggtgtgggtgcccagcgagaagcagggctttgaagctgccagcatcaaggaggagaagggagatgaggtggtggtggagctggtggagaatggcaagaaggtgacagtgggcaaggatgacatccagaagatgaacccccccaagttcagcaaggtggaggacatggccgagctgacctgcctgaatgaggcctctgtgctgcacaacctgcgggagcgctacttcagcggcctcatctacacctacagcggcctcttctgtgtggtggtgaacccctacaagcacctgcccatctacagcgagaagatcgtggacatgtacaagggcaagaagagacatgagatgccaccccacatctatgccatcgctgacacagcctaccgctccatgctgcaggaccgggaggaccagagcatcctgtgcacaggagagagcggggccggcaagacagagaacaccaagaaggtgatccagtacctggccgtggtggccagcagccacaagggcaagaaggacaccagcatcactggagagctggagaagcagctgctgcaggccaaccccatcctggaggcctttggaaatgccaagacagtgaagaatgacaacagcagcagatttgggaagttcatccgcatcaactttgatgtgacaggctacatcgtgggcgccaacatcgagacctacctgctggagaagagccgggccatccggcaggccagagatgagaggaccttccacatcttctactacatgattgctggggccaaggagaagatgagaagtgacctgctgctggagggcttcaacaactacaccttcctgagcaatggatttgtgcccatcccagctgcccaggatgatgagatgttccaggagaccgtggaggccatggccatcatgggcttcagcgaggaggagcagctgagcatcctgaaggtggtgtcctctgtgctgcagctgggcaacatcgtgttcaagaaggagaggaacacagaccaggcctccatgccagacaacacagctgcccagaaggtgtgccacctgatgggcatcaacgtgacagacttcaccaggagcatcctgaccccccgcatcaaggtgggcagagatgtggtgcagaaggcccagaccaaggagcaggccgactttgctgtggaggccctggccaaggccacctatgagcggctcttccgctggatcctgaccagggtgaacaaggccctggacaagacccaccggcagggcgccagcttcctgggcatcctggacattgctggctttgagatctttgaggtgaacagctttgagcagctgtgcatcaactacaccaatgagaagctgcagcagctgttcaaccacaccatgttcatcctggagcaggaggagtaccagcgggagggcatcgagtggaacttcatcgactttggcctggacctgcagccctgcatcgagctgattgaaagacccaacaaccccccaggagtgctggccctgctggatgaggagtgctggttccccaaggccacagacaagagctttgtggagaagctgtgcacagagcagggcagccaccccaagttccagaagcccaagcagctgaaggacaagacagagttcagcatcatccactacgccggcaaggtggactacaatgccagcgcctggctgaccaagaacatggaccccctgaatgacaacgtgaccagcctgctgaatgccagcagtgacaagtttgtggccgacctgtggaaggatgtggacagaattgtgggcctggaccagatggccaagatgacagagagcagcctgcccagcgccagcaagaccaagaagggcatgttcagaacagtgggccagctgtacaaggagcagctgggcaagctgatgaccaccctgaggaacaccacccccaactttgtgcgctgcatcatccccaaccacgagaagaggtctgggaagctggatgccttcctggtgctggagcagctgcgctgcaatggagtgctggagggcatccgcatctgccggcagggcttccccaacagaattgtgttccaggagttccggcagagatatgagatcctggccgccaatgccatccccaagggcttcatggatggcaagcaggcctgcatcctgatgatcaaggccctggagctggaccccaacctgtacagaattggccagagcaagatcttcttcagaactggagtgctggcccacctggaggaggagcgggacctgaagatcacagatgtgatcatggccttccaggccatgtgccggggctacctggccaggaaggcctttgccaagaggcagcagcagctgacagccatgaaggtgatccagaggaactgtgccgcctacctgaagctgaggaactggcagtggtggaggctcttcaccaaggtgaagcccctgctgcaggtgacccggcaggaggaggagatgcaggccaaggaggatgagctgcagaagaccaaggagcggcagcagaaggccgagaatgagctgaaggagctggagcagaagcacagccagctgacagaggagaagaacctgctgcaggagcagctgcaggccgagacagagctgtatgcagaggccgaggagatgagggtgcggctggccgccaagaagcaggagctggaggagatcctgcacgagatggaggcccggctggaggaggaggaggaccggggccagcagctgcaggccgagaggaagaagatggcccagcagatgctggacctggaggagcagctggaggaggaggaggccgcccggcagaagctgcagctggagaaggtgacagctgaggccaagatcaagaagctggaggatgagatcctggtgatggatgaccagaacaacaagctgagcaaggagaggaagctgctggaggagcgcatcagtgacctgaccaccaacctggccgaggaggaggagaaggccaagaacctgaccaagctgaagaacaagcatgagagcatgatcagcgagctggaggtgcggctgaagaaggaggagaagagccggcaggagctggagaagctgaagaggaagctggagggagatgccagtgacttccacgagcagattgctgacctgcaggcccagattgctgagctgaagatgcagctggccaagaaggaggaggagctgcaggccgccctggcccggctggatgatgaaattgcccagaagaacaatgccctgaagaagatccgggagctggagggccacatcagtgacctgcaggaggacctggacagcgagcgggccgccaggaacaaggccgagaagcagaagagggacctgggggaggagctggaggccctgaagacagagctggaggacaccctggacagcacagccacccagcaggagctgcgggccaagcgggagcaggaggtgacagtgctgaagaaggccctggatgaggagaccaggagccatgaggcccaggtgcaggagatgaggcagaagcacgcccaggccgtggaggagctgacagagcagctggagcagttcaagagggccaaggccaacctggacaagaacaagcagaccctggagaaggaaaatgctgacctggccggggagctgcgggtgctgggccaggccaagcaggaggtggagcacaagaagaagaagctggaggcccaggtgcaggagctgcagagcaaatgttctgatggagagcgggcccgggcagagctgaatgacaaggtgcacaagctgcagaatgaggtggagagcgtgacaggcatgctgaatgaagctgagggcaaggccatcaagctggccaaggatgtggccagcctgagcagccagctgcaggacacccaggagctgctgcaggaggagacccggcagaagctgaatgtgtccaccaagctgcggcagctggaggaggagaggaacagcctgcaggaccagctggatgaggagatggaggccaagcagaacctggagcggcacatcagcaccctgaacatccagctgagtgacagcaagaagaagctgcaggactttgccagcacagtggaggccctggaggagggcaagaagcgcttccagaaggagattgagaacctgacccagcagtatgaggagaaggctgctgcctatgacaagctggagaagaccaagaaccggctgcagcaggagctggatgacctggtggtggacctggacaaccagaggcagctggtgagcaacctggagaagaagcagaggaagtttgaccagctgctggccgaggagaagaacatcagcagcaaatatgcagatgagcgggacagagctgaggccgaggcccgggagaaggagaccaaggccctgagcctggcccgggccctggaggaggccctggaggccaaggaggagctggagaggaccaacaagatgctgaaggccgagatggaggacctggtgagcagcaaggatgatgtgggcaagaatgtgcatgagctggagaagagcaagagggccctggagacccagatggaggagatgaagacccagctggaggagctggaggatgagctgcaggccacagaagatgccaagctgcggctggaggtgaacatgcaggccctgaagggccagtttgagcgggacctgcaggccagagatgagcagaatgaggagaagaggcggcagctgcagaggcagctgcatgaatatgaaacagagctggaggatgagaggaagcagagggccctggccgctgctgccaagaagaagctggagggggacctgaaggacctggagctgcaggccgacagcgccatcaagggccgggaggaggccatcaagcagctgaggaagctgcaggcccagatgaaggacttccagcgggagctggaggatgcccgggccagcagagatgagatctttgccacagccaaggaaaatgagaagaaggccaagagcctggaggccgacctgatgcagctgcaggaggacctggccgctgctgagcgggccaggaagcaggccgacctggagaaggaggagctggccgaggagctggccagcagcctgagcggcagaaatgccctgcaggatgagaagaggcggctggaggcccgcatcgcccagctggaggaggagctggaggaggagcagggcaacatggaggccatgtctgacagagtgaggaaggccacccagcaggccgagcagctgagcaatgagctggccacagagaggagcacagcccagaagaatgaaagtgcccggcagcagctggagcggcagaacaaggagctgcggagcaagctgcacgagatggagggcgctgtgaagagcaagttcaagagcaccatcgccgccctggaggccaagatcgcccagctggaggagcaggtggagcaggaggcccgggagaagcaggccgccaccaagagcctgaagcagaaggacaagaagctgaaggagatcctgctgcaggtggaggatgagaggaagatggccgagcagtacaaggagcaggccgagaagggaaatgcccgggtgaagcagctgaagaggcagctggaggaggccgaggaggagagccagaggatcaatgccaacagaaggaagctgcagcgggagctggatgaggccacagagagcaatgaggccatgggccgggaggtgaatgccctgaagagcaagctgcggagaggaaatgagaccagctttgtgcccagccgccgcagcggcggcagaagagtgattgaaaatgctgatggcagcgaggaggagacagacaccagagatgctgacttcaacggcaccaaggccagcgagtag

SEQ ID NO: 160893 - DNA, 5817 bp, Artificial Sequence
  Description of Artificial Sequence: Synthetic coding sequence
atggcccagaagggccagctgagtgatgatgagaagttcctgtttgtggacaagaacttcatcaacagccctgtggcccaggccgactgggccgccaagaggctggtgtgggtgcccagcgagaagcagggctttgaagctgccagcatcaaggaggagaagggagatgaggtggtggtggagctggtggagaatggcaagaaggtgacagtgggcaaggatgacatccagaagatgaacccccccaagttcagcaaggtggaggacatggccgagctgacctgcctgaatgaggcctctgtgctgcacaacctgcgggagcgctacttcagcggcctcatctacacctacagcggcctcttctgtgtggtggtgaacccctacaagcacctgcccatctacagcgagaagatcgtggacatgtacaagggcaagaagagacatgagatgccaccccacatctatgccatcgctgacacagcctaccgctccatgctgcaggaccgggaggaccagagcatcctgtgcacaggagagagcggggccggcaagacagagaacaccaagaaggtgatccagtacctggccgtggtggccagcagccacaagggcaagaaggacaccagcatcactggagagctggagaagcagctgctgcaggccaaccccatcctggaggcctttggaaatgccaagacagtgaagaatgacaacagcagcagatttgggaagttcatccgcatcaactttgatgtgacaggctacatcgtgggcgccaacatcgagacctacctgctggagaagagccgggccatccggcaggccagagatgagaggaccttccacatcttctactacatgattgctggggccaaggagaagatgagaagtgacctgctgctggagggcttcaacaactacaccttcctgagcaatggatttgtgcccatcccagctgcccaggatgatgagatgttccaggagaccgtggaggccatggccatcatgggcttcagcgaggaggagcagctgagcatcctgaaggtggtgtcctctgtgctgcagctgggcaacatcgtgttcaagaaggagaggaacacagaccaggcctccatgccagacaacacagctgcccagaaggtgtgccacctgatgggcatcaacgtgacagacttcaccaggagcatcctgaccccccgcatcaaggtgggcagagatgtggtgcagaaggcccagaccaaggagcaggccgactttgctgtggaggccctggccaaggccacctatgagcggctcttccgctggatcctgaccagggtgaacaaggccctggacaagacccaccggcagggcgccagcttcctgggcatcctggacattgctggctttgagatctttgaggtgaacagctttgagcagctgtgcatcaactacaccaatgagaagctgcagcagctgttcaaccacaccatgttcatcctggagcaggaggagtaccagcgggagggcatcgagtggaacttcatcgactttggcctggacctgcagccctgcatcgagctgattgaaagacccaacaaccccccaggagtgctggccctgctggatgaggagtgctggttccccaaggccacagacaagagctttgtggagaagctgtgcacagagcagggcagccaccccaagttccagaagcccaagcagctgaaggacaagacagagttcagcatcatccactacgccggcaaggtggactacaatgccagcgcctggctgaccaagaacatggaccccctgaatgacaacgtgaccagcctgctgaatgccagcagtgacaagtttgtggccgacctgtggaaggatgtggacagaattgtgggcctggaccagatggccaagatgacagagagcagcctgcccagcgccagcaagaccaagaagggcatgttcagaacagtgggccagctgtacaaggagcagctgggcaagctgatgaccaccctgaggaacaccacccccaactttgtgcgctgcatcatccccaaccacgagaagaggtctgggaagctggatgccttcctggtgctggagcagctgcgctgcaatggagtgctggagggcatccgcatctgccggcagggcttccccaacagaattgtgttccaggagttccggcagagatatgagatcctggccgccaatgccatccccaagggcttcatggatggcaagcaggcctgcatcctgatgatcaaggccctggagctggaccccaacctgtacagaattggccagagcaagatcttcttcagaactggagtgctggcccacctggaggaggagcgggacctgaagatcacagatgtgatcatggccttccaggccatgtgccggggctacctggccaggaaggcctttgccaagaggcagcagcagctgacagccatgaaggtgatccagaggaactgtgccgcctacctgaagctgaggaactggcagtggtggaggctcttcaccaaggtgaagcccctgctgcaggtgacccggcaggaggaggagatgcaggccaaggaggatgagctgcagaagaccaaggagcggcagcagaaggccgagaatgagctgaaggagctggagcagaagcacagccagctgacagaggagaagaacctgctgcaggagcagctgcaggccgagacagagctgtatgcagaggccgaggagatgagggtgcggctggccgccaagaagcaggagctggaggagatcctgcacgagatggaggcccggctggaggaggaggaggaccggggccagcagctgcaggccgagaggaagaagatggcccagcagatgctggacctggaggagcagctggaggaggaggaggccgcccggcagaagctgcagctggagaaggtgacagctgaggccaagatcaagaagctggaggatgagatcctggtgatggatgaccagaacaacaagctgagcaaggagaggaagctgctggaggagcgcatcagtgacctgaccaccaacctggccgaggaggaggagaaggccaagaacctgaccaagctgaagaacaagcatgagagcatgatcagcgagctggaggtgcggctgaagaaggaggagaagagccggcaggagctggagaagctgaagaggaagctggagggagatgccagtgacttccacgagcagattgctgacctgcaggcccagattgctgagctgaagatgcagctggccaagaaggaggaggagctgcaggccgccctggcccggctggatgatgaaattgcccagaagaacaatgccctgaagaagatccgggagctggagggccacatcagtgacctgcaggaggacctggacagcgagcgggccgccaggaacaaggccgagaagcagaagagggacctgggggaggagctggaggccctgaagacagagctggaggacaccctggacagcacagccacccagcaggagctgcgggccaagcgggagcaggaggtgacagtgctgaagaaggccctggatgaggagaccaggagccatgaggcccaggtgcaggagatgaggcagaagcacgcccaggccgtggaggagctgacagagcagctggagcagttcaagagggccaaggccaacctggacaagaacaagcagaccctggagaaggaaaatgctgacctggccggggagctgcgggtgctgggccaggccaagcaggaggtggagcacaagaagaagaagctggaggcccaggtgcaggagctgcagagcaaatgttctgatggagagcgggcccgggcagagctgaatgacaaggtgcacaagctgcagaatgaggtggagagcgtgacaggcatgctgaatgaagctgagggcaaggccatcaagctggccaaggatgtggccagcctgagcagccagctgcaggacacccaggagctgctgcaggaggagacccggcagaagctgaatgtgtccaccaagctgcggcagctggaggaggagaggaacagcctgcaggaccagctggatgaggagatggaggccaagcagaacctggagcggcacatcagcaccctgaacatccagctgagtgacagcaagaagaagctgcaggactttgccagcacagtggaggccctggaggagggcaagaagcgcttccagaaggagattgagaacctgacccagcagtatgaggagaaggctgctgcctatgacaagctggagaagaccaagaaccggctgcagcaggagctggatgacctggtggtggacctggacaaccagaggcagctggtgagcaacctggagaagaagcagaggaagtttgaccagctgctggccgaggagaagaacatcagcagcaaatatgcagatgagcgggacagagctgaggccgaggcccgggagaaggagaccaaggccctgagcctggcccgggccctggaggaggccctggaggccaaggaggagctggagaggaccaacaagatgctgaaggccgagatggaggacctggtgagcagcaaggatgatgtgggcaagaatgtgcatgagctggagaagagcaagagggccctggagacccagatggaggagatgaagacccagctggaggagctggaggatgagctgcaggccacagaagatgccaagctgcggctggaggtgaacatgcaggccctgaagggccagtttgagcgggacctgcaggccagagatgagcagaatgaggagaagaggcggcagctgcagaggcagctgcatgaatatgaaacagagctggaggatgagaggaagcagagggccctggccgctgctgccaagaagaagctggagggggacctgaaggacctggagctgcaggccgacagcgccatcaagggccgggaggaggccatcaagcagctgaggaagctgcaggcccagatgaaggacttccagcgggagctggaggatgcccgggccagcagagatgagatctttgccacagccaaggaaaatgagaagaaggccaagagcctggaggccgacctgatgcagctgcaggaggacctggccgctgctgagcgggccaggaagcaggccgacctggagaaggaggagctggccgaggagctggccagcagcctgagcggcagaaatgccctgcaggatgagaagaggcggctggaggcccgcatcgcccagctggaggaggagctggaggaggagcagggcaacatggaggccatgtctgacagagtgaggaaggccacccagcaggccgagcagctgagcaatgagctggccacagagaggagcacagcccagaagaatgaaagtgcccggcagcagctggagcggcagaacaaggagctgcggagcaagctgcacgagatggagggcgctgtgaagagcaagttcaagagcaccatcgccgccctggaggccaagatcgcccagctggaggagcaggtggagcaggaggcccgggagaagcaggccgccaccaagagcctgaagcagaaggacaagaagctgaaggagatcctgctgcaggtggaggatgagaggaagatggccgagcagtacaaggagcaggccgagaagggaaatgcccgggtgaagcagctgaagaggcagctggaggaggccgaggaggagagccagaggatcaatgccaacagaaggaagctgcagcgggagctggatgaggccacagagagcaatgaggccatgggccgggaggtgaatgccctgaagagcaagctgcggggccccccaccccaggagaccagccagtag

SEQ ID NO: 160894 - DNA, 6090 bp, Artificial Sequence
  Description of Artificial Sequence: Synthetic coding sequence
atggcccagaagggccagctgagtgatgatgagaagttcctgtttgtggacaagaacttcatcaacagccctgtggcccaggccgactgggccgccaagaggctggtgtgggtgcccagcgagaagcagggctttgaagctgccagcatcaaggaggagaagggagatgaggtggtggtggagctggtggagaatggcaagaaggtgacagtgggcaaggatgacatccagaagatgaacccccccaagttcagcaaggtggaggacatggccgagctgacctgcctgaatgaggcctctgtgctgcacaacctgcgggagcgctacttcagcggcctcatctacacctacagcggcctcttctgtgtggtggtgaacccctacaagcacctgcccatctacagcgagaagatcgtggacatgtacaagggcaagaagagacatgagatgccaccccacatctatgccatcgctgacacagcctaccgctccatgctgcaggaccgggaggaccagagcatcctgtgcacaggagagagcggggccggcaagacagagaacaccaagaaggtgatccagtacctggccgtggtggccagcagccacaagggcaagaaggacaccagcatcacagagggccccagcttctggagaggagagctggagaagcagctgctgcaggccaaccccatcctggaggcctttggaaatgccaagacagtgaagaatgacaacagcagcagatttgggaagttcatccgcatcaactttgatgtgacaggctacatcgtgggcgccaacatcgagacctacctgctggagaagagccgggccatccggcaggccagagatgagaggaccttccacatcttctactacatgattgctggggccaaggagaagatgagaagtgacctgctgctggagggcttcaacaactacaccttcctgagcaatggatttgtgcccatcccagctgcccaggatgatgagatgttccaggagaccgtggaggccatggccatcatgggcttcagcgaggaggagcagctgagcatcctgaaggtggtgtcctctgtgctgcagctgggcaacatcgtgttcaagaaggagaggaacacagaccaggcctccatgccagacaacacagctgcccagaaggtgtgccacctgatgggcatcaacgtgacagacttcaccaggagcatcctgaccccccgcatcaaggtgggcagagatgtggtgcagaaggcccagaccaaggagcaggccgactttgctgtggaggccctggccaaggccacctatgaaagactcttccgctggatcctgaccagggtgaacaaggccctggacaagacccaccggcagggcgccagcttcctgggcatcctggacattgctggctttgagatctttgaggtgaacagctttgagcagctgtgcatcaactacaccaatgagaagctgcagcagctgttcaaccacaccatgttcatcctggagcaggaggagtaccagcgggagggcatcgagtggaacttcatcgactttggcctggacctgcagccctgcatcgagctgattgagcggcccaacaaccccccaggagtgctggccctgctggatgaggagtgctggttccccaaggccacagacaagagctttgtggagaagctgtgcacagagcagggcagccaccccaagttccagaagcccaagcagctgaaggacaagacagagttcagcatcatccactacgccggcaaggtggactacaatgccagcgcctggctgaccaagaacatggaccccctgaatgacaacgtgaccagcctgctgaatgccagcagtgacaagtttgtggccgacctgtggaaggatgtggaccgcatcgtgggcctggaccagatggccaagatgacagagagcagcctgcccagcgccagcaagaccaagaagggcatgttcagaacagtgggccagctgtacaaggagcagctgggcaagctgatgaccaccctgaggaacaccacccccaactttgtgcgctgcatcatccccaaccacgagaagaggtctgggaagctggatgccttcctggtgctggagcagctgcgctgcaatggagtgctggagggcatccgcatctgccggcagggcttccccaaccgcatcgtgttccaggagttccggcagagatatgagatcctggccgccaatgccatccccaagggcttcatggatggcaagcaggcctgcatcctgatgatcaaggccctggagctggaccccaacctgtaccgcatcggccagagcaagatcttcttcagaactggagtgctggcccacctggaggaggagcgggacctgaagatcacagatgtgatcatggccttccaggccatgtgccggggctacctggccaggaaggcctttgccaagaggcagcagcagctgacagccatgaaggtgatccagaggaactgtgccgcctacctgaagctgaggaactggcagtggtggaggctcttcaccaaggtgaagcccctgctgcaggtgacccggcaggaggaggagatgcaggccaaggaggatgagctgcagaagaccaaggagcggcagcagaaggcagaaaatgagctgaaggagctggagcagaagcacagccagctgacagaggagaagaacctgctgcaggagcagctgcaggccgagacagagctgtatgcagaggccgaggagatgagggtgcggctggccgccaagaagcaggagctggaggagatcctgcacgagatggaggcccggctggaggaggaggaggaccggggccagcagctgcaggccgagaggaagaagatggcccagcagatgctggacctggaggagcagctggaggaggaggaggccgcccggcagaagctgcagctggagaaggtgacagctgaggccaagatcaagaagctggaggatgagatcctggtgatggatgaccagaacaacaagctgagcaaggagaggaagctgctggaggagcgcatcagtgacctgaccaccaacctggccgaggaggaggagaaggccaagaacctgaccaagctgaagaacaagcatgagagcatgatcagcgagctggaggtgcggctgaagaaggaggagaagagccggcaggagctggagaagctgaagaggaagctggagggagatgccagtgacttccacgagcagattgctgacctgcaggcccagattgctgagctgaagatgcagctggccaagaaggaggaggagctgcaggccgccctggcccggctggatgatgagatcgcccagaagaacaatgccctgaagaagatccgggagctggagggccacatcagtgacctgcaggaggacctggacagcgagagagctgccaggaacaaggccgagaagcagaagagggacctgggggaggagctggaggccctgaagacagagctggaggacaccctggacagcacagccacccagcaggagctgcgggccaagcgggagcaggaggtgacagtgctgaagaaggccctggatgaggagaccaggagccatgaggcccaggtgcaggagatgaggcagaagcacgcccaggccgtggaggagctgacagagcagctggagcagttcaagagggccaaggccaacctggacaagaacaagcagaccctggagaaggaaaatgctgacctggccggggagctgcgggtgctgggccaggccaagcaggaggtggagcacaagaagaagaagctggaggcccaggtgcaggagctgcagagcaagtgcagtgatggagagcgggcccgggcagagctgaatgacaaggtgcacaagctgcagaatgaggtggagagcgtgacaggcatgctgaatgaggccgagggcaaggccatcaagctggccaaggatgtggccagcctgagcagccagctgcaggacacccaggagctgctgcaggaggagacccggcagaagctgaatgtgtccaccaagctgcggcagctggaggaggagaggaacagcctgcaggaccagctggatgaggagatggaggccaagcagaacctggagcggcacatcagcaccctgaacatccagctgagtgacagcaagaagaagctgcaggactttgccagcacagtggaggccctggaggagggcaagaagcgcttccagaaggagattgagaacctgacccagcagtatgaggagaaggccgccgcctatgacaagctggagaagaccaagaaccggctgcagcaggagctggatgacctggtggtggacctggacaaccagaggcagctggtgagcaacctggagaagaagcagaggaagtttgaccagctgctggccgaggagaagaacatcagcagcaaatatgcagatgagcgggacagagctgaggccgaggcccgggagaaggagaccaaggccctgagcctggcccgggccctggaggaggccctggaggccaaggaggagctggagaggaccaacaagatgctgaaggccgagatggaggacctggtgagcagcaaggatgatgtgggcaagaatgtgcatgagctggagaagagcaagagggccctggagacccagatggaggagatgaagacccagctggaggagctggaggatgagctgcaggccacagaagatgccaagctgcggctggaggtgaacatgcaggccctgaagggccagtttgagcgggacctgcaggccagagatgagcagaatgaggagaagaggcggcagctgcagaggcagctgcacgagtatgaaacagagctggaggatgagaggaagcagagggccctggccgccgccgccaagaagaagctggagggggacctgaaggacctggagctgcaggccgacagcgccatcaagggccgggaggaggccatcaagcagctgaggaagctgcaggcccagatgaaggacttccagcgggagctggaggatgcccgggccagcagagatgagatctttgccacagccaaggaaaatgagaagaaggccaagagcctggaggccgacctgatgcagctgcaggaggacctggccgctgctgagcgggccaggaagcaggccgacctggagaaggaggagctggccgaggagctggccagcagcctgtctggaagaaatgccctgcaggatgagaagaggcggctggaggccagaattgcccagctggaggaggagctggaggaggagcagggcaacatggaggccatgtctgacagagtgaggaaggccacccagcaggccgagcagctgagcaatgagctggccacagagaggagcacagcccagaagaatgaaagtgcccggcagcagctggagcggcagaacaaggagctgcggagcaagctgcacgagatggagggcgctgtgaagagcaagttcaagagcaccatcgccgccctggaggccaagatcgcccagctggaggagcaggtggagcaggaggcccgggagaagcaggccgccaccaagagcctgaagcagaaggacaagaagctgaaggagatcctgctgcaggtggaggatgagaggaagatggccgagcagtacaaggagcaggccgagaagggaaatgcccgggtgaagcagctgaagaggcagctggaggaggccgaggaggagagccagaggatcaatgccaacagaaggaagctgcagcgggagctggatgaggccacagagagcaatgaggccatgggccgggaggtgaatgccctgaagagcaagctgcggggccccccccacaggaagctgcggagtgatgcccctggagaggagacccggcccctgtccttcctgctggagggcctggaggatgtggagctgctgaagatgcagatggtgctgcggaggaagaggaccctggagacccagacctccatggagcccaggcctgtgaacaagcagctgagcacagtgctgcaccacggcaagaagaccaagaaccagaacaagcagaccaagaagacccagcagcagcccaggaccaagcagaacccagctgactgcacctag

SEQ ID NO: 160895 - DNA, 5940 bp, Artificial Sequence
  Description of Artificial Sequence: Synthetic coding sequence
atggcccagaagggccagctgagtgatgatgagaagttcctgtttgtggacaagaacttcatcaacagccctgtggcccaggccgactgggccgccaagaggctggtgtgggtgcccagcgagaagcagggctttgaagctgccagcatcaaggaggagaagggagatgaggtggtggtggagctggtggagaatggcaagaaggtgacagtgggcaaggatgacatccagaagatgaacccccccaagttcagcaaggtggaggacatggccgagctgacctgcctgaatgaggcctctgtgctgcacaacctgcgggagcgctacttcagcggcctcatctacacctacagcggcctcttctgtgtggtggtgaacccctacaagcacctgcccatctacagcgagaagatcgtggacatgtacaagggcaagaagagacatgagatgccaccccacatctatgccatcgctgacacagcctaccgctccatgctgcaggaccgggaggaccagagcatcctgtgcacaggagagagcggggccggcaagacagagaacaccaagaaggtgatccagtacctggccgtggtggccagcagccacaagggcaagaaggacaccagcatcacccagggccccagctttgcctacggggagctggagaagcagctgctgcaggccaaccccatcctggaggcctttggaaatgccaagacagtgaagaatgacaacagcagcagatttgggaagttcatccgcatcaactttgatgtgacaggctacatcgtgggcgccaacatcgagacctacctgctggagaagagccgggccatccggcaggccagagatgagaggaccttccacatcttctactacatgattgctggggccaaggagaagatgagaagtgacctgctgctggagggcttcaacaactacaccttcctgagcaatggatttgtgcccatcccagctgcccaggatgatgagatgttccaggagaccgtggaggccatggccatcatgggcttcagcgaggaggagcagctgagcatcctgaaggtggtgtcctctgtgctgcagctgggcaacatcgtgttcaagaaggagaggaacacagaccaggcctccatgccagacaacacagctgcccagaaggtgtgccacctgatgggcatcaacgtgacagacttcaccaggagcatcctgaccccccgcatcaaggtgggcagagatgtggtgcagaaggcccagaccaaggagcaggccgactttgctgtggaggccctggccaaggccacctatgaaagactcttccgctggatcctgaccagggtgaacaaggccctggacaagacccaccggcagggcgccagcttcctgggcatcctggacattgctggctttgagatctttgaggtgaacagctttgagcagctgtgcatcaactacaccaatgagaagctgcagcagctgttcaaccacaccatgttcatcctggagcaggaggagtaccagcgggagggcatcgagtggaacttcatcgactttggcctggacctgcagccctgcatcgagctgattgagcggcccaacaaccccccaggagtgctggccctgctggatgaggagtgctggttccccaaggccacagacaagagctttgtggagaagctgtgcacagagcagggcagccaccccaagttccagaagcccaagcagctgaaggacaagacagagttcagcatcatccactacgccggcaaggtggactacaatgccagcgcctggctgaccaagaacatggaccccctgaatgacaacgtgaccagcctgctgaatgccagcagtgacaagtttgtggccgacctgtggaaggatgtggaccgcatcgtgggcctggaccagatggccaagatgacagagagcagcctgcccagcgccagcaagaccaagaagggcatgttcagaacagtgggccagctgtacaaggagcagctgggcaagctgatgaccaccctgaggaacaccacccccaactttgtgcgctgcatcatccccaaccacgagaagaggtctgggaagctggatgccttcctggtgctggagcagctgcgctgcaatggagtgctggagggcatccgcatctgccggcagggcttccccaaccgcatcgtgttccaggagttccggcagagatatgagatcctggccgccaatgccatccccaagggcttcatggatggcaagcaggcctgcatcctgatgatcaaggccctggagctggaccccaacctgtaccgcatcggccagagcaagatcttcttcagaactggagtgctggcccacctggaggaggagcgggacctgaagatcacagatgtgatcatggccttccaggccatgtgccggggctacctggccaggaaggcctttgccaagaggcagcagcagctgacagccatgaaggtgatccagaggaactgtgccgcctacctgaagctgaggaactggcagtggtggaggctcttcaccaaggtgaagcccctgctgcaggtgacccggcaggaggaggagatgcaggccaaggaggatgagctgcagaagaccaaggagcggcagcagaaggcagaaaatgagctgaaggagctggagcagaagcacagccagctgacagaggagaagaacctgctgcaggagcagctgcaggccgagacagagctgtatgcagaggccgaggagatgagggtgcggctggccgccaagaagcaggagctggaggagatcctgcacgagatggaggcccggctggaggaggaggaggaccggggccagcagctgcaggccgagaggaagaagatggcccagcagatgctggacctggaggagcagctggaggaggaggaggccgcccggcagaagctgcagctggagaaggtgacagctgaggccaagatcaagaagctggaggatgagatcctggtgatggatgaccagaacaacaagctgagcaaggagaggaagctgctggaggagcgcatcagtgacctgaccaccaacctggccgaggaggaggagaaggccaagaacctgaccaagctgaagaacaagcatgagagcatgatcagcgagctggaggtgcggctgaagaaggaggagaagagccggcaggagctggagaagctgaagaggaagctggagggagatgccagtgacttccacgagcagattgctgacctgcaggcccagattgctgagctgaagatgcagctggccaagaaggaggaggagctgcaggccgccctggcccggctggatgatgagatcgcccagaagaacaatgccctgaagaagatccgggagctggagggccacatcagtgacctgcaggaggacctggacagcgagagagctgccaggaacaaggccgagaagcagaagagggacctgggggaggagctggaggccctgaagacagagctggaggacaccctggacagcacagccacccagcaggagctgcgggccaagcgggagcaggaggtgacagtgctgaagaaggccctggatgaggagaccaggagccatgaggcccaggtgcaggagatgaggcagaagcacgcccaggccgtggaggagctgacagagcagctggagcagttcaagagggccaaggccaacctggacaagaacaagcagaccctggagaaggaaaatgctgacctggccggggagctgcgggtgctgggccaggccaagcaggaggtggagcacaagaagaagaagctggaggcccaggtgcaggagctgcagagcaagtgcagtgatggagagcgggcccgggcagagctgaatgacaaggtgcacaagctgcagaatgaggtggagagcgtgacaggcatgctgaatgaggccgagggcaaggccatcaagctggccaaggatgtggccagcctgagcagccagctgcaggacacccaggagctgctgcaggaggagacccggcagaagctgaatgtgtccaccaagctgcggcagctggaggaggagaggaacagcctgcaggaccagctggatgaggagatggaggccaagcagaacctggagcggcacatcagcaccctgaacatccagctgagtgacagcaagaagaagctgcaggactttgccagcacagtggaggccctggaggagggcaagaagcgcttccagaaggagattgagaacctgacccagcagtatgaggagaaggccgccgcctatgacaagctggagaagaccaagaaccggctgcagcaggagctggatgacctggtggtggacctggacaaccagaggcagctggtgagcaacctggagaagaagcagaggaagtttgaccagctgctggccgaggagaagaacatcagcagcaaatatgcagatgagcgggacagagctgaggccgaggcccgggagaaggagaccaaggccctgagcctggcccgggccctggaggaggccctggaggccaaggaggagctggagaggaccaacaagatgctgaaggccgagatggaggacctggtgagcagcaaggatgatgtgggcaagaatgtgcatgagctggagaagagcaagagggccctggagacccagatggaggagatgaagacccagctggaggagctggaggatgagctgcaggccacagaagatgccaagctgcggctggaggtgaacatgcaggccctgaagggccagtttgagcgggacctgcaggccagagatgagcagaatgaggagaagaggcggcagctgcagaggcagctgcacgagtatgaaacagagctggaggatgagaggaagcagagggccctggccgccgccgccaagaagaagctggagggggacctgaaggacctggagctgcaggccgacagcgccatcaagggccgggaggaggccatcaagcagctgaggaagctgcaggcccagatgaaggacttccagcgggagctggaggatgcccgggccagcagagatgagatctttgccacagccaaggaaaatgagaagaaggccaagagcctggaggccgacctgatgcagctgcaggaggacctggccgctgctgagcgggccaggaagcaggccgacctggagaaggaggagctggccgaggagctggccagcagcctgtctggaagaaatgccctgcaggatgagaagaggcggctggaggccagaattgcccagctggaggaggagctggaggaggagcagggcaacatggaggccatgtctgacagagtgaggaaggccacccagcaggccgagcagctgagcaatgagctggccacagagaggagcacagcccagaagaatgaaagtgcccggcagcagctggagcggcagaacaaggagctgcggagcaagctgcacgagatggagggcgctgtgaagagcaagttcaagagcaccatcgccgccctggaggccaagatcgcccagctggaggagcaggtggagcaggaggcccgggagaagcaggccgccaccaagagcctgaagcagaaggacaagaagctgaaggagatcctgctgcaggtggaggatgagaggaagatggccgagcagtacaaggagcaggccgagaagggaaatgcccgggtgaagcagctgaagaggcagctggaggaggccgaggaggagagccagaggatcaatgccaacagaaggaagctgcagcgggagctggatgaggccacagagagcaatgaggccatgggccgggaggtgaatgccctgaagagcaagctgcggagaggaaatgagaccagctttgtgcccagcagaagaagtggcggccggcgggtgattgaaaatgctgatggcagcgaggaggagacagacaccagagatgctgacttcaacggcaccaaggccagcgagtag

SEQ ID NO: 160896 - DNA, 5838 bp, Artificial Sequence
  Description of Artificial Sequence: Synthetic coding sequence
atggcccagaagggccagctgagtgatgatgagaagttcctgtttgtggacaagaacttcatcaacagccctgtggcccaggccgactgggccgccaagaggctggtgtgggtgcccagcgagaagcagggctttgaagctgccagcatcaaggaggagaagggagatgaggtggtggtggagctggtggagaatggcaagaaggtgacagtgggcaaggatgacatccagaagatgaacccccccaagttcagcaaggtggaggacatggccgagctgacctgcctgaatgaggcctctgtgctgcacaacctgcgggagcgctacttcagcggcctcatctacacctacagcggcctcttctgtgtggtggtgaacccctacaagcacctgcccatctacagcgagaagatcgtggacatgtacaagggcaagaagagacatgagatgccaccccacatctatgccatcgctgacacagcctaccgctccatgctgcaggaccgggaggaccagagcatcctgtgcacaggagagagcggggccggcaagacagagaacaccaagaaggtgatccagtacctggccgtggtggccagcagccacaagggcaagaaggacaccagcatcacccagggccccagctttgcctacggggagctggagaagcagctgctgcaggccaaccccatcctggaggcctttggaaatgccaagacagtgaagaatgacaacagcagcagatttgggaagttcatccgcatcaactttgatgtgacaggctacatcgtgggcgccaacatcgagacctacctgctggagaagagccgggccatccggcaggccagagatgagaggaccttccacatcttctactacatgattgctggggccaaggagaagatgagaagtgacctgctgctggagggcttcaacaactacaccttcctgagcaatggatttgtgcccatcccagctgcccaggatgatgagatgttccaggagaccgtggaggccatggccatcatgggcttcagcgaggaggagcagctgagcatcctgaaggtggtgtcctctgtgctgcagctgggcaacatcgtgttcaagaaggagaggaacacagaccaggcctccatgccagacaacacagctgcccagaaggtgtgccacctgatgggcatcaacgtgacagacttcaccaggagcatcctgaccccccgcatcaaggtgggcagagatgtggtgcagaaggcccagaccaaggagcaggccgactttgctgtggaggccctggccaaggccacctatgaaagactcttccgctggatcctgaccagggtgaacaaggccctggacaagacccaccggcagggcgccagcttcctgggcatcctggacattgctggctttgagatctttgaggtgaacagctttgagcagctgtgcatcaactacaccaatgagaagctgcagcagctgttcaaccacaccatgttcatcctggagcaggaggagtaccagcgggagggcatcgagtggaacttcatcgactttggcctggacctgcagccctgcatcgagctgattgagcggcccaacaaccccccaggagtgctggccctgctggatgaggagtgctggttccccaaggccacagacaagagctttgtggagaagctgtgcacagagcagggcagccaccccaagttccagaagcccaagcagctgaaggacaagacagagttcagcatcatccactacgccggcaaggtggactacaatgccagcgcctggctgaccaagaacatggaccccctgaatgacaacgtgaccagcctgctgaatgccagcagtgacaagtttgtggccgacctgtggaaggatgtggaccgcatcgtgggcctggaccagatggccaagatgacagagagcagcctgcccagcgccagcaagaccaagaagggcatgttcagaacagtgggccagctgtacaaggagcagctgggcaagctgatgaccaccctgaggaacaccacccccaactttgtgcgctgcatcatccccaaccacgagaagaggtctgggaagctggatgccttcctggtgctggagcagctgcgctgcaatggagtgctggagggcatccgcatctgccggcagggcttccccaaccgcatcgtgttccaggagttccggcagagatatgagatcctggccgccaatgccatccccaagggcttcatggatggcaagcaggcctgcatcctgatgatcaaggccctggagctggaccccaacctgtaccgcatcggccagagcaagatcttcttcagaactggagtgctggcccacctggaggaggagcgggacctgaagatcacagatgtgatcatggccttccaggccatgtgccggggctacctggccaggaaggcctttgccaagaggcagcagcagctgacagccatgaaggtgatccagaggaactgtgccgcctacctgaagctgaggaactggcagtggtggaggctcttcaccaaggtgaagcccctgctgcaggtgacccggcaggaggaggagatgcaggccaaggaggatgagctgcagaagaccaaggagcggcagcagaaggcagaaaatgagctgaaggagctggagcagaagcacagccagctgacagaggagaagaacctgctgcaggagcagctgcaggccgagacagagctgtatgcagaggccgaggagatgagggtgcggctggccgccaagaagcaggagctggaggagatcctgcacgagatggaggcccggctggaggaggaggaggaccggggccagcagctgcaggccgagaggaagaagatggcccagcagatgctggacctggaggagcagctggaggaggaggaggccgcccggcagaagctgcagctggagaaggtgacagctgaggccaagatcaagaagctggaggatgagatcctggtgatggatgaccagaacaacaagctgagcaaggagaggaagctgctggaggagcgcatcagtgacctgaccaccaacctggccgaggaggaggagaaggccaagaacctgaccaagctgaagaacaagcatgagagcatgatcagcgagctggaggtgcggctgaagaaggaggagaagagccggcaggagctggagaagctgaagaggaagctggagggagatgccagtgacttccacgagcagattgctgacctgcaggcccagattgctgagctgaagatgcagctggccaagaaggaggaggagctgcaggccgccctggcccggctggatgatgagatcgcccagaagaacaatgccctgaagaagatccgggagctggagggccacatcagtgacctgcaggaggacctggacagcgagagagctgccaggaacaaggccgagaagcagaagagggacctgggggaggagctggaggccctgaagacagagctggaggacaccctggacagcacagccacccagcaggagctgcgggccaagcgggagcaggaggtgacagtgctgaagaaggccctggatgaggagaccaggagccatgaggcccaggtgcaggagatgaggcagaagcacgcccaggccgtggaggagctgacagagcagctggagcagttcaagagggccaaggccaacctggacaagaacaagcagaccctggagaaggaaaatgctgacctggccggggagctgcgggtgctgggccaggccaagcaggaggtggagcacaagaagaagaagctggaggcccaggtgcaggagctgcagagcaagtgcagtgatggagagcgggcccgggcagagctgaatgacaaggtgcacaagctgcagaatgaggtggagagcgtgacaggcatgctgaatgaggccgagggcaaggccatcaagctggccaaggatgtggccagcctgagcagccagctgcaggacacccaggagctgctgcaggaggagacccggcagaagctgaatgtgtccaccaagctgcggcagctggaggaggagaggaacagcctgcaggaccagctggatgaggagatggaggccaagcagaacctggagcggcacatcagcaccctgaacatccagctgagtgacagcaagaagaagctgcaggactttgccagcacagtggaggccctggaggagggcaagaagcgcttccagaaggagattgagaacctgacccagcagtatgaggagaaggccgccgcctatgacaagctggagaagaccaagaaccggctgcagcaggagctggatgacctggtggtggacctggacaaccagaggcagctggtgagcaacctggagaagaagcagaggaagtttgaccagctgctggccgaggagaagaacatcagcagcaaatatgcagatgagcgggacagagctgaggccgaggcccgggagaaggagaccaaggccctgagcctggcccgggccctggaggaggccctggaggccaaggaggagctggagaggaccaacaagatgctgaaggccgagatggaggacctggtgagcagcaaggatgatgtgggcaagaatgtgcatgagctggagaagagcaagagggccctggagacccagatggaggagatgaagacccagctggaggagctggaggatgagctgcaggccacagaagatgccaagctgcggctggaggtgaacatgcaggccctgaagggccagtttgagcgggacctgcaggccagagatgagcagaatgaggagaagaggcggcagctgcagaggcagctgcacgagtatgaaacagagctggaggatgagaggaagcagagggccctggccgccgccgccaagaagaagctggagggggacctgaaggacctggagctgcaggccgacagcgccatcaagggccgggaggaggccatcaagcagctgaggaagctgcaggcccagatgaaggacttccagcgggagctggaggatgcccgggccagcagagatgagatctttgccacagccaaggaaaatgagaagaaggccaagagcctggaggccgacctgatgcagctgcaggaggacctggccgctgctgagcgggccaggaagcaggccgacctggagaaggaggagctggccgaggagctggccagcagcctgtctggaagaaatgccctgcaggatgagaagaggcggctggaggccagaattgcccagctggaggaggagctggaggaggagcagggcaacatggaggccatgtctgacagagtgaggaaggccacccagcaggccgagcagctgagcaatgagctggccacagagaggagcacagcccagaagaatgaaagtgcccggcagcagctggagcggcagaacaaggagctgcggagcaagctgcacgagatggagggcgctgtgaagagcaagttcaagagcaccatcgccgccctggaggccaagatcgcccagctggaggagcaggtggagcaggaggcccgggagaagcaggccgccaccaagagcctgaagcagaaggacaagaagctgaaggagatcctgctgcaggtggaggatgagaggaagatggccgagcagtacaaggagcaggccgagaagggaaatgcccgggtgaagcagctgaagaggcagctggaggaggccgaggaggagagccagaggatcaatgccaacagaaggaagctgcagcgggagctggatgaggccacagagagcaatgaggccatgggccgggaggtgaatgccctgaagagcaagctgcggggccccccaccccaggagaccagccagtag

SEQ ID NO: 160897 - DNA, 5817 bp, Artificial Sequence; identical to SEQ ID NO: 160768
  Description of Artificial Sequence: Synthetic coding sequence

SEQ ID NO: 160898 - DNA, 2001 bp, Artificial Sequence
  Description of Artificial Sequence: Synthetic coding sequence
atgctgagccacatgctgtacaagaaggaaaatgccatcgacatcctgggcttcagcagcgaggagaaggtgggcatctacaagctgaccggggctgtgatgcactacggcaacatgaagttcaagcagaagcagcgggaggagcaggccgagccagatggaacagaggtggccgacaaggccggctacctgatgggcctgaacagcgctgagatgctgaagggcctgtgctgcccccgggtgaaggtgggcaatgaatatgtgaccaagggccagaatgtgcagcaggtgaccaacagcgtgggcgccctggccaaggctgtgtatgagaagatgttcctgtggatggtgacccgcatcaaccagcagctggacaccaagcagccccggcagtacttcatcggcgtgctggacattgctggctttgagatctttgacttcaacagcctggagcagctgtgcatcaacttcaccaatgagaagctgcagcagttcttcaaccaccacatgtttgtgctggagcaggaggagtacaagaaggagggcatcgagtgggagttcatcgactttggcatggacctggccgcctgcatcgagctgattgagaagcccatgggcatcttcagcatcctggaggaggagtgcatgttccccaaggccacagacaccagcttcaagaacaagctgtatgaccagcacctgggcaagagcaacaacttccagaagcccaagccagccaagggcaaggccgaggcccacttcagcctggtgcactacgccggcaccgtggactacaacattgctggctggctggacaagaacaaggaccccctgaatgaaacagtggtgggcctgtaccagaagagcagcctgaagctgctgtccttcctgttcagcaactatgctggagctgagaccggggacagcggcggcagcaagaagggcggcaagaagaagggcagcagcttccagacagtgtctgctgtgttccgggagaacctgaacaagctgatgaccaacctgcggagcacccacccccactttgtgcgctgcctgatccccaatgagaccaagaccccaggagtgatggaccactacctggtgatgcaccagctgcgctgcaatggagtgctggagggcatccgcatctgcaggaagggcttccccagccgcatcctgtatgctgacttcaagcagcgctaccgcatcctgaatgccagcgccatccctgagggccagttcatcgacagcaagaatgccagcgagaagctgctgaacagcattgatgtggaccgggagcagttccgctttggaaacaccaaggtgttcttcaaggccggcctgctgggcctgctggaggagatgagagatgagaagctggtgaccctgatgaccagcacccaggccgtgtgccggggctacctgatgagggtggagttcaagaagatgatggagcggcgggacagcatcttctgcatccagtacaacatccgctccttcatgaatgtgaagcactggccctggatgaacctcttcttcaagatcaagcccctgctgaagtctgctgaggccgagaaggagatggccaccatgaaggaggactttgagaggaccaaggaggagctggcccggtctgaggcccggaggaaggagctgacagagcggctggaggaggaggaggagatgaacagcgagctggtggccaagaagaggaacctggaggacaagtgcagcagcctgaagagggacattgatgacctggagctgaccctgaccaaggtggagaaggagaagcacgccacagagaacaaggtgaagaacctgtctgaggagatgacagccctggaggagaacatcagcaagctgaccaaggagaagaagagcctgcaggaggcccaccagcagaccctggatgacctgcaggtggaggaggacaaggtgaatggcctcatcaagatcaatgccaagctggagcagcagacagatgatgaaggagtgtag

SEQ ID NO: 160899 - DNA, 6111 bp, Artificial Sequence; identical to SEQ ID NO: 160769
  Description of Artificial Sequence: Synthetic coding sequence

SEQ ID NO: 160900 - DNA, 4437 bp, Artificial Sequence
  Description of Artificial Sequence: Synthetic coding sequence
atggctgctgtgaccatgtctgtgcccggcaggaaggccccacccaggcctggccctgtgcctgaggccgcccagcccttcctgttcaccccccggggccccagcgctgggggcggccctggcagcggcaccagcccccaggtggagtggacagcccggcggctggtgtgggtgcccagcgagctgcacggctttgaagctgctgccctgagagatgaaggagaggaggaggccgaggtggagctggccgagagcggccgccgcctgcggctgccccgggaccagatccagaggatgaacccccccaagttcagcaaggccgaggacatggccgagctgacctgcctgaatgaggcctctgtgctgcacaacctgcgggagcgctactacagcggcctcatctacacctacagcggcctcttctgtgtggtgatcaacccctacaagcagctgcccatctacacagaggccatcgtggagatgtaccggggcaagaagagacatgaggtgccccctcatgtgtatgctgtgacagagggcgcctaccgctccatgctgcaggaccgggaggaccagagcatcctgtgcacaggagagagcggggccggcaagacagagaacaccaagaaggtgatccagtacctggcccacgtggccagcagccccaagggcaggaaggagcccggggtgcctggagagctggagcggcagctgctgcaggccaaccccatcctggaggcctttggaaatgccaagacagtgaagaatgacaacagcagcagatttgggaagttcatccgcatcaactttgatgtggccggctacatcgtgggcgccaacatcgagacctacctgctggagaagagccgggccatccggcaggccaaggatgagtgcagcttccacatcttctaccagctgctgggcggggccggggagcagctgaaggctgacctgctgctggagccctgcagccactaccgcttcctgaccaacggccccagcagcagccctggccaggagcgggagctgttccaggagaccctggagagcctgcgggtgctgggcttcagccatgaggagatcatctccatgctgaggatggtgtctgctgtgctgcagtttggaaacatcgccctgaagcgggagaggaacacagaccaggccaccatgccagacaacacagctgcccagaagctgtgccgcctgctgggcctgggcgtgacagacttcagccgggccctgctgaccccccgcatcaaggtgggccgggactatgtgcagaaggcccagaccaaggagcaggccgactttgccctggaggccctggccaaggccacctatgaaagactcttccgctggctggtgctgcggctgaacagagccctggacaggagcccccggcagggcgccagcttcctgggcatcctggacattgctggctttgagatcttccagctgaacagctttgagcagctgtgcatcaactacaccaatgagaagctgcagcagctgttcaaccacaccatgtttgtgctggagcaggaggagtaccagcgggagggcatcccctggaccttcctggactttggcctggacctgcagccctgcatcgacctgattgaaagacctgccaaccccccaggcctgctggccctgctggatgaggagtgctggttccccaaggccacagacaagagctttgtggagaaggtggcccaggagcagggcggccaccccaagttccagaggcccaggcacctgcgggaccaggccgacttctctgtgctgcactacgccggcaaggtggactacaaggccaatgagtggctgatgaagaacatggaccccctgaatgacaacgtggccgccctgctgcaccagagcacagaccggctgacagctgagatctggaaggatgtggagggcatcgtgggcctggagcaggtgagcagcctgggagatggccccccaggcggccggccccggcggggcatgttcagaacagtgggccagctgtacaaggagagcctgagccggctgatggccaccctgagcaacaccaaccccagctttgtgcgctgcatcgtgcccaaccacgagaagagagctgggaagctggagccccggctggtgctggaccagctgcgctgcaatggagtgctggagggcatccgcatctgccggcagggcttccccaaccgcatcctcttccaggagttccggcagagatatgagatcctgaccccaaatgccatccccaagggcttcatggatggcaagcaggcctgtgagaagatgatccaggccctggagctggaccccaacctgtacagagtgggccagagcaagatcttcttccgggccggcgtgctggcccagctggaggaggagcgggacctgaaggtgacagacatcatcgtgtccttccaggccgccgcccggggctacctggcccggcgggccttccagaagaggcagcagcagcagagcgccctgcgggtgatgcagaggaactgtgccgcctacctgaagctgcggcactggcagtggtggaggctcttcaccaaggtgaagcccctgctgcaggtgacccggcaggatgaggtgctgcaggcccgggcccaggagctgcagaaggtgcaggagctgcagcagcagagcgcccgggaggtgggggagctgcagggccgggtggcccagctggaggaggagcgggcccggctggccgagcagctgcgggcagaggccgagctgtgtgccgaggccgaggagacccggggccgcctggccgccaggaagcaggagctggagctggtggtgtctgagctggaggcccgggtgggggaggaggaggagtgcagccggcagatgcagacagagaagaagaggctgcagcagcacatccaggagctggaggcccacctggaggccgaggagggcgcccggcagaagctgcagctggagaaggtgaccacagaggccaagatgaagaagtttgaggaggacctgctgctgctggaggaccagaacagcaagctgagcaagagcggcagctgctggaagatcgtgtggcccagcagccacccccggcagctgcggaggagaagaagaagccgggccagcatctcctatggcagcaacatgaggccccagagccagacctggagggaccggctgaggaaggaggagaagggccggcaggagctggagaagctgaagaggcggctggatggagagagcagcgagctgcaggagcagatggtggagcagcagcagagagctgaggagctgcgggcccagctgggcaggaaggaggaggagctgcaggccgccctggcccgggcagaagatgagggcggggcccgggcccagctgctgaagagcctgcgggaggcccaggccgccctggccgaggcccaggaggacctggagagcgagcgggtggcccggaccaaggccgagaagcagaggcgggacctgggggaggagctggaggccctgcggggggagctggaggacaccctggacagcaccaatgcccagcaggagctgcggagcaagcgggagcaggaggtgacagagctgaagaagaccctggaggaggagacccgcatccatgaagctgctgtgcaggagctgcggcagagacatggccaggccctgggggagctggccgagcagctggagcaggcccggcggggcaagggggcctgggagaagacccggctggccctggaggccgaggtgtctgagctgcgggcagagctgagcagcctgcagacagcccggcaggagggggagcagaggagaagaaggctggagctgcagctgcaggaggtgcagggccgggctggagatggagagcgggcccgggcagaggccgctgagaagctgcagagggcccaggccgagctggagaatgtgtctggggccctgaatgaggccgagagcaagaccatccggctgagcaaggagctgagcagcacagaggcccagctgcatgatgcccaggagctgctgcaggaggagacccgggccaagctggccctgggcagccgggtgcgggccatggaggccgaggccgccggcctgcgggagcagctggaggaggaggccgccgcccgggagagagctggccgggagctgcagacagcccaggcccagctgtctgagtggaggcggcggcaggaggaggaggccggggccctggaggccggggaggaggcccggcggcgggccgcccgggaggccgaggccctgacccagaggctggccgagaagacagaaacagtggaccggctggagcggggcagaagaaggctgcagcaggagctggatgatgccaccctgagcccagatgccctgacagatggagcccagccccccagcagcctggaccccaccggcccctgccccaggaacccagccctgtag

SEQ ID NO: 160901 - DNA, 5340 bp, Artificial Sequence
  Description of Artificial Sequence: Synthetic coding sequence
atggctgctgtgaccatgtctgtgcccggcaggaaggccccacccaggcctggccctgtgcctgaggccgcccagcccttcctgttcaccccccggggccccagcgctgggggcggccctggcagcggcaccagcccccaggtggagtggacagcccggcggctggtgtgggtgcccagcgagctgcacggctttgaagctgctgccctgagagatgaaggagaggaggaggccgaggtggagctggccgagagcggccgccgcctgcggctgccccgggaccagatccagaggatgaacccccccaagttcagcaaggccgaggacatggccgagctgacctgcctgaatgaggcctctgtgctgcacaacctgcgggagcgctactacagcggcctcatctacacctacagcggcctcttctgtgtggtgatcaacccctacaagcagctgcccatctacacagaggccatcgtggagatgtaccggggcaagaagagacatgaggtgccccctcatgtgtatgctgtgacagagggcgcctaccgctccatgctgcaggaccgggaggaccagagcatcctgtgcacaggagagagcggggccggcaagacagagaacaccaagaaggtgatccagtacctggcccacgtggccagcagccccaagggcaggaaggagcccggggtgcctggagagctggagcggcagctgctgcaggccaaccccatcctggaggcctttggaaatgccaagacagtgaagaatgacaacagcagcagatttgggaagttcatccgcatcaactttgatgtggccggctacatcgtgggcgccaacatcgagacctacctgctggagaagagccgggccatccggcaggccaaggatgagtgcagcttccacatcttctaccagctgctgggcggggccggggagcagctgaaggctgacctgctgctggagccctgcagccactaccgcttcctgaccaacggccccagcagcagccctggccaggagcgggagctgttccaggagaccctggagagcctgcgggtgctgggcttcagccatgaggagatcatctccatgctgaggatggtgtctgctgtgctgcagtttggaaacatcgccctgaagcgggagaggaacacagaccaggccaccatgccagacaacacagctgcccagaagctgtgccgcctgctgggcctgggcgtgacagacttcagccgggccctgctgaccccccgcatcaaggtgggccgggactatgtgcagaaggcccagaccaaggagcaggccgactttgccctggaggccctggccaaggccacctatgaaagactcttccgctggctggtgctgcggctgaacagagccctggacaggagcccccggcagggcgccagcttcctgggcatcctggacattgctggctttgagatcttccagctgaacagctttgagcagctgtgcatcaactacaccaatgagaagctgcagcagctgttcaaccacaccatgtttgtgctggagcaggaggagtaccagcgggagggcatcccctggaccttcctggactttggcctggacctgcagccctgcatcgacctgattgaaagacctgccaaccccccaggcctgctggccctgctggatgaggagtgctggttccccaaggccacagacaagagctttgtggagaaggtggcccaggagcagggcggccaccccaagttccagaggcccaggcacctgcgggaccaggccgacttctctgtgctgcactacgccggcaaggtggactacaaggccaatgagtggctgatgaagaacatggaccccctgaatgacaacgtggccgccctgctgcaccagagcacagaccggctgacagctgagatctggaaggatgtggagggcatcgtgggcctggagcaggtgagcagcctgggagatggccccccaggcggccggccccggcggggcatgttcagaacagtgggccagctgtacaaggagagcctgagccggctgatggccaccctgagcaacaccaaccccagctttgtgcgctgcatcgtgcccaaccacgagaagagagctgggaagctggagccccggctggtgctggaccagctgcgctgcaatggagtgctggagggcatccgcatctgccggcagggcttccccaaccgcatcctcttccaggagttccggcagagatatgagatcctgaccccaaatgccatccccaagggcttcatggatggcaagcaggcctgtgagaagatgatccaggccctggagctggaccccaacctgtacagagtgggccagagcaagatcttcttccgggccggcgtgctggcccagctggaggaggagcgggacctgaaggtgacagacatcatcgtgtccttccaggccgccgcccggggctacctggcccggcgggccttccagaagaggcagcagcagcagagcgccctgcgggtgatgcagaggaactgtgccgcctacctgaagctgcggcactggcagtggtggaggctcttcaccaaggtgaagcccctgctgcaggtgacccggcaggatgaggtgctgcaggcccgggcccaggagctgcagaaggtgcaggagctgcagcagcagagcgcccgggaggtgggggagctgcagggccgggtggcccagctggaggaggagcgggcccggctggccgagcagctgcgggcagaggccgagctgtgtgccgaggccgaggagacccggggccgcctggccgccaggaagcaggagctggagctggtggtgtctgagctggaggcccgggtgggggaggaggaggagtgcagccggcagatgcagacagagaagaagaggctgcagcagcacatccaggagctggaggcccacctggaggccgaggagggcgcccggcagaagctgcagctggagaaggtgaccacagaggccaagatgaagaagtttgaggaggacctgctgctgctggaggaccagaacagcaagctgagcaagagcggcagctgctggaagatcgtgtggcccagcagccacccccggcagctgcggaggagaagaagaagccgggccagcatctcctatggcagcaacatgaggccccagagccagacctggagggaccggctgaggaaggaggagaagggccggcaggagctggagaagctgaagaggcggctggatggagagagcagcgagctgcaggagcagatggtggagcagcagcagagagctgaggagctgcgggcccagctgggcaggaaggaggaggagctgcaggccgccctggcccgggcagaagatgagggcggggcccgggcccagctgctgaagagcctgcgggaggcccaggccgccctggccgaggcccaggaggacctggagagcgagcgggtggcccggaccaaggccgagaagcagaggcgggacctgggggaggagctggaggccctgcggggggagctggaggacaccctggacagcaccaatgcccagcaggagctgcggagcaagcgggagcaggaggtgacagagctgaagaagaccctggaggaggagacccgcatccatgaagctgctgtgcaggagctgcggcagagacatggccaggccctgggggagctggccgagcagctggagcaggcccggcggggcaagggggcctgggagaagacccggctggccctggaggccgaggtgtctgagctgcgggcagagctgagcagcctgcagacagcccggcaggagggggagcagaggagaagaaggctggagctgcagctgcaggaggtgcagggccgggctggagatggagagcgggcccgggcagaggccgctgagaagctgcagagggcccaggccgagctggagaatgtgtctggggccctgaatgaggccctgctgagcagcaaggatgatgtgggcaagtctgtgcatgagctggagcgggcctgccgggtggccgagcaggccgccaatgacctgcgggcccaggtgacagagctggaggatgagctgacagctgctgaagatgccaagctgcggctggaggtgacagtgcaggccctgaagacccagcacgagcgggacctgcagggcagagatgaagctggggaggagcggcggcggcagctggccaagcagctgagagatgctgaggtggagagagatgaggagaggaagcagaggaccctggccgtggccgccaggaagaagctggagggggagctggaggagctgaaggcccagatggccagcgctggccagggcaaggaggaggccgtgaagcagctgaggaagatgcaggcccagatgaaggagctgtggagggaggtggaggagaccaggaccagccgggaggagatcttcagccagaaccgggagagcgagaagaggctgaagggcctggaggccgaggtgctgcggctgcaggaggagctggccgccagtgaccgggcccggcggcaggcccagcaggacagagatgagatggctgatgaggtggccaacggcaacctgagcaaggccgccatcctggaggagaagaggcagctggagggccgcctgggccagctggaggaggagctggaggaggagcagagcaacagcgagctgctgaatgaccgctacaggaagctgctgctgcaggtggagagcctgaccacagagctgtctgctgagaggagcttcagcgccaaggccgagagcggccggcagcagctggagcggcagatccaggagctgcggggccgcctgggggaggaggatgctggggcccgggcccggcacaagatgaccatcgccgccctggagagcaagctggcccaggccgaggagcagctggagcaggagacccgggagcgcatcctgagcggcaagctggtgcggcgggcagagaagaggctgaaggaggtggtgctgcaggtggaggaggagaggagagtggccgaccagctgcgggaccagctggagaagggcaacctgcgggtgaagcagctgaagaggcagctggaggaggccgaggaggaggccagccgggcccaggccggcagaagaaggctgcagcgggagctggaggatgtgacagagagcgctgagagcatgaaccgggaggtgaccaccctgaggaaccggctgcggcggggccccctgaccttcaccaccaggacagtgcggcaggtgttccggctggaggagggcgtggccagtgatgaggaggccgaggaggcccagcccggcagcggccccagccctgagcctgagggcagccccccagcccacccccagtag

SEQ ID NO: 160902 - DNA, 6087 bp, Artificial Sequence
  Description of Artificial Sequence: Synthetic coding sequence
atggctgctgtgaccatgtctgtgcccggcaggaaggccccacccaggcctggccctgtgcctgaggccgcccagcccttcctgttcaccccccggggccccagcgctgggggcggccctggcagcggcaccagcccccaggtggagtggacagcccggcggctggtgtgggtgcccagcgagctgcacggctttgaagctgctgccctgagagatgaaggagaggaggaggccgaggtggagctggccgagagcggccgccgcctgcggctgccccgggaccagatccagaggatgaacccccccaagttcagcaaggccgaggacatggccgagctgacctgcctgaatgaggcctctgtgctgcacaacctgcgggagcgctactacagcggcctcatctacacctacagcggcctcttctgtgtggtgatcaacccctacaagcagctgcccatctacacagaggccatcgtggagatgtaccggggcaagaagagacatgaggtgccccctcatgtgtatgctgtgacagagggcgcctaccgctccatgctgcaggaccgggaggaccagagcatcctgtgcacaggagagagcggggccggcaagacagagaacaccaagaaggtgatccagtacctggcccacgtggccagcagccccaagggcaggaaggagcccggggtgcctggagagctggagcggcagctgctgcaggccaaccccatcctggaggcctttggaaatgccaagacagtgaagaatgacaacagcagcagatttgggaagttcatccgcatcaactttgatgtggccggctacatcgtgggcgccaacatcgagacctacctgctggagaagagccgggccatccggcaggccaaggatgagtgcagcttccacatcttctaccagctgctgggcggggccggggagcagctgaaggctgacctgctgctggagccctgcagccactaccgcttcctgaccaacggccccagcagcagccctggccaggagcgggagctgttccaggagaccctggagagcctgcgggtgctgggcttcagccatgaggagatcatctccatgctgaggatggtgtctgctgtgctgcagtttggaaacatcgccctgaagcgggagaggaacacagaccaggccaccatgccagacaacacagctgcccagaagctgtgccgcctgctgggcctgggcgtgacagacttcagccgggccctgctgaccccccgcatcaaggtgggccgggactatgtgcagaaggcccagaccaaggagcaggccgactttgccctggaggccctggccaaggccacctatgaaagactcttccgctggctggtgctgcggctgaacagagccctggacaggagcccccggcagggcgccagcttcctgggcatcctggacattgctggctttgagatcttccagctgaacagctttgagcagctgtgcatcaactacaccaatgagaagctgcagcagctgttcaaccacaccatgtttgtgctggagcaggaggagtaccagcgggagggcatcccctggaccttcctggactttggcctggacctgcagccctgcatcgacctgattgaaagacctgccaaccccccaggcctgctggccctgctggatgaggagtgctggttccccaaggccacagacaagagctttgtggagaaggtggcccaggagcagggcggccaccccaagttccagaggcccaggcacctgcgggaccaggccgacttctctgtgctgcactacgccggcaaggtggactacaaggccaatgagtggctgatgaagaacatggaccccctgaatgacaacgtggccgccctgctgcaccagagcacagaccggctgacagctgagatctggaaggatgagcacggcggcttccagcagttctccttcctgggcagcttcccccccagccccccaggcagcgctgagcgctgcagcagcgccatcagccccccaggagtggagggcatcgtgggcctggagcaggtgagcagcctgggagatggccccccaggcggccggccccggcggggcatgttcagaacagtgggccagctgtacaaggagagcctgagccggctgatggccaccctgagcaacaccaaccccagctttgtgcgctgcatcgtgcccaaccacgagaagagagctgggaagctggagccccggctggtgctggaccagctgcgctgcaatggagtgctggagggcatccgcatctgccggcagggcttccccaaccgcatcctcttccaggagttccggcagagatatgagatcctgaccccaaatgccatccccaagggcttcatggatggcaagcaggcctgtgagaagatgatccaggccctggagctggaccccaacctgtacagagtgggccagagcaagatcttcttccgggccggcgtgctggcccagctggaggaggagcgggacctgaaggtgacagacatcatcgtgtccttccaggccgccgcccggggctacctggcccggcgggccttccagaagaggcagcagcagcagagcgccctgcgggtgatgcagaggaactgtgccgcctacctgaagctgcggcactggcagtggtggaggctcttcaccaaggtgaagcccctgctgcaggtgacccggcaggatgaggtgctgcaggcccgggcccaggagctgcagaaggtgcaggagctgcagcagcagagcgcccgggaggtgggggagctgcagggccgggtggcccagctggaggaggagcgggcccggctggccgagcagctgcgggcagaggccgagctgtgtgccgaggccgaggagacccggggccgcctggccgccaggaagcaggagctggagctggtggtgtctgagctggaggcccgggtgggggaggaggaggagtgcagccggcagatgcagacagagaagaagaggctgcagcagcacatccaggagctggaggcccacctggaggccgaggagggcgcccggcagaagctgcagctggagaaggtgaccacagaggccaagatgaagaagtttgaggaggacctgctgctgctggaggaccagaacagcaagctgagcaaggagaggaagctgctggaggaccggctggccgagttcagcagccaggccgctgaggaggaggagaaggtgaagagcctgaacaagctgcggctgaagtatgaggccaccatcgctgacatggaggaccggctgaggaaggaggagaagggccggcaggagctggagaagctgaagaggcggctggatggagagagcagcgagctgcaggagcagatggtggagcagcagcagagagctgaggagctgcgggcccagctgggcaggaaggaggaggagctgcaggccgccctggcccgggcagaagatgaaggaggagcccgggcccagctgctgaagagcctgcgggaggcccaggccgccctggccgaggcccaggaggacctggagagcgagcgggtggcccggaccaaggccgagaagcagaggcgggacctgggggaggagctggaggccctgcggggggagctggaggacaccctggacagcaccaatgcccagcaggagctgcggagcaagcgggagcaggaggtgacagagctgaagaagaccctggaggaggagacccgcatccacgaggccgctgtgcaggagctgcggcagagacatggccaggccctgggggagctggccgagcagctggagcaggcccggcggggcaaaggagcctgggagaagacccggctggccctggaggccgaggtgtctgagctgcgggcagagctgagcagcctgcagacagcccggcaggagggggagcagaggagaagaaggctggagctgcagctgcaggaggtgcagggccgggctggagatggagagcgggcccgggcagaggccgctgagaagctgcagagggcccaggccgagctggagaatgtgtctggggccctgaatgaagctgagagcaagaccatccggctgagcaaggagctgagcagcacagaggcccagctgcatgatgcccaggagctgctgcaggaggagacccgggccaagctggccctgggcagccgggtgcgggccatggaggccgaggccgccggcctgcgggagcagctggaggaggaggccgccgcccgggagcgggccggccgggagctgcagacagcccaggcccagctgtctgagtggaggcggcggcaggaggaggaggccggggccctggaggccggggaggaggccaggagaagagctgcccgggaggccgaggccctgacccagaggctggccgagaagacagagaccgtggaccggctggagcggggcagaagaaggctgcagcaggagctggatgatgccaccatggacctggagcagcagaggcagctggtgtccaccctggagaagaagcagaggaagtttgaccagctgctggccgaggagaaggctgctgtgctgcgggctgtggaggagcgggagcgggcagaggccgagggccgggagcgggaggcccgggccctgagcctgacccgggccctggaggaggagcaggaggcccgggaggagctggagcggcagaacagagccctgcgggcagagctggaggccctgctgagcagcaaggatgatgtgggcaagtctgtgcatgagctggagcgggcctgccgggtggccgagcaggccgccaatgacctgcgggcccaggtgacagagctggaggatgagctgacagctgctgaagatgccaagctgcggctggaggtgacagtgcaggccctgaagacccagcacgagcgggacctgcagggcagagatgaggccggggaggagcggcggcggcagctggccaagcagctgagagatgctgaggtggagagagatgaggagaggaagcagaggaccctggccgtggccgccaggaagaagctggagggggagctggaggagctgaaggcccagatggccagcgctggccagggcaaggaggaggccgtgaagcagctgaggaagatgcaggcccagatgaaggagctgtggagggaggtggaggagaccaggaccagccgggaggagatcttcagccagaaccgggagagcgagaagaggctgaagggcctggaggccgaggtgctgcggctgcaggaggagctggccgccagtgaccgggcccggcggcaggcccagcaggacagagatgagatggctgatgaggtggccaatggaaacctgagcaaggccgccatcctggaggagaagaggcagctggagggccgcctgggccagctggaggaggagctggaggaggagcagagcaacagcgagctgctgaatgaccgctacaggaagctgctgctgcaggtggagagcctgaccacagagctgtctgctgagaggagcttcagcgccaaggccgagagcggccggcagcagctggagcggcagatccaggagctgcggggccgcctgggggaggaggatgctggggcccgggcccggcacaagatgaccatcgccgccctggagagcaagctggcccaggccgaggagcagctggagcaggagacccgggagcgcatcctgagcggcaagctggtgagaagagctgagaagaggctgaaggaggtggtgctgcaggtggaggaggagcggcgggtggccgaccagctgcgggaccagctggagaagggcaacctgcgggtgaagcagctgaagaggcagctggaggaggccgaggaggaggccagccgggcccaggccggcagaagaaggctgcagcgggagctggaggatgtgacagaatctgctgagagcatgaaccgggaggtgaccaccctgaggaaccggctgcggcggggccccctgaccttcaccaccaggacagtgcggcaggtgttccggctggaggagggcgtggccagtgatgaggaggccgaggaggcccagcccggcagcggccccagccctgagcctgagggcagccccccagcccacccccagtag

SEQ ID NO: 160903 - DNA, 6012 bp, Artificial Sequence
  Description of Artificial Sequence: Synthetic coding sequence
atggctgctgtgaccatgtctgtgcccggcaggaaggccccacccaggcctggccctgtgcctgaggccgcccagcccttcctgttcaccccccggggccccagcgctgggggcggccctggcagcggcaccagcccccaggtggagtggacagcccggcggctggtgtgggtgcccagcgagctgcacggctttgaagctgctgccctgagagatgaaggagaggaggaggccgaggtggagctggccgagagcggccgccgcctgcggctgccccgggaccagatccagaggatgaacccccccaagttcagcaaggccgaggacatggccgagctgacctgcctgaatgaggcctctgtgctgcacaacctgcgggagcgctactacagcggcctcatctacacctacagcggcctcttctgtgtggtgatcaacccctacaagcagctgcccatctacacagaggccatcgtggagatgtaccggggcaagaagagacatgaggtgccccctcatgtgtatgctgtgacagagggcgcctaccgctccatgctgcaggaccgggaggaccagagcatcctgtgcacaggagagagcggggccggcaagacagagaacaccaagaaggtgatccagtacctggcccacgtggccagcagccccaagggcaggaaggagcccggggtgcctgcctctgtgtccacagtgtcctatggagagctggagcggcagctgctgcaggccaaccccatcctggaggcctttggaaatgccaagacagtgaagaatgacaacagcagcagatttgggaagttcatccgcatcaactttgatgtggccggctacatcgtgggcgccaacatcgagacctacctgctggagaagagccgggccatccggcaggccaaggatgagtgcagcttccacatcttctaccagctgctgggcggggccggggagcagctgaaggctgacctgctgctggagccctgcagccactaccgcttcctgaccaacggccccagcagcagccctggccaggagcgggagctgttccaggagaccctggagagcctgcgggtgctgggcttcagccatgaggagatcatctccatgctgaggatggtgtctgctgtgctgcagtttggaaacatcgccctgaagcgggagaggaacacagaccaggccaccatgccagacaacacagctgcccagaagctgtgccgcctgctgggcctgggcgtgacagacttcagccgggccctgctgaccccccgcatcaaggtgggccgggactatgtgcagaaggcccagaccaaggagcaggccgactttgccctggaggccctggccaaggccacctatgaaagactcttccgctggctggtgctgcggctgaacagagccctggacaggagcccccggcagggcgccagcttcctgggcatcctggacattgctggctttgagatcttccagctgaacagctttgagcagctgtgcatcaactacaccaatgagaagctgcagcagctgttcaaccacaccatgtttgtgctggagcaggaggagtaccagcgggagggcatcccctggaccttcctggactttggcctggacctgcagccctgcatcgacctgattgaaagacctgccaaccccccaggcctgctggccctgctggatgaggagtgctggttccccaaggccacagacaagagctttgtggagaaggtggcccaggagcagggcggccaccccaagttccagaggcccaggcacctgcgggaccaggccgacttctctgtgctgcactacgccggcaaggtggactacaaggccaatgagtggctgatgaagaacatggaccccctgaatgacaacgtggccgccctgctgcaccagagcacagaccggctgacagctgagatctggaaggatgtggagggcatcgtgggcctggagcaggtgagcagcctgggagatggccccccaggcggccggccccggcggggcatgttcagaacagtgggccagctgtacaaggagagcctgagccggctgatggccaccctgagcaacaccaaccccagctttgtgcgctgcatcgtgcccaaccacgagaagagagctgggaagctggagccccggctggtgctggaccagctgcgctgcaatggagtgctggagggcatccgcatctgccggcagggcttccccaaccgcatcctcttccaggagttccggcagagatatgagatcctgaccccaaatgccatccccaagggcttcatggatggcaagcaggcctgtgagaagatgatccaggccctggagctggaccccaacctgtacagagtgggccagagcaagatcttcttccgggccggcgtgctggcccagctggaggaggagcgggacctgaaggtgacagacatcatcgtgtccttccaggccgccgcccggggctacctggcccggcgggccttccagaagaggcagcagcagcagagcgccctgcgggtgatgcagaggaactgtgccgcctacctgaagctgcggcactggcagtggtggaggctcttcaccaaggtgaagcccctgctgcaggtgacccggcaggatgaggtgctgcaggcccgggcccaggagctgcagaaggtgcaggagctgcagcagcagagcgcccgggaggtgggggagctgcagggccgggtggcccagctggaggaggagcgggcccggctggccgagcagctgcgggcagaggccgagctgtgtgccgaggccgaggagacccggggccgcctggccgccaggaagcaggagctggagctggtggtgtctgagctggaggcccgggtgggggaggaggaggagtgcagccggcagatgcagacagagaagaagaggctgcagcagcacatccaggagctggaggcccacctggaggccgaggagggcgcccggcagaagctgcagctggagaaggtgaccacagaggccaagatgaagaagtttgaggaggacctgctgctgctggaggaccagaacagcaagctgagcaaggagaggaagctgctggaggaccggctggccgagttcagcagccaggccgctgaggaggaggagaaggtgaagagcctgaacaagctgcggctgaagtatgaggccaccatcgctgacatggaggaccggctgaggaaggaggagaagggccggcaggagctggagaagctgaagaggcggctggatggagagagcagcgagctgcaggagcagatggtggagcagcagcagagagctgaggagctgcgggcccagctgggcaggaaggaggaggagctgcaggccgccctggcccgggcagaagatgagggcggggcccgggcccagctgctgaagagcctgcgggaggcccaggccgccctggccgaggcccaggaggacctggagagcgagcgggtggcccggaccaaggccgagaagcagaggcgggacctgggggaggagctggaggccctgcggggggagctggaggacaccctggacagcaccaatgcccagcaggagctgcggagcaagcgggagcaggaggtgacagagctgaagaagaccctggaggaggagacccgcatccatgaagctgctgtgcaggagctgcggcagagacatggccaggccctgggggagctggccgagcagctggagcaggcccggcggggcaagggggcctgggagaagacccggctggccctggaggccgaggtgtctgagctgcgggcagagctgagcagcctgcagacagcccggcaggagggggagcagaggagaagaaggctggagctgcagctgcaggaggtgcagggccgggctggagatggagagcgggcccgggcagaggccgctgagaagctgcagagggcccaggccgagctggagaatgtgtctggggccctgaatgaggccgagagcaagaccatccggctgagcaaggagctgagcagcacagaggcccagctgcatgatgcccaggagctgctgcaggaggagacccgggccaagctggccctgggcagccgggtgcgggccatggaggccgaggccgccggcctgcgggagcagctggaggaggaggccgccgcccgggagagagctggccgggagctgcagacagcccaggcccagctgtctgagtggaggcggcggcaggaggaggaggccggggccctggaggccggggaggaggcccggcggcgggccgcccgggaggccgaggccctgacccagaggctggccgagaagacagaaacagtggaccggctggagcggggcagaagaaggctgcagcaggagctggatgatgccaccatggacctggagcagcagaggcagctggtgtccaccctggagaagaagcagaggaagtttgaccagctgctggccgaggagaaggctgctgtgctgcgggctgtggaggagcgggagagagctgaggccgagggccgggagcgggaggcccgggccctgagcctgacccgggccctggaggaggagcaggaggcccgggaggagctggagcggcagaacagagccctgcgggcagagctggaggccctgctgagcagcaaggatgatgtgggcaagtctgtgcatgagctggagcgggcctgccgggtggccgagcaggccgccaatgacctgcgggcccaggtgacagagctggaggatgagctgacagctgctgaagatgccaagctgcggctggaggtgacagtgcaggccctgaagacccagcacgagcgggacctgcagggcagagatgaagctggggaggagcggcggcggcagctggccaagcagctgagagatgctgaggtggagagagatgaggagaggaagcagaggaccctggccgtggccgccaggaagaagctggagggggagctggaggagctgaaggcccagatggccagcgctggccagggcaaggaggaggccgtgaagcagctgaggaagatgcaggcccagatgaaggagctgtggagggaggtggaggagaccaggaccagccgggaggagatcttcagccagaaccgggagagcgagaagaggctgaagggcctggaggccgaggtgctgcggctgcaggaggagctggccgccagtgaccgggcccggcggcaggcccagcaggacagagatgagatggctgatgaggtggccaacggcaacctgagcaaggccgccatcctggaggagaagaggcagctggagggccgcctgggccagctggaggaggagctggaggaggagcagagcaacagcgagctgctgaatgaccgctacaggaagctgctgctgcaggtggagagcctgaccacagagctgtctgctgagaggagcttcagcgccaaggccgagagcggccggcagcagctggagcggcagatccaggagctgcggggccgcctgggggaggaggatgctggggcccgggcccggcacaagatgaccatcgccgccctggagagcaagctggcccaggccgaggagcagctggagcaggagacccgggagcgcatcctgagcggcaagctggtgcggcgggcagagaagaggctgaaggaggtggtgctgcaggtggaggaggagaggagagtggccgaccagctgcgggaccagctggagaagggcaacctgcgggtgaagcagctgaagaggcagctggaggaggccgaggaggaggccagccgggcccaggccggcagaagaaggctgcagcgggagctggaggatgtgacagagagcgctgagagcatgaaccgggaggtgaccaccctgaggaaccggctgcggcggggccccctgaccttcaccaccaggacagtgcggcaggtgttccggctggaggagggcgtggccagtgatgaggaggccgaggaggcccagcccggcagcggccccagccctgagcctgagggcagccccccagcccacccccagtag

SEQ ID NO: 160904 - DNA, 6111 bp, Artificial Sequence
  Description of Artificial Sequence: Synthetic coding sequence
atggctgctgtgaccatgtctgtgcccggcaggaaggccccacccaggcctggccctgtgcctgaggccgcccagcccttcctgttcaccccccggggccccagcgctgggggcggccctggcagcggcaccagcccccaggtggagtggacagcccggcggctggtgtgggtgcccagcgagctgcacggctttgaagctgctgccctgagagatgaaggagaggaggaggccgaggtggagctggccgagagcggccgccgcctgcggctgccccgggaccagatccagaggatgaacccccccaagttcagcaaggccgaggacatggccgagctgacctgcctgaatgaggcctctgtgctgcacaacctgcgggagcgctactacagcggcctcatctacacctacagcggcctcttctgtgtggtgatcaacccctacaagcagctgcccatctacacagaggccatcgtggagatgtaccggggcaagaagagacatgaggtgccccctcatgtgtatgctgtgacagagggcgcctaccgctccatgctgcaggaccgggaggaccagagcatcctgtgcacaggagagagcggggccggcaagacagagaacaccaagaaggtgatccagtacctggcccacgtggccagcagccccaagggcaggaaggagcccggggtgcctgtgagcaacccagccctgggctggggcgagctggagcggcagctgctgcaggccaaccccatcctggaggcctttggaaatgccaagacagtgaagaatgacaacagcagcagatttgggaagttcatccgcatcaactttgatgtggccggctacatcgtgggcgccaacatcgagacctacctgctggagaagagccgggccatccggcaggccaaggatgagtgcagcttccacatcttctaccagctgctgggcggggccggggagcagctgaaggctgacctgctgctggagccctgcagccactaccgcttcctgaccaacggccccagcagcagccctggccaggagcgggagctgttccaggagaccctggagagcctgcgggtgctgggcttcagccatgaggagatcatctccatgctgaggatggtgtctgctgtgctgcagtttggaaacatcgccctgaagcgggagaggaacacagaccaggccaccatgccagacaacacagctgcccagaagctgtgccgcctgctgggcctgggcgtgacagacttcagccgggccctgctgaccccccgcatcaaggtgggccgggactatgtgcagaaggcccagaccaaggagcaggccgactttgccctggaggccctggccaaggccacctatgaaagactcttccgctggctggtgctgcggctgaacagagccctggacaggagcccccggcagggcgccagcttcctgggcatcctggacattgctggctttgagatcttccagctgaacagctttgagcagctgtgcatcaactacaccaatgagaagctgcagcagctgttcaaccacaccatgtttgtgctggagcaggaggagtaccagcgggagggcatcccctggaccttcctggactttggcctggacctgcagccctgcatcgacctgattgaaagacctgccaaccccccaggcctgctggccctgctggatgaggagtgctggttccccaaggccacagacaagagctttgtggagaaggtggcccaggagcagggcggccaccccaagttccagaggcccaggcacctgcgggaccaggccgacttctctgtgctgcactacgccggcaaggtggactacaaggccaatgagtggctgatgaagaacatggaccccctgaatgacaacgtggccgccctgctgcaccagagcacagaccggctgacagctgagatctggaaggatgagcacggcggcttccagcagttctccttcctgggcagcttcccccccagccccccaggcagcgctgagcgctgcagcagcgccatcagccccccaggagtggagggcatcgtgggcctggagcaggtgagcagcctgggagatggccccccaggcggccggccccggcggggcatgttcagaacagtgggccagctgtacaaggagagcctgagccggctgatggccaccctgagcaacaccaaccccagctttgtgcgctgcatcgtgcccaaccacgagaagagagctgggaagctggagccccggctggtgctggaccagctgcgctgcaatggagtgctggagggcatccgcatctgccggcagggcttccccaaccgcatcctcttccaggagttccggcagagatatgagatcctgaccccaaatgccatccccaagggcttcatggatggcaagcaggcctgtgagaagatgatccaggccctggagctggaccccaacctgtacagagtgggccagagcaagatcttcttccgggccggcgtgctggcccagctggaggaggagcgggacctgaaggtgacagacatcatcgtgtccttccaggccgccgcccggggctacctggcccggcgggccttccagaagaggcagcagcagcagagcgccctgcgggtgatgcagaggaactgtgccgcctacctgaagctgcggcactggcagtggtggaggctcttcaccaaggtgaagcccctgctgcaggtgacccggcaggatgaggtgctgcaggcccgggcccaggagctgcagaaggtgcaggagctgcagcagcagagcgcccgggaggtgggggagctgcagggccgggtggcccagctggaggaggagcgggcccggctggccgagcagctgcgggcagaggccgagctgtgtgccgaggccgaggagacccggggccgcctggccgccaggaagcaggagctggagctggtggtgtctgagctggaggcccgggtgggggaggaggaggagtgcagccggcagatgcagacagagaagaagaggctgcagcagcacatccaggagctggaggcccacctggaggccgaggagggcgcccggcagaagctgcagctggagaaggtgaccacagaggccaagatgaagaagtttgaggaggacctgctgctgctggaggaccagaacagcaagctgagcaaggagaggaagctgctggaggaccggctggccgagttcagcagccaggccgctgaggaggaggagaaggtgaagagcctgaacaagctgcggctgaagtatgaggccaccatcgctgacatggaggaccggctgaggaaggaggagaagggccggcaggagctggagaagctgaagaggcggctggatggagagagcagcgagctgcaggagcagatggtggagcagcagcagagagctgaggagctgcgggcccagctgggcaggaaggaggaggagctgcaggccgccctggcccgggcagaagatgaaggaggagcccgggcccagctgctgaagagcctgcgggaggcccaggccgccctggccgaggcccaggaggacctggagagcgagcgggtggcccggaccaaggccgagaagcagaggcgggacctgggggaggagctggaggccctgcggggggagctggaggacaccctggacagcaccaatgcccagcaggagctgcggagcaagcgggagcaggaggtgacagagctgaagaagaccctggaggaggagacccgcatccacgaggccgctgtgcaggagctgcggcagagacatggccaggccctgggggagctggccgagcagctggagcaggcccggcggggcaaaggagcctgggagaagacccggctggccctggaggccgaggtgtctgagctgcgggcagagctgagcagcctgcagacagcccggcaggagggggagcagaggagaagaaggctggagctgcagctgcaggaggtgcagggccgggctggagatggagagcgggcccgggcagaggccgctgagaagctgcagagggcccaggccgagctggagaatgtgtctggggccctgaatgaagctgagagcaagaccatccggctgagcaaggagctgagcagcacagaggcccagctgcatgatgcccaggagctgctgcaggaggagacccgggccaagctggccctgggcagccgggtgcgggccatggaggccgaggccgccggcctgcgggagcagctggaggaggaggccgccgcccgggagcgggccggccgggagctgcagacagcccaggcccagctgtctgagtggaggcggcggcaggaggaggaggccggggccctggaggccggggaggaggccaggagaagagctgcccgggaggccgaggccctgacccagaggctggccgagaagacagagaccgtggaccggctggagcggggcagaagaaggctgcagcaggagctggatgatgccaccatggacctggagcagcagaggcagctggtgtccaccctggagaagaagcagaggaagtttgaccagctgctggccgaggagaaggctgctgtgctgcgggctgtggaggagcgggagcgggcagaggccgagggccgggagcgggaggcccgggccctgagcctgacccgggccctggaggaggagcaggaggcccgggaggagctggagcggcagaacagagccctgcgggcagagctggaggccctgctgagcagcaaggatgatgtgggcaagtctgtgcatgagctggagcgggcctgccgggtggccgagcaggccgccaatgacctgcgggcccaggtgacagagctggaggatgagctgacagctgctgaagatgccaagctgcggctggaggtgacagtgcaggccctgaagacccagcacgagcgggacctgcagggcagagatgaggccggggaggagcggcggcggcagctggccaagcagctgagagatgctgaggtggagagagatgaggagaggaagcagaggaccctggccgtggccgccaggaagaagctggagggggagctggaggagctgaaggcccagatggccagcgctggccagggcaaggaggaggccgtgaagcagctgaggaagatgcaggcccagatgaaggagctgtggagggaggtggaggagaccaggaccagccgggaggagatcttcagccagaaccgggagagcgagaagaggctgaagggcctggaggccgaggtgctgcggctgcaggaggagctggccgccagtgaccgggcccggcggcaggcccagcaggacagagatgagatggctgatgaggtggccaatggaaacctgagcaaggccgccatcctggaggagaagaggcagctggagggccgcctgggccagctggaggaggagctggaggaggagcagagcaacagcgagctgctgaatgaccgctacaggaagctgctgctgcaggtggagagcctgaccacagagctgtctgctgagaggagcttcagcgccaaggccgagagcggccggcagcagctggagcggcagatccaggagctgcggggccgcctgggggaggaggatgctggggcccgggcccggcacaagatgaccatcgccgccctggagagcaagctggcccaggccgaggagcagctggagcaggagacccgggagcgcatcctgagcggcaagctggtgagaagagctgagaagaggctgaaggaggtggtgctgcaggtggaggaggagcggcgggtggccgaccagctgcgggaccagctggagaagggcaacctgcgggtgaagcagctgaagaggcagctggaggaggccgaggaggaggccagccgggcccaggccggcagaagaaggctgcagcgggagctggaggatgtgacagaatctgctgagagcatgaaccgggaggtgaccaccctgaggaaccggctgcggcggggccccctgaccttcaccaccaggacagtgcggcaggtgttccggctggaggagggcgtggccagtgatgaggaggccgaggaggcccagcccggcagcggccccagccctgagcctgagggcagccccccagcccacccccagtag

SEQ ID NO: 160905 - DNA, 5841 bp, Artificial Sequence
  Description of Artificial Sequence: Synthetic coding sequence
atggtggagagctgcctgctgaccttccgggccttcttctggtggatcgccctgatcaagatggacctgagtgacctgggggaggccgccgccttcctgcggcgctctgaggccgagctgctgctgctgcaggccacagccctggatggcaagaagaagtgctggatcccagatggagaaaatgcctacatcgaggccgaggtgaagggctctgaagatgatggcaccgtcatcgtggagacagcagatggagagagcctgagcatcaaggaggacaagatccagcagatgaaccccccagagtttgagatgattgaggacatggccatgctgacccacctgaatgaggcctctgtgctgcacaccctgaagagaagatatggccagtggatgatctacacctacagcggcctcttctgtgtgaccatcaacccctacaagtggctgcctgtgtaccagaaggaggtgatggccgcctacaagggcaagagaagaagtgaggccccaccccacatctttgctgtggccaacaatgccttccaggacatgctgcacaaccgggagaaccagagcatcctcttcaccggggagagcggggccggcaagacagtgaacagcaagcacatcatccagtactttgccaccatcgccgccatgattgagagcaggaagaagcagggcgccctggaggaccagatcatgcaggccaacaccatcctggaggcctttggaaatgccaagaccctgagaaatgacaacagcagcagatttgggaagttcatccgcatgcactttggagcccggggcatgctgagctctgtggacatcgacatctacctgctggagaagagcagggtcatcttccagcaggccggggagaggaactaccacatcttctaccagatcctgagcggccagaaggagctgcatgacctgctgctggtgtctgccaaccccagcgacttccacttctgcagctgtggggctgtgacagtggagagcctggatgatgctgaggagctgctggccacagagcaggccatggacatcctgggcttcctgcctgatgagaagtatggctgctacaagctgactggagccatcatgcactttggaaacatgaagttcaagcagaagccccgggaggagcagctggaggctgatggaacagaaaatgctgacaaggccgccttcctgatgggcatcaacagcagcgagctggtgaagtgcctgatccacccccgcatcaaggtgggcaatgaatatgtgacccggggccagaccatcgagcaggtgacctgtgctgtgggcgccctgagcaagtccatgtatgaaagaatgttcaagtggctggtggcccgcatcaacagagccctggatgccaagctgagccggcagttcttcatcggcatcctggacatcactggatttgagatcctggagtacaacagcctggagcagctgtgcatcaacttcaccaatgagaagctgcagcagttcttcaactggcacatgtttgtgctggagcaggaggagtacaagaaggagagcattgagtgggtgtccattggatttggcctggacctgcaggcctgcatcgacctgattgagaagcccatgggcatcctgagcatcctggaggaggagtgcatgttccccaaggccacagacctgaccttcaagaccaagctgtttgacaaccactttgggaagtctgtgcacctgcagaagcccaagccagacaagaagaagtttgaggcccactttgagctggtgcactacgccggcgtggtgccctacaacatcagcggctggctggagaagaacaaggacctgctgaatgagaccgtggtggccgtgttccagaagagcagcaaccggctgctggccagcctgtttgagaactacatgagcacagattctgccatcccctttggagagaagaagaggaagaagggggccagcttccagacagtggccagcctgcacaaggagaacctgaacaagctgatgaccaacctgaagagcacagccccccactttgtgcgctgcatcaaccccaacgtgaacaagatccctggcatcctggacccctacctggtgctgcagcagctgcgctgcaatggagtgctggagggcacccgcatctgccgggagggcttccccaaccggctgcagtatgctgacttcaagcagcgctactgcatcctgaaccccaggaccttccccaagagcaagtttgtgagcagcaggaaggctgctgaggagctgctgggcagcctggagattgaccacacccagtaccgcttcggcatcaccaaggtgttcttcaaggccggcttcctgggccagctggaggccatcagagatgagcggctgagcaaggtgttcaccctcttccaggcccgggcccagggcaagctgatgaggatcaagttccagaagatcctggaggagagagatgccctgatcctgatccagtggaacatccgggccttcatggctgtgaagaactggccctggatgaggctcttcttcaagatcaagcccctggtgaagagcagcgaggtgggggaggaggtggccggcctgaaggaggagtgtgcccagctgcagaaggccctggagaagtctgagttccagcgggaggagctgaaggccaagcaggtgtccctgacccaggagaagaatgacctgatcctgcagctgcaggccgagcaggagaccctggccaacgtggaggagcagtgtgagtggctgatcaagagcaagatccagctggaggcccgggtgaaggagctgtctgagcgggtggaggaggaggaggagatcaacagcgagctgacagcccggggcaggaagctggaggatgagtgctttgagctgaagaaggagattgatgacctggagaccatgctggtgaagtctgagaaggagaagaggaccacagagcacaaggtgaagaacctgacagaggaggtggagttcctgaatgaagacatcagcaagctgaacagagctgccaaggtggtgcaggaggcccaccagcagaccctggatgacctgcacatggaggaggagaagctgagcagcctgagcaaggccaacctgaagctggagcagcaggtggatgagctggagggcgccctggagcaggagaggaaggccaggatgaactgtgagcgggagctgcacaagctggagggcaacctgaagctgaaccgggagagcatggagaacctggagagcagccagaggcacctggccgaggagctgaggaagaaggagctggagctgagccagatgaacagcaaggtggagaatgagaagggcctggtggcccagctgcagaagacagtgaaggagctgcagacccagatcaaggacctgaaggagaagctggaggccgagaggaccacccgggccaagatggagcgggagagagctgacctgacccaggacctggccgacctgaatgaaaggctggaggaggtgggcggcagcagcctggcccagctggagatcaccaagaagcaggagaccaagttccagaagctgcaccgggacatggaggaggccaccctgcactttgagaccaccagcgccagcctgaagaagagacatgctgacagcctggccgagctggagggccaggtggagaacctgcagcaggtgaagcagaagctggagaaggacaagagtgacctgcagctggaggtggatgacctgctgaccagggtggagcagatgacccgggccaaggccaatgctgagaagctgtgcaccctgtatgaggagcggctgcacgaggccacagccaagctggacaaggtgacccagctggccaatgacctggccgcccagaagaccaagctgtggagcgagagcggggagttcctgcggcggctggaggagaaggaggccctgatcaaccagctgagccgggagaagagcaacttcacccggcagatcgaggacctgcggggccagctggagaaggagaccaagagccagagcgccctggcccacgccctgcagaaggcccagagggactgtgacctgctgcgggagcagtatgaggaggagcaggaggtgaaggccgagctgcacaggaccctgagcaaggtgaatgctgagatggtgcagtggaggatgaagtatgagaacaacgtcatccagaggacagaggacctggaggatgccaagaaggagctggccatccggctgcaggaggccgctgaggccatgggcgtggccaatgccagaaatgccagcctggagcgggcccggcaccagctgcagctggagctgggagatgccctgagtgacctgggcaaggtgcgctctgctgctgcccggctggaccagaagcagctgcagagcggcaaggccctggccgactggaagcagaagcatgaggagagccaggccctgctggatgccagccagaaggaggtgcaggccctgagcacagagctgctgaagctgaagaacacctatgaggagagcatcgtgggccaggagaccctgcggcgggagaacaagaacctgcaggaggagatcagcaacctgaccaaccaggtgcgggagggcaccaagaacctgacagagatggagaaggtgaagaagctgattgaggaggagaagacagaggtgcaggtgaccctggaggagacagaaggagccctggagagaaatgaaagcaagatcctgcacttccagctggagctgctggaggccaaggccgagctggagaggaagctgtctgagaaggatgaggagattgagaacttccggaggaagcagcagtgcaccatcgacagcctgcagagcagcctggacagcgaggccaagagcagaattgaggtgacccggctgaagaagaagatggaggaggacctgaatgagatggagctgcagctgagctgtgccaaccggcaggtgtctgaggccaccaagagcctgggccagctgcagatccagatcaaggacctgcagatgcagctggatgacagcacccagctgaacagcgacctgaaggagcaggtggccgtggccgagaggaggaacagcctgctgcagagcgagctggaggacctgcggagcctgcaggagcagacagagcggggccgccgcctgtctgaggaggagctgctggaggccacagagcgcatcaacctcttctacacccagaacaccagcctgctgagccagaagaagaagctggaggctgatgtggccaggatgcagaaggaggccgaggaggtggtgcaggagtgccagaatgctgaggagaaggccaagaaggccgccatcgaggccgccaacctgtctgaggagctgaagaagaagcaggacaccatcgcccacctggagaggacccgggagaacatggagcagaccatcacagacctgcagaagaggctggccgaggccgagcagatggccctgatgggcagcaggaagcagatccagaagctggagagccgggtgcgggagctggagggggagctggagggggagatcagaagatctgctgaggcccagagaggagcccggcggctggagcgctgcatcaaggagctgacctaccaggccgaggaggacaagaagaacctgagcaggatgcagacccagatggacaagctgcagctgaaggtgcagaactacaagcagcaggtggaggtggccgagacccaggccaaccagtacctgagcaagtacaagaagcagcagcacgagctgaatgaggtgaaggagcgggcagaggtggccgagagccaggtgaacaagctgaagatcaaggcccgggagtttgggaagaaggtgcaggaggagtag

SEQ ID NO: 160906 - DNA, 5826 bp, Artificial Sequence
  Description of Artificial Sequence: Synthetic coding sequence
atgagcagtgacagcgagctggccgtgtttggagaggccgcccccttcctgaggaagtctgagcgggagagaattgaggcccagaaccggccctttgatgccaagacctctgtgtttgtggccgagcccaaggagagctttgtgaagggcaccatccagagccgggagggcggcaaggtgacagtgaagacagagggcggggccaccctgactgtgaaggatgaccaggtgttccccatgaacccccccaagtatgacaagattgaggacatggccatgatgacccacctgcacgagcctgctgtgctgtacaacctgaaggagagatatgctgcctggatgatctacacctacagcggcctcttctgtgtgacagtgaacccctacaagtggctgcctgtgtacaagccagaggtggtgacagcctaccggggcaagaagaggcaggaggccccaccccacatcttcagcatcagtgacaatgcctaccagttcatgctgacagaccgggagaaccagagcatcctgatcaccggggagagcggggccggcaagacagtgaacaccaagagggtcatccagtactttgccaccatcgctgtgactggagagaagaagaaggaggagatcaccagcggcaagatccagggcaccctggaggaccagatcatcagcgccaaccccctgctggaggcctttggaaatgccaagacagtgagaaatgacaacagcagcagatttgggaagttcatccgcatccacttcggcaccaccgggaagctggccagcgctgacatcgagacctacctgctggagaagagccgggtggtgttccagctgaaggccgagaggagctaccacatcttctaccagatcaccagcaacaagaagccagagctgattgagatgctgctgatcaccaccaacccctatgactacccctttgtgtcccagggcgagatctctgtggccagcattgatgaccaggaggagctgatggccacagattctgccatcgacatcctgggcttcaccaatgaggagaaggtgtccatctacaagctgaccggggctgtgatgcactacggcaacctgaagttcaagcagaagcagcgggaggagcaggccgagccagatggaacagaggtggccgacaaggccgcctacctgcagagcctgaacagcgctgacctgctgaaggccctgtgctacccccgggtgaaggtgggcaatgaatatgtgaccaagggccagacagtggagcaggtgtccaatgctgtgggcgccctggccaaggctgtgtatgagaagatgttcctgtggatggtggcccgcatcaaccagcagctggacaccaagcagccccggcagtacttcatcggcgtgctggacattgctggctttgagatctttgacttcaacagcctggagcagctgtgcatcaacttcaccaatgagaagctgcagcagttcttcaaccaccacatgtttgtgctggagcaggaggagtacaagaaggagggcatcgagtggaccttcatcgactttggcatggacctggccgcctgcatcgagctgattgagaagcccatgggcatcttcagcatcctggaggaggagtgcatgttccccaaggccacagacaccagcttcaagaacaagctgtatgaccagcacctgggcaagagcgccaacttccagaagcccaaggtggtgaagggcaaggccgaggcccactttgccctgatccactacgccggcgtggtggactacaacatcaccggctggctggagaagaacaaggaccccctgaatgaaacagtggtgggcctgtaccagaagagcgccatgaagaccctggcccagctgttcagcggggcccagacagctgagggggagggcgccggcggcggggccaagaagggcggcaagaagaagggcagcagcttccagacagtgtctgccctcttccgggagaacctgaacaagctgatgaccaacctgcggagcacccacccccactttgtgcgctgcatcatccccaatgagaccaagacccctggggccatggagcacgagctggtgctgcaccagctgcgctgcaatggagtgctggagggcatccgcatctgcaggaagggcttccccagccgcatcctgtatgctgacttcaagcagcgctacaaggtgctgaatgccagcgccatccctgagggccagttcatcgacagcaagaaggccagcgagaagctgctggccagcattgatattgaccacacccagtacaagtttggccacaccaaggtgttcttcaaggccggcctgctgggcctgctggaggagatgagagatgacaagctggcccagctgatcaccaggacccaggcccgctgccggggcttcctggcccgggtggagtaccagaggatggtggagcggcgggaggccatcttctgcatccagtacaacatccgctccttcatgaatgtgaagcactggccctggatgaagctgttcttcaagatcaagcccctgctgaagtctgctgagacagagaaggagatggccaccatgaaggaggagttccagaagatcaaggatgagctggccaagtctgaggccaagaggaaggagctggaggagaagatggtgaccctgctgaaggagaagaatgacctgcagctgcaggtgcaggccgaggccgagggcctggctgatgctgaggagcgctgtgaccagctgatcaagaccaagatccagctggaggccaagatcaaggaggtgacagagcgggcagaagatgaggaggagatcaatgctgagctgacagccaagaagaggaagctggaggatgagtgcagcgagctgaagaaggacattgatgacctggagctgaccctggccaaggtggagaaggagaagcacgccacagagaacaaggtgaagaacctgacagaggagatggccggcctggatgagaccatcgccaagctgaccaaggagaagaaggccctgcaggaggcccaccagcagaccctggatgacctgcaggccgaggaggacaaggtgaacaccctgaccaaggccaagatcaagctggagcagcaggtggatgacctggagggcagcctggagcaggagaagaagctgaggatggacctggagcgggccaagaggaagctggagggggacctgaagctggcccaggagagcatcatggacattgaaaatgagaagcagcagctggatgagaagctgaagaagaaggagtttgagatcagcaacctgcagagcaagattgaagatgagcaggccctgggcatccagctgcagaagaagatcaaggagctgcaggccagaattgaggagctggaggaggagattgaggccgagcgggccagccgggccaaggccgagaagcagaggagtgacctgagccgggagctggaggagatcagcgagcggctggaggaggccggcggggccaccagcgcccagatcgagatgaacaagaagcgggaggccgagttccagaagatgagaagagacctggaggaggccaccctgcagcacgaggccacagctgccaccctgaggaagaagcatgctgacagcgtggccgagctgggggagcagattgacaacctgcagagggtgaagcagaagctggagaaggagaagtctgagatgaagatggagattgatgacctggccagcaatgtggagaccgtgtccaaggccaagggcaacctggagaagatgtgcaggaccctggaggaccagctgtctgagctgaagagcaaggaggaggagcagcagaggctcatcaatgacctgacagcccagaggggccgcctgcagacagagagcggggagttcagccggcagctggatgagaaggaggccctggtgtcccagctgagccggggcaagcaggccttcacccagcagatcgaggagctgaagaggcagctggaggaggagatcaaggccaagaatgccctggcccacgccctgcagagcagcagacatgactgtgacctgctgcgggagcagtatgaggaggagcaggagagcaaggccgagctgcagagggccctgagcaaggccaacacagaggtggcccagtggaggaccaagtatgaaacagatgccatccagaggacagaggagctggaggaggccaagaagaagctggcccagaggctgcaggccgctgaggagcacgtggaggccgtgaatgccaagtgtgccagcctggagaagaccaagcagaggctgcagaatgaggtggaggacctgatgctggatgtggagaggaccaatgctgcctgtgccgccctggacaagaagcagaggaactttgacaagatcctggccgagtggaagcagaagtgtgaggagacccatgctgagctggaggccagccagaaggaggcccggagcctgggcacagagctgttcaagatcaagaatgcctatgaggagagcctggaccagctggagaccctgaagcgggagaacaagaacctgcagcaggagatcagtgacctgacagagcagattgctgagggcggcaagaggatccacgagctggagaagatcaagaagcaggtggagcaggagaagtgtgagctgcaggccgccctggaggaggccgaggccagcctggagcacgaggagggcaagatcctgcgcatccagctggagctgaaccaggtgaagtctgaggtggacaggaagattgctgagaaggatgaggagattgaccagctgaagaggaaccacatcagaattgtggagagcatgcagagcaccctggatgctgagatccgcagcagaaatgatgccatccggctgaagaagaagatggagggggacctgaatgagatggagatccagctgaaccacgccaacaggatggctgctgaggccctgaggaactacagaaacacccagggcatcctgaaggacacccagatccacctggatgatgccctgcggagccaggaggacctgaaggagcagctggccatggtggagcggcgggccaacctgctgcaggccgagattgaggagctgcgggccaccctggagcagacagagaggagcaggaagattgctgagcaggagctgctggatgccagcgagcgggtgcagctgctgcacacccagaacaccagcctcatcaacaccaagaagaagctggagacagacatcagccagatgcagggcgagatggaggacatcctgcaggaggccagaaatgctgaggagaaggccaagaaggccatcacagatgctgccatgatggccgaggagctgaagaaggagcaggacaccagcgcccacctggagaggatgaagaagaacatggagcagacagtgaaggacctgcagctgcggctggatgaggccgagcagctggccctgaagggcggcaagaagcagatccagaagctggaggcccgggtgcgggagctggagggggaggtggagagcgagcagaagagaaatgctgaggccgtgaagggcctgaggaagcatgaaagaagagtgaaggagctgacctaccagacagaggaggacaggaagaacatcctgcggctgcaggacctggtggacaagctgcaggccaaggtgaagagctacaagaggcaggccgaggaggccgaggagcagagcaacaccaacctggccaagttcaggaagctgcagcacgagctggaggaggccgaggagagagctgacattgctgagagccaggtgaacaagctgcgggtgaagagccgggaggtgcacaccaaggtgatcagcgaggagtag

SEQ ID NO: 160907 - DNA, 5826 bp, Artificial Sequence; identical to SEQ ID NO: 160906
  Description of Artificial Sequence: Synthetic coding sequence

SEQ ID NO: 160908 - DNA, 549 bp, Artificial Sequence
  Description of Artificial Sequence: Synthetic coding sequence
atgagcagtgacagcgagctggccgtgtttggagaggccgcccccttcctgaggaagtctgagcgggagagaattgaggcccagaaccggccctttgatgccaagacctctgtgtttgtggccgagcccaaggagagctttgtgaagggcaccatccagagccgggagggcggcaaggtgacagtgaagacagagggcggggccaccctgactgtgaaggatgaccaggtgttccccatgaacccccccaagtatgacaagattgaggacatggccatgatgacccacctgcacgagcctgctgtgctgtacaacctgaaggagagatatgctgcctggatgatctacacctacagcggcctcttctgtgtgacagtgaacccctacaagtggctgcctgtgtacaagccagaggtggtgacagcctaccggggcaagaagaggcaggaggccccaccccacatcttcagcatcagtgacaatgcctaccagttcatgctgacagaccgggagaaccagagcatcctgatcaccggggagagcggctag

SEQ ID NO: 160909 - DNA, 405 bp, Artificial Sequence
  Description of Artificial Sequence: Synthetic coding sequence
atgagcagtgacagcgagctggccgtgtttggagaggccgcccccttcctgaggaagtctgagcgggagagaattgaggcccagaaccggccctttgatgccaagacctctgtgtttgtggccgagcccaaggagagctttgtgaagggcaccatccagagccgggagggcggcaaggtgacagtgaagacagagggcggggccaccctgactgtgaaggatgaccaggtgttccccatgaacccccccaagtatgacaagattgaggacatggccatgatgacccacctgcacgagcctgctgtgctgtacaacctgaaggagagatatgctgcctggatgatctacacctacagcggcctcttctgtgtgacagtgaacccctacaagtggctgcctgtgtag

SEQ ID NO: 160910 - DNA, 2127 bp, Artificial Sequence
  Description of Artificial Sequence: Synthetic coding sequence
atgagcagtgacagcgagctggccgtgtttggagaggccgcccccttcctgaggaagtctgagcgggagagaattgaggcccagaaccggccctttgatgccaagacctctgtgtttgtggccgagcccaaggagagctttgtgaagggcaccatccagagccgggagggcggcaaggtgacagtgaagacagagggcggggccaccctgactgtgaaggatgaccaggtgttccccatgaacccccccaagtatgacaagattgaggacatggccatgatgacccacctgcacgagcctgctgtgctgtacaacctgaaggagagatatgctgcctggatgatctacacctacagcggcctcttctgtgtgacagtgaacccctacaagtggctgcctgtgtacaagccagaggtggtgacagcctaccggggcaagaagaggcaggaggccccaccccacatcttcagcatcagtgacaatgcctaccagttcatgctgacagaccgggagaaccagagcatcctgatcaccggggagagcggggccggcaagacagtgaacaccaagagggtcatccagtactttgccaccatcgctgtgactggagagaagaagaaggaggagatcaccagcggcaagatccagggcaccctggaggaccagatcatcagcgccaaccccctgctggaggcctttggaaatgccaagacagtgagaaatgacaacagcagcagatttgggaagttcatccgcatccacttcggcaccaccgggaagctggccagcgctgacatcgagacctacctgctggagaagagccgggtggtgttccagctgaaggccgagaggagctaccacatcttctaccagatcaccagcaacaagaagccagagctgattgagatgctgctgatcaccaccaacccctatgactacccctttgtgtcccagggcgagatctctgtggccagcattgatgaccaggaggagctgatggccacagattctgccatcgacatcctgggcttcaccaatgaggagaaggtgtccatctacaagctgaccggggctgtgatgcactacggcaacctgaagttcaagcagaagcagcgggaggagcaggccgagccagatggaacagaggtggccgacaaggccgcctacctgcagagcctgaacagcgctgacctgctgaaggccctgtgctacccccgggtgaaggtgggcaatgaatatgtgaccaagggccagacagtggagcaggtgtccaatgctgtgggcgccctggccaaggctgtgtatgagaagatgttcctgtggatggtggcccgcatcaaccagcagctggacaccaagcagccccggcagtacttcatcggcgtgctggacattgctggctttgagatctttgacttcaacagcctggagcagctgtgcatcaacttcaccaatgagaagctgcagcagttcttcaaccaccacatgtttgtgctggagcaggaggagtacaagaaggagggcatcgagtggaccttcatcgactttggcatggacctggccgcctgcatcgagctgattgagaagcccatgggcatcttcagcatcctggaggaggagtgcatgttccccaaggccacagacaccagcttcaagaacaagctgtatgaccagcacctgggcaagagcgccaacttccagaagcccaaggtggtgaagggcaaggccgaggcccactttgccctgatccactacgccggcgtggtggactacaacatcaccggctggctggagaagaacaaggaccccctgaatgaaacagtggtgggcctgtaccagaagagcgccatgaagaccctggcccagctgttcagcggggcccagacagctgagggggagggcgccggcggcggggccaagaagggcggcaagaagaagggcagcagcttccagacagtgtctgccctcttccgggaggagcagagcaacaccaacctggccaagttcaggaagctgcagcacgagctggaggaggccgaggagagagctgacattgctgagagccaggtgaacaagctgcgggtgaagagccgggaggtgcacaccaaggtgatcagcgaggagtag

SEQ ID NO: 160911 - DNA, 5820 bp, Artificial Sequence
  Description of Artificial Sequence: Synthetic coding sequence
atgagcagtgacagcgagatggccatctttggagaggccgcccccttcctgaggaagtctgagcgggagagaattgaggcccagaacaagccctttgatgccaagacctctgtgtttgtggtggaccccaaggagagctttgtgaaggccaccgtgcagagccgggagggcggcaaggtgacagccaagacagaggccggggccaccgtgacagtgaaggatgaccaggtgttccccatgaacccccccaagtatgacaagattgaggacatggccatgatgacccacctgcacgagcctgctgtgctgtacaacctgaaggagagatatgctgcctggatgatctacacctacagcggcctcttctgtgtgacagtgaacccctacaagtggctgcctgtgtacaatgctgaggtggtgacagcctaccggggcaagaagaggcaggaggccccaccccacatcttcagcatcagtgacaatgcctaccagttcatgctgacagaccgggagaaccagagcatcctgatcaccggggagagcggggccggcaagacagtgaacaccaagagggtcatccagtactttgccaccatcgctgtgactggagagaagaagaaggaggaggtgaccagcggcaagatgcagggcaccctggaggaccagatcatcagcgccaaccccctgctggaggcctttggaaatgccaagacagtgagaaatgacaacagcagcagatttgggaagttcatccgcatccacttcggcaccaccgggaagctggccagcgctgacatcgagacctacctgctggagaagagccgggtgaccttccagctgaaggccgagaggagctaccacatcttctaccagatcatgagcaacaagaagccagacctgattgagatgctgctgatcaccaccaacccctatgactatgcctttgtgtcccagggcgagatcaccgtgcccagcattgatgaccaggaggagctgatggccacagattctgccatcgagatcctgggcttcaccagtgatgagcgggtgtccatctacaagctgaccggggctgtgatgcactacggcaacatgaagttcaagcagaagcagcgggaggagcaggccgagccagatggaacagaggtggccgacaaggccgcctacctgcagaacctgaacagcgctgacctgctgaaggccctgtgctacccccgggtgaaggtgggcaatgaatatgtgaccaagggccagacagtgcagcaggtgtacaatgctgtgggcgccctggccaaggctgtgtatgacaagatgttcctgtggatggtgacccgcatcaaccagcagctggacaccaagcagccccggcagtacttcatcggcgtgctggacattgctggctttgagatctttgacttcaacagcctggagcagctgtgcatcaacttcaccaatgagaagctgcagcagttcttcaaccaccacatgtttgtgctggagcaggaggagtacaagaaggagggcatcgagtggaccttcatcgactttggcatggacctggccgcctgcatcgagctgattgagaagcccatgggcatcttcagcatcctggaggaggagtgcatgttccccaaggccacagacaccagcttcaagaacaagctgtatgagcagcacctgggcaagagcaacaacttccagaagcccaagccagccaagggcaagccagaggcccacttcagcctcatccactacgccggcaccgtggactacaacattgctggctggctggacaagaacaaggaccccctgaatgaaacagtggtgggcctgtaccagaagagcgccatgaagaccctggccctgctgtttgtgggcgccaccggggctgaggccgaggccggcggcggcaagaagggcggcaagaagaagggcagcagcttccagacagtgtctgccctcttccgggagaacctgaacaagctgatgaccaacctgcggagcacccacccccactttgtgcgctgcatcatccccaatgagaccaagacccctggggccatggagcacgagctggtgctgcaccagctgcgctgcaatggagtgctggagggcatccgcatctgcaggaagggcttccccagccgcatcctgtatgctgacttcaagcagcgctacaaggtgctgaatgccagcgccatccctgagggccagttcatcgacagcaagaaggccagcgagaagctgctgggcagcattgatattgaccacacccagtacaagtttggccacaccaaggtgttcttcaaggccggcctgctgggcctgctggaggagatgagagatgagaagctggcccagctgatcaccaggacccaggccatgtgccggggcttcctggcccgggtggagtaccagaagatggtggagcggcgggagagcatcttctgcatccagtacaacgtgcgggccttcatgaatgtgaagcactggccctggatgaagctgtacttcaagatcaagcccctgctgaagtctgctgagacagagaaggagatggccaacatgaaggaggagtttgagaagaccaaggaggagctggccaagacagaggccaagaggaaggagctggaggagaagatggtgaccctgatgcaggagaagaatgacctgcagctgcaggtgcaggccgaggccgacagcctggctgatgctgaggagcgctgtgaccagctgatcaagaccaagatccagctggaggccaagatcaaggaggtgacagagcgggcagaagatgaggaggagatcaatgctgagctgacagccaagaagaggaagctggaggatgagtgcagcgagctgaagaaggacattgatgacctggagctgaccctggccaaggtggagaaggagaagcacgccacagagaacaaggtgaagaacctgacagaggagatggccggcctggatgagaccatcgccaagctgaccaaggagaagaaggccctgcaggaggcccaccagcagaccctggatgacctgcaggccgaggaggacaaggtgaacaccctgaccaaggccaagatcaagctggagcagcaggtggatgacctggagggcagcctggagcaggagaagaagatccgcatggacctggagcgggccaagaggaagctggagggggacctgaagctggcccaggagagcaccatggacattgaaaatgacaagcagcagctggatgagaagctgaagaagaaggagtttgagatgagcggcctgcagagcaagattgaagatgagcaggccctgggcatgcagctgcagaagaagatcaaggagctgcaggccagaattgaggagctggaggaggagattgaggccgagcgggccagccgggccaaggccgagaagcagaggagtgacctgagccgggagctggaggagatcagcgagcggctggaggaggccggcggggccaccagcgcccagatcgagatgaacaagaagcgggaggccgagttccagaagatgagaagagacctggaggaggccaccctgcagcacgaggccacagctgccaccctgaggaagaagcatgctgacagcgtggccgagctgggggagcagattgacaacctgcagagggtgaagcagaagctggagaaggagaagtctgagatgaagatggagattgatgacctggccagcaacatggagaccgtgtccaaggccaagggcaacctggagaagatgtgccgggccctggaggaccagctgtctgagatcaagaccaaggaggaggagcagcagaggctcatcaatgacctgacagcccagagggcccggctgcagacagagagcggggagtacagccggcagctggatgagaaggacaccctggtgtcccagctgagccggggcaagcaggccttcacccagcagatcgaggagctgaagaggcagctggaggaggagatcaaggccaagagcgccctggcccacgccctgcagagcagcagacatgactgtgacctgctgcgggagcagtatgaggaggagcaggaggccaaggccgagctgcagagggccatgagcaaggccaacagcgaggtggcccagtggaggaccaagtatgaaacagatgccatccagaggacagaggagctggaggaggccaagaagaagctggcccagaggctgcaggatgctgaggagcacgtggaggccgtgaatgccaagtgtgccagcctggagaagaccaagcagaggctgcagaatgaggtggaggacctgatgattgatgtggagaggaccaatgctgcctgtgccgccctggacaagaagcagaggaactttgacaagatcctggccgagtggaagcagaagtgtgaggagacccatgctgagctggaggccagccagaaggagagccgcagcctgagcacagagctgttcaagatcaagaatgcctatgaggagagcctggaccagctggagaccctgaagcgggagaacaagaacctgcagcaggagatcagtgacctgacagagcagattgctgagggcggcaagaggatccacgagctggagaagatcaagaagcaggtggagcaggagaagtctgagctgcaggccgccctggaggaggccgaggccagcctggagcacgaggagggcaagatcctgcgcatccagctggagctgaaccaggtgaagtctgaggtggacaggaagattgctgagaaggatgaggagattgaccagatgaagaggaaccacatcagaattgtggagagcatgcagagcaccctggatgctgagatccgcagcagaaatgatgccatccggctgaagaagaagatggagggggacctgaatgagatggagatccagctgaaccacgccaacaggatggctgctgaggccctgaggaactacagaaacacccaggccatcctgaaggacacccagctgcacctggatgatgccctgcggagccaggaggacctgaaggagcagctggccatggtggagcggcgggccaacctgctgcaggccgagattgaggagctgcgggccaccctggagcagacagagaggagcaggaagattgctgagcaggagctgctggatgccagcgagcgggtgcagctgctgcacacccagaacaccagcctcatcaacaccaagaagaagctggagacagacatcagccagatccagggcgagatggaggacatcatccaggaggccagaaatgctgaggagaaggccaagaaggccatcacagatgctgccatgatggccgaggagctgaagaaggagcaggacaccagcgcccacctggagaggatgaagaagaacctggagcagacagtgaaggacctgcagcaccggctggatgaggccgagcagctggccctgaagggcggcaagaagcagatccagaagctggaggcccgggtgcgggagctggagggggaggtggagagcgagcagaagagaaatgtggaggccgtgaagggcctgaggaagcatgagaggaaggtgaaggagctgacctaccagacagaggaggacaggaagaacatcctgcggctgcaggacctggtggacaagctgcaggccaaggtgaagagctacaagaggcaggccgaggaggccgaggagcagagcaatgtgaacctgagcaagttccgccgcatccagcacgagctggaggaggccgaggagagagctgacattgctgagagccaggtgaacaagctgcgggtgaagagccgggaggtgcacaccaagatcatcagcgaggagtag

SEQ ID NO: 160912 - DNA, 5820 bp, Artificial Sequence
  Description of Artificial Sequence: Synthetic coding sequence
atgagcagtgacagcgagatggccatctttggagaggccgcccccttcctgaggaagtctgagaaggagagaattgaggcccagaacaagccctttgatgccaagacctctgtgtttgtggtggaccccaaggagagctatgtgaaggccatcgtgcagagccgggagggcggcaaggtgacagccaagacagaggccggggccaccgtgacagtgaaggaggaccaggtgttctccatgaacccccccaagtatgacaagattgaggacatggccatgatgacccacctgcacgagcctgctgtgctgtacaacctgaaggagagatatgctgcctggatgatctacacctacagcggcctcttctgtgtgacagtgaacccctacaagtggctgcctgtgtacaaccctgaggtggtgacagcctaccggggcaagaagaggcaggaggccccaccccacatcttcagcatcagtgacaatgcctaccagttcatgctgacagaccgggagaaccagagcatcctgatcaccggggagagcggggccggcaagacagtgaacaccaagagggtcatccagtactttgccaccatcgctgtgactggagagaagaagaaggaggagcccgccagcggcaagatgcagggcaccctggaggaccagatcatcagcgccaaccccctgctggaggcctttggaaatgccaagacagtgagaaatgacaacagcagcagatttgggaagttcatccgcatccactttggagccaccgggaagctggccagcgctgacatcgagacctacctgctggagaagagccgggtgaccttccagctgaaggccgagaggagctaccacatcttctaccagatcctgagcaacaagaagccagagctgattgagatgctgctgatcaccaccaacccctatgactttgcctttgtgtcccagggcgagatcaccgtgcccagcattgatgaccaggaggagctgatggccacagattctgctgtggacatcctgggcttcaccgcagatgagaaggtggccatctacaagctgaccggggctgtgatgcactacggcaacatgaagttcaagcagaagcagcgggaggagcaggccgagccagatggaacagaggtggccgacaaggccgcctacctgaccagcctgaacagcgctgacctgctgaagagcctgtgctacccccgggtgaaggtgggcaatgaatttgtgaccaagggccagacagtgcagcaggtgtacaatgctgtgggcgccctggccaaggccatctatgagaagatgttcctgtggatggtgacccgcatcaaccagcagctggacaccaagcagccccggcagtacttcatcggcgtgctggacattgctggctttgagatctttgacttcaacagcctggagcagctgtgcatcaacttcaccaatgagaagctgcagcagttcttcaaccaccacatgtttgtgctggagcaggaggagtacaagaaggagggcatcgagtgggagttcatcgactttggcatggacctggccgcctgcatcgagctgattgagaagcccatgggcatcttcagcatcctggaggaggagtgcatgttccccaaggccacagacaccagcttcaagaacaagctgtatgagcagcacctgggcaagagcaacaacttccagaagcccaagccagccaagggcaagccagaggcccacttcagcctggtgcactacgccggcaccgtggactacaacattgctggctggctggacaagaacaaggaccccctgaatgaaacagtggtgggcctgtaccagaagagcgccatgaagaccctggccttcctgttcagcggggcccagacagctgaggccgagggcggcggcggcaagaagggcggcaagaagaagggcagcagcttccagacagtgtctgccctcttccgggagaacctgaacaagctgatgaccaacctgcggagcacccacccccactttgtgcgctgcatcatccccaatgagaccaagacccctggggccatggagcacgagctggtgctgcaccagctgcgctgcaatggagtgctggagggcatccgcatctgcaggaagggcttccccagccgcatcctgtatgctgacttcaagcagcgctacaaggtgctgaatgccagcgccatccctgagggccagttcatcgacagcaagaaggccagcgagaagctgctgggcagcattgaaattgaccacacccagtacaagtttggccacaccaaggtgttcttcaaggccggcctgctgggcaccctggaggagatgagagatgagaagctggcccagctgatcaccaggacccaggccatctgccggggcttcctgatgagggtggagttcaggaagatgatggagcggcgggagagcatcttctgcatccagtacaacatccgggccttcatgaatgtgaagcactggccctggatgaagctgtacttcaagatcaagcccctgctgaagtctgctgagacagagaaggagatggccaacatgaaggaggagtttgagaagaccaaggaggagctggccaagacagaggccaagaggaaggagctggaggagaagatggtgaccctgatgcaggagaagaatgacctgcagctgcaggtgcaggccgaggctgatgccctggctgatgctgaggagcgctgtgaccagctgatcaagaccaagatccagctggaggccaagatcaaggaggtgacagagcgggcagaagatgaggaggagatcaatgctgagctgacagccaagaagaggaagctggaggatgagtgcagcgagctgaagaaggacattgatgacctggagctgaccctggccaaggtggagaaggagaagcacgccacagagaacaaggtgaagaacctgacagaggagatggccggcctggatgagaccatcgccaagctgaccaaggagaagaaggccctgcaggaggcccaccagcagaccctggatgacctgcagatggaggaggacaaggtgaacaccctgaccaaggccaagaccaagctggagcagcaggtggatgacctggagggcagcctggagcaggagaagaagctgtgcatggacctggagcgggccaagaggaagctggagggggacctgaagctggcccaggagagcaccatggacacagaaaatgacaagcagcagctgaatgagaagctgaagaagaaggagtttgagatgagcaacctgcagggcaagattgaagatgagcaggccctggccatccagctgcagaagaagatcaaggagctgcaggccagaattgaggagctggaggaggagattgaggccgagcgggccagccgggccaaggccgagaagcagaggagtgacctgagccgggagctggaggagatcagcgagcggctggaggaggccggcggggccaccagcgcccagatcgagatgaacaagaagcgggaggccgagttccagaagatgagaagagacctggaggagagcaccctgcagcacgaggccacagctgctgccctgaggaagaagcatgctgacagcgtggccgagctgggggagcagattgacagcctgcagagggtgaagcagaagctggagaaggagaagtctgagctgaagatggagatcaatgacctggccagcaacatggagaccgtgtccaaggccaaggccaactttgagaagatgtgcaggaccctggaggaccagctgtctgagatcaagaccaaggaggaggagcagcagaggctcatcaatgagctgagcgcccagaaggcccggctgcacacagagagcggggagttcagccggcagctggatgagaaggatgccatggtgtcccagctgagccggggcaagcaggccttcacccagcagatcgaggagctgaagaggcagctggaggaggagaccaaggccaagagcaccctggcccacgccctgcagagcgcccggcatgactgtgacctgctgcgggagcagtatgaggaggagcaggaggccaaggccgagctgcagaggggcatgagcaaggccaacagcgaggtggcccagtggaggaccaagtatgaaacagatgccatccagaggacagaggagctggaggaggccaagaagaagctggcccagaggctgcaggatgctgaggagcacgtggaggccgtgaacagcaaatgtgccagcctggagaagaccaagcagaggctgcagaatgaggtggaggacctgatgattgatgtggagaggagcaatgctgcctgcatcgccctggacaagaagcagaggaactttgacaaggtgctggccgagtggaagcagaagtatgaggagacccaggccgagctggaggccagccagaaggagagccgcagcctgagcacagagctgttcaaggtgaagaatgcctatgaggagagcctggaccacctggagaccctgaagcgggagaacaagaacctgcagcaggagatcagtgacctgacagagcagattgctgagggcggcaagcacatccacgagctggagaaggtgaagaagcagctggaccacgagaagtctgagctgcagaccagcctggaggaggccgaggccagcctggagcacgaggagggcaagatcctgcgcatccagctggagctgaaccaggtgaagtcagaaattgacaggaagattgctgagaaggatgaggagctggaccagctgaagaggaaccacctgcgggtggtggagagcatgcagagcaccctggatgctgagatccgcagcagaaatgatgccctgcgcatcaagaagaagatggagggggacctgaatgagatggagatccagctgaaccacgccaaccggcaggccgctgaggccctgaggaacctgaggaacacccagggcatcctgaaggacacccagctgcacctggatgatgccatccggggccaggatgacctgaaggagcagctggccatggtggagcggcgggccaacctgatgcaggccgaggtggaggagctgcgggccagcctggagaggacagagcggggcaggaagatggccgagcaggagctgctggatgccagcgagcgggtgcagctgctgcacacccagaacaccagcctcatcaacaccaagaagaagctggagacagacatcagccagatccagggcgagatggaggacatcgtgcaggaggccagaaatgctgaggagaaggccaagaaggccatcacagatgctgccatgatggccgaggagctgaagaaggagcaggacaccagcgcccacctggagaggatgaagaagaacatggagcagacagtgaaggacctgcagctgcggctggatgaggccgagcagctggccctgaagggcggcaagaagcagatccagaagctggaggcccgggtgcgggagctggagagcgaggtggagagcgagcagaagcacaacgtggaggccgtgaagggcctgaggaagcatgaaagaagagtgaaggagctgacctaccagacagaggaggacaggaagaacatcctgcggctgcaggacctggtggacaagctgcagaccaaggtgaaggcctacaagaggcaggccgaggaggccgaggagcagagcaatgtgaacctggccaagttcaggaagctgcagcacgagctggaggaggccaaggagagagctgacattgctgagagccaggtgaacaagctgcgggtgaagagccgggaggtgcacaccaaggtgatcagcgaggagtag

SEQ ID NO: 160913 - DNA, 5820 bp, Artificial Sequence
  Description of Artificial Sequence: Synthetic coding sequence
atgacagatgcccagatggctgactttggagctgctgcccagtacctgaggaagtctgagaaggagcggctggaggcccagacccggccctttgacatcagaacagagtgctttgtgcctgatgacaaggaggagtttgtgaaggccaagatcctgagccgggagggcggcaaggtgattgctgagacagaaaatggcaagacagtgacagtgaaggaggaccaggtgctgcagcagaacccccccaagtttgacaagattgaggacatggccatgctgaccttcctgcacgagcctgctgtgctcttcaacctgaaggagagatatgctgcctggatgatctacacctacagcggcctcttctgtgtgacagtgaacccctacaagtggctgcctgtgtacaatgctgaggtggtggccgcctaccggggcaagaagaggtctgaggccccaccccacatcttcagcatcagtgacaatgcctaccagtacatgctgacagaccgggagaaccagagcatcctgatcactggagagagcggggccggcaagacagtgaacaccaagagggtcatccagtactttgccagcattgctgccatcggggaccggggcaagaaggacaatgccaatgccaacaagggcaccctggaggaccagatcatccaggccaacccagccctggaggcctttggaaatgccaagacagtgagaaatgacaacagcagcagatttgggaagttcatccgcatccactttggagccaccgggaagctggccagcgctgacatcgagacctacctgctggagaagagcagggtcatcttccagctgaaggccgagaggaactaccacatcttctaccagatcctgagcaacaagaagccagagctgctggacatgctgctggtgaccaacaacccctatgactatgcctttgtgtcccagggcgaggtgtctgtggccagcattgatgattctgaggagctgatggccacagattctgcctttgatgtgctgggcttcaccagcgaggagaaggccggcgtgtacaagctgaccggggccatcatgcactacggcaacatgaagttcaagcagaagcagcgggaggagcaggccgagccagatggaacagaagatgctgacaagagcgcctacctgatgggcctgaacagcgctgacctgctgaagggcctgtgccacccccgggtgaaggtgggcaatgaatatgtgaccaagggccagagcgtgcagcaggtgtactacagcattggagccctggccaaggctgtgtatgagaagatgttcaactggatggtgacccgcatcaatgccaccctggagaccaagcagccccggcagtacttcatcggcgtgctggacattgctggctttgagatctttgacttcaacagctttgagcagctgtgcatcaacttcaccaatgagaagctgcagcagttcttcaaccaccacatgtttgtgctggagcaggaggagtacaagaaggagggcatcgagtggaccttcatcgactttggcatggacctgcaggcctgcatcgacctgattgagaagcccatgggcatcatgagcatcctggaggaggagtgcatgttccccaaggccacagacatgaccttcaaggccaagctgtatgacaaccacctgggcaagagcaacaacttccagaagcccaggaacatcaagggcaagcaggaggcccacttcagcctcatccactacgccggcaccgtggactacaacatcctgggctggctggagaagaacaaggaccccctgaatgaaacagtggtggccctgtaccagaagagcagcctgaagctgatggccaccctcttcagcagctatgccacagctgacaccggggacagcggcaagagcaaaggaggcaagaagaagggcagcagcttccagacagtgtctgccctgcaccgggagaacctgaacaagctgatgaccaacctgcggaccacccacccccactttgtgcgctgcatcatccccaatgaaaggaaggcccctggggtgatggacaaccccctggtgatgcaccagctgcgctgcaatggagtgctggagggcatccgcatctgcaggaagggcttccccaaccgcatcctgtatggagacttccggcagcgctaccgcatcctgaaccctgtggccatccctgagggccagttcatcgacagcaggaagggcacagagaagctgctgagcagcctggacatcgaccacaaccagtacaagtttggccacaccaaggtgttcttcaaggccggcctgctgggcctgctggaggagatgagagatgagcggctgagccgcatcatcaccaggatgcaggcccaggcccggggccagctgatgagaattgagttcaagaagatcgtggagaggagagatgccctgctggtgatccagtggaacatccgggccttcatgggcgtgaagaactggccctggatgaagctgtacttcaagatcaagcccctgctgaagtctgctgagacagagaaggagatggccaccatgaaggaggagtttggccgcatcaaggagaccctggagaagtctgaggcccggaggaaggagctggaggagaagatggtgtccctgctgcaggagaagaatgacctgcagctgcaggtgcaggccgagcaggacaacctgaatgatgctgaggagcgctgtgaccagctgatcaagaacaagatccagctggaggccaaggtgaaggagatgaatgaaaggctggaggatgaggaggagatgaatgctgagctgacagccaagaagaggaagctggaggatgagtgcagcgagctgaagaaggacattgatgacctggagctgaccctggccaaggtggagaaggagaagcacgccacagagaacaaggtgaagaacctgacagaggagatggccggcctggatgagatcatcgccaagctgaccaaggagaagaaggccctgcaggaggcccaccagcaggccctggatgacctgcaggtggaggaggacaaggtgaacagcctgagcaagagcaaggtgaagctggagcagcaggtggatgacctggagggcagcctggagcaggagaagaaggtgaggatggacctggagcgggccaagaggaagctggagggggacctgaagctgacccaggagagcatcatggacctggagaatgacaagctgcagctggaggagaagctgaagaagaaggagtttgacatcaaccagcagaacagcaagattgaagatgagcaggtgctggccctgcagctgcagaagaagctgaaggagaaccaggccagaattgaggagctggaggaggagctggaggccgagaggacagcccgggccaaggtggagaagctgcggagtgacctgagccgggagctggaggagatcagcgagcggctggaggaggccggcggggccacctctgtgcagatcgagatgaacaagaagcgggaggccgagttccagaagatgagaagagacctggaggaggccaccctgcagcacgaggccacagctgctgccctgaggaagaagcatgctgacagcgtggccgagctgggggagcagattgacaacctgcagagggtgaagcagaagctggagaaggagaagtctgagttcaagctggagctggatgatgtgaccagcaacatggagcagatcatcaaggccaaggccaacctggagaaggtgtccaggaccctggaggaccaggccaatgagtacagagtgaagctggaggaggcccagaggagcctgaatgacttcaccacccagagggccaagctgcagacagaaaatggagagctggcccggcagctggaggagaaggaggccctgatcagccagctgacccggggcaagctgagctacacccagcagatggaggacctgaagaggcagctggaggaggagggcaaggccaagaatgccctggcccacgccctgcagagcgcccggcatgactgtgacctgctgcgggagcagtatgaggaggagacagaggccaaggccgagctgcagagggtgctgagcaaggccaacagcgaggtggcccagtggaggaccaagtatgaaacagatgccatccagaggacagaggagctggaggaggccaagaagaagctggcccagaggctgcaggatgctgaggaggccgtggaggccgtgaatgccaagtgcagcagcctggagaagaccaagcaccggctgcagaatgaaattgaggacctgatggtggatgtggagaggagcaatgctgctgctgctgccctggacaagaagcagaggaactttgacaagatcctggccgagtggaagcagaagtatgaggagagccagagcgagctggagagcagccagaaggaggcccggagcctgagcacagagctgttcaagctgaagaatgcctatgaggagagcctggagcacctggagaccttcaagcgggagaacaagaacctgcaggaggagatcagtgacctgacagagcagctgggggagggcggcaagaatgtgcatgagctggagaaggtgaggaagcagctggaggtggagaagctggagctgcagagcgccctggaggaggccgaggccagcctggagcacgaggagggcaagatcctgcgggcccagctggagttcaaccagatcaaggccgagattgaaaggaagctggccgagaaggatgaggagatggagcaggccaagaggaaccaccagagggtggtggacagcctgcagaccagcctggatgctgagaccaggagcagaaatgaggtgctgcgggtgaagaagaagatggagggggacctgaatgagatggagatccagctgagccacgccaacaggatggctgctgaggcccagaagcaggtgaagagcctgcagagcctgctgaaggacacccagatccagctggatgatgctgtgcgggccaatgatgacctgaaggaaaatattgccatcgtggagaggaggaacaacctgctgcaggccgagctggaggagctgcgggctgtggtggagcagacagagaggagcaggaagctggccgagcaggagctgattgagaccagcgagcgggtgcagctgctgcacagccagaacaccagcctcatcaaccagaagaagaagatggagagtgacctgacccagctgcagagcgaggtggaggaggccgtgcaggagtgcagaaatgctgaggagaaggccaagaaggccatcacagatgctgccatgatggccgaggagctgaagaaggagcaggacaccagcgcccacctggagaggatgaagaagaacatggagcagaccatcaaggacctgcagcaccggctggatgaggccgagcagatcgccctgaagggcggcaagaagcagctgcagaagctggaggcccgggtgcgggagctggagggggagctggaggccgagcagaagagaaatgctgagagcgtgaagggcatgaggaagtcagaaagacgcatcaaggagctgacctaccagacagaggaggacaagaagaacctgctgcggctgcaggacctggtggacaagctgcagctgaaggtgaaggcctacaagaggcaggccgaggaggccgaggagcaggccaacaccaacctgagcaagttcaggaaggtgcagcacgagctggatgaggccgaggagagagctgacattgctgagagccaggtgaacaagctgcgggccaagagccgggacattggagccaagcagaagatgcatgatgaggagtag

SEQ ID NO: 160914 - DNA, 5820 bp, Artificial Sequence; identical to SEQ ID NO: 160913
  Description of Artificial Sequence: Synthetic coding sequence

SEQ ID NO: 160915 - DNA, 5808 bp, Artificial Sequence
  Description of Artificial Sequence: Synthetic coding sequence
atgggagacagcgagatggctgtgtttggagctgctgccccctacctgaggaagtctgagaaggagcggctggaggcccagacccggccctttgacctgaagaaggatgtgtttgtgcctgatgacaagcaggagtttgtgaaggccaagatcgtgtcccgggagggcggcaaggtgacagctgagacagaatatggcaagacagtgacagtgaaggaggaccaggtgatgcagcagaacccccccaagtttgacaagattgaggacatggccatgctgaccttcctgcacgagcctgctgtgctgtacaacctgaaggacagatatggctcctggatgatctacacctacagcggcctcttctgtgtgacagtgaacccctacaagtggctgcctgtgtacaccccagaggtggtggccgcctaccggggcaagaagaggtctgaggccccaccccacatcttcagcatcagtgacaatgcctaccagtacatgctgacagaccgggagaaccagagcatcctgatcactggagagagcggggccggcaagacagtgaacaccaagagggtcatccagtactttgctgtgattgctgccatcggggacaggagcaagaaggaccagagccctgggaagggcaccctggaggaccagatcatccaggccaacccagccctggaggcctttggaaatgccaagacagtgagaaatgacaacagcagcagatttgggaagttcatccgcatccactttggagccaccgggaagctggccagcgctgacatcgagacctacctgctggagaagagcagggtcatcttccagctgaaggccgagcgggactaccacatcttctaccagatcctgagcaacaagaagccagagctgctggacatgctgctgatcaccaacaacccctatgactatgccttcatcagccagggcgagaccaccgtggccagcattgatgatgctgaggagctgatggccacagacaatgcctttgatgtgctgggcttcaccagcgaggagaagaacagcatgtacaagctgactggagccatcatgcactttggaaacatgaagttcaagctgaagcagcgggaggagcaggccgagccagatggaacagaggaggccgacaagagcgcctacctgatgggcctgaacagcgctgacctgctgaagggcctgtgccacccccgggtgaaggtgggcaatgaatatgtgaccaagggccagaatgtgcagcaggtgatctatgccaccggggccctggccaaggctgtgtatgaaagaatgttcaactggatggtgacccgcatcaatgccaccctggagaccaagcagccccggcagtacttcatcggcgtgctggacattgctggctttgagatctttgacttcaacagctttgagcagctgtgcatcaacttcaccaatgagaagctgcagcagttcttcaaccaccacatgtttgtgctggagcaggaggagtacaagaaggagggcatcgagtggaccttcatcgactttggcatggacctgcaggcctgcatcgacctgattgagaagcccatgggcatcatgagcatcctggaggaggagtgcatgttccccaaggccacagacatgaccttcaaggccaagctgtttgacaaccacctgggcaagagcgccaacttccagaagcccaggaacatcaagggcaagccagaggcccacttcagcctcatccactacgccggcatcgtggactacaacatcatcggctggctgcagaagaacaaggaccccctgaatgagaccgtggtgggcctgtaccagaagagcagcctgaagctgctgagcaccctgtttgccaactatgctggagcagatgcccccatcgagaagggcaagggcaaggccaagaagggcagcagcttccagacagtgtctgccctgcaccgggagaacctgaacaagctgatgaccaacctgcggagcacccacccccactttgtgcgctgcatcatccccaatgagaccaagagccctggggtgatggacaaccccctggtgatgcaccagctgcgctgcaatggagtgctggagggcatccgcatctgcaggaagggcttccccaaccgcatcctgtatggagacttccggcagcgctaccgcatcctgaacccagctgccatccctgagggccagttcatcgacagcaggaaaggagctgagaagctgctgagcagcctggacatcgaccacaaccagtacaagtttggccacaccaaggtgttcttcaaggccggcctgctgggcctgctggaggagatgagagatgagcggctgagccgcatcatcacccgcatccaggcccagagccggggcgtgctggccaggatggagtacaagaagctgctggagcggcgggacagcctgctggtgatccagtggaacatccgggccttcatgggcgtgaagaactggccctggatgaagctgtacttcaagatcaagcccctgctgaagtctgctgagcgggagaaggagatggcctccatgaaggaggagttcacccggctgaaggaggccctggagaagtctgaggcccggaggaaggagctggaggagaagatggtgtccctgctgcaggagaagaatgacctgcagctgcaggtgcaggccgagcaggacaacctggctgatgctgaggagcgctgtgaccagctgatcaagaacaagatccagctggaggccaaggtgaaggagatgaatgaaaggctggaggatgaggaggagatgaatgctgagctgacagccaagaagaggaagctggaggatgagtgcagcgagctgaagagggacattgatgacctggagctgaccctggccaaggtggagaaggagaagcacgccacagagaacaaggtgaagaacctgacagaggagatggccggcctggatgagatcatcgccaagctgaccaaggagaagaaggccctgcaggaggcccaccagcaggccctggatgacctgcaggccgaggaggacaaggtgaacaccctgaccaaggccaaggtgaagctggagcagcaggtggatgacctggagggcagcctggagcaggagaagaaggtgaggatggacctggagcgggccaagaggaagctggagggggacctgaagctgacccaggagagcatcatggacctggagaatgacaagcagcagctggatgagcggctgaagaagaaggactttgagctgaatgccctgaatgccagaattgaagatgagcaggccctgggcagccagctgcagaagaagctgaaggagctgcaggccagaattgaggagctggaggaggagctggaggccgagaggacagcccgggccaaggtggagaagctgcggagtgacctgagccgggagctggaggagatcagcgagcggctggaggaggccggcggggccacctctgtgcagatcgagatgaacaagaagcgggaggccgagttccagaagatgagaagagacctggaggaggccaccctgcagcacgaggccacagctgctgccctgaggaagaagcatgctgacagcgtggccgagctgggggagcagattgacaacctgcagagggtgaagcagaagctggagaaggagaagtctgagttcaagctggagctggatgatgtgaccagcaacatggagcagatcatcaaggccaaggccaacctggagaagatgtgcaggaccctggaggaccagatgaatgagcacaggagcaaggccgaggagacccagaggtctgtgaatgacctgaccagccagagggccaagctgcagacagaaaatggagagctgagccggcagctggatgagaaggaggccctgatcagccagctgacccggggcaagctgacctacacccagcagctggaggacctgaagaggcagctggaggaggaggtgaaggccaagaatgccctggcccacgccctgcagagcgcccggcatgactgtgacctgctgcgggagcagtatgaggaggagacagaggccaaggccgagctgcagagggtgctgagcaaggccaacagcgaggtggcccagtggaggaccaagtatgaaacagatgccatccagaggacagaggagctggaggaggccaagaagaagctggcccagaggctgcaggaggccgaggaggccgtggaggccgtgaatgccaagtgcagcagcctggagaagaccaagcaccggctgcagaatgaaattgaggacctgatggtggatgtggagaggagcaatgctgctgctgctgccctggacaagaagcagaggaactttgacaagatcctggccgagtggaagcagaagtatgaggagagccagagcgagctggagagcagccagaaggaggcccggagcctgagcacagagctgttcaagctgaagaatgcctatgaggagagcctggagcacctggagaccttcaagcgggagaacaagaacctgcaggaggagatcagtgacctgacagagcagctgggcagcagcggcaagaccatccacgagctggagaaggtgaggaagcagctggaggccgagaagatggagctgcagagcgccctggaggaggccgaggccagcctggagcacgaggagggcaagatcctgcgggcccagctggagttcaaccagatcaaggccgagattgaaaggaagctggccgagaaggatgaggagatggagcaggccaagaggaaccacctgcgggtggtggacagcctgcagaccagcctggatgctgagaccaggagcagaaatgaggccctgcgggtgaagaagaagatggagggggacctgaatgagatggagatccagctgagccacgccaacaggatggctgctgaggcccagaagcaggtgaagagcctgcagagcctgctgaaggacacccagatccagctggatgatgctgtgcgggccaatgatgacctgaaggaaaatattgccatcgtggagaggaggaacaacctgctgcaggccgagctggaggagctgcgggctgtggtggagcagacagagaggagcaggaagctggccgagcaggagctgattgagaccagcgagcgggtgcagctgctgcacagccagaacaccagcctcatcaaccagaagaagaagatggatgctgacctgagccagctgcagacagaggtggaggaggccgtgcaggagtgcagaaatgctgaggagaaggccaagaaggccatcacagatgctgccatgatggccgaggagctgaagaaggagcaggacaccagcgcccacctggagaggatgaagaagaacatggagcagaccatcaaggacctgcagcaccggctggatgaggccgagcagatcgccctgaagggcggcaagaagcagctgcagaagctggaggcccgggtgcgggagctggagaatgagctggaggccgagcagaagagaaatgctgagagcgtgaagggcatgaggaagtcagaaagacgcatcaaggagctgacctaccagacagaggaggacaggaagaacctgctgcggctgcaggacctggtggacaagctgcagctgaaggtgaaggcctacaagaggcaggccgaggaggccgaggagcaggccaacaccaacctgagcaagttcaggaaggtgcagcacgagctggatgaggccgaggagagagctgacattgctgagagccaggtgaacaagctgcgggccaagagccgggacatcggcaccaagggcctgaatgaggagtag

SEQ ID NO: 160916 - DNA, 5823 bp, Artificial Sequence
  Description of Artificial Sequence: Synthetic coding sequence
atgggagacagcgagatggctgtgtttggagctgctgccccctacctgaggaagtctgagaaggagcggctggaggcccagacccggccctttgacctgaagaaggatgtgtttgtgcctgatgacaagcaggagtttgtgaaggccaagatcgtgtcccgggagggcggcaaggtgacagctgagacagaatatggcaagacagtgacagtgaaggaggaccaggtgatgcagcagaacccccccaagtttgacaagattgaggacatggccatgctgaccttcctgcacgagcctgctgtgctgtacaacctgaaggacagatatggctcctggatgatctacacctacagcggcctcttctgtgtgacagtgaacccctacaagtggctgcctgtgtacaccccagaggtggtggccgcctaccggggcaagaagaggtctgaggccccaccccacatcttcagcatcagtgacaatgcctaccagtacatgctgacagaccgggagaaccagagcatcctgatcactggagagagcggggccggcaagacagtgaacaccaagagggtcatccagtactttgctgtgattgctgccatcggggacaggagcaagaaggaccagagccctgggaagggcaccctggaggaccagatcatccaggccaacccagccctggaggcctttggaaatgccaagacagtgagaaatgacaacagcagcagatttgggaagttcatccgcatccactttggagccaccgggaagctggccagcgctgacatcgagacctacctgctggagaagagcagggtcatcttccagctgaaggccgagcgggactaccacatcttctaccagatcctgagcaacaagaagccagagctgctggacatgctgctgatcaccaacaacccctatgactatgccttcatcagccagggcgagaccaccgtggccagcattgatgatgctgaggagctgatggccacagacaatgcctttgatgtgctgggcttcaccagcgaggagaagaacagcatgtacaagctgactggagccatcatgcactttggaaacatgaagttcaagctgaagcagcgggaggagcaggccgagccagatggaacagaggaggccgacaagagcgcctacctgatgggcctgaacagcgctgacctgctgaagggcctgtgccacccccgggtgaaggtgggcaatgaatatgtgaccaagggccagaatgtgcagcaggtgatctatgccaccggggccctggccaaggctgtgtatgaaagaatgttcaactggatggtgacccgcatcaatgccaccctggagaccaagcagccccggcagtacttcatcggcgtgctggacattgctggctttgagatctttgacttcaacagctttgagcagctgtgcatcaacttcaccaatgagaagctgcagcagttcttcaaccaccacatgtttgtgctggagcaggaggagtacaagaaggagggcatcgagtggaccttcatcgactttggcatggacctgcaggcctgcatcgacctgattgagaagcccatgggcatcatgagcatcctggaggaggagtgcatgttccccaaggccacagacatgaccttcaaggccaagctgtttgacaaccacctgggcaagagcgccaacttccagaagcccaggaacatcaagggcaagccagaggcccacttcagcctcatccactacgccggcatcgtggactacaacatcatcggctggctgcagaagaacaaggaccccctgaatgagaccgtggtgggcctgtaccagaagagcagcctgaagctgctgagcaccctgtttgccaactatgctggagcagatgcccccatcgagaagggcaagggcaaggccaagaagggcagcagcttccagacagtgtctgccctgcaccgggagaacctgaacaagctgatgaccaacctgcggagcacccacccccactttgtgcgctgcatcatccccaatgagaccaagagccctggggtgatggacaaccccctggtgatgcaccagctgcgctgcaatggagtgctggagggcatccgcatctgcaggaagggcttccccaaccgcatcctgtatggagacttccggcagcgctaccgcatcctgaacccagctgccatccctgagggccagttcatcgacagcaggaaaggagctgagaagctgctgagcagcctggacatcgaccacaaccagtacaagtttggccacaccaaggtgttcttcaaggccggcctgctgggcctgctggaggagatgagagatgagcggctgagccgcatcatcacccgcatccaggcccagagccggggcgtgctggccaggatggagtacaagaagctgctggagcggcgggacagcctgctggtgatccagtggaacatccgggccttcatgggcgtgaagaactggccctggatgaagctgtacttcaagatcaagcccctgctgaagtctgctgagcgggagaaggagatggcctccatgaaggaggagttcacccggctgaaggaggccctggagaagtctgaggcccggaggaaggagctggaggagaagatggtgtccctgctgcaggagaagaatgacctgcagctgcaggtgcaggccgagcaggacaacctggctgatgctgaggagcgctgtgaccagctgatcaagaacaagatccagctggaggccaaggtgaaggagatgaatgaaaggctggaggatgaggaggagatgaatgctgagctgacagccaagaagaggaagctggaggatgagtgcagcgagctgaagagggacattgatgacctggagctgaccctggccaaggtggagaaggagaagcacgccacagagaacaaggtgaagaacctgacagaggagatggccggcctggatgagatcatcgccaagctgaccaaggagaagaaggccctgcaggaggcccaccagcaggccctggatgacctgcaggccgaggaggacaaggtgaacaccctgaccaaggccaaggtgaagctggagcagcaggtggatgacctggagggcagcctggagcaggagaagaaggtgaggatggacctggagcgggccaagaggaagctggagggggacctgaagctgacccaggagagcatcatggacctggagaatgacaagcagcagctggatgagcggctgaagaagaaggactttgagctgaatgccctgaatgccagaattgaagatgagcaggccctgggcagccagctgcagaagaagctgaaggagctgcaggccagaattgaggagctggaggaggagctggaggccgagaggacagcccgggccaaggtggagaagctgcggagtgacctgagccgggagctggaggagatcagcgagcggctggaggaggccggcggggccacctctgtgcagatcgagatgaacaagaagcgggaggccgagttccagaagatgagaagagacctggaggaggccaccctgcagcacgaggccacagctgctgccctgaggaagaagcatgctgacagcgtggccgagctgggggagcagattgacaacctgcagagggtgaagcagaagctggagaaggagaagtctgagttcaagctggagctggatgatgccctgctgggcctgcccagcagcaacttcctgctgcccccacccctgagcgccaacctggagaagatgtgcaggaccctggaggaccagatgaatgagcacaggagcaaggccgaggagacccagaggtctgtgaatgacctgaccagccagagggccaagctgcagacagaaaatggagagctgagccggcagctggatgagaaggaggccctgatcagccagctgacccggggcaagctgacctacacccagcagctggaggacctgaagaggcagctggaggaggaggtgaaggccaagaatgccctggcccacgccctgcagagcgcccggcatgactgtgacctgctgcgggagcagtatgaggaggagacagaggccaaggccgagctgcagagggtgctgagcaaggccaacagcgaggtggcccagtggaggaccaagtatgaaacagatgccatccagaggacagaggagctggaggaggccaagaagaagctggcccagaggctgcaggaggccgaggaggccgtggaggccgtgaatgccaagtgcagcagcctggagaagaccaagcaccggctgcagaatgaaattgaggacctgatggtggatgtggagaggagcaatgctgctgctgctgccctggacaagaagcagaggaactttgacaagatcctggccgagtggaagcagaagtatgaggagagccagagcgagctggagagcagccagaaggaggcccggagcctgagcacagagctgttcaagctgaagaatgcctatgaggagagcctggagcacctggagaccttcaagcgggagaacaagaacctgcaggaggagatcagtgacctgacagagcagctgggcagcagcggcaagaccatccacgagctggagaaggtgaggaagcagctggaggccgagaagatggagctgcagagcgccctggaggaggccgaggccagcctggagcacgaggagggcaagatcctgcgggcccagctggagttcaaccagatcaaggccgagattgaaaggaagctggccgagaaggatgaggagatggagcaggccaagaggaaccacctgcgggtggtggacagcctgcagaccagcctggatgctgagaccaggagcagaaatgaggccctgcgggtgaagaagaagatggagggggacctgaatgagatggagatccagctgagccacgccaacaggatggctgctgaggcccagaagcaggtgaagagcctgcagagcctgctgaaggacacccagatccagctggatgatgctgtgcgggccaatgatgacctgaaggagaacatcgccatcgtggagaggaggaacaacctgctgcaggccgagctggaggagctgcgggctgtggtggagcagacagagaggagcaggaagctggccgagcaggagctgattgagaccagcgagcgggtgcagctgctgcacagccagaacaccagcctcatcaaccagaagaagaagatggatgctgacctgagccagctgcagacagaggtggaggaggccgtgcaggagtgcagaaatgctgaggagaaggccaagaaggccatcacagatgctgccatgatggccgaggagctgaagaaggagcaggacaccagcgcccacctggagaggatgaagaagaacatggagcagaccatcaaggacctgcagcaccggctggatgaagctgagcagatcgccctgaagggcggcaagaagcagctgcagaagctggaggcccgggtgcgggagctggagaatgagctggaggccgagcagaagagaaatgctgagagcgtgaagggcatgaggaagtctgagcggcgcatcaaggagctgacctaccagacagaggaggacaggaagaacctgctgcggctgcaggacctggtggacaagctgcagctgaaggtgaaggcctacaagaggcaggccgaggaggccgaggagcaggccaacaccaacctgagcaagttcaggaaggtgcagcacgagctggatgaagctgaggagagagctgacattgctgagagccaggtgaacaagctgcgggccaagagccgggacatcggcaccaagggcctgaatgaggagtag

SEQ ID NO: 160917 - DNA, 5814 bp, Artificial Sequence
  Description of Artificial Sequence: Synthetic coding sequence
atgtctgccagcagtgatgctgagatggctgtgtttggagaggccgccccctacctgaggaagtctgagaaggagagaattgaggcccagaacaagccctttgatgccaagacctctgtgtttgtggccgagcccaaggagagctatgtgaagagcaccatccagagcaaggagggcggcaaggtgacagtgaagacagagggcggggccaccctgactgtgcgggaggaccaggtgttccccatgaacccccccaagtatgacaagattgaggacatggccatgatgacccacctgcacgagcccggggtgctgtacaacctgaaggagagatatgctgcctggatgatctacacctacagcggcctcttctgtgtgacagtgaacccctacaagtggctgcctgtgtacaagccagaggtggtggccgcctaccggggcaagaagaggcaggaggccccaccccacatcttcagcatcagtgacaatgcctaccagttcatgctgacagaccgggagaaccagagcatcctgatcaccggggagagcggggccggcaagacagtgaacaccaagagggtcatccagtactttgccaccatcgctgtgactggagagaagaagaaggatgagagcggcaagatgcagggcaccctggaggaccagatcatcagcgccaaccccctgctggaggcctttggaaatgccaagacagtgagaaatgacaacagcagcagatttgggaagttcatccgcatccacttcggcaccaccgggaagctggccagcgctgacatcgagacctacctgctggagaagagccgggtgaccttccagctgaaggccgagaggagctaccacatcttctaccagatcaccagcaacaagaagccagacctgattgagatgctgctgatcaccaccaacccctatgactatgcctttgtgtcccagggcgagatcaccgtgcccagcattgatgaccaggaggagctgatggccacagattctgccatcgacatcctgggcttcaccccagaggagaaggtgtccatctacaagctgaccggggctgtgatgcactacggcaacatgaagttcaagcagaagcagcgggaggagcaggccgagccagatggaacagaggtggccgacaaggccgcctacctgcagagcctgaacagcgctgacctgctgaaggccctgtgctacccccgggtgaaggtgggcaatgaatatgtgaccaagggccagacagtgcagcaggtgtacaatgctgtgggcgccctggccaaggctgtgtatgagaagatgttcctgtggatggtgacccgcatcaaccagcagctggacaccaagcagccccggcagtacttcatcggcgtgctggacattgctggctttgagatctttgacttcaacagcctggagcagctgtgcatcaacttcaccaatgagaagctgcagcagttcttcaaccaccacatgtttgtgctggagcaggaggagtacaagaaggagggcatcgagtggaccttcatcgactttggcatggacctggccgcctgcatcgagctgattgagaagcccctgggcatcttcagcatcctggaggaggagtgcatgttccccaaggccacagacaccagcttcaagaacaagctgtatgaccagcacctgggcaagagcgccaacttccagaagcccaaggtggtgaagggcaaggccgaggcccacttcagcctcatccactacgccggcaccgtggactacaacatcaccggctggctggacaagaacaaggaccccctgaatgacacagtggtgggcctgtaccagaagagcgccatgaagaccctggccagcctcttcagcacctacgccagcgctgaggccgacagcagcgccaagaagggggccaagaagaagggcagcagcttccagacagtgtctgccctcttccgggagaacctgaacaagctgatgaccaacctgcggagcacccacccccactttgtgcgctgcatcatccccaatgagaccaagacccctggggccatggagcacgagctggtgctgcaccagctgcgctgcaatggagtgctggagggcatccgcatctgcaggaagggcttccccagccgcatcctgtatggagacttcaagcagcgctacaaggtgctgaatgccagcgccatccctgagggccagttcatcgacagcaagaaggccagcgagaagctgctggccagcattgacatcgaccacacccagtacaagtttggccacaccaaggtgttcttcaaggccggcctgctgggcctgctggaggagatgagagatgagaagctggcccagatcatcaccaggacccaggccgtgtgccggggcttcctgatgagggtggagtaccagaagatgctgcagaggcgggaggccctcttctgcatccagtacaacgtgcgggccttcatgaatgtgaagcactggccctggatgaagctgttcttcaagatcaagcccctgctgaagtctgctgagacagagaaggagatggccaccatgaaggaggagttccagaagaccaaggatgagctggccaagtctgaggccaagaggaaggagctggaggagaagatggtgaccctgctgaaggagaagaatgacctgcagctgcaggtgcagagcgaggccgacagcctggctgatgctgaggagcgctgtgagcagctgatcaagaacaagatccagctggaggccaagatcaaggaggtgacagaaagagctgaggaggaggaggagatcaatgctgagctgacagccaagaagaggaagctggaggatgaatgttctgagctgaagaaggacattgatgacctggagctgaccctggccaaggtggagaaggagaagcacgccacagagaacaaggtgaagaacctgacagaggagatggccggcctggatgagaccatcgccaagctgagcaaggagaagaaggccctgcaggagacccaccagcagaccctggatgacctgcaggccgaggaggacaaggtgaacatcctgaccaaggccaagaccaagctggagcagcaggtggatgacctggagggcagcctggagcaggagaagaagctgaggatggacctggagcgggccaagaggaagctggagggggacctgaagctggcccaggagagcaccatggacatggagaatgacaagcagcagctggatgagaagctggagaagaaggagtttgagatcagcaacctgatcagcaagattgaagatgagcaggccgtggagatccagctgcagaagaagatcaaggagctgcaggcccgcatcgaggagctgggggaggagattgaagctgagcgggccagccgggccaaggccgagaagcagaggagtgacctgagccgggagctggaggagatcagcgagcggctggaggaggccggcggggccaccagcgcccaggtggagctgaacaagaagcgggaggccgagttccagaagctgcggcgggacctggaggaggccaccctgcagcacgaggccatggtggccgccctgaggaagaagcacgccgacagcatggccgagctgggggagcagattgacaacctgcagagggtgaagcagaagctggagaaggagaagtctgagctgaagatggagacagatgacctgagcagcaatgctgaggccatcagcaaggccaagggcaacctggagaagatgtgccgcagcctggaggaccaggtgtctgagctgaagaccaaggaggaggagcagcagaggctcatcaatgacctgacagcccagagggcccggctgcagacagaagctggggagtacagccggcagctggatgagaaggatgccctggtgtcccagctgagccgcagcaagcaggccagcacccagcagatcgaggagctgaagcaccagctggaggaggagaccaaggccaagaatgccctggcccacgccctgcagagcagcagacatgactgtgacctgctgcgggagcagtatgaggaggagcaggagggcaaggccgagctgcagagggccctgagcaaggccaacagcgaggtggcccagtggaggaccaagtatgaaacagatgccatccagaggacagaggagctggaggaggccaagaagaagctggcccagaggctgcaggaggccgaggagcacgtggaggccgtgaatgccaagtgtgccagcctggagaagaccaagcagaggctgcagaatgaggtggaggacctgatgctggatgtggagaggagcaatgctgcctgtgccgccctggacaagaagcagaggaactttgacaaggtgctgtctgagtggaagcagaagtatgaggagacccaggccgagctggaggccagccagaaggagagccgcagcctgagcacagagctgttcaaggtgaagaatgtgtatgaggagagcctggaccagctggagaccctgcggcgggagaacaagaacctgcagcaggagatcagtgacctgacagagcagattgctgagggcggcaagcagatccacgagctggagaagatcaagaagcaggtggagcaggagaagtgtgagatccaggccgccctggaggaggccgaggccagcctggagcacgaggagggcaagatcctgcgcatccagctggagctgaaccaggtgaagtctgaggtggacaggaagattgctgagaaggatgaggagattgaccagctgaagaggaaccacaccagggtggtggagaccatgcagagcaccctggatgctgagatccgcagcagaaatgatgccctgcgggtgaagaagaagatggagggggacctgaatgagatggagatccagctgaaccacgccaaccggctggccgctgagagcctgaggaactacagaaacacccagggcatcctgaaggagacccagctgcacctggatgatgccctgcggggccaggaggacctgaaggagcagctggccatcgtggagcggcgggccaacctgctgcaggccgagattgaggagctgtgggccaccctggagcagacagagaggagcaggaagattgctgagcaggagctgctggatgccagcgagcgggtgcagctgctgcacacccagaacaccagcctcatcaacaccaagaagaagctggagaatgatgtgtcccagctgcagagcgaggtggaggaggtgatccaggagagcagaaatgctgaggagaaggccaagaaggccatcacagatgctgccatgatggccgaggagctgaagaaggagcaggacaccagcgcccacctggagaggatgaagaagaacctggagcagacagtgaaggacctgcagcaccggctggatgaagctgagcagctggccctgaagggcggcaagaagcagatccagaagctggaggcccgggtgcgggagctggagggggaggtggagaatgagcagaagagaaatgctgaggccgtgaagggcctgaggaagcatgagcggcgggtgaaggagctgacctaccagacagaggaggacaggaagaatgtgctgcggctgcaggacctggtggacaagctgcaggccaaggtgaagagctacaagaggcaggccgaggaggccgaggagcagagcaatgccaacctgagcaagttcaggaagctgcagcacgagctggaggaggccgaggagagagctgacattgctgagagccaggtgaacaagctgcgggtgaagagccgggaggtgcacaccaagatctctgctgagtag

SEQ ID NO: 160918 - DNA, 5814 bp, Artificial Sequence; identical to SEQ ID NO: 160917
  Description of Artificial Sequence: Synthetic coding sequence

SEQ ID NO: 160919 - DNA, 453 bp, Artificial Sequence
  Description of Artificial Sequence: Synthetic coding sequence
atgtccttctctgctgaccagattgctgagttcaaggaggccttcctgctgtttgacagaactggagacagcaagatcaccctgagccaggtgggagatgtgctgcgggccctgggcaccaaccccaccaatgctgaggtgaggaaggtgctgggcaaccccagcaatgaggagctgaatgccaagaagattgaatttgagcagttcctgcccatgatgcaggccatcagcaacaacaaggaccaggccacctatgaggactttgtggagggcctgcgggtgtttgacaaggagggcaatggcaccgtgatgggcgctgagctgcggcacgtgctggccaccctgggggagaagatgaaggaggaggaggtggaggccctgatggccggccaggaggacagcaatggctgcatcaactatgaggcctttgtgaagcacatcatgagcatctag

SEQ ID NO: 160920 - DNA, 585 bp, Artificial Sequence
  Description of Artificial Sequence: Synthetic coding sequence
atggcccccaagaaggatgtgaagaagcctgtggccgctgctgctgctgccccagccccagccccagccccagccccagccccagccccagccaagcccaaggaggagaagattgacctgagcgccatcaagattgagttcagcaaggagcagcaggatgagttcaaggaggccttcctgctgtttgacagaactggagacagcaagatcaccctgagccaggtgggagatgtgctgcgggccctgggcaccaaccccaccaatgctgaggtgaggaaggtgctgggcaaccccagcaatgaggagctgaatgccaagaagattgaatttgagcagttcctgcccatgatgcaggccatcagcaacaacaaggaccaggccacctatgaggactttgtggagggcctgcgggtgtttgacaaggagggcaatggcaccgtgatgggcgctgagctgcggcacgtgctggccaccctgggggagaagatgaaggaggaggaggtggaggccctgatggccggccaggaggacagcaatggctgcatcaactatgaggcctttgtgaagcacatcatgagcatctag

SEQ ID NO: 160921 - DNA, 519 bp, Artificial Sequence; identical to SEQ ID NO: 160813
  Description of Artificial Sequence: Synthetic coding sequence

SEQ ID NO: 160922 - DNA, 519 bp, Artificial Sequence; identical to SEQ ID NO: 160813
  Description of Artificial Sequence: Synthetic coding sequence

SEQ ID NO: 160923 - DNA, 519 bp, Artificial Sequence; identical to SEQ ID NO: 160813
  Description of Artificial Sequence: Synthetic coding sequence

SEQ ID NO: 160924 - DNA, 519 bp, Artificial Sequence; identical to SEQ ID NO: 160813
  Description of Artificial Sequence: Synthetic coding sequence

SEQ ID NO: 160925 - DNA, 627 bp, Artificial Sequence
  Description of Artificial Sequence: Synthetic coding sequence
atggccctgggccagaagctgttcatcaccatgagcagaggagctggccgcctgcagggcaccctgtgggccctggtgttcctgggcatcctggtgggcatggtggtgcccagccctgctggcacccgggccaacaacaccctgctggacagccggggctggggcaccctgctgagccgcagcagagctggcctggccggggagattgctggggtgaactgggagagcggctacctggtgggcatcaagaggcagaggcggctgtactgcaatgtgggcatcggcttccacctgcaggtgctgcctgatggccgcatcagcggcacccatgaggagaacccctacagcctgctggagatcagcacagtggagcggggcgtggtgtccctgtttggagtgcgcagcgccctgtttgtggccatgaacagcaagggccgcctgtatgccacccccagcttccaggaggagtgcaagttccgggagaccctgctgcccaacaactacaatgcctatgaaagtgacctgtaccagggcacctacatcgccctgagcaaatatggccgggtgaagaggggcagcaaggtgagccccatcatgacagtgacccacttcctgccccgcatctag

SEQ ID NO: 160926 - DNA, 588 bp, Artificial Sequence
  Description of Artificial Sequence: Synthetic coding sequence
atggcccccaagaagccagagcccaagaaggatgatgccaaggccgcccccaaggccgccccagccccagcccctcctcctgagcctgagcggcccaaggaggtggagtttgatgccagcaagatcaagattgagttcaccccagagcagatcgaggagttcaaggaggccttcatgctgtttgacaggacccccaagtgtgagatgaagatcacctacggccagtgtggagatgtgctgcgggccctgggccagaaccccacccaggccgaggtgctgcgggtgctgggcaagccccggcaggaggagctgaacaccaagatgatggactttgagaccttcctgcccatgctgcagcacatcagcaagaacaaggacaccggcacctatgaagattttgtggagggcctgcgggtgtttgacaaggagggcaatggaacagtgatgggcgctgagctgcggcacgtgctggccaccctgggggagcggctgacagaagatgaggtggagaagctgatggccggccaggaggacagcaatggctgcatcaactatgaggcctttgtgaagcacatcatgagcagctag

SEQ ID NO: 160927 - DNA, 588 bp, Artificial Sequence; identical to SEQ ID NO: 160926
  Description of Artificial Sequence: Synthetic coding sequence

SEQ ID NO: 160928 - DNA, 141 bp, Artificial Sequence
  Description of Artificial Sequence: Synthetic coding sequence
atggcccccaagaagccagagcccaagaaggatgatgccaaggccgcccccaaggccgccccagccccagcccctcctcctgagcctgagcggcccaaggaggtggagtttgatgccagcaagatcaagattgagttctag

SEQ ID NO: 160929 - DNA, 594 bp, Artificial Sequence
  Description of Artificial Sequence: Synthetic coding sequence
atggcccccaagaagccagagcccaagaaggaggccgccaagccagccccagccccagccccagccccagccccagccccagccccagcccctgaggcccccaaggagcccgcctttgaccccaagtctgtgaagattgacttcaccgctgaccagatcgaggagttcaaggaggccttcagcctgtttgacaggacccccaccggggagatgaagatcacctacggccagtgtggagatgtgctgcgggccctgggccagaaccccaccaatgctgaggtgctgcgggtgctgggcaagcccaagccagaggagatgaatgtgaagatgctggactttgagaccttcctgcccatcctgcagcacatcagcaggaacaaggagcagggcacctatgaagattttgtggagggcctgcgggtgtttgacaaggagagcaatggaacagtgatgggcgctgagctgcggcacgtgctggccaccctgggggagaagatgacagaagctgaggtggagcagctgctggccggccaggaggatgccaacggctgcatcaactatgaggcctttgtgaagcacatcatgagcggctag

SEQ ID NO: 160930 - DNA, 594 bp, Artificial Sequence; identical to SEQ ID NO: 160929
  Description of Artificial Sequence: Synthetic coding sequence

SEQ ID NO: 160931 - DNA, 264 bp, Artificial Sequence
  Description of Artificial Sequence: Synthetic coding sequence
cctgaggcccccaaggagcccgcctttgaccccaagtctgtgaaggtgattggctgcccctgccccaggagccagagccatggagctgtgattgacttcaccgctgaccagatcgaggagttcaaggaggccttcatgggcgctgagctgcggcacgtgctggccaccctggtgatcaagagcgcccccccacccaagcccacagctggggagaagatgacagaggccgaggtggagcagctgctggccggccaggaggactag

SEQ ID NO: 160932 - DNA, 522 bp, Artificial Sequence
  Description of Artificial Sequence: Synthetic coding sequence
atggccagcaggaagaccaagaagaaggagggcggggccctgcgggcccagagggccagcagcaatgtgttcagcaactttgagcagacccagatccaggagttcaaggaggccttcaccctgatggaccagaacagagatggcttcatcgacaaggaggacctgaaggacacctacgccagcctgggcaagaccaacgtgaaggatgatgagctggatgccatgctgaaggaggccagcggccccatcaacttcaccatgttcctgaacctgtttggagagaagctgtctggaacagatgctgaggagaccatcctgaatgccttcaagatgctggaccctgatggcaagggcaagatcaacaaggagtacatcaagaggctgctgatgagccaggccgacaagatgacagctgaggaggtggaccagatgttccagtttgccagcattgatgtggccggcaacctggactacaaggccctgtcctatgtgatcacccatggagaggagaaggaggagtag

SEQ ID NO: 160933 - DNA, 399 bp, Artificial Sequence
  Description of Artificial Sequence: Synthetic coding sequence
atggaccagaacagagatggcttcatcgacaaggaggacctgaaggacacctacgccagcctgggcaagaccaacgtgaaggatgatgagctggatgccatgctgaaggaggccagcggccccatcaacttcaccatgttcctgaacctgtttggagagaagctgagcggcacagatgctgaggagaccatcctgaatgccttcaagatgctggaccctgatggcaagggcaagatcaacaaggagtacatcaagaggctgctgatgagccaggccgacaagatgacagctgaggaggtggaccagatgttccagtttgccagcattgatgtggccggcaacctggactacaaggccctgtcctatgtgatcacccacggggaggagaaggaggagtag

SEQ ID NO: 160934 - DNA, 399 bp, Artificial Sequence; identical to SEQ ID NO: 160933
  Description of Artificial Sequence: Synthetic coding sequence

SEQ ID NO: 160935 - DNA, 399 bp, Artificial Sequence; identical to SEQ ID NO: 160933
  Description of Artificial Sequence: Synthetic coding sequence

SEQ ID NO: 160936 - DNA, 456 bp, Artificial Sequence
  Description of Artificial Sequence: Synthetic coding sequence
atgtgtgacttcacagaggaccagacagctgagttcaaggaggccttccagctgtttgacagaactggagatggcaagatcctgtacagccagtgtggagatgtgatgagggccctgggccagaaccccaccaatgctgaggtgctgaaggtgctgggcaaccccaagagtgatgagatgaatgtgaaggtgctggactttgagcacttcctgcccatgctgcagacagtggccaagaacaaggaccagggcacctatgaagattatgtggagggcctgcgggtgtttgacaaggagggcaatggaacagtgatgggcgctgagatcagacatgtgctggtgaccctgggggagaagatgacagaggaggaggtggagatgctggtggccggccacgaggacagcaatggctgcatcaactatgaggagctggtgaggatggtgctgaatggatag

SEQ ID NO: 160937 - DNA, 456 bp, Artificial Sequence
  Description of Artificial Sequence: Synthetic coding sequence
atgtgtgacttcacagaggaccagacagctgagttcaaggaggccttccagctgtttgacagaactggagatggcaagatcctgtacagccagtgtggagatgtgatgagggccctgggccagaaccccaccaatgctgaggtgctgaaggtgctgggcaaccccaagagtgatgagatgaatgtgaaggtgctggactttgagcacttcctgcccatgctgcagacagtggccaagaacaaggaccagggcacctatgaagattatgtggagggcctgcgggtgtttgacaaggagggcaatggaacagtgatgggcgctgagatcagacatgtgctggtgaccctgggggagaagatgacagaggaggaggtggagatgctggtggccggccacgaggacagcaatggctgcatcaactatgaggcctttgtgcgccacatcctgagcggctag

SEQ ID NO: 160938 - DNA, 456 bp, Artificial Sequence; identical to SEQ ID NO: 160937
  Description of Artificial Sequence: Synthetic coding sequence

SEQ ID NO: 160939 - DNA, 1491 bp, Artificial Sequence
  Description of Artificial Sequence: Synthetic coding sequence
atgagctccatggaggagatccaggtggagctgcagtgtgccgacctgtggaagcgcttccatgacattggaacagagatgatcatcaccaaggccggccgcaggatgtttcctgccatgagggtgaagatcaccggcctggacccccaccagcagtactacatcgccatggacatcgtgcctgtggacaacaagcgctaccgctacgtgtaccacagcagcaagtggatggtggccggaaatgctgacagccctgtgcccccccgggtgtacatccacccagacagcctggccagcggggacacctggatgaggcaggtggtgtcctttgacaagctgaagctgaccaacaatgagctggatgaccagggccacatcatcctgcacagcatgcacaagtaccagccccgggtgcacgtgatcaggaaggacttcagcagtgacctgagccccaccaagcctgtgcctgtgggagatggagtgaagaccttcaacttccctgagaccgtcttcaccaccgtgacagcctaccagaaccagcagatcacccggctgaagattgacaggaacccctttgccaagggcttccgggacagcggcaggaacagaacaggcctggaggccatcatggagacctacgccttctggaggcctcctgtgaggaccctgacctttgaggacttcaccaccatgcagaagcagcagggcggcagcacaggcaccagccccaccaccagcagcacaggcacccccagccccagcgccagcagccacctgctgagccccagctgcagcccccccaccttccacctggcccccaacaccttcaacgtgggctgccgggagagccagctgtgcaacctgaacctgagtgactacccaccctgtgcccggagcaacatggccgccctgcagagctacccaggcctgagtgacagcggctacaaccggctgcagagcggcaccaccagcgccacccagcccagcgagaccttcatgccccagaggacccccagcctcatcagcggcatccccaccccacccagcctgcccggcaacagcaagatggaggcctatggaggccagctgggcagcttccccaccagccagttccagtatgtgatgcaggccggaaatgctgccagcagcagcagcagcccccacatgtttggaggcagccacatgcagcagagcagctacaatgccttcagcctgcacaacccctacaacctgtatggctacaacttccccaccagcccccggctggccgccagccctgagaagctgagcgccagccagagcaccctgctgtgcagcagccccagcaatggagccttcggggagcggcagtacctgcccagcggcatggagcacagcatgcacatgatcagccccagccccaacaaccagcaggccaccaacacctgtgatggccggcagtatggagctgtgcccggcagcagcagccagatgtctgtgcacatggtgtag

SEQ ID NO: 160940 - DNA, 627 bp, Artificial Sequence
  Description of Artificial Sequence: Synthetic coding sequence
atgccacccaagaaggatgtgcctgtgaagaagccagctggccccagcatcagcaagccagctgccaagccagctgctgctggggcccccccagccaagaccaaggccgagcctgctgtgccccaggccccccagaagacccaggagccccctgtggacctgagcaaggtggtgattgagttcaacaaggaccagctggaggagttcaaggaggcctttgagctgtttgacagagtgggagatggcaagatcctgtacagccagtgtggagatgtgatgagggccctgggccagaaccccaccaatgctgaggtgctgaaggtgctgggcaaccccaagagtgatgagctgaagagccggcgggtggactttgagaccttcctgcccatgctgcaggccgtggccaagaacagaggccagggcacctatgaggactacctggagggcttccgggtgtttgacaaggagggcaatggcaaggtgatgggcgctgagctgcggcacgtgctgaccaccctgggggagaagatgacagaggaggaggtggagaccgtgctggccggccacgaggacagcaatggctgcatcaactatgaggccttcctgaagcacatcctgtctgtgtag

SEQ ID NO: 160941 - DNA, 90 bp, Artificial Sequence
  Description of Artificial Sequence: Synthetic coding sequence
atgccacccaagaaggatgtgcctgtgaagaagccagctggccccagcatcagcaagccagctgccaagccagctgctgctggggcctag

SEQ ID NO: 160942 - DNA, 627 bp, Artificial Sequence; identical to SEQ ID NO: 160940
  Description of Artificial Sequence: Synthetic coding sequence

SEQ ID NO: 160943 - DNA, 3477 bp, Artificial Sequence
  Description of Artificial Sequence: Synthetic coding sequence
atggctgctgtgcggggggcccccctgctgagctgcctgctggccctgctggccctgtgccctgggggccggccccagacagtgctgacagatgatgaaattgaggagttcctggagggcttcctgtctgagctggagcctgagcccagagaagatgatgtggaggcccctcctcctcctgagcccaccccccgggtgaggaaggcccaggccggcggcaagccaggcaagaggcctggaacagctgctgaggtgcccccagagaagaccaaggacaagggcaagaagggcaagaaggacaagggccccaaggtgcccaaggagagcctggagggcagcccccggccccccaagaagggcaaggagaagccacccaaggccaccaagaagcccaaggagaagccacccaaggccaccaagaagcccaaggagaagccacccaaggccaccaagaagcccaaggagaagccacccaaggccaccaagaagccacccagcggcaagaggcctcccatcctggcccccagcgagaccctggagtggcccctgcccccaccacccagccctggccctgaggagctgccccaggagggcggggcccccctgagcaacaactggcagaaccctggagaggagacccacgtggaggcccgggagcaccagcctgagcctgaggaggagacagagcagcccaccctggactacaatgaccagatcgagcgggaggactatgaagattttgagtacatccggcggcagaagcagccccggcccccacccagcagaagaagaagacctgagcgggtgtggccagagcccccagaggagaaggccccagccccagcccctgaggagagaattgagccccctgtgaagcccctgctgccccccctgcccccagactatggagatggctacgtgatccccaactatgatgacatggactactacttcggccccccaccaccccagaagccagatgctgagcggcagacagatgaggagaaggaggagctgaagaagcccaagaaggaggacagcagccccaaggaggagacagacaagtgggccgtggagaagggcaaggaccacaaggagcccaggaaaggagaggagctggaggaggagtggacccccacagagaaggtgaagtgcccccccatcggcatggagagccacagaattgaggacaaccagatccgggccagctccatgctgcggcacggcctgggcgcccagaggggccgcctgaacatgcagacaggagccacagaagatgactactatgatggagcctggtgtgccgaggatgatgcccggacccagtggattgaggtggacaccaggaggaccacccgcttcaccggggtcatcacccagggccgggacagcagcatccatgatgactttgtgaccaccttctttgtgggcttcagcaatgacagccagacctgggtgatgtacaccaacggctatgaggagatgaccttccacggcaatgtggacaaggacacccctgtgctgtctgagctgcctgagcctgtggtggcccgcttcatccgcatctaccccctgacctggaatggcagcctgtgcatgaggctggaggtgctgggctgcagcgtggcccctgtgtacagctactatgcccagaatgaggtggtggccacagatgacctggacttccgccaccacagctacaaggacatgaggcagctgatgaaggtggtgaatgaggagtgccccaccatcaccaggacctacagcctgggcaagagcagccggggcctgaagatctatgccatggagatcagtgacaaccctggagaacatgagctgggggagcctgagttccgctacacagctggcatccatggaaatgaggtgctgggccgggagctgctgctgctgctgatgcagtacctgtgccgggagtacagagatggcaacccccgggtgcgcagcctggtgcaggacacccgcatccacctggtgcccagcctgaacccagatggctatgaggtggccgcccagatgggcagcgagtttggaaactgggccctgggcctgtggacagaggagggctttgacatctttgaggacttcccagacctgaacagcgtgctgtggggcgctgaggagaggaagtgggtgccctacagagtgcccaacaacaacctgcccatccctgagcgctacctgagcccagatgccaccgtgtccacagaggtgcgggccatcatcgcctggatggagaagaacccctttgtgctgggcgccaacctgaatggaggagagcggctggtgtcctacccctatgacatggcccggacccccacccaggagcagctgctggccgccgccatggctgctgcccggggagaagatgaagatgaggtgtctgaggcccaggagaccccagaccacgccatcttccgctggctggccatcagctttgccagcgcccacctgaccctgacagagccctaccggggcggctgccaggcccaggactacacaggaggcatgggcatcgtgaatggagccaagtggaaccccaggacaggcaccatcaatgacttctcctacctgcacaccaactgcctggagctgtccttctacctgggctgtgacaagttcccccatgagagcgagctgccccgggagtgggagaacaacaaggaggccctgctgaccttcatggagcaggtgcaccggggcatcaagggcgtggtgacagatgagcagggcatccccatcgccaatgccaccatctctgtgtctggcatcaaccacggcgtgaagacagccagcggcggggactactggaggatcctgaaccctggagagtacagagtgacagcccatgctgagggctacaccccatctgccaagacctgcaatgtggactatgacattggagccacccagtgcaacttcatcctggcccggagcaactggaagaggatccgggagatcatggccatgaatggaaaccggcccatcccccacatcgaccccagccggcccatgaccccccagcagaggcggctgcagcagaggcggctgcagcaccggctgcggctgcgggcccagatgaggctgcggcggctgaatgccaccaccaccctgggcccccacacagtgccccccaccctgcccccagccccagccaccaccctgagcaccaccatcgagccctggggcctcatcccccccaccacagctggctgggaggagagcgagacagagacctacacagaggtggtgacagaatttggaacagaggtggagcctgagtttggcaccaaggtggagcctgagtttgagacccagctggagcctgagtttgagacccagctggagcctgagtttgaggaggaggaggaggaggagaaggaggaggagatcgccaccggccaggccttccccttcaccaccgtggagacctacacagtgaactttggagacttctag

SEQ ID NO: 160944 - DNA, 447 bp, Artificial Sequence
  Description of Artificial Sequence: Synthetic coding sequence
atgtttgagcaggcccagatccaggagttcaaggaggccttcagctgcatcgaccagaacagagatggcatcatctgcaaggctgacctgcgggagacctacagccagctgggcaaggtgtctgtgcctgaggaggagctggatgccatgctgcaggagggcaagggccccatcaacttcaccgtcttcctgaccctgtttggagagaagctgaatggaacagatcctgaggaggccatcctgagcgccttcaggatgtttgaccccagcggcaagggcgtggtgaacaaggatgagttcaagcagctgctgctgacccaggccgacaagttctccccagctgaggtggagcagatgtttgccctgacccccatggacctggccggcaacatcgactacaagagcctgtgctacatcatcacccatggagatgagaaggaggagtag

SEQ ID NO: 160945 - DNA, 1128 bp, Artificial Sequence
  Description of Artificial Sequence: Synthetic coding sequence
atgcagaagctgcagctgtgtgtgtacatctacctgttcatgctgattgtggccggccctgtggacctgaatgaaaattctgagcagaaggaaaatgtggagaaggagggcctgtgcaatgcctgcacctggaggcagaacaccaagagcagcagaattgaggccatcaagatccagatcctgagcaagctgcggctggagacagcccccaacatcagcaaggatgtgatccggcagctgctgcccaaggccccacccctgcgggagctgattgaccagtatgatgtgcagagagatgacagcagtgatggcagcctggaggatgatgactaccacgccaccacagagaccatcatcaccatgcccacagaaagtgacttcctgatgcaggtggatggcaagcccaagtgctgcttcttcaagttcagcagcaagatccagtacaacaaggtggtgaaggcccagctgtggatctacctgcggcctgtggagacccccaccaccgtgtttgtgcagatcctgcggctcatcaagcccatgaaggatggcacccgctacacaggcatccgcagcctgaagctggacatgaaccctggcaccggcatctggcagagcattgatgtgaagacagtgctgcagaactggctgaagcagcctgagagcaacctgggcatcgagatcaaggccctggatgaaaatggacatgacctggccgtgaccttccctggccctggagaagatggcctgaaccccttcctggaggtgaaggtgacagacacccccaagaggagcagaagagactttggcctggactgtgatgagcacagcacagagagccgctgctgccgctaccccctgactgtggactttgaggccttcggctgggactggatcatcgcccccaagcgctacaaggccaactactgcagcggggagtgtgaatttgtgttcctgcagaagtacccccacacccacctggtgcaccaggccaacccccggggcagcgctggcccctgctgcacccccaccaagatgagccccatcaacatgctgtacttcaacgggaaggagcagatcatctacggcaagatcccagccatggtggtggacagatgtggctgcagctag

SEQ ID NO: 160946 - DNA, 1497 bp, Artificial Sequence
  Description of Artificial Sequence: Synthetic coding sequence
atgttcaactatgaaagacccaagcacttcatccagagccagaacccctgtggcagccggctgcagcccccaggccctgagaccagcagcttcagcagccagaccaagcagagcagcatcatcatccagccccggcagtgcacagagcagcgcttcagcgccagcagcaccctgagcagccacatcaccatgagcagcagcgccttccctgccagccccaagcagcacgccggcagcaaccctggccagagggtgaccaccacctacaaccagagccctgccagcttcctgagcagcatcctgcccagccagcctgactacaacagcagcaagatccccagcgccatggacagcaactaccagcagagcagcgctggccagcccatcaatgccaagcccagccagacagccaatgccaagcccatccccaggaccccagaccacgagatccagggcagcaaggaggccctgatccaggacctggagaggaagctgaagtgcaaggacaccctgctgcacaacggcaaccagaggctgacctatgaggagaagatggcccggcggctgctgggcccccagaatgctgctgctgtgttccaggcccaggatgattctggggcccaggacagccagcagcacaacagcgagcacgcccggctgcaggtgcccaccagccaggtgcgcagccgcagcaccagcagaggagatgtgaatgaccaggatgccatccaggagaagttctacccaccccgcttcatccaggtgcctgagaacatgagcattgatgagggccgcttctgcaggatggacttcaaggtgtctggcctgcctgccccagatgtgtcctggtacctgaatggccgcacagtgcagagtgatgacctgcacaagatgattgtgtctgagaagggcctgcacagcctcatctttgaggtggtgcgggccagtgatgctggggcctatgcctgtgtggccaagaacagagctggggaggccaccttcaccgtgcagctggatgtgctggccaaggagcacaagagggcccccatgttcatctacaagccccagagcaagaaggtgctggagggggacagcgtgaagctggagtgccagatcagcgccatccccccacccaagctgttctggaagaggaacaatgagatggtgcagttcaacacagaccgcatcagcctgtaccaggacaacacaggccgggtgaccctgctgatcaaggatgtgaacaagaaggatgctggctggtacacagtgtctgctgtgaatgaagctggggtgaccacctgcaacacccggctggatgtgacagcccggcccaaccagaccctgcctgcccccaagcagctgcgggtgcggcccaccttcagcaagtacctggccctgaatggcaagggcctgaatgtgaagcaggccttcaaccctgagggggagttccagaggctggccgcccagagcggcctgtatgaaagtgaggagctgtag

SEQ ID NO: 160947 - DNA, 945 bp, Artificial Sequence
  Description of Artificial Sequence: Synthetic coding sequence
atggcccggcggctgctgggcccccagaatgctgctgctgtgttccaggcccaggatgattctggggcccaggacagccagcagcacaacagcgagcacgcccggctgcaggtgcccaccagccaggtgcgcagccgcagcaccagcagaggagatgtgaatgaccaggatgccatccaggagaagttctacccaccccgcttcatccaggtgcctgagaacatgagcattgatgagggccgcttctgcaggatggacttcaaggtgtctggcctgcctgccccagatgtgtcctggtacctgaatggccgcacagtgcagagtgatgacctgcacaagatgattgtgtctgagaagggcctgcacagcctcatctttgaggtggtgcgggccagtgatgctggggcctatgcctgtgtggccaagaacagagctggggaggccaccttcaccgtgcagctggatgtgctggccaaggagcacaagagggcccccatgttcatctacaagccccagagcaagaaggtgctggagggggacagcgtgaagctggagtgccagatcagcgccatccccccacccaagctgttctggaagaggaacaatgagatggtgcagttcaacacagaccgcatcagcctgtaccaggacaacacaggccgggtgaccctgctgatcaaggatgtgaacaagaaggatgctggctggtacacagtgtctgctgtgaatgaagctggggtgaccacctgcaacacccggctggatgtgacagcccggcccaaccagaccctgcctgcccccaagcagctgcgggtgcggcccaccttcagcaagtacctggccctgaatggcaagggcctgaatgtgaagcaggccttcaaccctgagggggagttccagaggctggccgcccagagcggcctgtatgaaagtgaggagctgtag

SEQ ID NO: 160948 - DNA, 357 bp, Artificial Sequence
  Description of Artificial Sequence: Synthetic coding sequence
atgtgtgacaaggagttcatgtgggccctgaagaatggagacctggatgaggtgaaggactatgtggccaagggggaggatgtgaacagaaccctggagggcggcaggaagcccctgcactacgccgctgactgtggccagctggagatcctggagttcctgctgctgaagggagctgacatcaatgccccagacaagcaccacatcacccccctgctgtctgctgtgtatgagggccacgtgtcctgtgtgaagctgctgctgagcaaaggagctgacaagacagtgaagggcccagatggcctgacagcctttgaggccacagacaaccaggccatcaaggccctgctgcagtag

SEQ ID NO: 160949 - DNA, 1812 bp, Artificial Sequence
  Description of Artificial Sequence: Synthetic coding sequence
atggccagcgccagcaccagcaagtacaacagccacagcctggagaatgaaagcatcaagaggaccagcagagatggagtgaacagagacctgacagaggccgtgccccggctgcctggagagaccctcatcacagacaaggaggtgatctacatctgccccttcaacggccccatcaagggccgggtgtacatcaccaactaccgcctgtacctgcggagcctggagacagacagcagcctcatcctggatgtgcccctgggcgtcatcagcagaattgagaagatgggcggggccaccagcagaggagagaacagctatggcctggacatcacctgcaaggacatgaggaacctgcgctttgccctgaagcaggagggccacagccggcgggacatgtttgagatcctgaccaggtatgccttccccctggcccacagcctgcccctgtttgccttcctgaatgaggagaagttcaacgtggatggctggacagtgtacaaccctgtggaggagtaccgccggcagggcctgcccaaccaccactggaggatcaccttcatcaacaagtgctatgagctgtgtgacacctacccagccctgctggtggtgccctaccgggccagtgatgatgacctgcggcgggtggccaccttccgcagcaggaaccgcatccctgtgctgtcctggatccaccctgagaacaagacagtgattgtgcgctgcagccagcccctggtgggcatgtctgggaagaggaacaaggatgatgagaagtacctggatgtgatccgggagaccaacaagcagatcagcaagctgaccatctatgatgcccggcccagcgtgaatgctgtggccaacaaggccactggaggcggctatgaaagtgatgatgcctaccacaatgctgagctgttcttcctggacatccacaacatccacgtgatgagggagagcctgaagaaggtgaaggacatcgtgtacccaaatgtggaggagagccactggctgagcagcctggagagcacccactggctggagcacatcaagctggtgctgactggagccatccaggtggccgacaaggtgagcagcggcaagagctctgtgctggtgcactgcagtgatggctgggacagaacagcccagctgaccagcctggccatgctgatgctggacagcttctaccgcagcattgagggctttgagatcctggtgcagaaggagtggatcagctttggccacaagtttgccagccgcatcggccacggggacaagaaccacacagatgctgacaggagccccatcttcctgcagttcatcgactgtgtgtggcagatgagcaagcagttccccacagcctttgagttcaatgagcagttcctgatcatcatcctggaccacctgtacagctgccgcttcggcaccttcctgttcaactgtgagagcgcccgggagcggcagaaggtgacagagaggacagtgtccctgtggagcctcatcaacagcaacaaggagaagttcaagaaccccttctacaccaaggagatcaacagagtgctgtaccctgtggcctccatgaggcacctggagctgtgggtgaactactacatccgctggaacccccgcatcaagcagcagcagcccaaccctgtggagcagcgctacatggagctgctggccctgagagatgagtacatcaagaggctggaggagctgcagctggccaacagcgccaagctgagtgacccccccaccagccccagcagccccagccagatgatgccccacgtgcagacccacttctag

SEQ ID NO: 160950 - DNA, 1701 bp, Artificial Sequence
  Description of Artificial Sequence: Synthetic coding sequence
atggccagcgccagcaccagcaagtacaacagccacagcctggagaatgaaagcatcaagaggaccagcagagatggagtgaacagagacctgacagaggccgtgccccggctgcctggagagaccctcatcacagacaaggaggtgatctacatctgccccttcaacggccccatcaagggccgggtgtacatcaccaactaccgcctgtacctgcggagcctggagacagacatgaggaacctgcgctttgccctgaagcaggagggccacagcagaagagacatgtttgagatcctgaccaggtatgccttccccctggcccacagcctgcccctgtttgccttcctgaatgaggagaagttcaacgtggatggctggacagtgtacaaccctgtggaggagtaccgccggcagggcctgcccaaccaccactggaggatcaccttcatcaacaagtgctatgagctgtgtgacacctacccagccctgctggtggtgccctaccgggccagtgatgatgacctgcggcgggtggccaccttccgcagcaggaaccgcatccctgtgctgtcctggatccaccctgagaacaagacagtcatcgtgcgctgcagccagcccctggtgggcatgtctgggaagaggaacaaggatgatgagaagtacctggatgtgatccgggagaccaacaagcagatcagcaagctgaccatctatgatgcccggcccagcgtgaatgctgtggccaacaaggccaccggcggcggctatgaaagtgatgatgcctaccacaatgctgagctgttcttcctggacatccacaacatccacgtgatgagggagagcctgaagaaggtgaaggacatcgtgtaccccaacgtggaggagagccactggctgagcagcctggagagcacccactggctggagcacatcaagctggtgctgaccggggccatccaggtggccgacaaggtgtcctctgggaagagctctgtgctggtgcactgcagtgatggctgggacagaacagcccagctgaccagcctggccatgctgatgctggacagcttctaccgcagcattgagggctttgagatcctggtgcagaaggagtggatcagctttggccacaagtttgccagcagaattggacatggagacaagaaccacacagatgctgacaggagccccatcttcctgcagttcatcgactgtgtgtggcagatgagcaagcagttccccacagcctttgagttcaatgagcagttcctgatcatcatcctggaccacctgtacagctgccgcttcggcaccttcctgttcaactgtgagagcgcccgggagcggcagaaggtgacagagaggacagtgtccctgtggagcctcatcaacagcaacaaggagaagttcaagaaccccttctacaccaaggagatcaacagagtgctgtaccctgtggcctccatgaggcacctggagctgtgggtgaactactacatccgctggaacccccgcatcaagcagcagcagcccaaccctgtggagcagcgctacatggagctgctggccctgagagatgagtacatcaagaggctggaggagctgcagctggccaacagcgccaagctgagtgacccccccaccagccccagcagccccagccagatgatgcctcatgtgcagacccacttctag

SEQ ID NO: 160951 - DNA, 1251 bp, Artificial Sequence
  Description of Artificial Sequence: Synthetic coding sequence
atgggcggggccaccagcagaggagaaaattcctatggcctggacatcacctgcaaggacatgaggaacctgcgctttgccctgaagcaggagggccacagcagaagagacatgtttgagatcctgaccaggtatgccttccccctggcccacagcctgcccctgtttgccttcctgaatgaggagaagttcaacgtggatggctggacagtgtacaaccctgtggaggagtaccgccggcagggcctgcccaaccaccactggaggatcaccttcatcaacaagtgctatgagctgtgtgacacctacccagccctgctggtggtgccctaccgggccagtgatgatgacctgcggcgggtggccaccttccgcagcaggaaccgcatccctgtgctgtcctggatccaccctgagaacaagacagtcatcgtgcgctgcagccagcccctggtgggcatgtctgggaagaggaacaaggatgatgagaagtacctggatgtgatccgggagaccaacaagcagatcagcaagctgaccatctatgatgcccggcccagcgtgaatgctgtggccaacaaggccaccggcggcggctatgaaagtgatgatgcctaccacaatgctgagctgttcttcctggacatccacaacatccacgtgatgagggagagcctgaagaaggtgaaggacatcgtgtaccccaacgtggaggagagccactggctgagcagcctggagagcacccactggctggagcacatcaagctggtgctgaccggggccatccaggtggccgacaaggtgtcctctgggaagagctctgtgctggtgcactgcagtgatggctgggacagaacagcccagctgaccagcctggccatgctgatgctggacagcttctaccgcagcattgagggctttgagatcctggtgcagaaggagtggatcagctttggccacaagtttgccagcagaattggacatggagacaagaaccacacagatgctgacaggagccccatcttcctgcagttcatcgactgtgtgtggcagatgagcaagcagttccccacagcctttgagttcaatgagcagttcctgatcatcatcctggaccacctgtacagctgccgcttcggcaccttcctgttcaactgtgagagcgcccgggagcggcaggccctgcacttcctgagcctgagcctgtgccggcggctgcagaagggcctcttcctgtatggccactag

SEQ ID NO: 160952 - DNA, 1467 bp, Artificial Sequence
  Description of Artificial Sequence: Synthetic coding sequence
atgaggaacctgcgctttgccctgaagcaggagggccacagcagaagagacatgtttgagatcctgaccaggtatgccttccccctggcccacagcctgcccctgtttgccttcctgaatgaggagaagttcaacgtggatggctggacagtgtacaaccctgtggaggagtaccgccggcagggcctgcccaaccaccactggaggatcaccttcatcaacaagtgctatgagctgtgtgacacctacccagccctgctggtggtgccctaccgggccagtgatgatgacctgcggcgggtggccaccttccgcagcaggaaccgcatccctgtgctgtcctggatccaccctgagaacaagacagtcatcgtgcgctgcagccagcccctggtgggcatgtctgggaagaggaacaaggatgatgagaagtacctggatgtgatccgggagaccaacaagcagatcagcaagctgaccatctatgatgcccggcccagcgtgaatgctgtggccaacaaggccaccggcggcggctatgaaagtgatgatgcctaccacaatgctgagctgttcttcctggacatccacaacatccacgtgatgagggagagcctgaagaaggtgaaggacatcgtgtaccccaacgtggaggagagccactggctgagcagcctggagagcacccactggctggagcacatcaagctggtgctgaccggggccatccaggtggccgacaaggtgtcctctgggaagagctctgtgctggtgcactgcagtgatggctgggacagaacagcccagctgaccagcctggccatgctgatgctggacagcttctaccgcagcattgagggctttgagatcctggtgcagaaggagtggatcagctttggccacaagtttgccagcagaattggacatggagacaagaaccacacagatgctgacaggagccccatcttcctgcagttcatcgactgtgtgtggcagatgagcaagcagttccccacagcctttgagttcaatgagcagttcctgatcatcatcctggaccacctgtacagctgccgcttcggcaccttcctgttcaactgtgagagcgcccgggagcggcagaaggtgacagagaggacagtgtccctgtggagcctcatcaacagcaacaaggagaagttcaagaaccccttctacaccaaggagatcaacagagtgctgtaccctgtggcctccatgaggcacctggagctgtgggtgaactactacatccgctggaacccccgcatcaagcagcagcagcccaaccctgtggagcagcgctacatggagctgctggccctgagagatgagtacatcaagaggctggaggagctgcagctggccaacagcgccaagctgagtgacccccccaccagccccagcagccccagccagatgatgcctcatgtgcagacccacttctag

SEQ ID NO: 160953 - DNA, 1998 bp, Artificial Sequence
  Description of Artificial Sequence: Synthetic coding sequence
atggacaggcctgctgctgctgctgctgctggctgtgagggcggcggcggccccaaccctggccctgctgggggccggcggccccccagggctgctgggggcgccacagctggcagccggcagcccagcgtggagaccctggacagccccaccggcagccacgtggagtggtgcaagcagctgattgctgccaccatcagcagccagatcagcggctctgtgaccagtgaaaatgtgtcccgggactacaaggccctgagagatggcaacaagctggcccagatggaggaggcccccctcttccctggagagagcatcaaggccatcgtgaaggatgtgatgtacatctgccccttcatgggcgctgtgtctggcaccctgactgtgacagacttcaagctgtacttcaagaatgtggagcgggacccccacttcatcctggatgtgcccctgggcgtcatcagccgggtggagaagatcggggcccagagccatggagacaacagctgtggcatcgagatcgtgtgcaaggacatgaggaacctgcggctggcctacaagcaggaggagcagagcaagctgggcatctttgagaacctgaacaagcacgccttccccctgagcaatggccaggccctgtttgccttctcctacaaggagaagttccccatcaatggctggaaggtgtatgaccctgtgtctgagtacaagaggcagggcctgcccaatgaatcctggaagatcagcaagatcaacagcaactatgagttctgtgacacctacccagccatcatcgtggtgcccacctctgtgaaggatgatgacctgagcaaggtggccgccttccgggccaagggccgggtgcctgtgctgtcctggatccaccctgagagccaggccaccatcacccgctgcagccagcccctggtgggccccaatgacaagcgctgcaaggaggatgagaagtacctgcagaccatcatggatgccaatgcccagagccacaagctgatcatctttgatgcccggcagaacagcgtggccgacaccaacaagaccaagggcggcggctatgagagcgagagcgcctacccaaatgctgagctggtgttcctggagatccacaacatccacgtgatgagggagagcctgaggaagctgaaggagatcgtgtaccccagcattgatgaggcccgctggctgagcaatgtggatggcacccactggctggagtacatccgcatgctgctggccggggctgtgagaattgctgacaagattgaaagtggcaagacctctgtggtggtgcactgcagtgatggctgggacagaacagcccagctgaccagcctggccatgctgatgctggacagctactaccgcaccatcaagggctttgagaccctggtggagaaggagtggatcagctttggccacagatttgccctgcgggtgggccatggaaatgacaaccacgcagatgctgacaggagccccatcttcctgcagtttgtggactgtgtgtggcagatgacccggcagttccccagcgcctttgagttcaatgagctgttcctgatcaccatcctggaccacctgtacagctgcctgtttggcaccttcctgtgcaactgtgagcagcagcgcttcaaggaggatgtgtacaccaagaccatcagcctgtggagctacatcaacagccagctggatgagttcagcaaccccttctttgtgaactatgaaaatcatgtgctgtaccctgtggccagcctgagccacctggagctgtgggtgaactactacgtgcgctggaaccccaggatgaggccccagatgcccatccaccagaacctgaaggagctgctggccgtgcgggcagagctgcagaagagggtggagggcctgcagcgggaggtggccaccagggctgtgagcagcagcagcgagcggggcagcagccccagccacagcgccacctctgtgcacacctctgtgtag

SEQ ID NO: 160954 - DNA, 264 bp, Artificial Sequence
  Description of Artificial Sequence: Synthetic coding sequence
atggaggaggcccccctcttccctggagagagcatcaaggccatcgtgaaggatgtgatgtacatctgccccttcatgggcgctgtgtctggcaccctgactgtgacagacttcaagctgtacttcaagaatgtggagcgggacccccacttcatcctggatgtgcccctgggcgtcatcagccgggtggagaagatcggggcccagagccatggagacaacagctgtggcatcgagatcgtgtgcaaggacatgaggaactag

SEQ ID NO: 160955 - DNA, 264 bp, Artificial Sequence; identical to SEQ ID NO: 160954
  Description of Artificial Sequence: Synthetic coding sequence

SEQ ID NO: 160956 - DNA, 273 bp, Artificial Sequence
  Description of Artificial Sequence: Synthetic coding sequence
atggaggaggcccccctcttccctggagagagcatcaaggccatcgtgaaggatgtgatgtacatctgccccttcatgggcgctgtgtctggcaccctgactgtgacagacttcaagctgtacttcaagaatgtggagcgggacccccacttcatcctggatgtgcccctgggcgtcatcagccgggtggagaagatcggggcccagagccatggagacaacagctgtggcatcgagatcgtgtgcaaggacatgaggaacctgcggctgtag

SEQ ID NO: 160957 - DNA, 2022 bp, Artificial Sequence
  Description of Artificial Sequence: Synthetic coding sequence
atggacaggcctgctgctgctgctgctgctggctgtgagggcggcggcggccccaaccctggccctgctgggggccggcggccccccagggctgctgggggcgccacagctggcagccggcagcccagcgtggagaccctggacagccccaccggcagccacgtggagtggtgcaagcagctgattgctgccaccatcagcagccagatcagcggctctgtgaccagtgaaaatgtgtcccgggactacaaggtgttcagaagaccagacctgcgggccctgagagatggcaacaagctggcccagatggaggaggcccccctcttccctggagagagcatcaaggccatcgtgaaggatgtgatgtacatctgccccttcatgggcgctgtgtctggcaccctgactgtgacagacttcaagctgtacttcaagaatgtggagcgggacccccacttcatcctggatgtgcccctgggcgtcatcagccgggtggagaagatcggggcccagagccatggagacaacagctgtggcatcgagatcgtgtgcaaggacatgaggaacctgcggctggcctacaagcaggaggagcagagcaagctgggcatctttgagaacctgaacaagcacgccttccccctgagcaatggccaggccctgtttgccttctcctacaaggagaagttccccatcaatggctggaaggtgtatgaccctgtgtctgagtacaagaggcagggcctgcccaatgaatcctggaagatcagcaagatcaacagcaactatgagttctgtgacacctacccagccatcatcgtggtgcccacctctgtgaaggatgatgacctgagcaaggtggccgccttccgggccaagggccgggtgcctgtgctgtcctggatccaccctgagagccaggccaccatcacccgctgcagccagcccctggtgggccccaatgacaagcgctgcaaggaggatgagaagtacctgcagaccatcatggatgccaatgcccagagccacaagctgatcatctttgatgcccggcagaacagcgtggccgacaccaacaagaccaagggcggcggctatgagagcgagagcgcctacccaaatgctgagctggtgttcctggagatccacaacatccacgtgatgagggagagcctgaggaagctgaaggagatcgtgtaccccagcattgatgaggcccgctggctgagcaatgtggatggcacccactggctggagtacatccgcatgctgctggccggggctgtgagaattgctgacaagattgaaagtggcaagacctctgtggtggtgcactgcagtgatggctgggacagaacagcccagctgaccagcctggccatgctgatgctggacagctactaccgcaccatcaagggctttgagaccctggtggagaaggagtggatcagctttggccacagatttgccctgcgggtgggccatggaaatgacaaccacgcagatgctgacaggagccccatcttcctgcagtttgtggactgtgtgtggcagatgacccggcagttccccagcgcctttgagttcaatgagctgttcctgatcaccatcctggaccacctgtacagctgcctgtttggcaccttcctgtgcaactgtgagcagcagcgcttcaaggaggatgtgtacaccaagaccatcagcctgtggagctacatcaacagccagctggatgagttcagcaaccccttctttgtgaactatgaaaatcatgtgctgtaccctgtggccagcctgagccacctggagctgtgggtgaactactacgtgcgctggaaccccaggatgaggccccagatgcccatccaccagaacctgaaggagctgctggccgtgcgggcagagctgcagaagagggtggagggcctgcagcgggaggtggccaccagggctgtgagcagcagcagcgagcggggcagcagccccagccacagcgccacctctgtgcacacctctgtgtag

SEQ ID NO: 160958 - DNA, 1707 bp, Artificial Sequence
  Description of Artificial Sequence: Synthetic coding sequence
atggacaggcctgctgctgctgctgctgctggctgtgagggcggcggcggccccaaccctggccctgctgggggccggcggccccccagggctgctgggggcgccacagctggcagccggcagcccagcgtggagaccctggacagccccaccggcagccacgtggagtggtgcaagcagctgattgctgccaccatcagcagccagatcagcggctctgtgaccagtgaaaatgtgtcccgggactacaaggccctgagagatggcaacaagctggcccagatggaggaggcccccctcttccctggagagagcatcaaggccatcgtgaaggatgtgatgtacatctgccccttcatgggcgctgtgtctggcaccctgactgtgacagacttcaagctgtacttcaagaatgtggagcgggacccccacttcatcctggatgtgcccctgggcgtcatcagccgggtggagaagatcggggcccagagccatggagacaacagctgtggcatcgagatcgtgtgcaaggacatgaggaacctgcggctggcctacaagcaggaggagcagagcaagctgggcatctttgagaacctgaacaagcacgccttccccctgagcaatggccaggccctgtttgccttctcctacaaggagaagttccccatcaatggctggaaggtgtatgaccctgtgtctgagtacaagaggcagggcctgcccaatgaatcctggaagatcagcaagatcaacagcaactatgagttctgtgacacctacccagccatcatcgtggtgcccacctctgtgaaggatgatgacctgagcaaggtggccgccttccgggccaagggccgggtgcctgtgctgtcctggatccaccctgagagccaggccaccatcacccgctgcagccagcccctggtgggccccaatgacaagcgctgcaaggaggatgagaagtacctgcagaccatcatggatgccaatgcccagagccacaagctgatcatctttgatgcccggcagaacagcgtggccgacaccaacaagaccaagggcggcggctatgagagcgagagcgcctacccaaatgctgagctggtgttcctggagatccacaacatccacgtgatgagggagagcctgaggaagctgaaggagatcgtgtaccccagcattgatgaggcccgctggctgagcaatgtggatggcacccactggctggagtacatccgcatgctgctggccggggctgtgagaattgctgacaagattgaaagtggcaagacctctgtggtggtgcactgcagtgatggctgggacagaacagcccagctgaccagcctggccatgctgatgctggacagctactaccgcaccatcaagggctttgagaccctggtggagaaggagtggatcagctttggccacagatttgccctgcgggtgggccatggaaatgacaaccacgcagatgctgacaggagccccatcttcctgcagtttgtggactgtgtgtggcagatgacccggcagttccccagcgcctttgagttcaatgagctgttcctgatcaccatcctggaccacctgtacagctgcctgtttggcaccttcctgtgcaactgtgagcagcagcgcttcaaggaggcctggggcgccggcacccagagggcccggggcagcctgcggagcaggtag

SEQ ID NO: 160959 - DNA, 444 bp, Artificial Sequence
  Description of Artificial Sequence: Synthetic coding sequence
atggaggaggcccccctcttccctggagagagcatcaaggccatcgtgaaggatgtgatgtacatctgccccttcatgggcgctgtgtctggcaccctgactgtgacagacttcaagctgtacttcaagaatgtggagcgggacccccacttcatcctggatgtgcccctgggcgtcatcagccgggtggagaagatcggggcccagagccatggagacaacagctgtggcatcgagatcgtgtgcaaggacatgaggaacctgcggctggcctacaagcaggaggagcagagcaagctgggcatctttgagaacctgaacaagcacgccttccccctgagcaatggccaggccctgtttgccttctcctacaaggagaagttccccatcaatggctggaaggtgtatgaccctgtgtctgagtacaagaggcagggcctgtag

SEQ ID NO: 160960 - DNA, 1182 bp, Artificial Sequence
  Description of Artificial Sequence: Synthetic coding sequence
atgtacatctgccccttcatgggcgctgtgtctggcaccctgactgtgacagacttcaagctgtacttcaagaatgtggagcgggacccccacttcatcctggatgtgcccctgggcgtcatcagccgggtggagaagattggagcccagagccacggggacaacagctgtggcattgaaattgtgtgcaaggacatgaggaacctgcggctggcctacaagcaggaggagcagagcaagctgggcatctttgagaacctgaacaagcacgccttccccctgagcaatggccaggccctgtttgccttctcctacaaggagaagttccccatcaatggctggaaggtgtatgaccctgtgtctgagtacaagaggcagggcctgcccaatgaatcctggaagatcagcaagatcaacagcaactatgagttctgtgacacctacccagccatcatcgtggtgcccacctctgtgaaggatgatgacctgagcaaggtggccgccttccgggccaagggccgggtgcctgtgctgtcctggatccaccctgagagccaggccaccatcacccgctgcagccagcccctggtgggccccaatgacaagcgctgcaaggaggatgagaagtacctgcagaccatcatggatgccaatgcccagagccacaagctgatcatctttgatgcccggcagaacagcgtggccgacaccaacaagatgctgctggccggggctgtgagaattgctgacaagattgagagcggcaagacctctgtggtggtgcactgcagtgatggctgggacagaacagcccagctgaccagcctggccatgctgatgctggacagctactaccgcaccatcaagggctttgagaccctggtggagaaggagtggatcagctttggccacagatttgccctgcgggtgggccacggcaatgacaaccacgcagatgctgacaggagccccatcttcctgcagtttgtggactgtgtgtggcagatgacccggcagttccccagcgcctttgagttcaatgaactcttcctgatcaccatcctggaccacctgtacagctgcctgtttggcaccttcctgtgcaactgtgagcagcagcgcttcaaggaggcctggggcgccggcacccagagggcccggggcagcctgcggagcaggtag

SEQ ID NO: 160961 - DNA, 1716 bp, Artificial Sequence
  Description of Artificial Sequence: Synthetic coding sequence
atggaggaggcccccctcttccctggagagagcatcaaggccatcgtgaaggatgtgatgtacatctgccccttcatgggcgctgtgtctggcaccctgactgtgacagacttcaagctgtacttcaagaatgtggagcgggacccccacttcatcctggatgtgcccctgggcgtcatcagccgggtggagaagatcggggcccagagccatggagacaacagctgtggcatcgagatcgtgtgcaaggacatgaggaacctgcggctggcctacaagcaggaggagcagagcaagctgggcatctttgagaacctgaacaagcacgccttccccctgagcaatggccaggccctgtttgccttctcctacaaggagaagttccccatcaatggctggaaggtgtatgaccctgtgtctgagtacaagaggcagggcctgcccaatgaatcctggaagatcagcaagatcaacagcaactatgagttctgtgacacctacccagccatcatcgtggtgcccacctctgtgaaggatgatgacctgagcaaggtggccgccttccgggccaagggccgggtgcctgtgctgtcctggatccaccctgagagccaggccaccatcacccgctgcagccagcccctggtgggccccaatgacaagcgctgcaaggaggatgagaagtacctgcagaccatcatggatgccaatgcccagagccacaagctgatcatctttgatgcccggcagaacagcgtggccgacaccaacaagaccaagggcggcggctatgagagcgagagcgcctacccaaatgctgagctggtgttcctggagatccacaacatccacgtgatgagggagagcctgaggaagctgaaggagatcgtgtaccccagcattgatgaggcccgctggctgagcaatgtggatggcacccactggctggagtacatccgcatgctgctggccggggctgtgagaattgctgacaagattgaaagtggcaagacctctgtggtggtgcactgcagtgatggctgggacagaacagcccagctgaccagcctggccatgctgatgctggacagctactaccgcaccatcaagggctttgagaccctggtggagaaggagtggatcagctttggccacagatttgccctgcgggtgggccatggaaatgacaaccacgcagatgctgacaggagccccatcttcctgcagtttgtggactgtgtgtggcagatgacccggcagttccccagcgcctttgagttcaatgagctgttcctgatcaccatcctggaccacctgtacagctgcctgtttggcaccttcctgtgcaactgtgagcagcagcgcttcaaggaggatgtgtacaccaagaccatcagcctgtggagctacatcaacagccagctggatgagttcagcaaccccttctttgtgaactatgaaaatcatgtgctgtaccctgtggccagcctgagccacctggagctgtgggtgaactactacgtgcgctggaaccccaggatgaggccccagatgcccatccaccagaacctgaaggagctgctggccgtgcgggcagagctgcagaagagggtggagggcctgcagcgggaggtggccaccagggctgtgagcagcagcagcgagcggggcagcagccccagccacagcgccacctctgtgcacacctctgtgtag

SEQ ID NO: 160962 - DNA, 1092 bp, Artificial Sequence
  Description of Artificial Sequence: Synthetic coding sequence
atggacaggcctgctgctgctgctgctgctggctgtgagggcggcggcggccccaaccctggccctgctgggggccggcggccccccagggctgctgggggcgccacagctggcagccggcagcccagcgtggagaccctggacagccccaccggcagccacgtggagtggtgcaagcagctgattgctgccaccatcagcagccagatcagcggctctgtgaccagtgaaaatgtgtcccgggactacaaggccctgagagatggcaacaagctggcccagatggaggaggcccccctcttccctggagagagcatcaaggccatcgtgaaggatgtgatgtacatctgccccttcatgggcgctgtgtctggcaccctgactgtgacagacttcaagctgtacttcaagaatgtggagcgggacccccacttcatcctggatgtgcccctgggcgtcatcagccgggtggagaagatcggggcccagagccatggagacaacagctgtggcatcgagatcgtgtgcaaggacatgaggaacctgcggctggcctacaagcaggaggagcagagcaagctgggcatctttgagaacctgaacaagcacgccttccccctgagcaatggccaggccctgtttgccttctcctacaaggagaagttccccatcaatggctggaaggtgtatgaccctgtgtctgagtacaagaggcagggcctgcccaatgaatcctggaagatcagcaagatcaacagcaactatgagttctgtgacacctacccagccatcatcgtggtgcccacctctgtgaaggatgatgacctgagcaaggtggccgccttccgggccaagggccgggtgcctgtgctgtcctggatccaccctgagagccaggccaccatcacccgctgcagccagcccctggtgggccccaatgacaagcgctgcaaggaggatgagaagtacctgcagaccatcatggatgccaatgcccagagccacaagctgatcatctttgatgcccggcagaacagcgtggccgacaccaacaagctgtggtaccaggacacagccagcctgatggagtag

SEQ ID NO: 160963 - DNA, 1998 bp, Artificial Sequence; identical to SEQ ID NO: 160953
  Description of Artificial Sequence: Synthetic coding sequence

SEQ ID NO: 160964 - DNA, 1914 bp, Artificial Sequence
  Description of Artificial Sequence: Synthetic coding sequence
atgctgggcaagggcgtggtgggcggcggcggcggcaccaaggcccccaagcccagctttgtgtcctatgtgcggcctgaggagatccacaccaatgagaaggaggtgacagagaaggaggtgaccctgcacctgctgcctggagagcagctgctgtgtgaggccagcacagtgctgaagtatgtgcaggaggacagctgccagcacggcgtgtatggccgcctggtgtgcacagacttcaagatcgccttcctgggagatgatgagagcgccctggacaatgatgagacccagttcaagaacaaggtgattggagaaaatgacatcaccctgcactgtgtggaccagatctacggcgtgtttgatgagaagaagaagaccctgtttggccagctgaagaagtacccagagaagctgatcatccactgcaaggacctgcgggtcttccagttctgcctgcgctacaccaaggaggaggaggtgaagagaattgtgtctggcatcatccaccacacccaggcccccaagctgctgaagaggctcttcctgttctcctatgccacagctgcccagaacaacacagtgacagaccccaagaaccacacagtgatgtttgacaccctgaaggactggtgctgggagctggagaggaccaagggcaacatgaagtacaaggctgtgtctgtgaatgaaggctacaaggtgtgtgagcggctgcctgcctactttgtggtgcccacccccctgcctgaggagaatgtgcagcgcttccagggccacggcatccccatctggtgctggagctgccacaatggaagtgccctgctgaagatgtctgccctgcccaaggagcaggatgatggcatcctgcagatccagaagagcttcctggatggcatctacaagaccatccacaggcctccctatgaaattgtgaagacagaggacctgagcagcaacttcctgagcctgcaggagatccagacagcctacagcaagttcaagcagctgttcctgattgacaacagcacagagttctgggacacagacatcaagtggttcagcctgctggagagcagctcctggctggacatcatccgccgctgcctgaagaaggccatcgagatcacagagtgcatggaggcccagaacatgaatgtgctgctgctggaggagaatgccagtgacctgtgctgcctgatcagcagcctggtgcagctgatgatggacccccactgcaggaccagaattggcttccagagcctcatccagaaggagtgggtgatgggcggccactgcttcctggaccgctgcaaccacctgcggcagaatgacaaggaggagcaccagaggcagctgagcctgcccctgacccagagcaagagcagccccaagaggggcttcttccgggaggagacagaccacctgatcaagaacctgctgggcaagaggatcagcaagctgatcaacagcagtgatgagctgcaggacaacttccgggagttctatgacagctggcacagcaagagcacagactaccacggcctgctgctgccccacatcgagggccctgagatcaaggtgtgggcccagcgctacctgcgctggatccctgaggcccagatcctgggcggcggccaggtggccaccctgagcaagctgctggagatgatggaggaggtgcagagcctgcaggagaagattgatgagcggcaccacagccagcaggccccccaggccgaggccccctgcctgctgagaaattctgcccggctgagcagcctcttcccctttgccctgctgcagaggcacagcagcaagcctgtgctgcccaccagcggctggaaggccctgggagatgaagatgacctggccaagcgggaggatgaatttgtggacctgggagatgtgtag

SEQ ID NO: 160965 - DNA, 2082 bp, Artificial Sequence
  Description of Artificial Sequence: Synthetic coding sequence
atgctgggcaagggcgtggtgggcggcggcggcggcaccaaggcccccaagcccagctttgtgtcctatgtgcggcctgaggagatccacaccaatgagaaggaggtgacagagaaggaggtgaccctgcacctgctgcctggagagcagctgctgtgtgaggccagcacagtgctgaagtatgtgcaggaggacagctgccagcacggcgtgtatggccgcctggtgtgcacagacttcaagatcgccttcctgggagatgatgagagcgccctggacaatgatgagacccagttcaagaacaaggtgattggagaaaatgacatcaccctgcactgtgtggaccagatctacggcgtgtttgatgagaagaagaagaccctgtttggccagctgaagaagtacccagagaagctgatcatccactgcaaggacctgcgggtcttccagttctgcctgcgctacaccaaggaggaggaggtgaagagaattgtgtctggcatcatccaccacacccaggcccccaagctgctgaagaggctcttcctgttctcctatgccacagctgcccagaacaacacagtgacagaccccaagaaccacacagtgatgtttgacaccctgaaggactggtgctgggagctggagaggaccaagggcaacatgaagtacaaggctgtgtctgtgaatgaaggctacaaggtgtgtgagcggctgcctgcctactttgtggtgcccacccccctgcctgaggagaatgtgcagcgcttccagggccacggcatccccatctggtgctggagctgccacaatggaagtgccctgctgaagatgtctgccctgcccaaggagcaggatgatggcatcctgcagatccagaagagcttcctggatggcatctacaagaccatccacaggcctccctatgaaattgtgaagacagaggacctgagcagcaacttcctgagcctgcaggagatccagacagcctacagcaagttcaagcagctgttcctgattgacaacagcacagagttctgggacacagacatcaagtggttcagcctgctggagagcagctcctggctggacatcatccgccgctgcctgaagaaggccatcgagatcacagagtgcatggaggcccagaacatgaatgtgctgctgctggaggagaatgccagtgacctgtgctgcctgatcagcagcctggtgcagctgatgatggacccccactgcaggaccagaattggcttccagagcctcatccagaaggagtgggtgatgggcggccactgcttcctggaccgctgcaaccacctgcggcagaatgacaaggaggaggtgcctgtgttcctgctcttcctggactgtgtgtggcagctggtgcaccagcaccccccagcctttgagttcacagagacctacctgactgtgctgagtgacagcctgtacatccccatcttcagcaccttcttcttcaacagcccccaccagaaggacaccaacatgcaccagaggcagctgagcctgcccctgacccagagcaagagcagccccaagaggggcttcttccgggaggagacagaccacctgatcaagaacctgctgggcaagaggatcagcaagctgatcaacagcagtgatgagctgcaggacaacttccgggagttctatgacagctggcacagcaagagcacagactaccacggcctgctgctgccccacatcgagggccctgagatcaaggtgtgggcccagcgctacctgcgctggatccctgaggcccagatcctgggcggcggccaggtggccaccctgagcaagctgctggagatgatggaggaggtgcagagcctgcaggagaagattgatgagcggcaccacagccagcaggccccccaggccgaggccccctgcctgctgagaaattctgcccggctgagcagcctcttcccctttgccctgctgcagaggcacagcagcaagcctgtgctgcccaccagcggctggaaggccctgggagatgaagatgacctggccaagcgggaggatgaatttgtggacctgggagatgtgtag

SEQ ID NO: 160966 - DNA, 2244 bp, Artificial Sequence
  Description of Artificial Sequence: Synthetic coding sequence
atgctgggcaagggcgtggtgggcggcggcggcggcaccaaggcccccaagcccagctttgtgtcctatgtgcggcctgaggagatccacaccaatgagaaggaggtgacagagaaggaggtgaccctgcacctgctgcctggagagcagctgctgtgtgaggccagcacagtgctgaagtatgtgcaggaggacagctgccagcacggcgtgtatggccgcctggtgtgcacagacttcaagatcgccttcctgggagatgatgagagcgccctggacaatgatgagacccagttcaagaacaaggtgattggagaaaatgacatcaccctgcactgtgtggaccagatctacggcgtgtttgatgagaagaagaagaccctgtttggccagctgaagaagtacccagagaagctgatcatccactgcaaggacctgcgggtcttccagttctgcctgcgctacaccaaggaggaggaggtgaagagaattgtgtctggcatcatccaccacacccaggcccccaagctgctgaagaggctcttcctgttctcctatgccacagctgcccagaacaacacagtgacagaccccaagaaccacacagtgatgtttgacaccctgaaggactggtgctgggagctggagaggaccaagggcaacatgaagtacaaggctgtgtctgtgaatgaaggctacaaggtgtgtgagcggctgcctgcctactttgtggtgcccacccccctgcctgaggagaatgtgcagcgcttccagggccacggcatccccatctggtgctggagctgccacaatggaagtgccctgctgaagatgtctgccctgcccaaggagcaggatgatggcatcctgcagatccagaagagcttcctggatggcatctacaagaccatccacaggcctccctatgaaattgtgaagacagaggacctgagcagcaacttcctgagcctgcaggagatccagacagcctacagcaagttcaagcagctgttcctgattgacaacagcacagagttctgggacacagacatcaagtggttcagcctgctggagagcagctcctggctggacatcatccgccgctgcctgaagaaggccatcgagatcacagagtgcatggaggcccagaacatgaatgtgctgctgctggaggagaatgccagtgacctgtgctgcctgatcagcagcctggtgcagctgatgatggacccccactgcaggaccagaattggcttccagagcctcatccagaaggagtgggtgatgggcggccactgcttcctggaccgctgcaaccacctgcggcagaatgacaaggaggaggtgcctgtgttcctgctcttcctggactgtgtgtggcagctggtgcaccagcaccccccagcctttgagttcacagagacctacctgactgtgctgagtgacagcctgtacatccccatcttcagcaccttcttcttcaacagcccccaccagaaggacaccaacatgggccgggagggccaggacacccagagcaagcccctgaacctgctgactgtgtgggactggagcgtgcagtttgagcccaaggcccagaccctgctgaagaaccccctgtatgtggagaagcccaagctggacaagggccagaggaagggcatgaggttcaagcaccagaggcagctgagcctgcccctgacccagagcaagagcagccccaagaggggcttcttccgggaggagacagaccacctgatcaagaacctgctgggcaagaggatcagcaagctgatcaacagcagtgatgagctgcaggacaacttccgggagttctatgacagctggcacagcaagagcacagactaccacggcctgctgctgccccacatcgagggccctgagatcaaggtgtgggcccagcgctacctgcgctggatccctgaggcccagatcctgggcggcggccaggtggccaccctgagcaagctgctggagatgatggaggaggtgcagagcctgcaggagaagattgatgagcggcaccacagccagcaggccccccaggccgaggccccctgcctgctgagaaattctgcccggctgagcagcctcttcccctttgccctgctgcagaggcacagcagcaagcctgtgctgcccaccagcggctggaaggccctgggagatgaagatgacctggccaagcgggaggatgaatttgtggacctgggagatgtgtag

SEQ ID NO: 160967 - DNA, 1953 bp, Artificial Sequence
  Description of Artificial Sequence: Synthetic coding sequence
atggccggggcccgggctgctgctgctgctgccagcgctggcagcagcgccagcagcggcaaccagcccccccaggagctgggcctgggggagctgctggaggagttcagcaggacccagtaccgggccaaggatggcagcggcactggaggcagcaaggtggagagaattgagaagcgctgcctggagctgtttggccgggactactgcttcagcgtcatccccaacaccaacggggacatctgtggccactaccccaggcacatcgtgttcctggagtatgagagcagcgagaaggagaaggacacctttgagagcacagtgcaggtgtccaagctgcaggacctgatccacaggagcaagatggcccgctgccggggccgctttgtgtgccctgtgatcctcttcaagggcaagcacatctgccgcagcgccaccctggccggctggggcgagctgtatggccgcagcggctacaactacttcttcagcggcggcgcagatgatgcctgggcagatgtggaggatgtgacagaggaggactgtgccctgcggagcggggacacccacctgtttgacaaggtgcggggctatgacatcaagctgctgcgctacctgtctgtgaagtacatctgtgacctgatggtggagaacaagaaggtgaagtttggcatgaatgtgaccagcagcgagaaggtggacaaggcccagagatatgctgacttcaccctgctgagcatcccctacccaggctgtgagttcttcaaggagtacaaggaccgggactacatggccgagggcctcatcttcaactggaagcaggactatgtggatgcccccctgagcatcccagacttcctgacccacagcctgaacatcgactggagccagtaccagtgctgggacctggtgcagcagacccagaactacctgaagctgctgctgagcctggtgaacagtgatgatgacagcggcctgctggtgcactgcatcagcggctgggacaggacccccctcttcatcagcctgctgcggctgagcctgtgggcagatggcctcatccacaccagcctgaagcccacagagatcctgtacctgactgtggcctatgactggttcctgtttggccacatgctggtggaccggctgagcaaaggagaggagatcttcttcttctgcttcaacttcctgaagcacatcaccagcgaggagttcagcgccctgaagacccagaggaggaagagcctgcctgccagagatggcggcttcaccctggaggacatctgcatgctgcggaggaaggaccggggcagcaccaccagcctgggcagtgacttcagcctggtgatggagagcagccctggggccaccggcagcttcacctatgaggccgtggagctggtgcctgctggggcccccacccaggccgcctggaggaagagccacagcagcagcccccagagcgtgctgtggaaccggccccagcccagcgaggaccggctgcccagccagcagggcctggccgaggcccggagcagcagcagcagcagcagcaaccacagcgacaacttcttcaggatgggcagcagccccctggaggtgcccaagcccaggtctgtggaccaccccctgcccggcagcagcctgagcacagattatggctcctggcagatggtgacaggctgcggcagcatccaggagagagctgtgctgcacacagacagcagcctgcccttctccttcccagatgagctgcccaacagctgcctgctggccgccctgagtgaccgggagacccggctgcaggaggtgcgcagcgccttcctggccgcctacagcagcacagtgggcctgcgggctgtggcccccagccccagcggggccatcggcggcctgctggagcagtttgcccggggcgtgggcctgcggagcatcagcagcaatgccctgtag

SEQ ID NO: 160968 - DNA, 1617 bp, Artificial Sequence
  Description of Artificial Sequence: Synthetic coding sequence
atggccggggcccgggctgctgctgctgctgccagcgctggcagcagcgccagcagcggcaaccagcccccccaggagctgggcctgggggagctgctggaggagttcagcaggacccagtaccgggccaaggatggcagcggcactggaggcagcaaggtggagagaattgagaagcgctgcctggagctgtttggccgggactactgcttcagcgtcatccccaacaccaacggggacatctgtggccactaccccaggcacatcgtgttcctggagtatgagagcagcgagaaggagaaggacacctttgagagcacagtgcaggtgtccaagctgcaggacctgatccacaggagcaagatggcccgctgccggggccgctttgtgtgccctgtgatcctcttcaagggcaagcacatctgccgcagcgccaccctggccggctggggcgagctgtatggccgcagcggctacaactacttcttcagcggcggcgcagatgatgcctgggcagatgtggaggatgtgacagaggaggactgtgccctgcggagcggggacacccacctgtttgacaaggtgcggggctatgacatcaagctgctgcgctacctgtctgtgaagtacatctgtgacctgatggtggagaacaagaaggtgaagtttggcatgaatgtgaccagcagcgagaaggtggacaaggcccagagatatgctgacttcaccctgctgagcatcccctacccaggctgtgagttcttcaaggagtacaaggaccgggactacatggccgagggcctcatcttcaactggaagcaggactatgtggatgcccccctgagcatcccagacttcctgacccacagcctgaacatcgactggagccagtaccagtgctgggacctggtgcagcagacccagaactacctgaagctgctgctgagcctggtgaacagtgatgatgacagcggcctgctggtgcactgcatcagcggctgggacaggacccccctcttcatcagcctgctgcggctgagcctgtgggcagatggcctcatccacaccagcctgaagcccacagagatcctgtacctgactgtggcctatgactggttcctgtttggccacatgctggtggaccggctgagcaaaggagaggagatcttcttcttctgcttcaacttcctgaagcacatcaccagcgaggagttcagcgccctgaagacccagaggaggaagagcctgcctgccagagatggcggcttcaccctggaggacatctgcatgctgcggaggaaggaccggggcagcaccaccagcctgggcagtgacttcagcctggtgatggagagcagccctggggccaccggcagcttcacctatgaggccgtggagctggtgcctgctggggcccccacccaggccgcctggctggccgccctgagtgaccgggagacccggctgcaggaggtgcgcagcgccttcctggccgcctacagcagcacagtgggcctgcgggctgtggcccccagccccagcggggccatcggcggcctgctggagcagtttgcccggggcgtgggcctgcggagcatcagcagcaatgccctgtag

SEQ ID NO: 160969 - DNA, 1797 bp, Artificial Sequence
  Description of Artificial Sequence: Synthetic coding sequence
atggccggggcccgggctgctgctgctgctgccagcgctggcagcagcgccagcagcggcaaccagcccccccaggagctgggcctgggggagctgctggaggagttcagcaggacccagtaccgggccaaggatggcagcggcactggaggcagcaaggtggagagaattgagaagcgctgcctggagctgtttggccgggactactgcttcagcgtcatccccaacaccaacggggacatctgtggccactaccccaggcacatcgtgttcctggagtatgagagcagcgagaaggagaaggacacctttgagagcacagtgcaggtgtccaagctgcaggacctgatccacaggagcaagatggcccgctgccggggccgctttgtgtgccctgtgatcctcttcaagggcaagcacatctgccgcagcgccaccctggccggctggggcgagctgtatggccgcagcggctacaactacttcttcagcggcggcgcagatgatgcctgggcagatgtggaggatgtgacagaggaggactgtgccctgcggagcggggacacccacctgtttgacaaggtgcggggctatgacatcaagctgctgcgctacctgtctgtgaagtacatctgtgacctgatggtggagaacaagaaggtgaagtttggcatgaatgtgaccagcagcgagaaggtggacaaggcccagagatatgctgacttcaccctgctgagcatcccctacccaggctgtgagttcttcaaggagtacaaggaccgggactacatggccgagggcctcatcttcaactggaagcaggactatgtggatgcccccctgagcatcccagacttcctgacccacagcctgaacatcgactggagccagtaccagtgctgggacctggtgcagcagacccagaactacctgaagctgctgctgagcctggtgaacagtgatgatgacagcggcctgctggtgcactgcatcagcggctgggacaggacccccctcttcatcagcctgctgcggctgagcctgtgggcagatggcctcatccacaccagcctgaagcccacagagatcctgtacctgactgtggcctatgactggttcctgtttggccacatgctggtggaccggctgagcaaaggagaggagatcttcttcttctgcttcaacttcctgaagcacatcaccagcgaggagttcagcgccctgaagacccagaggaggaagagcctgcctgccagagatggcggcttcaccctggaggacatctgcatgctgcggaggaaggaccggggcagcaccaccagcctgggcagtgacttcagcctggtgatggagagcagccctggggccaccggcagcttcacctatgaggccgtggagctggtgcctgctggggcccccacccaggccgcctggaggaagagccacagcagcagcccccagagcgtgctgtggaaccggccccagcccagcgaggaccggctgcccagccagcagggcctggccgaggcccggagcagcagcagcagcagcagcaaccacagcgacaacttcttcaggatgggcagcagccccctggaggtgcccaagccccggctggccgccctgagtgaccgggagacccggctgcaggaggtgcgcagcgccttcctggccgcctacagcagcacagtgggcctgcgggctgtggcccccagccccagcggggccatcggcggcctgctggagcagtttgcccggggcgtgggcctgcggagcatcagcagcaatgccctgtag

SEQ ID NO: 160970 - DNA, 1563 bp, Artificial Sequence
  Description of Artificial Sequence: Synthetic coding sequence
atggccggggcccgggctgctgctgctgctgccagcgctggcagcagcgccagcagcggcaaccagcccccccaggagctgggcctgggggagctgctggaggagttcagcaggacccagtaccgggccaaggatggcagcggcactggaggcagcaaggtggagagaattgagaagcgctgcctggagctgtttggccgggactactgcttcagcgtcatccccaacaccaacggggacatctgtggccactaccccaggcacatcgtgttcctggagtatgagagcagcgagaaggagaaggacacctttgagagcacagtgcaggtgtccaagctgcaggacctgatccacaggagcaagatggcccgctgccggggccgctttgtgtgccctgtgatcctcttcaagggcaagcacatctgccgcagcgccaccctggccggctggggcgagctgtatggccgcagcggctacaactacttcttcagcggcggcgcagatgatgcctgggcagatgtggaggatgtgacagaggaggactgtgccctgcggagcggggacacccacctgtttgacaaggtgcggggctatgacatcaagctgctgcgctacctgtctgtgaagtacatctgtgacctgatggtggagaacaagaaggtgaagtttggcatgaatgtgaccagcagcgagaaggtggacaaggcccagagatatgctgacttcaccctgctgagcatcccctacccaggctgtgagttcttcaaggagtacaaggaccgggactacatggccgagggcctcatcttcaactggaagcaggactatgtggatgcccccctgagcatcccagacttcctgacccacagcctgaacatcgactggagccagtaccagtgctgggacctggtgcagcagacccagaactacctgaagctgctgctgagcctggtgaacagtgatgatgacagcggcctgctggtgcactgcatcagcggctgggacaggacccccctcttcatcagcctgctgcggctgagcctgtgggcagatggcctcatccacaccagcctgaagcccacagagatcctgtacctgactgtggcctatgactggttcctgtttggccacatgctggtggaccggctgagcaaaggagaggagatcttcttcttctgcttcaacttcctgaagcacatcaccagcgaggagttcagcgccctgaagacccagaggaggaagagcctgcctgccagagatggcggcttcaccctggaggacatctgcatgctgcggaggaaggaccggggcagcaccaccagcctgggcagtgacttcagcctggtgatggagagcagccctggggccaccggcagcttcacctatgaaagaggagctggccccagccgcagcgccaacagcggcagcctggaggaggagcccctcatcctgagcacagaatgtcccctggagcccgccaccaccctgcggggccccctggccttccctgctggggccggcggcagccaggtgttccagctgctcttcctgaagcccttctag

SEQ ID NO: 160971 - DNA, 1932 bp, Artificial Sequence
  Description of Artificial Sequence: Synthetic coding sequence
atggagaagagcagcagctgtgagagcctgggcagccagcctgctgctgcccggcccccatctgtggacagcctgagcagcgccagcaccagccacagcgagaacagcgtgcacaccaagagcgcctctgtggtgtccagtgacagcatcagcaccagcgctgacaacttctccccagacctgcgggtgctgcgggagagcaacaagctggccgagatggaggagccccccctgctgcccggggagaacatcaaggacatggccaaggatgtgacctacatctgccccttcaccggggctgtgcggggcaccctgactgtgaccaactaccgcctgtacttcaagtccatggagcgggaccccccatttgtgctggatgccagcctgggcgtcatcaacagagtggagaagattggaggagccagcagcagaggagagaacagctatggcctggagaccgtgtgcaaggacatccggaacctgcgctttgcccacaagccagagggccgcacccggcgcagcatctttgagaacctgatgaagtatgccttccctgtgagcaacaacctgcccctgtttgcctttgagtacaaggaggtgtttcctgaaaatggctggaagctgtatgaccccctgctggagtaccgccggcagggcatccccaatgaatcctggaggatcaccaagatcaatgaaagatatgagctgtgtgacacctacccagccctgctggtggtgcctgccaacatcccagatgaggagctgaagagggtggccagcttccgcagccggggccgcatccctgtgctgtcctggatccaccctgagagccaggccaccatcacccgctgcagccagcccatggtgggcgtgtctgggaagaggagcaaggaggatgagaagtacctgcaggccatcatggacagcaatgcccagagccacaagatcttcatctttgatgcccggcccagcgtgaatgctgtggccaacaaggccaagggcggcggctatgaaagtgaagatgcctaccagaatgctgagctggtgttcctggacatccacaacatccacgtgatgagggagagcctgaggaagctgaaggagatcgtgtaccccaacatcgaggagacccactggctgagcaacctggagagcacccactggctggagcacatcaagctgatcctggccggggccctgagaattgctgacaaggtggagagcggcaagacctctgtggtggtgcactgcagtgatggctgggacagaacagcccagctgaccagcctggccatgctgatgctggatggctactaccgcaccatccggggctttgaggtgctggtggagaaggagtggctgagctttggccaccgcttccagctgcgggtgggccacggggacaagaaccacgcagatgctgacaggagccctgtgttcctgcagttcatcgactgtgtgtggcagatgacccggcagttccccacagcctttgagttcaatgagtacttcctgatcaccatcctggaccacctgtacagctgcctgtttggcaccttcctgtgcaacagcgagcagcagaggggcaaggagaacctgcccaagaggacagtgtccctgtggagctacatcaacagccagctggaggacttcaccaaccccctgtatggcagctacagcaaccacgtgctgtaccctgtggcctccatgaggcacctggagctgtgggtgggctactacatccgctggaaccccaggatgaagccccaggagcccatccacaaccgctacaaggagctgctggccaagagagctgagctgcagaagaaggtggaggagctgcagcgggagatcagcaacagaagcaccagcagcagcgagcgggccagcagccctgcccagtgtgtgacccctgtgcagacagtggtgtag

SEQ ID NO: 160972 - DNA, 1716 bp, Artificial Sequence
  Description of Artificial Sequence: Synthetic coding sequence
atggaggagccccccctgctgcccggggagaacatcaaggacatggccaaggatgtgacctacatctgccccttcaccggggctgtgcggggcaccctgactgtgaccaactaccgcctgtacttcaagtccatggagcgggaccccccatttgtgctggatgccagcctgggcgtcatcaacagagtggagaagattggaggagccagcagcagaggagagaacagctatggcctggagaccgtgtgcaaggacatccggaacctgcgctttgcccacaagccagagggccgcacccggcgcagcatctttgagaacctgatgaagtatgccttccctgtgagcaacaacctgcccctgtttgcctttgagtacaaggaggtgtttcctgaaaatggctggaagctgtatgaccccctgctggagtaccgccggcagggcatccccaatgaatcctggaggatcaccaagatcaatgaaagatatgagctgtgtgacacctacccagccctgctggtggtgcctgccaacatcccagatgaggagctgaagagggtggccagcttccgcagccggggccgcatccctgtgctgtcctggatccaccctgagagccaggccaccatcacccgctgcagccagcccatggtgggcgtgtctgggaagaggagcaaggaggatgagaagtacctgcaggccatcatggacagcaatgcccagagccacaagatcttcatctttgatgcccggcccagcgtgaatgctgtggccaacaaggccaagggcggcggctatgaaagtgaagatgcctaccagaatgctgagctggtgttcctggacatccacaacatccacgtgatgagggagagcctgaggaagctgaaggagatcgtgtaccccaacatcgaggagacccactggctgagcaacctggagagcacccactggctggagcacatcaagctgatcctggccggggccctgagaattgctgacaaggtggagagcggcaagacctctgtggtggtgcactgcagtgatggctgggacagaacagcccagctgaccagcctggccatgctgatgctggatggctactaccgcaccatccggggctttgaggtgctggtggagaaggagtggctgagctttggccaccgcttccagctgcgggtgggccacggggacaagaaccacgcagatgctgacaggagccctgtgttcctgcagttcatcgactgtgtgtggcagatgacccggcagttccccacagcctttgagttcaatgagtacttcctgatcaccatcctggaccacctgtacagctgcctgtttggcaccttcctgtgcaacagcgagcagcagaggggcaaggagaacctgcccaagaggacagtgtccctgtggagctacatcaacagccagctggaggacttcaccaaccccctgtatggcagctacagcaaccacgtgctgtaccctgtggcctccatgaggcacctggagctgtgggtgggctactacatccgctggaaccccaggatgaagccccaggagcccatccacaaccgctacaaggagctgctggccaagagagctgagctgcagaagaaggtggaggagctgcagcgggagatcagcaacagaagcaccagcagcagcgagcgggccagcagccctgcccagtgtgtgacccctgtgcagacagtggtgtag

SEQ ID NO: 160973 - DNA, 1716 bp, Artificial Sequence; identical to SEQ ID NO: 160972
  Description of Artificial Sequence: Synthetic coding sequence

SEQ ID NO: 160974 - DNA, 1716 bp, Artificial Sequence; identical to SEQ ID NO: 160972
  Description of Artificial Sequence: Synthetic coding sequence

SEQ ID NO: 160975 - DNA, 981 bp, Artificial Sequence
  Description of Artificial Sequence: Synthetic coding sequence
atgctggccgtggccctgaccatcctgagcgccagcaccagccacagtgaaaattctgtgcacaccaagagcgcctctgtggtgtccagtgacagcatcagcaccagcgctgacaacttctccccagacctgcgggtgctgcgggagagcaacaagctggccgagatggaggagccccccctgctgcctggagagaacatcaaggacatggccaaggatgtgacctacatctgccccttcaccggggctgtgcggggcaccctgactgtgaccaactaccgcctgtacttcaagtccatggagcgggaccccccatttgtgctggatgccagcctgggcgtcatcaacagagtggagaagattggaggagccagcagcagaggagaaaattcctatggcctggagaccgtgtgcaaggacatccggaacctgcgctttgcccacaagccagagggccgcaccaggaggagcatctttgagaacctgatgaagtatgccttccctgtgagcaacaacctgcccctgtttgcctttgagtacaaggaggtgtttcctgaaaatggctggaagctgtatgaccccctgctggagtaccgccggcagggcatccccaatgaatcctggaggatcaccaagatcaatgaaagatatgagctgtgtgacacctacccagccctgctggtggtgcctgccaacatcccagatgaggagctgaagagggtggccagcttccgcagccggggccgcatccctgtgctgtcctggatccaccctgagagccaggccaccatcacccgctgcagccagcccatggtgggcgtgtctgggaagaggagcaaagaagatgagaagtacctgcaggccatcatggacagcaatgcccagagccacaagatcttcatctttgatgcccggcccagcgtgaatgctgtggccaacaaggccaagggcggcggctatgaaagtgaagatgcctactag

SEQ ID NO: 160976 - DNA, 3513 bp, Artificial Sequence
  Description of Artificial Sequence: Synthetic coding sequence
atggatgaggagaccaggcacagcctggagtgcatccaggccaaccagatcttccccaggaagcagctgatccgggaggatgagaacctgcaggtgcccttcctggagctgcacggggagagcacagaatttgtgggccgggcagaagatgccatcatcgccctgagcaactaccgcctgcacatcaagttcaaggagagcctggtgaatgtgcccctgcagctgattgagagcgtggagtgccgggacatcttccagctgcacctgacctgcaaggactgcaaggtgatccgctgccagttcagcacctttgagcagtgccaggagtggctgaagaggctgaacaatgccatccggcccccagccaagattgaagatctcttctcctttgcctaccacgcctggtgcatggaggtgtatgccagcgagaaggagcagcacggggacctgtgcaggcctggagagcacgtgaccagccgcttcaagaatgaggtggagaggatgggctttgacatgaacaatgcctggaggatcagcaacatcaatgagaagtacaagctgtgtggcagctacccccaggagctgattgtgcctgcctggatcacagacaaggagctggagagcgtgtcctccttccgctcctggaagaggatcccagctgtgatctaccgccaccagagcaatggagctgtgattgcccgctgtggccagcctgaggtgtcctggtggggctggagaaatgctgatgatgagcacctggtgcagagcgtggccaaggcctgtgccagtgacagccgcagcagcggcagcaagctgagcaccaggaacaccagccgggacttccccaatggaggagacctgagtgatgtggagtttgacagcagcctgagcaatgccagcggggctgagagcctggccatccagccccagaagctgctgatcctggatgcccggagctatgctgctgctgtggccaacagagccaagggcggcggctgtgagtgcccagagtactaccccaactgtgaggtggtgttcatgggcatggccaacatccacagcatccgccgctccttccagagcctgcggctgctgtgcacccagatgccagaccccggcaactggctgagcgccctggagagcaccaagtggctgcaccacctgtctgtgctgctgaagagcgccctgctggtggtgcatgctgtggaccaggaccagaggcctgtgctggtgcactgcagtgatggctgggacaggaccccccagatcgtggccctggccaagctgctgctggacccctactaccgcaccatcgagggcttccaggtgctggtggagatggagtggctggactttggccacaagtttgctgacagatgtggccacggggagaacagtgatgacctgaatgaacgctgccctgtgttcctgcagtggctggactgtgtgcaccagctgcagaggcagttcccctgcagctttgagttcaatgaggccttcctggtgaagctggtgcagcacacctacagctgcctgtttggcaccttcctgtgcaacaatgccaaggagcggggggagaagcacacccaggagaggacctgcagcgtgtggagcctgctgcgggccggcaacaaggccttcaagaacctgctgtacagcagccagagcgaggccgtgctgtaccctgtgtgccacgtgaggaacctgatgctgtggagcgctgtgtacctgccctgccccagccccaccacccctgtggatgacagctgtgccccctacccagcccctggcaccagcccagatgatcctcccctgagccggctgcccaagaccaggagctatgacaacctgaccacagcctgtgacaacacagtgcccctggccagccgccgctgcagcgaccccagcctgaatgagaagtggcaggagcacagaagaagcctggagctgagcagcctggccggccctggagaggaccccctgtctgctgacagcctgggcaagcccaccagggtgcctggaggagctgagctgtctgtggccgccggcgtggccgagggccagatggagaacatcctgcaggaggccaccaaggaggagagcggcgtggaggagcccgcccaccgggccggcatcgagatccaggagggcaaggaggaccccctgctggagaaggagagcaggaggaagaccccagaggccagcgccatcggcctgcaccaggaccctgagctgggagatgctgccctgcggagccacctggacatgtcctggcccctcttcagccagggcatcagcgagcagcagagcggcctgtctgtgctgctgagcagcctgcaggtgcccccaagaggagaggacagcctggaggtgcctgtggagcagttccgcatcgaggagattgctgagggccgggaggaggccgtgctgcccatccctgtggatgccaaggtgggctacggcaccagccagagctgcagcctgctgcccagccaggtgccctttgagacccggggccccaacgtggacagcagcacagacatgctggtggaggacaaggtgaagtctgtgtctggcccccagggccaccacaggagctgcctggtgaacagcggcaaggaccggctgccccagaccatggagcccagccccagcgagaccagcctggtggagcggccccaggtgggctctgtggtgcacaggaccagcctgggcagcaccctgagcctgaccaggagcccctgtgccctgcccctggccgagtgcaaggagggcctggtgtgcaatggagcccctgagacagaaaatagagccagcgagcagcccccaggcctgagcaccctgcagatgtaccccaccccaaatggccactgtgccaacggggaggccggccgcagcaaggacagcctgagccggcagctgagcgccatgagctgcagcagcgcccacctgcacagcaggaacctgcaccacaagtggctgcacagccacagcggccggcccagcgccaccagcagcccagaccagcccagccgcagccacctggatgatgatggcatgtctgtgtacacagacaccatccagcagaggctgcggcagatcgagagcggccaccagcaggaggtggagaccctgaagaagcaggtgcaggagctgaagagccggctggagagccagtacctgaccagcagcctgcacttcaacggggactttggagatgaggtgatgacccgctggctgcctgaccacctggccgcccactgctacgcctgtgacagcgccttctggctggccagcaggaagcaccactgccgggacacagacagagtggaccagacctggaactgtggaaatgtgttctgcagcagctgctgcaaccagaaggtgcctgtgcccagccagcagctgtttgagcccagccgggtgtgcaagagctgctacagcagcctgcaccccaccagcagcagcattgacctggagctggacaagcccatcgccgccaccagcaactag

SEQ ID NO: 160977 - DNA, 3486 bp, Artificial Sequence
  Description of Artificial Sequence: Synthetic coding sequence
atggatgaggagaccaggcacagcctggagtgcatccaggccaaccagatcttccccaggaagcagctgatccgggaggatgagaacctgcaggtgcccttcctggagctgcacggggagagcacagaatttgtgggccgggcagaagatgccatcatcgccctgagcaactaccgcctgcacatcaagttcaaggagagcctggtgaatgtgcccctgcagctgattgagagcgtggagtgccgggacatcttccagctgcacctgacctgcaaggactgcaaggtgatccgctgccagttcagcacctttgagcagtgccaggagtggctgaagaggctgaacaatgccatccggcccccagccaagattgaagatctcttctcctttgcctaccacgcctggtgcatggaggtgtatgccagcgagaaggagcagcacggggacctgtgcaggcctggagagcacgtgaccagccgcttcaagaatgaggtggagaggatgggctttgacatgaacaatgcctggaggatcagcaacatcaatgagaagtacaagctgtgtggcagctacccccaggagctgattgtgcctgcctggatcacagacaaggagctggagagcgtgtcctccttccgctcctggaagaggatcccagctgtgatctaccgccaccagagcaatggagctgtgattgcccgctgtggccagcctgaggtgtcctggtggggctggagaaatgctgatgatgagcacctggtgcagagcgtggccaaggcctgtgccagtgacagccgcagcagcggcagcaagctgagcaccaggaacaccagccgggacttccccaatggaggagacctgagtgatgtggagtttgacagcagcctgagcaatgccagcggggctgagagcctggccatccagccccagaagctgctgatcctggatgcccggagctatgctgctgctgtggccaacagagccaagggcggcggctgtgagtgcccagagtactaccccaactgtgaggtggtgttcatgggcatggccaacatccacagcatccgccgctccttccagagcctgcggctgctgtgcacccagatgccagaccccggcaactggctgagcgccctggagagcaccaagtggctgcaccacctgtctgtgctgctgaagagcgccctgctggtggtgcatgctgtggaccaggaccagaggcctgtgctggtgcactgcagtgatggctgggacaggaccccccagatcgtggccctggccaagctgctgctggacccctactaccgcaccatcgagggcttccaggtgctggtggagatggagtggctggactttggccacaagtttgctgacagatgtggccacggggagaacagtgatgacctgaatgaacgctgccctgtgttcctgcagtggctggactgtgtgcaccagctgcagaggcagttcccctgcagctttgagttcaatgaggccttcctggtgaagctggtgcagcacacctacagctgcctgtttggcaccttcctgtgcaacaatgccaaggagcggggggagaagcacacccaggagaggacctgcagcgtgtggagcctgctgcgggccggcaacaaggccttcaagaacctgctgtacagcagccagagcgaggccgtgctgtaccctgtgtgccacgtgaggaacctgatgctgtggagcgctgtgtacctgccctgccccagccccaccacccctgtggatgacagctgtgccccctacccagcccctggcaccagcccagatgatcctcccctgagccggctgcccaagaccaggagctatgacaacctgaccacagcctgtgacaacacagtgcccctggccagccgccgctgcagcgaccccagcctgaatgagaagtggcaggagcacagaagaagcctggagctgagcagcctggccggccctggagaggaccccctgtctgctgacagcctgggcaagcccaccagggtgcctggaggagctgagctgtctgtggccgccggcgtggccgagggccagatggagaacatcctgcaggaggccaccaaggaggagagcggcgtggaggagcccgcccaccgggccggcatcgagatccaggagggcaaggaggaccccctgctggagaaggagagcaggaggaagaccccagaggccagcgccatcggcctgcaccaggaccctgagctgggagatgctgccctgcggagccacctggacatgtcctggcccctcttcagccagggcatcagcgagcagcagagcggcctgtctgtgctgctgagcagcctgcaggtgcccccaagaggagaggacagcctggaggtgcctgtggagcagttccgcatcgaggagattgctgagggccgggaggaggccgtgctgcccatccctgtggatgccaaggtgggctacggcaccagccagagctgcagcctgctgcccagccaggtgccctttgagacccggggccccaacgtggacagcagcacagacatgctggtggaggacaaggtgaagtctgtgtctggcccccagggccaccacaggagctgcctggtgaacagcggcaaggaccggctgccccagaccatggagcccagccccagcgagaccagcctggtggagcggccccaggtgggctctgtggtgcacaggaccagcctgggcagcaccctgagcctgaccaggagcccctgtgccctgcccctggccgagtgcaaggagggcctggtgtgcaatggagcccctgagacagaaaatagagccagcgagcagcccccaggcctgagcaccctgcagatgtaccccaccccaaatggccactgtgccaacggggaggccggccgcagcaaggacagcctgagccggcagctgagcgccatgagctgcagcagcgcccacctgcacagcaggaacctgcaccacaagtggctgcacagccacagcggccggcccagcgccaccagcagcccagaccagcccagccgcagccacctggatgatgatggcatgtctgtgtacacagacaccatccagcagaggctgcggcagatcgagagcggccaccagcaggaggtggagaccctgaagaagcaggtgcaggagctgaagagccggctggagagccagtacctgaccagcagcctgcacttcaacggggactttggagatgaggtgatgacccgctggctgcctgaccacctggccgcccactgctacgcctgtgacagcgccttctggctggccagcaggaagcaccactgcaggaactgtggaaatgtgttctgcagcagctgctgcaaccagaaggtgcctgtgcccagccagcagctgtttgagcccagccgggtgtgcaagagctgctacagcagcctgcaccccaccagcagcagcattgacctggagctggacaagcccatcgccgccaccagcaactag

SEQ ID NO: 160978 - DNA, 3597 bp, Artificial Sequence
  Description of Artificial Sequence: Synthetic coding sequence
atggatgaggagaccaggcacagcctggagtgcatccaggccaaccagatcttccccaggaagcagctgatccgggaggatgagaacctgcaggtgcccttcctggagctgcacggggagagcacagaatttgtgggccgggcagaagatgccatcatcgccctgagcaactaccgcctgcacatcaagttcaaggagagcctggtgaatgtgcccctgcagctgattgagagcgtggagtgccgggacatcttccagctgcacctgacctgcaaggactgcaaggtgatccgctgccagttcagcacctttgagcagtgccaggagtggctgaagaggctgaacaatgccatccggcccccagccaagattgaagatctcttctcctttgcctaccacgcctggtgcatggaggtgtatgccagcgagaaggagcagcacggggacctgtgcaggcctggagagcacgtgaccagccgcttcaagaatgaggtggagaggatgggctttgacatgaacaatgcctggaggatcagcaacatcaatgagaagtacaagctgtgtggcagctacccccaggagctgattgtgcctgcctggatcacagacaaggagctggagagcgtgtcctccttccgctcctggaagaggatcccagctgtgatctaccgccaccagagcaatggagctgtgattgcccgctgtggccagcctgaggtgtcctggtggggctggagaaatgctgatgatgagcacctggtgcagagcgtggccaaggcctgtgccagtgacagccgcagcagcggcagcaagctgagcaccaggaacaccagccgggacttccccaatggaggagacctgagtgatgtggagtttgacagcagcctgagcaatgccagcggggctgagagcctggccatccagccccagaagctgctgatcctggatgcccggagctatgctgctgctgtggccaacagagccaagggcggcggctgtgagtgcccagagtactaccccaactgtgaggtggtgttcatgggcatggccaacatccacagcatccgccgctccttccagagcctgcggctgctgtgcacccagatgccagaccccggcaactggctgagcgccctggagagcaccaagtggctgcaccacctgtctgtgctgctgaagagcgccctgctggtggtgcatgctgtggaccaggaccagaggcctgtgctggtgcactgcagtgatggctgggacaggaccccccagatcgtggccctggccaagctgctgctggacccctactaccgcaccatcgagggcttccaggtgctggtggagatggagtggctggactttggccacaagtttgctgacagatgtggccacggggagaacagtgatgacctgaatgaacgctgccctgtgttcctgcagtggctggactgtgtgcaccagctgcagaggcagttcccctgcagctttgagttcaatgaggccttcctggtgaagctggtgcagcacacctacagctgcctgtttggcaccttcctgtgcaacaatgccaaggagcggggggagaagcacacccaggagaggacctgcagcgtgtggagcctgctgcgggccggcaacaaggccttcaagaacctgctgtacagcagccagagcgaggccgtgctgtaccctgtgtgccacgtgaggaacctgatgctgtggagcgctgtgtacctgccctgccccagccccaccacccctgtggatgacagctgtgccccctacccagcccctggcaccagcccagatgatcctcccctgagccggctgcccaagaccaggagctatgacaacctgaccacagcctgtgacaacacagtgcccctggccagccgccgctgcagcgaccccagcctgaatgagaagtggcaggagcacagaagaagcctggagctgagcagcctggccggccctggagaggaccccctgtctgctgacagcctgggcaagcccaccagggtgcctggaggagctgagctgtctgtggccgccggcgtggccgagggccagatggagaacatcctgcaggaggccaccaaggaggagagcggcgtggaggagcccgcccaccgggccggcatcgagatccaggagggcaaggaggaccccctgctggagaaggagagcaggaggaagaccccagaggccagcgccatcggcctgcaccaggaccctgagctgggagatgctgccctgcggagccacctggacatgtcctggcccctcttcagccagggcatcagcgagcagcagagcggcctgtctgtgctgctgagcagcctgcaggtgcccccaagaggagaggacagcctggaggtgcctgtggagcagttccgcatcgaggagattgctgagggccgggaggaggccgtgctgcccatccctgtggatgccaaggtgggctacggcaccagccagagctgcagcctgctgcccagccaggtgccctttgagacccggggccccaacgtggacagcagcacagacatgctggtggaggacaaggtgaagtctgtgtctggcccccagggccaccacaggagctgcctggtgaacagcggcaaggaccggctgccccagaccatggagcccagccccagcgagaccagcctggtggagcggccccaggtgggctctgtggtgcacaggaccagcctgggcagcaccctgagcctgaccaggagcccctgtgccctgcccctggccgagtgcaaggagggcctggtgtgcaatggagcccctgagacagaaaatagagccagcgagcagcccccaggcctgagcaccctgcagatgtaccccaccccaaatggccactgtgccaacggggaggccggccgcagcaaggacagcctgagccggcagctgagcgccatgagctgcagcagcgcccacctgcacagcaggaacctgcaccacaagtggctgcacagccacagcggccggcccagcgccaccagcagcccagaccagcccagccgcagccacctggatgatgatggcatgtctgtgtacacagacaccatccagcagaggctgcggcagatcgagagcggccaccagcaggaggtggagaccctgaagaagcaggtgcaggagctgaagagccggctggagagccagtacctgaccagcagcctgcacttcaacggggactttggagatgaggtgaccagcatcccagattctgagagcaacctggaccagaactgcctgagccgctgcagcacagagatcttcagcgaggcctcctgggagcaggtggacaagcaggacacagagatgacccgctggctgcctgaccacctggccgcccactgctacgcctgtgacagcgccttctggctggccagcaggaagcaccactgcaggaactgtggaaatgtgttctgcagcagctgctgcaaccagaaggtgcctgtgcccagccagcagctgtttgagcccagccgggtgtgcaagagctgctacagcagcctgcaccccaccagcagcagcattgacctggagctggacaagcccatcgccgccaccagcaactag

SEQ ID NO: 160979 - DNA, 3513 bp, Artificial Sequence; identical to SEQ ID NO: 160976
  Description of Artificial Sequence: Synthetic coding sequence

SEQ ID NO: 160980 - DNA, 420 bp, Artificial Sequence
  Description of Artificial Sequence: Synthetic coding sequence
atggatgaggagaccaggcacagcctggagtgcatccaggccaaccagatcttccccaggaagcagctgatccgggaggatgagaacctgcaggtgcccttcctggagctgcacggggagagcacagaatttgtgggccgggcagaagatgccatcatcgccctgagcaactaccgcctgcacatcaagttcaaggagagcctggtgaatgtgcccctgcagctgattgagagcgtggagtgccgggacatcttccagctgcacctgacctgcaaggactgcaaggtgatccgctgccagttcagcacctttgagcagtgccaggagtggctgaagaggctgaacaatgccatccggcccccagccaagattgaagatctcttctcctttgcctaccacgcctggtgcatggaggtgtag

SEQ ID NO: 160981 - DNA, 3588 bp, Artificial Sequence
  Description of Artificial Sequence: Synthetic coding sequence
atgggagaggagggcccccccagcctggagtacatccaggccaaggacctcttcccccccaaggagctggtgaaggaggaggagaacctgcaggtgcccttcaccgtgctgcagggcgagggcgtggagttcctgggccgggctgctgatgccctgattgccatcagcaactaccgcctgcacatcaagttcaaggacagcgtcatcaacgtgcccctgaggatgattgacagcgtggagagccgggacatgttccagctgcacatcagctgcaaggacagcaaggtggtgcgctgccacttcagcaccttcaagcagtgccaggagtggctgagccggctgagccgggccacagcccggcctgccaagccagaggacctgtttgcctttgcctaccacgcctggtgcctgggcctgacagaggaggaccagcacacccacctgtgccagcctggagagcacatccgctgccggcaggaggccgagctggccaggatgggctttgacctgcagaatgtgtggagggtgagccacatcaacagcaactacaagctgtgccccagctacccccagaagctgctggtgcctgtgtggatcacagacaaggagctggagaatgtggccagcttccgctcctggaagagaattcctgtggtggtgtaccgccacctgagaaatggagctgccatcgcccgctgcagccagcctgagatctcctggtggggctggagaaatgctgatgatgagtacctggtgaccagcatcgccaaggcctgtgccctggaccccggcacccgggccaccggcggcagcctgagcacaggcaacaatgacaccagcgaggcctgtgatgctgactttgacagcagcctgacagcctgcagcggcgtggagagcacagctgccccccagaagctgctgatcctggatgcccggagctacacagctgctgtggccaacagagccaagggcggcggctgtgaatgtgaggagtactaccccaactgtgaggtggtgttcatgggcatggccaacatccacgccatccggaacagcttccagtacctgcgggctgtgtgcagccagatgccagaccccagcaactggctgagcgccctggagagcaccaagtggctgcagcacctgtctgtgatgctgaaggctgctgtgctggtggccaacacagtggaccgggagggccggcctgtgctggtgcactgcagtgatggctgggacaggaccccccagatcgtggccctggccaagatcctgctggacccctactaccgcaccctggagggcttccaggtgctggtggagagtgactggctggactttggccacaagtttggagacagatgtggccaccaggagaatgtggaggaccagaatgagcagtgccctgtgttcctgcagtggctggacagcgtgcaccagctgctgaagcagttcccctgcctgtttgagttcaatgaggccttcctggtgaagctggtgcagcacacctacagctgcctgtatggcaccttcctggccaacaacccctgtgagcgggagaagaggaacatctacaagaggacctgcagcgtgtgggccctgctgcgggccggcaacaagaacttccacaacttcctgtacacccccagcagtgacatggtgctgcaccctgtgtgccacgtgcgggccctgcacctgtggacagctgtgtacctgcctgccagcagcccctgcaccctgggggaggagaacatggacctgtacctgagccctgtggcccagagccaggagttcagcggccgcagcctggaccggctgcccaagaccaggtccatggatgacctgctgagcgcctgtgacaccagcagccccctgaccaggaccagcagtgaccccaacctgaacaaccactgccaggaggtgcgggtgggcctggagccctggcacagcaaccctgagggcagcgagaccagctttgtggacagcggcgtgggcggcccccagcagacagtgggggaggtgggcctgcccccacccctgcccagcagccagaaggactacctgagcaacaagcccttcaagagccacaagagctgcagccccagctacaagctgctgaacacagctgtgccccgggagatgaagagcaacaccagtgaccctgagatcaaggtgctggaggagaccaagggccctgccccagaccccagcgcccaggatgagctgggccgcaccctggatggcatcggggagcccccagagcactgcccagagacagaggccgtgtctgccctgagcaaggtgatcagcaacaagtgtgatggagtgtgcaacttccctgagagcagccagaacagccccaccggcaccccccagcaggcccagcctgacagcatgctgggcgtgcccagcaaatgtgtgctggaccacagcctgagcacagtgtgcaaccccccatctgctgcctgccagacccccctggaccccagcacagacttcctgaaccaggaccccagcggctctgtggccagcatcagccaccaggagcagctgagctctgtgcctgacctgacccacggggaggaggacatcggcaagaggggcaacaacagaaatggccagctgctggagaaccccaggtttgggaagatgcccctggagctggtgaggaagcccatcagccagagccagatcagcgagttctccttcctgggcagcaactgggacagcttccagggcatggtgaccagcttccccagcggggaggccaccccccggcggctgctgtcctatggctgctgcagcaagaggcccaacagcaagcagatgagggccaccggcccctgctttggaggccagtgggcccagcgggagggcgtgaagagccctgtgtgcagcagccacagcaatggccactgcaccggccctgggggcaagaaccagatgtggctgagcagccaccccaagcaggtgagcagcaccaagcctgtgcccctgaactgccccagccctgtgccccccctgtacctggatgatgatggcctgcccttccccacagatgtgatccagcaccggctgcggcagatcgaggccggctacaagcaggaggtggagcagctgcggcggcaggtgcgggagctgcagatgaggctggacatccgccactgctgtgcccccccagctgagccccccatggactatgaagatgacttcacctgcctgaaggagagtgatggcagtgacacagaggactttggaagtgaccacagcgaggactgcctgtctgaggcctcctgggagcctgtggacaagaaggagacagaggtgacccgctgggtgcctgaccacatggccagccactgctacaactgtgactgtgagttctggctggccaagaggaggcaccactgcaggaactgtggaaatgtgttctgtgccggctgctgccacctgaagctgcccatcccagaccagcagctgtatgaccctgtgctggtgtgcaacagctgctatgagcacatccaggtgtcccgggcccgggagctgatgagccagcagctgaagaagcccatcgccacagccagcagctag

SEQ ID NO: 160982 - DNA, 570 bp, Artificial Sequence
  Description of Artificial Sequence: Synthetic coding sequence
atgcctgtgtggaagctgccctggaagctgtctgagggcaagagaagagcccaggtggagggggaggacctcttccctgtggccatcagctttggccggcccaaggaggtgctgcccctgtacagcagcgagagccaccgcttcaccgtgctggagcccaacacagtgtccttcaacttcaagttctggaggaacatgtaccaccagtttgacaggaccctgcacccccggcagagcgtcttcaacatcatcatgaacatgaatgagcagaacaagcagctggagaaggacatcaaggacctggagagcaagatcaagcagaggaagaacaagcagacagatggcatcctgaccaaggagctgctgcacagcgtgcaccctgagagccccaacctgaagaccagcctgtgcttcaaggagcagaccctgctgcctgtgaatgatgccctgcggaccatcgagggcagcagccctgctgacaaccgctacagtgaatatgcagaggagttcagcaagtctgagcctgctgtggtgtccctggagtatggagtggccaggatgacctgctag

SEQ ID NO: 160983 - DNA, 1866 bp, Artificial Sequence
  Description of Artificial Sequence: Synthetic coding sequence
atggagcacatccgcaccaccaaggtggagcaggtgaagctgctggaccgcttcagcaccagcaacaagagcctgaccggcaccctgtacctgacagccacccacctgctcttcatcgacagccaccagaaggagacctggatcctgcaccaccacatcgcctctgtggagaagctggccctgaccaccagcggctgccccctggtgatccagtgcaagaacttcagaacagtgcacttcatcgtgccccgggagcgggactgccacgacatctacaacagcctgctgcagctgagcaagcaggccaagtatgaggacctgtatgccttctcctacaaccccaagcagaatgattctgagcggctgcagggctggcagctgattgacctggccgaggagtacaagaggatgggcgtgcccaacagccactggcagctgagtgatgccaacagagactacaagatctgtgagacctacccccgggagctgtatgtgccccgcatcgccagcaagcccatcatcgtgggcagcagcaagttccgcagcaagggccgcttccctgtgctgagctactaccaccaggacaaggaggccgccatctgccgctgcagccagcccctgagcggcttcagcgcccgctgcctggaggatgagcacctgctgcaggccatcagcaaggccaaccctgtgaaccgctacatgtatgtgatggacacccggcccaagctgaatgccatggccaacagagctgctgggaagggctatgaaaatgaagacaactacagcaacatccgcttccagtttgtgggcatcgagaacatccacgtgatgaggagcagcctgcagaagctgctggaggtgaatggcaccaagggcctgtctgtgaatgacttctacagcggcctggagagcagcggctggctgcggcacatcaaggctgtgatggatgctgccatcttcctggccaaggccatcaccgtggagaatgcctctgtgctggtgcactgcagtgatggctgggacaggaccagccaggtgtgcagcctgggcagcctgctgctggacagctactaccgcaccatcaagggcttcatggtgctgattgagaaggactggatcagctttggccacaagttcagcgagcgctgtggccagctggatggagaccccaaggaggtgtcccctgtgttcacccagttcctggagtgtgtgtggcacctgacagagcagttcccccaggcctttgagttcagcgaggccttcctgctgcagatccacgagcacatccacagctgccagtttggaaacttcctgggcaactgccagaaggagcgggaggagctgaagctgaaggagaagacctacagcctgtggcccttcctgctggaggaccagaagaagtacctgaaccccctgtacagcagcgagagccaccgcttcaccgtgctggagcccaacacagtgtccttcaacttcaagttctggaggaacatgtaccaccagtttgacaggaccctgcacccccggcagagcgtcttcaacatcatcatgaacatgaatgagcagaacaagcagctggagaaggacatcaaggacctggagagcaagatcaagcagaggaagaacaagcagacagatggcatcctgaccaaggagctgctgcacagcgtgcaccctgagagccccaacctgaagaccagcctgtgcttcaaggagcagaccctgctgcctgtgaatgatgccctgcggaccatcgagggcagcagccctgctgacaaccgctacagtgaatatgcagaggagttcagcaagtctgagcctgctgtggtgtccctggagtatggagtggccaggatgacctgctag

SEQ ID NO: 160984 - DNA, 1647 bp, Artificial Sequence
  Description of Artificial Sequence: Synthetic coding sequence
atggagcacatccgcaccaccaaggtggagcaggtgaagctgctggaccgcttcagcaccagcaacaagagcctgaccggcaccctgtacctgacagccacccacctgctcttcatcgacagccaccagaaggagacctggatcctgcaccaccacatcgcctctgtggagaagctggccctgaccaccagcggctgccccctggtgatccagtgcaagaacttcagaacagtgcacttcatcgtgccccgggagcgggactgccacgacatctacaacagcctgctgcagctgagcaagcaggccaagtatgaggacctgtatgccttctcctacaaccccaagcagaatgattctgagcggctgcagggctggcagctgattgacctggccgaggagtacaagaggatgggcgtgcccaacagccactggcagctgagtgatgccaacagagactacaagatctgtgagacctacccccgggagctgtatgtgccccgcatcgccagcaagcccatcatcgtgggcagcagcaagttccgcagcaagggccgcttccctgtgctgagctactaccaccaggacaaggaggccgccatctgccgctgcagccagcccctgagcggcttcagcgcccgctgcctggaggatgagcacctgctgcaggccatcagcaaggccaaccctgtgaaccgctacatgtatgtgatggacacccggcccaagctgaatgccatggccaacagagctgctgggaagggctatgaaaatgaagacaactacagcaacatccgcttccagtttgtgggcatcgagaacatccacgtgatgaggagcagcctgcagaagctgctggaggtgaatggcaccaagggcctgtctgtgaatgacttctacagcggcctggagagcagcggctggctgcggcacatcaaggctgtgatggatgctgccatcttcctggccaaggccatcaccgtggagaatgcctctgtgctggtgcactgcagtgatggctgggacaggaccagccaggtgtgcagcctgggcagcctgctgctggacagctactaccgcaccatcaagggcttcatggtgctgattgagaaggactggatcagctttggccacaagttcagcgagcgctgtggccagctggatggagaccccaaggaggtgtcccctgtgttcacccagttcctggagtgtgtgtggcacctgacagagcagttcccccaggcctttgagttcagcgaggccttcctgctgcagatccacgagcacatccacagctgccagtttggaaacttcctgggcaactgccagaaggagcgggaggagctgaagctgaaggagaagacctacagcctgtggcccttcctgctggaggaccagaagaagtacctgaaccccctgtacagcagcgagagccaccgcttcaccgtgctggagcccaacacagtgtccttcaacttcaagttctggaggaacatgtaccaccagtttgacaggaccctgcacccccggcagagcgtcttcaacatcatcatgaacatgaatgagcagaacaagcagctggagaaggacatcaaggacctggagagcctgaccagctacagcagcttcaagatcatcgtgggccagtag

SEQ ID NO: 160985 - DNA, 1647 bp, Artificial Sequence
  Description of Artificial Sequence: Synthetic coding sequence
atggagcacatccgcaccaccaaggtggagcaggtgaagctgctggaccgcttcagcaccagcaacaagagcctgaccggcaccctgtacctgacagccacccacctgctcttcatcgacagccaccagaaggagacctggatcctgcaccaccacatcgcctctgtggagaagctggccctgaccaccagcggctgccccctggtgatccagtgcaagaacttcagaacagtgcacttcatcgtgccccgggagcgggactgccacgacatctacaacagcctgctgcagctgagcaagcaggccaagtatgaggacctgtatgccttctcctacaaccccaagcagaatgattctgagcggctgcagggctggcagctgattgacctggccgaggagtacaagaggatgggcgtgcccaacagccactggcagctgagtgatgccaacagagactacaagatctgtgagacctacccccgggagctgtatgtgccccgcatcgccagcaagcccatcatcgtgggcagcagcaagttccgcagcaagggccgcttccctgtgctgagctactaccaccaggacaaggaggccgccatctgccgctgcagccagcccctgagcggcttcagcgcccgctgcctggaggatgagcacctgctgcaggccatcagcaaggccaaccctgtgaaccgctacatgtatgtgatggacacccggcccaagctgaatgccatggccaacagagctgctgggaagggctatgaaaatgaagacaactacagcaacatccgcttccagtttgtgggcatcgagaacatccacgtgatgaggagcagcctgcagaagctgctggaggtgaatggcaccaagggcctgtctgtgaatgacttctacagcggcctggagagcagcggctggctgcggcacatcaaggctgtgatggatgctgccatcttcctggccaaggccatcaccgtggagaatgcctctgtgctggtgcactgcagtgatggctgggacaggaccagccaggtgtgcagcctgggcagcctgctgctggacagctactaccgcaccatcaagggcttcatggtgctgattgagaaggactggatcagctttggccacaagttcagcgagcgctgtggccagctggatggagaccccaaggaggtgtcccctgtgttcacccagttcctggagtgtgtgtggcacctgacagagcagttcccccaggcctttgagttcagcgaggccttcctgctgcagatccacgagcacatccacagctgccagtttggaaacttcctgggcaactgccagaaggagcgggaggagctgaagctgaaggagaagacctacagcctgtggcccttcctgctggaggaccagaagaagtacctgaaccccctgtacagcagcgagagccaccgcttcaccgtgctggagcccaacacagtgtccttcaacttcaagttctggaggaacatgtaccaccagtttgacaggaccctgcacccccggcagagcgtcttcaacatcatcatgaacatgaatgagcagaacaagcagctggagaaggacatcaaggacctggagagcttcaccagctttgctgctgcccgggtcatccagggccagtag

SEQ ID NO: 160986 - DNA, 1983 bp, Artificial Sequence
  Description of Artificial Sequence: Synthetic coding sequence
atggagcacatccgcacccccaaggtggagaatgtgcggctggtggacagagtgagccccaagaaggccgccctgggcaccctgtacctgacagccacccacgtgatctttgtggagaacagcccagaccccaggaaggagacctggatcctgcacagccagatcagcaccatcgagaagcaggccaccacagccaccggctgccccctgctgatccgctgcaagaacttccagatcatccagctgatcatcccccaggagcgggactgccatgatgtgtacatcagcctcatccggctggcccggcctgtgaagtatgaggagctgtactgcttctccttcaaccccatgctggacaaggaggagcgggagcagggctgggtgctgattgacctgtctgaggagtacaccaggatgggcctgcccaaccactactggcagctgagtgatgtgaacagagactacagagtgtgtgacagctaccccacagagctgtatgtgcccaagagcgccacagcccacatcatcgtgggcagcagcaagttccgcagcagaagacgcttccctgtgctgagctactactacaaggacaaccacgccagcatctgccgcagcagccagcccctgagcggcttcagcgcccgctgcctggaggatgagcagatgctgcaggccatcaggaaggccaaccctggcagtgactttgtgtatgtggtggacacccggcccaagctgaatgccatggccaacagagctgctgggaagggctatgaaaatgaagacaactacagcaacatcaagttccagttcatcggcatcgagaacatccacgtgatgaggaacagcctgcagaagatgctggaggtgtgtgagctgaagagccccagcatgtctgacttcctgtggggcctggagaacagcggctggctgcggcacatcaaggccatcatggatgctggcatcttcatcgccaaggctgtgtctgaggagggcgcctctgtgctggtgcactgcagtgatggctgggacagaacagcccaggtgtgcagcgtggccagcctgctgctggacccccactaccgcaccctgaagggcttcatggtgctgattgagaaggactggatcagctttggccacaagttcaaccacagatatggcaacctggatggagaccccaaggagatcagccctgtgattgaccagttcattgaatgtgtgtggcagctgatggagcagttcccctgtgcctttgagttcaatgaacgcttcctgatccacatccagcaccacatctacagctgccagtttggaaacttcctgtgcaacagccagaaggagcggcgggagctgaagatccaggagaggacctacagcctgtgggcccacctgtggaagaacagagctgactacctgaaccccctcttccgggctgaccacagccagacccagggcaccctgcacctgcccaccaccccctgcaacttcatgtacaagttctggagcggcatgtacaacagatttgagaagggcatgcagccccggcagagcgtgacagactacctgatggctgtgaaggaggagacccagcagctggaggaggagctggaggccctggaggagcggctggagaagatccagaaggtgcagctgaactgcaccaaggtgaagagcaagcagagcgagcccagcaagcacagcggcttcagcaccagtgacaacagcatcgccaacaccccccaggactacagcggcaacatgaagagcttccccagccgcagccccagccagggagatgaagattctgccctgatcctgacccaggacaacctgaagagcagtgaccctgacctgagcgccaacagcgaccaggagagcggcgtggaggacctgagctgccgcagccccagcggcggggagcacgcccccagcgaggacagcggcaaggaccgggacagtgatgaagctgtgttcctgacagcctag

SEQ ID NO: 160987 - DNA, 756 bp, Artificial Sequence
  Description of Artificial Sequence: Synthetic coding sequence
atggagcagttcccctgtgcctttgagttcaatgaacgcttcctgatccacatccagcaccacatctacagctgccagtttggaaacttcctgtgcaacagccagaaggagcggcgggagctgaagatccaggagaggacctacagcctgtgggcccacctgtggaagaacagagctgactacctgaaccccctcttccgggctgaccacagccagacccagggcaccctgcacctgcccaccaccccctgcaacttcatgtacaagttctggagcggcatgtacaacagatttgagaagggcatgcagccccggcagagcgtgacagactacctgatggctgtgaaggaggagacccagcagctggaggaggagctggaggccctggaggagcggctggagaagatccagaaggtgcagctgaactgcaccaaggtgaagagcaagcagagcgagcccagcaagcacagcggcttcagcaccagtgacaacagcatcgccaacaccccccaggactacagcggcaacatgaagagcttccccagccgcagccccagccagggagatgaggacagcgccctgatcctgacccaggacaacctgaagagcagtgaccctgacctgagcgccaacagcgaccaggagagcggcgtggaggacctgagctgccgcagccccagcggcggggagcacgcccccagtgaagattctgggaaggaccgggacagtgatgaggccgtgttcctgacagcctag

SEQ ID NO: 160988 - DNA, 1668 bp, Artificial Sequence
  Description of Artificial Sequence: Synthetic coding sequence
atggagcacatccgcacccccaaggtggagaatgtgcggctggtggacagagtgagccccaagaaggccgccctgggcaccctgtacctgacagccacccacgtgatctttgtggagaacagcccagaccccaggaaggagacctggatcctgcacagccagatcagcaccatcgagaagcaggccaccacagccaccggctgccccctgctgatccgctgcaagaacttccagatcatccagctgatcatcccccaggagcgggactgccatgatgtgtacatcagcctcatccggctggcccggcctgtgaagtatgaggagctgtactgcttctccttcaaccccatgctggacaaggaggagcgggagcagggctgggtgctgattgacctgtctgaggagtacaccaggatgggcctgcccaaccactactggcagctgagtgatgtgaacagagactacagagtgtgtgacagctaccccacagagctgtatgtgcccaagagcgccacagcccacatcatcgtgggcagcagcaagttccgcagcagaagacgcttccctgtgctgagctactactacaaggacaaccacgccagcatctgccgcagcagccagcccctgagcggcttcagcgcccgctgcctggaggatgagcagatgctgcaggccatcaggaaggccaaccctggcagtgactttgtgtatgtggtggacacccggcccaagctgaatgccatggccaacagagctgctgggaagggctatgaaaatgaagacaactacagcaacatcaagttccagttcatcggcatcgagaacatccacgtgatgaggaacagcctgcagaagatgctggaggtgtgtgagctgaagagccccagcatgtctgacttcctgtggggcctggagaacagcggctggctgcggcacatcaaggccatcatggatgctggcatcttcatcgccaaggctgtgtctgaggagggcgcctctgtgctggtgcactgcagtgatggctgggacagaacagcccaggtgtgcagcgtggccagcctgctgctggacccccactaccgcaccctgaagggcttcatggtgctgattgagaaggactggatcagctttggccacaagttcaaccacagatatggcaacctggatggagaccccaaggagatcagccctgtgattgaccagttcattgaatgtgtgtggcagctgatggagcagttcccctgtgcctttgagttcaatgaacgcttcctgatccacatccagcaccacatctacagctgccagtttggaaacttcctgtgcaacagccagaaggagcggcgggagctgaagatccaggagaggacctacagcctgtgggcccacctgtggaagaacagagctgactacctgaaccccctcttccgggctgaccacagccagacccagggcaccctgcacctgcccaccaccccctgcaacttcatgtacaagttctggagcggcatgtacaacagatttgagaagggcatgcagccccggcagagcgtgacagactacctgatggctgtgaaggaggagacccagcagctggaggaggagctggaggccctggaggaggtgcgccacacctgctttgtgaacctcttctctgtgctgatctcctag

SEQ ID NO: 160989 - DNA, 1773 bp, Artificial Sequence
  Description of Artificial Sequence: Synthetic coding sequence
ctggacctgctggtgcccaaggtggagaatgtgaagctggtggacagatatgtgtccaagaagccagccaacggcatcctgtacctgacagccacccacctgatctacgtggaggccagcggggccgccaggaaggagacctggatcgccctgcaccacatcgccaccgtggagaagctgcccatcaccagcctgggctgccccctgaccctgcgctgcaagaacttccgggtggcccactttgtgctggacagcgacctggtgtgccacgaggtgtacatcagcctgctgaagctgagccagcctgccctgcctgaggacctgtatgccttctcctacaaccccaagagcagcaaggagatgagggagagcggctggaagctgattgaccccatcagtgactttggaaggatgggcatccccaacagaaactggaccatcacagatgccaacatccgcttccgcttcatgggcatcgagaacatccacgtgatgaggagcagcctgcagaagctgctggaggtgtgtgagctgaagacccccaccatgtctgagttcctgagcggcctggagagcagcggctggctgcggcacatcaaggccatcatggatgctggcatcttcatcaccaaggctgtgaaggtggagaaggcctctgtgctggtgcactgcagtgatggctgggacagaacagcccaggtgtgcagcgtggccagcatcctgctggaccccttctaccgcaccttcaagggcctgatgatcctgattgagaaggagtggatctccatgggccacaagttcagccagagatgtggccacctggatggagacagcaaggaggtgagccccatcttcacccagttcctggactgcatctggcagctgatggagcagttcccctgtgcctttgagttcaatgaaaacttcctgctggagatccatgaccacgtgttcagctgccagtttggaaacttcctgggcaactgccagaaggaccgggaggacctgcgggtgtatgagaagacccacagcgtgtggcccttcctggtgcagaggaagccagacttcaggaaccccctgtacaagggcttcaccatgtatggagtgctgaaccccagcacagtgccctacaacatccagttctggtgtggcatgtacaacagatttgataaaggcctgcagcccaagcagagcatgctggagagcctgctggagatcaagaagcagagggccatgctggagacagatgtgcatgagctggagaagaagctgaaggtgagagatgagcccccagaggagatctgcacctgcagccagctgggcaacatcctgagccagcacctgggcagccccctgaccaaccccctgggcttcatgggcatcaacggggacctgaacaccctgatggagaatggcaccctgagccgggagggcggcctgcgggcccagatggaccaggtgaagagccagggcgctgacctgcaccacaactgctgtgaaattgtgggcagcctgcgggccatcaacatctctggagatgtgggcatcagcgaggccatgggcatcagcggggacatgtgcacctttgaggccaccggcttcagcaaggacctgggcatctgtggggccatggacatcagcgaggccaccggcatcagcggcaacctgggcatcagcgaggcccggggcttcagcggggacatgggcatcctgggggacaccggcatcagcaaggccagcaccaaggaggccgactacagcaagcaccagtag

SEQ ID NO: 160990 - DNA, 2115 bp, Artificial Sequence
  Description of Artificial Sequence: Synthetic coding sequence
atggaccacatcaccgtgcccaaggtggagaatgtgaagctggtggaccgctacgtgtccaagaagccagccaacggcatcctgtacctgacagccacccacctgatctacgtggaggccagcggggccgccaggaaggagacctggatcgccctgcaccacatcgccaccgtggagaagctgcccatcaccagcctgggctgccccctgaccctgcgctgcaagaacttccgggtggcccactttgtgctggacagcgacctggtgtgccacgaggtgtacatcagcctgctgaagctgagccagcctgccctgcctgaggacctgtatgccttctcctacaaccccaagagcagcaaggagatgagggagagcggctggaagctgattgaccccatcagtgactttggccgcatgggcatccccaacagaaactggaccatcacagatgccaacagaaattatgagatctgcagcacctacccacctgagatcgtggtgcccaagtctgtgaccctgggcaccgtggtgggcagcagcaagttccgcagcaaggagcgggtgcctgtgctgagctacctgtacaaggaaaataatgctgccatctgccgctgcagccagcccctgagcggcttctacacccgctgtgtggatgatgagctgctgctggaggccatcagccagaccaaccctggcagccagttcatgtatgtggtggacacccggcccaagctgaatgccatggccaacagagctgctgggaagggctatgaaaatgaagacaactatgccaacatccgcttccgcttcatgggcatcgagaacatccacgtgatgaggagcagcctgcagaagctgctggaggtgtgtgagctgaagacccccaccatgtctgagttcctgagcggcctggagagcagcggctggctgcggcacatcaaggccatcatggatgctggcatcttcatcaccaaggctgtgaaggtggagaaggcctctgtgctggtgcactgcagtgatggctgggacagaacagcccaggtgtgcagcgtggccagcatcctgctggaccccttctaccgcaccttcaagggcctgatgatcctgattgagaaggagtggatctccatgggccacaagttcagccagagatgtggccacctggatggagacagcaaggaggtgagccccatcttcacccagttcctggactgcatctggcagctgatggagcagttcccctgtgcctttgagttcaatgaaaacttcctgctggagatccatgaccacgtgttcagctgccagtttggaaacttcctgggcaactgccagaaggaccgggaggacctgcgggtgtatgagaagacccacagcgtgtggcccttcctggtgcagaggaagccagacttcaggaaccccctgtacaagggcttcaccatgtatggagtgctgaaccccagcacagtgccctacaacatccagttctggtgtggcatgtacaacagatttgataaaggcctgcagcccaagcagagcatgctggagagcctgctggagatcaagaagcagagggccatgctggagacagatgtgcatgagctggagaagaagctgaaggtgagagatgagcccccagaggagatctgcacctgcagccagctgggcaacatcctgagccagcacctgggcagccccctgaccaaccccctgggcttcatgggcatcaacggggacctgaacaccctgatggagaatggcaccctgagccgggagggcggcctgcgggcccagatggaccaggtgaagagccagggcgctgacctgcaccacaactgctgtgaaattgtgggcagcctgcgggccatcaacatctctggagatgtgggcatcagcgaggccatgggcatcagcggggacatgtgcacctttgaggccaccggcttcagcaaggacctgggcatctgtggggccatggacatcagcgaggccaccggcatcagcggcaacctgggcatcagcgaggcccggggcttcagcggggacatgggcatcctgggggacaccggcatcagcaaggccagcaccaaggaggccgactacagcaagcaccagtag

SEQ ID NO: 160991 - DNA, 1527 bp, Artificial Sequence
  Description of Artificial Sequence: Synthetic coding sequence
tgagattctgacctggtgtgccacgaggtgtacatcagcctgctgaagctgagccagcctgccctgcctgaggacctgtatgccttctcctacaaccccaagagcagcaaggagatgagggagagcggctggaagctgattgaccccatcagtgactttggaaggatgggcatccccaacagaaactggaccatcacagatgccaacatccgcttccgcttcatgggcatcgagaacatccacgtgatgaggagcagcctgcagaagctgctggaggtgtgtgagctgaagacccccaccatgtctgagttcctgagcggcctggagagcagcggctggctgcggcacatcaaggccatcatggatgctggcatcttcatcaccaaggctgtgaaggtggagaaggcctctgtgctggtgcactgcagtgatggctgggacagaacagcccaggtgtgcagcgtggccagcatcctgctggaccccttctaccgcaccttcaagggcctgatgatcctgattgagaaggagtggatctccatgggccacaagttcagccagagatgtggccacctggatggagacagcaaggaggtgagccccatcttcacccagttcctggactgcatctggcagctgatggagcagttcccctgtgcctttgagttcaatgaaaacttcctgctggagatccatgaccacgtgttcagctgccagtttggaaacttcctgggcaactgccagaaggaccgggaggacctgcgggtgtatgagaagacccacagcgtgtggcccttcctggtgcagaggaagccagacttcaggaaccccctgtacaagggcttcaccatgtatggagtgctgaaccccagcacagtgccctacaacatccagttctggtgtggcatgtacaacagatttgataaaggcctgcagcccaagcagagcatgctggagagcctgctggagatcaagaagcagagggccatgctggagacagatgtgcatgagctggagaagaagctgaaggtgagagatgagcccccagaggagatctgcacctgcagccagctgggcaacatcctgagccagcacctgggcagccccctgaccaaccccctgggcttcatgggcatcaacggggacctgaacaccctgatggagaatggcaccctgagccgggagggcggcctgcgggcccagatggaccaggtgaagagccagggcgctgacctgcaccacaactgctgtgaaattgtgggcagcctgcgggccatcaacatctctggagatgtgggcatcagcgaggccatgggcatcagcggggacatgtgcacctttgaggccaccggcttcagcaaggacctgggcatctgtggggccatggacatcagcgaggccaccggcatcagcggcaacctgggcatcagcgaggcccggggcttcagcggggacatgggcatcctgggggacaccggcatcagcaaggccagcaccaaggaggccgactacagcaagcaccagtag

SEQ ID NO: 160992 - DNA, 2082 bp, Artificial Sequence
  Description of Artificial Sequence: Synthetic coding sequence
atggaccacatcaccgtgcccaaggtggagaatgtgaagctggtggaccgctacgtgtccaagaagccagccaacggcatcctgtacctgacagccacccacctgatctacgtggaggccagcggggccgccaggaaggagacctggatcgccctgcaccacatcgccaccgtggagaagctgcccatcaccagcctgggctgccccctgaccctgcgctgcaagaacttccgggtggcccactttgtgctggacagcgacctggtgtgccacgaggtgtacatcagcctgctgaagctgagccagcctgccctgcctgaggacctgtatgccttctcctacaaccccaagagcagcaaggagatgagggagagcggctggaagctgattgaccccatcagtgactttggccgcatgggcatccccaacagaaactggaccatcacagatgccaacagaaattatgagatctgcagcacctacccacctgagatcgtggtgcccaagtctgtgaccctgggcaccgtggtgggcagcagcaagttccgcagcaaggagcgggtgcctgtgctgagctacctgtacaaggaaaataatgctgccatctgccgctgcagccagcccctgagcggcttctacacccgctgtgtggatgatgagctgctgctggaggccatcagccagaccaaccctggcagccagttcatgtatgtggtggacacccggcccaagctgaatgccatggccaacagagctgctgggaagggctatgaaaatgaagacaactatgccaacatccgcttccgcttcatgggcatcgagaacatccacgtgatgaggagcagcctgcagaagctgctggaggtgtgtgagctgaagacccccaccatgtctgagttcctgagcggcctggagagcagcggctggctgcggcacatcaaggccatcatggatgctggcatcttcatcaccaaggctgtgaaggtggagaaggcctctgtgctggtgcactgcagtgatggctgggacagaacagcccaggtgtgcagcgtggccagcatcctgctggaccccttctaccgcaccttcaagggcctgatgatctggcacttcctggtgctgatcatgagaattgtgctgcagctggccaagatgaacctgatggacatcaccaagatcttcagcctgctgcagcctgacaaggaggaggaggacacagacacagaggagaagcaggccctgaaccaggccgtgtatgacaatgacagctacaccctggaccagctgctgcggcaggagcgctacaagcgcttcatcaacagccgcagcggctggggcgtgcccggcacccccctgcggctggccgccagctatggccacctgagctgcctgcaggtgctgctggcccacggggctgatgtggacagcctggatgtgaaggcccagacccccctcttcaccgctgtgagccacggccacctggactgtgtgcgggtgctgctggaggccggggccagccctgggggcagcatctacaacaactgcagccctgtgctgacagctgccagagatggagctgtggccatcctgcaggagctgctggaccacggggctgaggccaacgtgaaggccaagctgcctgtgtgggccagcaacatcgccagctgcagcggccccctgtacctggccgctgtgtatggccacctggactgcttccggctgctgctgctgcacggggctgaccctgactacaactgcacagaccagggcctgctggcccgggtgccccggcccaggaccctgctggagatctgcctgcaccacaactgtgagcctgagtacatccagctgctgattgactttggagccaacatctacctgcccagcctgagcctggacctgaccagccaggatgacaagggcatcgccctgctgctgcaggcccgggccacccccaggagcctgctgagccaggtgcggctggtggtgcggcgggccctgtgccaggccggccagccccaggccatcaaccagctggacatcccccccatgctgatctcctacctgaagcaccagctgtag

SEQ ID NO: 160993 - DNA, 861 bp, Artificial Sequence
  Description of Artificial Sequence: Synthetic coding sequence
atgggcggggagaggtctggagtgcggggcaacaagatggctgctgctgagcccagccccaggagagtgggctttgtgggcgccggccgcatggccggggccatcgcccagggcctcatccgggccggcaaggtggaggcccagcacatcctggccagcgcccccacagacaggaacctgtgccacttccaggccctgggctgcaggaccacccacagcaaccaggaggtgctgcagagctgcctgctggtgatctttgccaccaagccccacgtgctgcctgctgtgctggccgaggtggcccctgtggtgaccacagagcacatcctggtgtctgtggccgccggcgtgtccctgagcaccctggaggagctgctgccccccaacaccagggtgctgcgggtgctgcccaacctgccctgtgtggtgcaggagggcgccatcgtgatggcccggggcagacatgtgggcagcagcgagaccaagctgctgcagcacctgctggaggcctgtggccgctgtgaggaggtgcctgaggcctacgtggacatccacacaggcctgagcggcagcggcgtggcctttgtgtgtgccttcagcgaggccctggccgagggcgctgtgaagatgggcatgcccagcagcctggcccacagaattgctgcccagaccctgctgggcacagccaagatgctgctgcacgagggccagcacccagcccagctgcggagtgatgtgtgcaccccaggcggcaccaccatctacggcctgcacgccctggagcagggcggcctgcgggccgccaccatgtctgctgtggaggccgccacctgccgggccaaggagctgagcaggaagtag

SEQ ID NO: 160994 - DNA, 900 bp, Artificial Sequence
  Description of Artificial Sequence: Synthetic coding sequence
atgcccctgagcggcaccccagcccccaacaagaagaggaagagcagcaagctgatcatggagctgactggaggcggccaggagagcagcggcctgaacctgggcaagaagatctctgtgcccagagatgtgatgctggaggagctgagcctgctgaccaacagaggcagcaagatgttcaagctgcggcagatgagggtggagaagttcatctatgagaaccacccagatgtgttcagtgacagctccatggaccacttccagaagttcctgcccaccgtgggcggccagctgggcacagctggccagggcttctcctacagcaagagcaatggccggggcggcagccaggccggcggcagcggcagcgctggccagtatggcagtgaccagcagcaccacctgggcagcggcagcggggccggcggcaccggcggccctgctggccaggccggccggggcggcgctgctggaacagctggggtgggggagactggaagtggggaccaggccggcggggagggcaagcacatcaccgtcttcaagacctacatcagcccctgggagcgggccatgggcgtggacccccagcagaagatggagctgggcatcgacctgctggcctatggagccaaggccgagctgcccaagtacaagagcttcaacagaacagccatgccctacggcggctatgagaaggccagcaagaggatgaccttccagatgcccaagtttgacctgggccccctgctgtctgagcccctggtgctgtacaaccagaacctgagcaaccggcccagcttcaacagaacacccatcccctggctgagcagcggggagcctgtggactacaacgtggacatcggcatccccctggatggagaaacagaggagctgtag

SEQ ID NO: 160995 - DNA, 795 bp, Artificial Sequence
  Description of Artificial Sequence: Synthetic coding sequence
atgctgagccacaacaccatgatgaagcagaggaagcagcaggccacagccatcatgaaggaggtgcatggaaatgatgtggatggcatggacctgggcaagaaggtgtccatcccccgggacatcatgctggaggagctgagccacctgagcaacagaggagcccggctcttcaagatgaggcagaggagaagtgacaagtacacctttgagaacttccagtaccagagccgggcccagatcaaccacagcatcgccatgcagaatggcaaggtggatggcagcaacctggagggcggcagccagcaggcccccctgaccccacccaacaccccagaccccaggagcccccccaacccagacaacatcgcccctggctacagcggccccctgaaggagatccccccagagaagttcaacaccacagctgtgcccaagtactaccagagcccctgggagcaggccatcagcaatgaccctgagctgctggaggccctgtaccccaagctgttcaagccagagggcaaggccgagctgcctgactaccgctccttcaacagagtggccaccccatttggaggctttgagaaggccagcaggatggtgaagttcaaggtgcctgactttgagctgctgctgctgacagacccccgcttcatgagctttgtgaaccccctgtctggaagaagaagcttcaacagaacacccaagggctggatcagcgagaacatccccatcgtcatcaccacagagcccacagatgacaccaccgtgcctgagagcgaggacctgtag

SEQ ID NO: 160996 - DNA, 756 bp, Artificial Sequence
  Description of Artificial Sequence: Synthetic coding sequence
atgatccccaaggagcagaagggccctgtgatggccgccatgggagacctgacagagcctgtgcccaccctggacctgggcaagaagctgtctgtgccccaggacctgatgatggaggagctgagcctgaggaacaacagaggcagcctgctcttccagaagaggcagaggagagtgcagaagttcacctttgagctggccgccagccagagggccatgctggccggcagcgcccggaggaaggtgactggaacagctgagagcggcaccgtggccaatgccaatggacctgagggccccaactacagaagtgagctgcacatcttccctgccagccctggggccagcctgggcggccctgagggcgcccaccctgctgctgccccagctggctgtgtgcccagccccagcgccctggcccctggctacgccgagcccctgaagggcgtgcccccagagaagttcaaccacacagccatcagcaagggctaccgctgcccctggcaggagtttgtgtcctacagagactaccagagtgatggccgcagccacacccccagccccaatgactacagaaacttcaacaagacccctgtgccctttggaggccccctggtgggcggcaccttccccaggcctggcacccccttcatccctgagcccctgagcggcctggagctgctgcggctgcggcccagcttcaacagagtggcccagggctgggtgaggaacctgcctgagagcgaggagctgtag

SEQ ID NO: 160997 - DNA, 756 bp, Artificial Sequence; identical to SEQ ID NO: 160996
  Description of Artificial Sequence: Synthetic coding sequence

SEQ ID NO: 160998 - DNA, 1989 bp, Artificial Sequence
  Description of Artificial Sequence: Synthetic coding sequence
atggtggtgtctgaggtggacatcgccaaggctgaccctgctgctgccagccaccccctgctgctgaatggagatgccaccgtggcccagaagaaccctggctctgtggccgagaacaacctgtgcagccagtatgaggagaaggtgcggccctgcatcgacctgattgacagcctgcgggccctgggcgtggagcaggacctggccctgcctgccatcgccgtcatcggggaccagagcagcggcaagagctctgtgctggaggccctgtctggagtggccctgccccggggcagcggcatcgtgacccgctgccccctggtgctgaagctgaagaagctggtgaatgaagacaagtggaggggcaaggtgtcctaccaggactatgaaattgagatcagtgatgccagcgaggtggagaaggagatcaacaaggcccagaatgccatcgccggggagggcatgggcatcagccatgagctgatcaccctggagatcagcagcagagatgtgcctgacctgaccctgattgacctgcccggcatcaccagggtggccgtgggcaaccagcctgctgacatcggctacaagatcaagaccctcatcaagaagtacatccagaggcaggagaccatcagcctggtggtggtgcccagcaatgtggacatcgccaccacagaggccctgtccatggcccaggaggtggaccctgagggggacaggaccatcggcatcctgaccaagccagacctggtggacaagggcacagaggacaaggtggtggatgtggtgaggaacctggtgttccacctgaagaagggctacatgattgtgaagtgccggggccagcaggagatccaggaccagctgagcctgtctgaggccctgcagcgggagaagatcttctttgagaaccacccctacttccgggacctgctggaggagggcaaggccaccgtgccctgcctggccgagaagctgaccagcgagctgatcacccacatctgcaagagcctgcccctgctggagaaccagatcaaggagacccaccagaggatcacagaggagctgcagaagtatggagtggacatcccagaagatgaaaatgagaagatgttcttcctgattgacaaggtgaatgccttcaaccaggacatcacagccctgatgcagggcgaggagaccgtgggggaggaggacatccgcctcttcacccggctgcggcatgagttccacaagtggagcaccatcatcgagaacaacttccaggagggccacaagatcctgagcaggaagatccagaagtttgagaaccagtaccggggccgggagctgcccggctttgtgaactaccgcacctttgagaccatcgtgaagcagcagatcaaggccctggaggagcctgctgtggacatgctgcacacagtgacagacatggtgcggctggccttcacagatgtgtccatcaagaactttgaggagttcttcaacctgcacaggacagccaagagcaagattgaggacatccgggcagagcaggagcgggagggggagaagctgatccggctgcacttccagatggagcagatcgtgtactgccaggaccaggtgtacagaggagccctgcagaaggtgcgggagaaggagctggaggaggagaagaagaagaagtcctgggactttggagccttccagagcagcagcgccacagacagctccatggaggagatcttccagcacctgatggcctaccaccaggaggccagcaagaggatcagcagccacatccccctcatcatccagttcttcatgctgcagacctacggccagcagctgcagaaggccatgctgcagctgctgcaggacaaggacacctacagctggctgctgaaggagaggagtgacaccagtgacaagaggaagttcctgaaggagcggctggcccggctgacccaggcccggcggcggctggcccagtttcctggatag

SEQ ID NO: 160999 - DNA, 1989 bp, Artificial Sequence; identical to SEQ ID NO: 160998
  Description of Artificial Sequence: Synthetic coding sequence

SEQ ID NO: 161000 - DNA, 207 bp, Artificial Sequence
  Description of Artificial Sequence: Synthetic coding sequence
atggtggtgtctgaggtggacatcgccaaggctgaccctgctgctgccagccaccccctgctgctgaatggagatgccaccgtggcccagaagaaccctggctctgtggccgagaacaacctgtgcagccagtatgaggagaaggtgcggccctgcatcgacctgattgacagcctgcgggccctgggcgtggagcaggacctgtag

SEQ ID NO: 161001 - DNA, 606 bp, Artificial Sequence
  Description of Artificial Sequence: Synthetic coding sequence
atggtggtgtctgaggtggacatcgccaaggctgaccctgctgctgccagccaccccctgctgctgaatggagatgccaccgtggcccagaagaaccctggctctgtggccgagaacaacctgtgcagccagtatgaggagaaggtgcggccctgcatcgacctgattgacagcctgcgggccctgggcgtggagcaggacctggccctgcctgccatcgccgtcatcggggaccagagcagcggcaagagctctgtgctggaggccctgtctggagtggccctgccccggggcagcggcatcgtgacccgctgccccctggtgctgaagctgaagaagctggtgaatgaagacaagtggaggggcaaggtgtcctaccaggactatgaaattgagatcagtgatgccagcgaggtggagaaggagatcaacaaggcccagaatgccatcgccggggagggcatgggcatcagccatgagctgatcaccctggagatcagcagcagagatgtgcctgacctgaccctgattgacctgcccggcatcaccagggtggccgtgggcaaccagcctgctgacatcggctacaagatcaagaccctgtag

SEQ ID NO: 161002 - DNA, 81 bp, Artificial Sequence
  Description of Artificial Sequence: Synthetic coding sequence
atggtggtgtctgaggtggacatcgccaaggctgaccctgctgctgccagccaccccctgctgctgaatggagatgcctag

SEQ ID NO: 161003 - DNA, 594 bp, Artificial Sequence
  Description of Artificial Sequence: Synthetic coding sequence
atggtggtgtctgaggtggacatcgccaaggctgaccctgctgctgccagccaccccctgctgctgaatggagatgccaccgtggcccagaagaaccctggctctgtggccgagaacaacctgtgcagccagtatgaggagaaggtgcggccctgcatcgacctgattgacagcctgcgggccctgggcgtggagcaggacctggccctgcctgccatcgccgtcatcggggaccagagcagcggcaagagctctgtgctggaggccctgtctggagtggccctgccccggggcagcggcatcgtgacccgctgccccctggtgctgaagctgaagaagctggtgaatgaagacaagtggaggggcaaggtgtcctaccaggactatgaaattgagatcagtgatgccagcgaggtggagaaggagatcaacaaggcccagaatgccatcgccggggagggcatgggcatcagccatgagctgatcaccctggagatcagcagcagagatgtgcctgacctgaccctgattgacctgcccggcatcaccagggtggccgtgggcaaccagcctgctgacatcggctacaagtag

SEQ ID NO: 161004 - DNA, 108 bp, Artificial Sequence
  Description of Artificial Sequence: Synthetic coding sequence
atggtggtgtctgaggtggacatcgccaaggctgaccctgctgctgccagccaccccctgctgctgaatggagatgccaccgtggcccagaagaaccctggcagctag

SEQ ID NO: 161005 - DNA, 234 bp, Artificial Sequence
  Description of Artificial Sequence: Synthetic coding sequence
atggtggtgtctgaggtggacatcgccaaggctgaccctgctgctgccagccaccccctgctgctgaatggagatgccaccgtggcccagaagaaccctggctctgtggccgagaacaacctgtgcagccagtatgaggagaaggtgcggccctgcatcgacctgattgacagcctgcgggccctgggcgtggagcaggacctggccctgcctgccatcgccgtcatcggctag

SEQ ID NO: 161006 - DNA, 1989 bp, Artificial Sequence; identical to SEQ ID NO: 160998
  Description of Artificial Sequence: Synthetic coding sequence

SEQ ID NO: 161007 - DNA, 2148 bp, Artificial Sequence
  Description of Artificial Sequence: Synthetic coding sequence
atgagcaaggcccacaagccctggccctacagaagaagaagccagttcagcagcaggaagtacctgaagaaggagatgaacagcttccagcagcagcccccacccttcggcaccgtgcccccccagatgatgttcccccccaactggcagggcgctgagaaggatgctgccttcctggccaaggacttcaacttcctgaccctgaacaaccagcccccacctggcaacagaagccagccccgggccatgggccctgagaacaacctgtacagccagtatgagcagaaggtgcggccctgcatcgacctgattgacagcctgcgggccctgggcgtggagcaggacctggccctgcctgccatcgccgtcatcggggaccagagcagcggcaagagctctgtgctggaggccctgtctggagtggccctgccccggggcagcggcatcgtgacccgctgccccctggtgctgaagctgaagaagcagccctgtgaggcctgggccggccgcatctcctacagaaacacagagctggagctgcaggaccccggccaggtggagaaggagatccacaaggcccagaatgtgatggctggaaatggccggggcatcagccatgagctgatcagcctggagatcaccagccctgaggtgcctgacctgaccatcatcgacctgcccggcatcaccagggtggccgtggacaaccagccccgggacatcggcctgcagatcaaggccctgatcaagaagtacatccagaggcagcagaccatcaacctggtggtggtgccctgcaatgtggacatcgccaccacagaggccctgtccatggcccacgaggtggaccctgagggggacaggaccatcggcatcctgaccaagccagacctgatggaccggggcacagagaagtctgtgatgaatgtggtgaggaacctgacctaccccctgaagaagggctacatgattgtgaagtgccggggccagcaggagatcaccaaccggctgagcctggccgaggccaccaagaaggagatcaccttcttccagacccacccctacttccgggtgctgctggaggagggcagcgccaccgtgccccggctggccgagcggctgaccacagagctgatcatgcacatccagaagagcctgcccctgctggagggccagatccgggagagccaccagaaggccacagaggagctgcggcgctgtggggctgacatccccagccaggaggccgacaagatgttcttcctgattgagaagatcaagatgttcaaccaggacatcgagaagctggtggagggggaggaggtggtgagagaaaatgagacccggctgtacaacaagatccgggaggacttcaagaactgggtgggcatcctggccaccaacacccagaaggtgaagaacatcatccacgaggaggtggagaagtatgagaagcagtaccggggcaaggagctgctgggctttgtgaactacaagacctttgagatcatcgtgcaccagtacatccagcagctggtggagcccgccctgtccatgctgcagaaggccatggagatcatccagcaggccttcatcaacgtggccaagaagcactttggagagttcttcaacctgaaccagacagtgcagagcaccatcgaggacatcaaggtgaagcacacagccaaggccgagaacatgatccagctgcagttcaggatggagcagatggtgttctgccaggaccagatctacagcgtggtgctgaagaaggtgcgggaggagatcttcaaccccctgggcacccccagccagaacatgaagctgaacagccacttccccagcaatgaatcttctgtgagcagcttcacagagatcggcatccacctgaatgcctacttcctggagaccagcaagaggctggccaaccagatccccttcatcatccagtacttcatgctgcgggagaatggagacagcctgcagaaggccatgatgcagatcctgcaggagaagaaccgctacagctggctgctgcaggagcagagcgagacagccaccaagaggcgcatcctgaaggagcgcatctaccgcctgacccaggcccggcatgccctgtgccagttcagcagcaaggagatccactag

SEQ ID NO: 161008 - DNA, 45 bp, Artificial Sequence; identical to SEQ ID NO: 90212
  Description of Artificial Sequence: Synthetic coding sequence

SEQ ID NO: 161009 - DNA, 405 bp, Artificial Sequence
  Description of Artificial Sequence: Synthetic coding sequence
atgagcaaggcccacaagccctggccctacagaagaagaagccagttcagcagcaggaagtacctgaagaaggagatgaacagcttccagcagcagcccccacccttcggcaccgtgcccccccagatgatgttcccccccaactggcagggcgctgagaaggatgctgccttcctggccaaggacttcaacttcctgaccctgaacaaccagcccccacctggcaacagaagccagccccgggccatgggccctgagaacaacctgtacagccagtatgagcagaaggtgcggccctgcatcgacctgattgacagcctgcgggccctgggcgtggagcaggacctggccctgcctgccatcgccgtcatcggggaccagagcagcggcaagagctctgtgtag

SEQ ID NO: 161010 - DNA, 378 bp, Artificial Sequence
  Description of Artificial Sequence: Synthetic coding sequence
atgagcaaggcccacaagccctggccctacagaagaagaagccagttcagcagcaggaagtacctgaagaaggagatgaacagcttccagcagcagcccccacccttcggcaccgtgcccccccagatgatgttcccccccaactggcagggcgctgagaaggatgctgccttcctggccaaggacttcaacttcctgaccctgaacaaccagcccccacctggcaacagaagccagccccgggccatgggccctgagaacaacctgtacagccagtatgagcagaaggtgcggccctgcatcgacctgattgacagcctgcgggccctgggcgtggagcaggacctggccctgcctgccatcgccgtcatcggctag

SEQ ID NO: 161011 - DNA, 390 bp, Artificial Sequence
  Description of Artificial Sequence: Synthetic coding sequence
atgagcaaggcccacaagccctggccctacagaagaagaagccagttcagcagcaggaagtacctgaagaaggagatgaacagcttccagcagcagcccccacccttcggcaccgtgcccccccagatgatgttcccccccaactggcagggcgctgagaaggatgctgccttcctggccaaggacttcaacttcctgaccctgaacaaccagcccccacctggcaacagaagccagccccgggccatgggccctgagaacaacctgtacagccagtatgagcagaaggtgcggccctgcatcgacctgattgacagcctgcgggccctgggcgtggagcaggacctggccctgcctgccatcgccgtcatcggggaccagagcagctag

SEQ ID NO: 161012 - DNA, 606 bp, Artificial Sequence
  Description of Artificial Sequence: Synthetic coding sequence
atgagcaaggcccacaagccctggccctacagaagaagaagccagttcagcagcaggaagtacctgaagaaggagatgaacagcttccagcagcagcccccacccttcggcaccgtgcccccccagatgatgttcccccccaactggcagggcgctgagaaggatgctgccttcctggccaaggacttcaacttcctgaccctgaacaaccagcccccacctggcaacagaagccagccccgggccatgggccctgagaacaacctgtacagccagtatgagcagaaggtgcggccctgcatcgacctgattgacagcctgcgggccctgggcgtggagcaggacctggccctgcctgccatcgccgtcatcggggaccagagcagcggcaagagctctgtgctggaggccctgtctggagtggccctgccccggggcagcgcccagaatgtgatggctggaaatggccggggcatcagccatgagctgatcagcctggagatcaccagccctgaggtgcctgacctgaccatcatcgacctgcccggcatcaccagggtggccgtggacaaccagccccgggacatcggcctgcaggtgtcctag

SEQ ID NO: 161013 - DNA, 663 bp, Artificial Sequence
  Description of Artificial Sequence: Synthetic coding sequence
atgaacatcagaaatgcccggcctgaggacctgatgaacatgcagcactgcaacctgctgtgcctgcctgagaactaccagatgaagtactacttctaccacggcctgtcctggccccagctgagctacatcgccgaggatgaaaatggcaagatcgtgggctacgtgctggccaagatggaggaggaccctgatgatgtgccccacggccacatcaccagcctggccgtgaagaggagccaccggcggctgggcctggcccagaagctgatggaccaggccagccgggccatgattgagaacttcaatgccaagtatgtgtccctgcacgtgaggaagaggatcagcgaggtggagcccaagtactatgcagatggagaagatgcctatgccatgaagagggacctgacccagatggctgatgagctgcggcggcacctggagctgaaggagaagggcagacatgtggtgctgggcgccatcgagaacaaggtggagagcaagggcaacagcccccccagcagtggagaggcctgccgggaggagaagggcctggccgctgaggacagcggcggggacagcaaggacctgtctgaggtgtctgagaccacagagagcacagatgtgaaggacagcagcgaggccagtgacagcgccagctag

SEQ ID NO: 161014 - DNA, 708 bp, Artificial Sequence
  Description of Artificial Sequence: Synthetic coding sequence
atgaacatcagaaatgcccggcctgaggacctgatgaacatgcagcactgcaacctgctgtgcctgcctgagaactaccagatgaagtactacttctaccacggcctgtcctggccccagctgagctacatcgccgaggatgaaaatggcaagatcgtgggctacgtgctggccaagatggaggaggaccctgatgatgtgccccacggccacatcaccagcctggccgtgaagaggagccaccggcggctgggcctggcccagaagctgatggaccaggccagccgggccatgattgagaacttcaatgccaagtatgtgtccctgcacgtgaggaagagcaacagagctgccctgcacctgtacagcaacaccctgaacttccagatcagcgaggtggagcccaagtactatgcagatggagaagatgcctatgccatgaagagggacctgacccagatggctgatgagctgcggcggcacctggagctgaaggagaagggccgccacgtggtgctgggcgccatcgagaacaaggtggagagcaaaggaaacagcccccccagcagcggggaggcctgccgggaggagaagggcctggccgcagaagattctggaggagacagcaaggacctgtctgaggtgtctgagaccacagagagcacagatgtgaaggacagcagcgaggccagtgacagcgccagctag

SEQ ID NO: 161015 - DNA, 396 bp, Artificial Sequence
  Description of Artificial Sequence: Synthetic coding sequence
atgaacatcagaaatgcccggcctgaggacctgatgaacatgcagcactgcaacctgctgtgcctgcctgagaactaccagatgaagtactacttctaccacggcctgtcctggccccagctgagctacatcgccgaggatgaaaatggcaagatcgtgggctacgtgctggccaagatggaggaggaccctgatgatgtgccccacggccacatcaccagcctggccgtgaagaggagccaccggcggctgggcctggcccagaagctgatggaccaggccagccgggccatgattgagaacttcaatgccaagtatgtgtccctgcacgtgaggaagaggtctgtgaagtggagccccaacaccatgcagatgggccgcacccccatgccctag

SEQ ID NO: 161016 - DNA, 534 bp, Artificial Sequence
  Description of Artificial Sequence: Synthetic coding sequence
atgattgtggccgagatcaagaacagaaccaagatccacaaggaggatggagacatcctggccagcaacttctctgtggacacccaggtggcctacatcctgagcctgggcgtggtgaaggagttcaggaagcatggaattggcagcctgctgctggagagcctgaaggaccacatcagcaccacagcccaggaccactgcaaggccatctacctgcacgtgctgaccaccaacaacacagccatcaacttctatgagaacagagacttcaagcagcaccactacctgccctactactacagcatccggggcgtgctgaaggatggcttcacctacgtgctgtacatcaatggaggccaccccccctggaccatcctggactacatccagcacctgggcagcgccctggccagcctgagcccctgcagcatcccccaccgggtgtaccggcaggcccacagcctgctgtgcagcttcctgccctggagcggcatcagcagcaagtctggaattgagtacagcaggaccatgtag

SEQ ID NO: 161017 - DNA, 729 bp, Artificial Sequence
  Description of Artificial Sequence: Synthetic coding sequence
atgacagaggtggtgcccagcagcgccctgtctgaggtgtccctgcggctgctgtgccatgatgacatcgacacagtgaagcacctgtgtggggactggttccccatcgagtacccagacagctggtacagagacatcaccagcaacaagaagttcttcagcctggccgccacctacagaggagccatcgtgggcatgattgtggccgagatcaagaacagaaccaagatccacaaggaggatggagacatcctggccagcaacttctctgtggacacccaggtggcctacatcctgagcctgggcgtggtgaaggagttcaggaagcacggcatcggcagcctgctgctggagagcctgaaggaccacatcagcaccacagcccaggaccactgcaaggccatctacctgcacgtgctgaccaccaacaacacagccatcaacttctatgaaaatagagacttcaagcagcaccactacctgccctactactacagcatccggggcgtgctgaaggatggcttcacctacgtgctgtacatcaatggaggccaccccccctggaccatcctggactacatccagcacctgggcagcgccctggccagcctgagcccctgcagcatcccccaccgggtgtaccggcaggcccacagcctgctgtgcagcttcctgccctggagcggcatcagcagcaagagcggcatcgagtacagcaggaccatgtag

SEQ ID NO: 161018 - DNA, 729 bp, Artificial Sequence; identical to SEQ ID NO: 161017
  Description of Artificial Sequence: Synthetic coding sequence

SEQ ID NO: 161019 - DNA, 573 bp, Artificial Sequence
  Description of Artificial Sequence: Synthetic coding sequence
atgacagaggtggtgcccagcagcgccctgtctgaggtgtccctgcggctgctgtgccatgatgacatcgacacagtgaagcacctgtgtggggactggttccccatcgagtacccagacagctggtacagagacatcaccagcaacaagaagttcttcagcctggccgccacctacagaggagccatcgtgggcatgattgtggccgagatcaagaacagaaccaagatccacaaggaggatggagacatcctggccagcaacttctctgtggacacccaggtggcctacatcctgagcctgggcgtggtgaaggagttcaggaagcacggcatcgagccccacggcctgcacccagcccctggcctgtgcaccagccagcctgagcccctgctgcacagcgcccagagcctgcccccaggcccccagcctgccctgcagctgcctgccatggtgggccacctgttccaggagtggcaccgggtgcagcctgaccacgtgatgtctgctggccagcccccacctggccccaccctgcggcccccagctgagcccgccttcctgagcatctag

SEQ ID NO: 161020 - DNA, 750 bp, Artificial Sequence
  Description of Artificial Sequence: Synthetic coding sequence
atgttccccaggagaagaacagaaagaaggctgggggacaccggcaccaggaagaagatcgcctacaggaaggctgtgcctgggggcaggaaatgtggggccagcctgtcctgggagaagagcagccgggagtacccagacagctggtacagagacatcaccagcaacaagaagttcttcagcctggccgccacctacagaggagccatcgtgggcatgattgtggccgagatcaagaacagaaccaagatccacaaggaggatggagacatcctggccagcaacttctctgtggacacccaggtggcctacatcctgagcctgggcgtggtgaaggagttcaggaagcatggaattggcagcctgctgctggagagcctgaaggaccacatcagcaccacagcccaggaccactgcaaggccatctacctgcacgtgctgaccaccaacaacacagccatcaacttctatgagaacagagacttcaagcagcaccactacctgccctactactacagcatccggggcgtgctgaaggatggcttcacctacgtgctgtacatcaatggaggccaccccccctggaccatcctggactacatccagcacctgggcagcgccctggccagcctgagcccctgcagcatcccccaccgggtgtaccggcaggcccacagcctgctgtgcagcttcctgccctggagcggcatcagcagcaagtctggaattgagtacagcaggaccatgtag

SEQ ID NO: 161021 - DNA, 492 bp, Artificial Sequence
  Description of Artificial Sequence: Synthetic coding sequence
atggccgtcatcctgggcatcttcggcaccgtgcagtaccgcagccgctacctgatcctgtatgctgcctggctggtgctgtgggtgggctggaatgccttcatcatctgcttctacctggaggtgggccagctgagccaggaccgggacttcatcatgaccttcaacaccagcctgcaccgctcctggtggatggagaatggacctggctgcctggtgacccctgtgctgaacagccggctggccctggaggaccaccacgtgatctctgtgacaggctgcctgctggactacccctacatcgaggccctgagcagcgccctgcagatcttcctggccctgtttggatttgtgtttgcctgctacgtgtccaaggtgttcctggaggaggaggacagctttgacttcatcggcggctttgacagctatggctaccaggccccccagaagaccagccacctgcagctgcagcccctgtacaccagcggctag

SEQ ID NO: 161022 - DNA, 624 bp, Artificial Sequence
  Description of Artificial Sequence: Synthetic coding sequence
atgggcaaatgttctggccgctgcaccctggtggccttctgctgcctgcagctggtggccgccctggagcggcagatctttgacttcctgggctaccagtgggcccccatcctggccaacttcctgcacatcatggccgtcatcctgggcatcttcggcaccgtgcagtaccgcagccgctacctgatcctgtatgctgcctggctggtgctgtgggtgggctggaatgccttcatcatctgcttctacctggaggtgggccagctgagccaggaccgggacttcatcatgaccttcaacaccagcctgcaccgctcctggtggatggagaatggacctggctgcctggtgacccctgtgctgaacagccggctggccctggaggaccaccacgtgatctctgtgacaggctgcctgctggactacccctacatcgaggccctgagcagcgccctgcagatcttcctggccctgtttggatttgtgtttgcctgctacgtgtccaaggtgttcctggaggaggaggacagctttgacttcatcggcggctttgacagctatggctaccaggccccccagaagaccagccacctgcagctgcagcccctgtacaccagcggctag

SEQ ID NO: 161023 - DNA, 411 bp, Artificial Sequence
  Description of Artificial Sequence: Synthetic coding sequence
atggccgtcatcctgggcatcttcggcaccgtgcagtaccgcagccgctacctgatcctggaccgggacttcatcatgaccttcaacaccagcctgcaccgctcctggtggatggagaatggacctggctgcctggtgacccctgtgctgaacagccggctggccctggaggaccaccacgtgatctctgtgacaggctgcctgctggactacccctacatcgaggccctgagcagcgccctgcagatcttcctggccctgtttggatttgtgtttgcctgctacgtgtccaaggtgttcctggaggaggaggacagctttgacttcatcggcggctttgacagctatggctaccaggccccccagaagaccagccacctgcagctgcagcccctgtacaccagcggctag

SEQ ID NO: 161024 - DNA, 567 bp, Artificial Sequence
  Description of Artificial Sequence: Synthetic coding sequence
atgggctactgcagcggccgctgcaccctcatcttcatctgtggcatgcagctggtgtgtgtgctggagcggcagatctttgacttcctgggctaccagtgggcccccatcctggccaactttgtgcacatcatcatcgtcatcctgggcctgtttggcaccatccagtaccggccccgctacatcaccggctatgctgtgtggctggtgctgtgggtgacctggaatgtgtttgtgatctgcttctacctggaggccggggacctgagcaaggagacagacctgatcctgaccttcaacatctccatgcaccgctcctggtggatggagaatggacctggctgcaccgtgacctctgtgaccccagccccagactgggcccctgaggaccaccgctacatcaccgtgtctggctgcctgctggagtaccagtacatcgaggtggcccacagcagcctgcagatcgtgctggccgtgtctgtgggcagccagcccctgctgctggtgcccctgggcctcttctacttctgtgccaacagcgtgcacaccaacggcatctgtggctag

SEQ ID NO: 161025 - DNA, 627 bp, Artificial Sequence
  Description of Artificial Sequence: Synthetic coding sequence
atgggctactgcagcggccgctgcaccctcatcttcatctgtggcatgcagctggtgtgtgtgctggagcggcagatctttgacttcctgggctaccagtgggcccccatcctggccaactttgtgcacatcatcatcgtcatcctgggcctgtttggcaccatccagtaccggccccgctacatcaccggctatgctgtgtggctggtgctgtgggtgacctggaatgtgtttgtgatctgcttctacctggaggccggggacctgagcaaggagacagacctgatcctgaccttcaacatctccatgcaccgctcctggtggatggagaatggacctggctgcaccgtgacctctgtgaccccagccccagactgggcccctgaggaccaccgctacatcaccgtgtctggctgcctgctggagtaccagtacatcgaggtggcccacagcagcctgcagatcgtgctggccctggccggcttcatctatgcctgctacgtggtgaagtgcatcacagaggaggaggacagctttgacttcatcggcggctttgacagctatggctaccagggcccccagaagaccagccacctgcagctgcagcccatgtacatgagcaagtag

SEQ ID NO: 161026 - DNA, 624 bp, Artificial Sequence
  Description of Artificial Sequence: Synthetic coding sequence
atgggcatcatccgcttcctgctgctgtactgccccaccaacatcctgactgtgtgtgtgctggagcggcagatctttgacttcctgggctaccagtgggcccccatcctggccaactttgtgcacatcatcatcgtcatcctgggcctgtttggcaccatccagtaccggccccgctacatcaccggctatgctgtgtggctggtgctgtgggtgacctggaatgtgtttgtgatctgcttctacctggaggccggggacctgagcaaggagacagacctgatcctgaccttcaacatctccatgcaccgctcctggtggatggagaatggacctggctgcaccgtgacctctgtgaccccagccccagactgggcccctgaggaccaccgctacatcaccgtgtctggctgcctgctggagtaccagtacatcgaggtggcccacagcagcctgcagatcgtgctggccctggccggcttcatctatgcctgctacgtggtgaagtgcatcacagaggaggaggacagctttgacttcatcggcggctttgacagctatggctaccagggcccccagaagaccagccacctgcagctgcagcccatgtacatgagcaagtag

SEQ ID NO: 161027 - DNA, 576 bp, Artificial Sequence
  Description of Artificial Sequence: Synthetic coding sequence
atgaagatcgtgtgtgtgctggagcggcagatctttgacttcctgggctaccagtgggcccccatcctggccaactttgtgcacatcatcatcgtcatcctgggcctgtttggcaccatccagtaccggccccgctacatcaccggctatgctgtgtggctggtgctgtgggtgacctggaatgtgtttgtgatctgcttctacctggaggccggggacctgagcaaggagacagacctgatcctgaccttcaacatctccatgcaccgctcctggtggatggagaatggacctggctgcaccgtgacctctgtgaccccagccccagactgggcccctgaggaccaccgctacatcaccgtgtctggctgcctgctggagtaccagtacatcgaggtggcccacagcagcctgcagatcgtgctggccctggccggcttcatctatgcctgctacgtggtgaagtgcatcacagaggaggaggacagctttgacttcatcggcggctttgacagctatggctaccagggcccccagaagaccagccacctgcagctgcagcccatgtacatgtag

SEQ ID NO: 161028 - DNA, 420 bp, Artificial Sequence
  Description of Artificial Sequence: Synthetic coding sequence
atgggctactgcagcggccgctgcaccctcatcttcatctgtggcatgcagctggtgtgtgtgctggagcggcagatctttgacttcctgggctaccagtgggcccccatcctggccaactttgtgcacatcatcatcgtcatcctgggcctgtttggcaccatccagtaccggccccgctacatcaccggctatgctgtgtggctggtgctgtgggtgacctggaatgtgtttgtgatctgcttctacctggaggccggggacctgagcaagctggccggcttcatctatgcctgctacgtggtgaagtgcatcacagaggaggaggacagctttgacttcatcggcggctttgacagctatggctaccagggcccccagaagaccagccacctgcagctgcagcccatgtacatgtag

SEQ ID NO: 161029 - DNA, 594 bp, Artificial Sequence
  Description of Artificial Sequence: Synthetic coding sequence
atgggctgctgcaccggccgctgcagcctcatctgcctgtgtgccctgcagctggtgtctgccctggagcggcagatctttgacttcctgggcttccagtgggcccccatcctgggcaacttcctgcacatcatcgtggtgatcctgggcctgtttggcaccatccagtaccggccccgctacatcatggtgtacacagtgtggacagccctgtgggtgacctggaatgtgttcatcatctgcttctacctggaggtgggcggcctgagcaaggacacagacctgatgaccttcaacatctctgtgcaccgctcctggtggagggagcacggccctggctgtgtgcggcgggtgctgccccccagcgcccacggcatgatggatgactacacctacgtgtctgtgacaggctgcatcgtggacttccagtacctggaggtgatccacagcgctgtgcagatcctgctgagcctggtgggctttgtgtatgcctgctacgtgatcagcatctccatggaggaggaggacacctacagctgtgacctgcaggtgtgcaagcacctgttcatccagatgctgcagatcatcgagtag

SEQ ID NO: 161030 - DNA, 594 bp, Artificial Sequence; identical to SEQ ID NO: 161029
  Description of Artificial Sequence: Synthetic coding sequence

SEQ ID NO: 161031 - DNA, 486 bp, Artificial Sequence
  Description of Artificial Sequence: Synthetic coding sequence
atgggctgctgcaccggccgctgcagcctcatctgcctgtgtgccctgcagctggtgtcctgggtgtttgaccggcagatcttcctgctgtccttccagtgggcccccatcctgggcaacttcctgcacatcatcgtggtgatcctgggcctgtttggcaccatccagtaccggccccgctacatcatggtgtacacagtgtggacagccctgtgggtgacctggaatgtgttcatcatctgcttctacctggaggtgggcggcctgagcaaggacacagacctgatgaccttcaacatctctgtgcaccgctcctggtggagggagcacggccctggctgtgtgcggcgggtgctgccccccagcgcccacggcatgatggatgactacacctacgtgtctgtgacaggctgcatcgtggacttccagtacctggaggtgatccacagcgctgtgcagatcctgctgagcatcttcttcctgtag

SEQ ID NO: 161032 - DNA, 627 bp, Artificial Sequence
  Description of Artificial Sequence: Synthetic coding sequence
atgggcagctgcagcggccgctgtgccctggtggtgctgtgtgccttccagctggtggccgccctggagcggcaggtgtttgacttcctgggctaccagtgggcccccatcctggccaactttgtgcacatcatcatcgtcatcctgggcctgtttggcaccatccagtaccgcctgcgctacgtgatggtgtacaccctgtgggccgctgtgtgggtgacctggaatgtgttcatcatctgcttctacctggaggtgggcggcctgctgaaggacagcgagctgctgaccttcagcctgagccgccaccgctcctggtggagggagcgctggccaggctgcctgcacgaggaggtgcctgctgtgggcctgggcgccccccacggccaggccctggtgtctggggccggctgtgccctggagcccagctatgtggaggccctgcacagctgcctgcagatcctgattgccctgctgggctttgtgtgtggctgccaggtggtgtctgtgttcacagaggaggaggacagctttgacttcatcggcggctttgaccccttccccctgtaccacgtgaatgagaagcccagcagcctgctgagcaagcaggtgtacctgcctgcctag

SEQ ID NO: 161033 - DNA, 267 bp, Artificial Sequence
  Description of Artificial Sequence: Synthetic coding sequence
atggccgagagccggggccgcctgtacctgtggatgtgcctggccgccgccctggccagcttcctgatgggcttcatggtgggctggttcatcaagcccctgaaggagaccaccacctctgtgcgctaccaccagagcatccgctggaagctggtgtctgagatgaaggccgagaacatcaagagcttcctgcggagcttcaccaagctgccccacctggccggcacagagcagaacttcctgctggccaagaagatccagacctag

SEQ ID NO: 161034 - DNA, 2223 bp, Artificial Sequence
  Description of Artificial Sequence: Synthetic coding sequence
atggccgagagccggggccgcctgtacctgtggatgtgcctggccgccgccctggccagcttcctgatgggcttcatggtgggctggttcatcaagcccctgaaggagaccaccacctctgtgcgctaccaccagagcatccgctggaagctggtgtctgagatgaaggccgagaacatcaagagcttcctgcggagcttcaccaagctgccccacctggccggcacagagcagaacttcctgctggccaagaagatccagacccagtggaagaagtttggcctggacagcgccaagctggtgcactatgatgtgctgctgagctacccaaatgagaccaatgccaactacatcagcatcgtggatgagcacgagacagagatcttcaagaccagctacctggagcccccaccagatggctatgaaaatgtgaccaacatcgtgcccccctacaatgccttcagcgcccagggcatgcctgagggggacctggtgtatgtgaactatgccaggacagaggacttcttcaagctggagcgggagatgggcatcaactgcaccgggaagatcgtcatcgcccgctatggcaagatcttccggggcaacaaggtgaagaatgccatgctggccggggccatcggcatcatcctgtacagcgaccctgctgactactttgcccctgaggtgcagccctaccccaagggctggaacctgcctggaacagctgcccagagaggaaatgtgctgaacctgaatggagctggggaccccctgaccccaggctacccagccaaggagtacaccttccggctggatgtggaggagggcgtgggcatcccccgcatccctgtgcaccccatcggctacaatgatgctgagatcctgctgcgctacctgggcggcatcgcccccccagacaagtcctggaagggggccctgaatgtgtcctacagcatcggccctggcttcaccggcagtgacagcttcaggaaggtgaggatgcacgtgtacaacatcaacaagatcacccgcatctacaacgtggtgggcaccatccggggctctgtggagccagacagatatgtgatcctgggcggccaccgggacagctgggtgtttggagccatcgaccccaccagcggcgtggccgtgctgcaggagatcgcccggagctttgggaagctgatgagcaagggctggaggcccaggaggaccatcatctttgcctcctgggatgctgaggagtttggcctgctgggcagcacagagtgggccgaggagaatgtgaagatcctgcaggagaggagcatcgcctacatcaacagcgacagcagcattgagggcaactacaccctgcgggtggactgcacccccctgctgtaccagctggtgtacaagctgaccaaggagatccccagcccagatgatggctttgagagcaagagcctgtatgagagctggctggagaaggaccccagccctgagaacaagaacctgccccgcatcaacaagctgggcagcggcagtgactttgaggcctacttccagaggctgggcatcgccagcggccgggcccgctacaccaagaacaagaagacagacaagtacagcagctaccctgtgtaccacaccatctatgagacctttgagctggtggagaagttctatgaccccaccttcaagaagcagctgtctgtggcccagctgcggggggccctggtgtatgagctggtggacagcaagatcatccccttcaacatccaggactatgcagaggccctgaagaactatgctgccagcatctacaacctgagcaagaagcatgaccagcagctgacagaccatggagtgtcctttgacagcctcttctctgctgtgaagaacttcagcgaggccgccagtgacttccacaagaggctcatccaggtggacctgaacaaccccatcgctgtgaggatgatgaatgaccagctgatgctgctggagcgggccttcatcgaccccctgggcctgcccgggaagctgttctaccgccacatcatctttgcccccagcagccacaacaagtatgctggggagagcttccctggcatctatgatgccatctttgatattgagaacaaggccaacagccggctggcctggaaggaggtgaagaagcacatcagcattgctgccttcaccatccaggccgctgctggcaccctgaaggaggtgctgtag

SEQ ID NO: 161035 - DNA, 1635 bp, Artificial Sequence
  Description of Artificial Sequence: Synthetic coding sequence
atgcagtggaccaaggtgctgggcctgggcctgggcgccgccgccctgctgggcctgggcatcatcctgggccactttgccatccccaagaaggccaacagcctggccccccaggacctggacctggagatcctggagaccgtgatgggccagctggatgcccaccgcatccgggagaacctgcgggagctgagccgggagccccacctggccagcagccccagagatgaggacctggtgcagctgctgctgcagcgctggaaggaccctgagagcggcctggacagcgctgaggccagcacctatgaggtgctgctgtccttccccagccaggagcagcccaacgtggtggacatcgtgggccccactggaggcatcatccacagctgccacaggacagaagaaaatgtgactggagagcagggcggcccagatgtggtgcagccctatgctgcctatgcccccagcggcaccccccagggcctgctggtgtatgccaacagaggagctgaggaggacttcaaggagctgcagacccagggcatcaagctggagggcaccatcgccctgaccaggtatggaggagtgggccgcggggccaaggctgtgaatgctgccaagcacggcgtggccggcgtgctggtgtacacagatcctgctgacatcaatgatggcctgagcagcccagatgagaccttccccaacagctggtacctgccccccagcggcgtggagcggggcagctactatgagtactttggagaccccctgaccccctacctgcctgctgtgcccagcagcttccgggtggacctggccaacgtgtctggcttcccccccatccccacccagcccatcggcttccaggatgcccgggacctgctgtgcaacctgaatggcaccctggccccagccacctggcagggcgccctgggctgccactaccgcctgggccctggcttccggccagatggagacttccctgctgacagccaggtgaatgtgtctgtgtacaaccggctggagctgaggaacagcagcaatgtgctgggcatcatcagaggagctgtggagccagaccgctacgtgctgtatggcaaccaccgggacagctgggtgcacggggctgtggaccccagcagcggcacagctgtgctgctggagctgagccgggtgctgggcaccctgctgaagaagggcacctggaggcccaggaggagcatcgtgtttgcctcctggggcgctgaggagtttggcctgattggcagcacagagttcacagaggagttcttcaacaagctgcaggagaggacagtggcctacatcaacgtggacatctctgtgtttgccaatgccaccctgcgggtgcagggcaccccacctgtgcagagcgtggtgttcagcgccaccaaggagatccgcagccctggccctggggacctgagcatctatgacaactggatccgctacttcaacagaagcagccctgtgtatggcctggtgccccgggcccggctgcagcccggcagcaccccacccaccacccagcccctgacccccctgaccatgtggaccagcttctggacccgggccagcgctgccatccggctgtggccaggccagaggggcgtgtag

SEQ ID NO: 161036 - DNA, 1569 bp, Artificial Sequence
  Description of Artificial Sequence: Synthetic coding sequence
atgcagtggaccaaggtgctgggcctgggcctgggcgccgccgccctgctgggcctgggcatcatcctgggccactttgccatccccaagaaggccaacagcctggccccccaggacctggacctggagatcctggagaccgtgatgggccagctggatgcccaccgcatccgggagaacctgcgggagctgagccgggagccccacctggccagcagccccagagatgaggacctggtgcagctgctgctgcagcgctggaaggaccctgagagcggcctggacagcgctgaggccagcacctatgaggtgctgctgtccttccccagccaggagcagcccaacgtggtggacatcgtgggccccactggaggcatcatccacagctgccacaggacagaagaaaatgtgactggagagcagggcggcccagatgtggtgcagccctatgctgcctatgcccccagcggcaccccccagggcctgctggtgtatgccaacagaggagctgaggaggacttcaaggagctgcagacccagggcatcaagctggagggcaccatcgccctgaccaggtatggaggagtgggccgcggggccaaggctgtgaatgctgccaagcacggcgtggccggcgtgctggtgtacacagatcctgctgacatcaatgatggcctgagcagcccagatgagaccttccccaacagctggtacctgccccccagcggcgtggagcggggcagctactatgagtactttggagaccccctgaccccctacctgcctgctgtgcccagcagcttccgggtggacctggccaacgtgtctggcttcccccccatccccacccagcccatcggcttccaggatgcccgggacctgctgtgcaacctgaatggcaccctggccccagccacctggcagggcgccctgggctgccactaccgcctgggccctggcttccggccagatggagacttccctgctgacagccaggtgaatgtgtctgtgtacaaccggctggagctgaggaacagcagcaatgtgctgggcatcatcagaggagctgtggagccagaccgctacgtgctgtatggcaaccaccgggacagctgggtgcacggggctgtggaccccagcagcggcacagctgtgctgctggagctgagccgggtgctgggcaccctgctgaagaagggcacctggaggcccaggaggagcatcgtgtttgcctcctggggcgctgaggagtttggcctgattggcagcacagagttcacagaggagttcttcaacaagctgcaggagaggacagtggcctacatcaacgtggacatctctgtgtttgccaatgccaccctgcgggtgcagggcaccccacctgtgcagagcgtggtgttcagcgccaccaaggagatccgcagccctggccctggggacctgagcatctatgacaactggatccgctacttcaacagaagcagccctgtgtatggcctggtgccccggctgcagcagcccagcggctgcggccctgacagcggggagtgtgacagccctgcccagtag

SEQ ID NO: 161037 - DNA, 2223 bp, Artificial Sequence
  Description of Artificial Sequence: Synthetic coding sequence
atgcagtggaccaaggtgctgggcctgggcctgggcgccgccgccctgctgggcctgggcatcatcctgggccactttgccatccccaagaaggccaacagcctggccccccaggacctggacctggagatcctggagaccgtgatgggccagctggatgcccaccgcatccgggagaacctgcgggagctgagccgggagccccacctggccagcagccccagagatgaggacctggtgcagctgctgctgcagcgctggaaggaccctgagagcggcctggacagcgctgaggccagcacctatgaggtgctgctgtccttccccagccaggagcagcccaacgtggtggacatcgtgggccccactggaggcatcatccacagctgccacaggacagaagaaaatgtgactggagagcagggcggcccagatgtggtgcagccctatgctgcctatgcccccagcggcaccccccagggcctgctggtgtatgccaacagaggagctgaggaggacttcaaggagctgcagacccagggcatcaagctggagggcaccatcgccctgaccaggtatggaggagtgggccgcggggccaaggctgtgaatgctgccaagcacggcgtggccggcgtgctggtgtacacagatcctgctgacatcaatgatggcctgagcagcccagatgagaccttccccaacagctggtacctgccccccagcggcgtggagcggggcagctactatgagtactttggagaccccctgaccccctacctgcctgctgtgcccagcagcttccgggtggacctggccaacgtgtctggcttcccccccatccccacccagcccatcggcttccaggatgcccgggacctgctgtgcaacctgaatggcaccctggccccagccacctggcagggcgccctgggctgccactaccgcctgggccctggcttccggccagatggagacttccctgctgacagccaggtgaatgtgtctgtgtacaaccggctggagctgaggaacagcagcaatgtgctgggcatcatcagaggagctgtggagccagaccgctacgtgctgtatggcaaccaccgggacagctgggtgcacggggctgtggaccccagcagcggcacagctgtgctgctggagctgagccgggtgctgggcaccctgctgaagaagggcacctggaggcccaggaggagcatcgtgtttgcctcctggggcgctgaggagtttggcctgattggcagcacagagttcacagaggagttcttcaacaagctgcaggagaggacagtggcctacatcaacgtggacatctctgtgtttgccaatgccaccctgcgggtgcagggcaccccacctgtgcagagcgtggtgttcagcgccaccaaggagatccgcagccctggccctggggacctgagcatctatgacaactggatccgctacttcaacagaagcagccctgtgtatggcctggtgcccagcctgggcagcctgggcgccggcagtgactatgccccctttgtgcacttcctgggcatcagctccatggacatcgcctacacctatgacaggagcaagaccagcgcccgcatctaccccacctaccacacagcctttgacacctttgattatgtggacaagttcctggaccccggcttcagcagccaccaggccgtggccaggacagctggcagcgtcatcctgcggctgagtgacagcttcttcctgcccctgaaggtgtctgactacagcgagaccctgcggagcttcctgcaggccgcccagcaggacctgggcgccctgctggagcagcacagcatcagcctgggccccctggtgacagctgtggagaagtttgaggccgaggccgccgccctgggccagaggatcagcaccctgcagaagggcagcccagaccccctgcaggtgaggatgctgaatgaccagctgatgctgctggagaggaccttcctgaacccccgggccttccctgaggagcgctactacagccacgtgctgtgggcccccaggactggatctgtggtgaccttccctggcctgagcaatgcctgcagccgggcccgggacacagccagcggcagcgaggcctgggccgaggtgcagaggcagctgagcatcgtggtgacagccctggagggcgctgctgccaccctgcggcctgtggccgacctgtag

SEQ ID NO: 161038 - DNA, 2220 bp, Artificial Sequence
  Description of Artificial Sequence: Synthetic coding sequence
atgcagtggaccaaggtgctgggcctgggcctgggcgccgccgccctgctgggcctgggcatcatcctgggccactttgccatccccaagaaggccaacagcctggccccccaggacctggacctggagatcctggagaccgtgatgggccagctggatgcccaccgcatccgggagaacctgcgggagctgagccgggagccccacctggccagcagccccagagatgaggacctggtgcagctgctgctgcagcgctggaaggaccctgagagcggcctggacagcgctgaggccagcacctatgaggtgctgctgtccttccccagccaggagcagcccaacgtggtggacatcgtgggccccactggaggcatcatccacagctgccacaggacagaagaaaatgtgactggagagcagggcggcccagatgtggtgcagccctatgctgcctatgcccccagcggcaccccccagggcctgctggtgtatgccaacagaggagctgaggaggacttcaaggagctgcagacccagggcatcaagctggagggcaccatcgccctgaccaggtatggaggagtgggccgcggggccaaggctgtgaatgctgccaagcacggcgtggccggcgtgctggtgtacacagatcctgctgacatcaatgatggcctgagcagcccagatgagaccttccccaacagctggtacctgccccccagcggcgtggagcggggcagctactatgagtactttggagaccccctgaccccctacctgcctgctgtgcccagcagcttccgggtggacctggccaacgtgtctggcttcccccccatccccacccagcccatcggcttccaggatgcccgggacctgctgtgcaacctgaatggcaccctggccccagccacctggcagggcgccctgggctgccactaccgcctgggccctggcttccggccagatggagacttccctgctgacagccaggtgaatgtgtctgtgtacaaccggctggagctgaggaacagcagcaatgtgctgggcatcatcagaggagctgtggagccagaccgctacgtgctgtatggcaaccaccgggacagctgggtgcacggggctgtggaccccagcagcggcacagctgtgctgctggagctgagccgggtgctgggcaccctgctgaagaagggcacctggaggcccaggaggagcatcgtgtttgcctcctggggcgctgaggagtttggcctgattggcagcacagagttcacagaggagttcttcaacaagctgcaggagaggacagtggcctacatcaacgtggacatctctgtgtttgccaatgccaccctgcgggtgcagggcaccccacctgtgcagagcgtggtgttcagcgccaccaaggagatccgcagccctggccctggggacctgagcatctatgacaactggatccgctacttcaacagaagcagccctgtgtatggcctggtgcccagcctgggcagcctgggcgccggcagtgactatgccccctttgtgcacttcctgggcatcagctccatggacatcgcctacacctatgacaggagcaagaccagcgcccgcatctaccccacctaccacacagcctttgacacctttgattatgtggacaagttcctggaccccggcttcagcagccaccaggccgtggccaggacagctggcagcgtcatcctgcggctgagtgacagcttcttcctgcccctgaaggtgtctgactacagcgagaccctgcggagcttcctgcaggccgcccagcaggacctgggcgccctgctggagcagcacagcatcagcctgggccccctggtgacagctgtggagaagtttgaggccgaggccgccgccctgggccagaggatcagcaccctgcagaagggcagcccagaccccctgcaggtgaggatgctgaatgaccagctgatgctgctggagaggaccttcctgaacccccgggccttccctgaggagcgctactacagccacgtgctgtgggccccccggggcctgcggagccacatccctggcctgagcaatgcctgcagccgggcccgggacacagccagcggcagcgaggcctgggccgaggtgcagaggcagctgagcatcgtggtgacagccctggagggcgccgccgccaccctgcggcctgtggccgacctgtag

SEQ ID NO: 161039 - DNA, 405 bp, Artificial Sequence
  Description of Artificial Sequence: Synthetic coding sequence
atggagatcagcaagaagatcaagacccagtggaccagcctgggcctggaggatgtgcagtttgtgaactacagcgtgctgctggacctgcccggccccagccccagcacagtgaccctgagcagcagcggccagtgcttccaccccaacggccagccctgcagcgaggaggccaggaaggacagcagccaggacctgctgtacagctatgctgcctacagcgccaagggcaccctgaaggccgaggtgattgatgtgtcctatggcatggctgatgacctgaagaggatcaggaagatcaagaatgtgaccaaccagatcgccctgctgaagctgggcaagctgcccctgctgtacaagatgaaggtgctggacaaggctgaccagaccagccccctgtactag

SEQ ID NO: 161040 - DNA, 2388 bp, Artificial Sequence
  Description of Artificial Sequence: Synthetic coding sequence
atgggagaaaatgaggccagcctgcccaacaccagcctgcagggcaagaagatggcctaccagaaggtgcatgctgaccagagggcccctggccacagccagtacctggacaatgatgacctgcaggccacagccctggacctggagtgggacatggagaaggagctggaggagagcggctttgaccagttccagctggatggagctgagaaccagaacctgggccacagcgagaccatcgacctgaacctggacagcatccagcctgccaccagccccaagggccgcttccagaggctgcaggaggagagtgactacatcacccactacaccaggtctgcccccaagagcaaccgctgcaacttctgccacgtgctgaagatcctgtgcacagccaccatcctcttcatcttcggcatcctgattggctactacgtgcacaccaactgccccagtgatgcccccagcagcggcaccgtggacccccagctgtaccaggagatcctgaagaccatccaggccgaggacatcaagaagagcttcaggaacctggtgcagctgtacaagaatgaagatgacatggagatcagcaagaagatcaagacccagtggaccagcctgggcctggaggatgtgcagtttgtgaactacagcgtgctgctggacctgcccggccccagccccagcacagtgaccctgagcagcagcggccagtgcttccaccccaacggccagccctgcagcgaggaggccaggaaggacagcagccaggacctgctgtacagctatgctgcctacagcgccaagggcaccctgaaggccgaggtgattgatgtgtcctatggcatggctgatgacctgaagaggatcaggaagatcaagaatgtgaccaaccagatcgccctgctgaagctgggcaagctgcccctgctgtacaagctgagcagcctggagaaggccggctttggaggagtgctgctgtacatcgacccctgtgacctgcccaagacagtgaaccccagccatgacaccttcatggtgtccctgaaccctggaggagaccccagcaccccaggctaccccagcgtggatgagagcttccggcagagccgcagcaacctgaccagcctgctggtgcagcccatcagcgcccccctggtggccaagctgatcagcagccccaaggcccggaccaagaatgaggcctgcagcagcctggagctgcccaacaatgagatccgggtggtgtccatgcaggtgcagacagtgaccaagctgaagacagtgaccaacgtggtgggctttgtgatgggcctgaccagcccagaccgctacatcatcgtgggcagccaccaccacacagcccacagctacaacggccaggagtgggccagcagcacagccatcatcacagccttcatccgggccctgatgagcaaggtgaagaggggctggaggccagacaggaccatcgtgttctgctcctggggcggcacagcctttggaaacatcggcagctatgagtggggcgaggacttcaagaaggtgctgcagaagaatgtggtggcctacatcagcctgcacagccccatccggggcaacagcagcctgtaccctgtggccagccccagcctgcagcagctggtggtggagaagaacaacttcaactgcacccggcgggcccagtgcccagagaccaacatcagcagcatccagatccagggagatgctgactacttcatcaaccacctgggcgtgcccatcgtgcagtttgcctatgaggacatcaagaccctggagggccccagcttcctgtctgaggcccgcttcagcacccgggccaccaagattgaggagatggaccccagcttcaacctgcacgagaccatcaccaagctgagcggggaggtgatcctgcagatcgccaatgaacctgtgctgcccttcaatgccctggacatcgccctggaggtgcagaacaacctgaagggggaccagcccaacacccaccagctgctggccatggccctgcggctgcgggagagcgctgagctgttccagagtgatgagatgaggcctgccaatgaccccaaggagcgggcccccatccgcatccgcatgctgaatgacatcctgcaggacatggagaagagcttcctggtgaagcaggcccctcctggcttctacagaaacatcctgtaccacctggatgagaagaccagccgcttcagcatcctgattgaggcctgggagcactgcaagcccctggccagcaatgagaccctgcaggaggccctgtctgaggtgctgaacagcatcaacagcgcccaggtgtacttcaaggccggcctggatgtgttcaagtctgtgctggatggcaagaactag

SEQ ID NO: 161041 - DNA, 1236 bp, Artificial Sequence
  Description of Artificial Sequence: Synthetic coding sequence
atgctgctgaagacagtgctgctgctgggccacgtggcccaggtgctgatgctggacaatggcctgctgcagaccccacccatgggctggctggcctgggagcgcttccgctgcaacatcaactgtgatgaggaccccaagaactgcatcagcgagcagctgttcatggagatggctgacaggatggcccaggacggctggagggacatgggctacacctacctgaacattgatgactgctggattggaggaagagatgccagcggccgcctgatgccagaccccaagcgcttcccccacggcatccccttcctggccgactatgtgcacagcctgggcctgaagctgggcatctatgctgacatgggcaacttcacctgcatgggctacccaggcaccaccctggacaaggtggtgcaggatgcccagacctttgctgagtggaaggtggacatgctgaagctggatggctgcttcagcaccccagaggagcgggcccagggctaccccaagatggccgccgccctgaatgccaccggccggcccatcgccttcagctgctcctggccagcctatgagggcggcctgcccccccgggtgaactacagcctgctggccgacatctgcaacctgtggagaaattatgatgacatccaggacagctggtggagcgtgctgagcatcctgaactggtttgtggagcaccaggacatcctgcagcctgtggccggccctggccactggaatgaccctgacatgctgctgattggcaactttggcctgagcctggagcagagccgggcccagatggccctgtggacagtgctggccgcccccctgctgatgagcacagacctgcggaccatcagcgcccagaacatggacatcctgcagaaccccctgatgatcaagatcaaccaggaccccctgggcatccagggccgccgcatccacaaggagaagagcctcatcgaggtgtacatgaggcccctgagcaacaaggccagcgccctggtgttcttcagctgcaggacagacatgccctaccgctaccacagcagcctgggccagctgaacttcaccggcagcgtcatctatgaggcccaggatgtgtacagcggggacatcatcagcggcctgagagatgagaccaacttcaccgtcatcatcaaccccagcggcgtggtgatgtggtacctgtaccccatcaagaacctggagatgagccagcagtag

SEQ ID NO: 161042 - DNA, 1236 bp, Artificial Sequence; identical to SEQ ID NO: 161041
  Description of Artificial Sequence: Synthetic coding sequence

SEQ ID NO: 161043 - DNA, 1236 bp, Artificial Sequence; identical to SEQ ID NO: 161041
  Description of Artificial Sequence: Synthetic coding sequence

SEQ ID NO: 161044 - DNA, 1035 bp, Artificial Sequence
  Description of Artificial Sequence: Synthetic coding sequence
atggccgccatctatggaggagtggagggcggcggcaccaggtctgaggtgctgctggtgtctgaagatggcaagatcctggccgaggctgatggcctgagcaccaaccactggctgattggaacagacaagtgtgtggagcgcatcaatgagatggtgaacagagccaagaggaaggccggcgtggaccccctggtgcccctgcggagcctgggcctgagcctgagcggcggggaccaggaggatgctggccgcatcctgattgaggagctgcgggaccgcttcccctacctgtctgagagctacctgatcaccacagatgctgctggcagcatcgccacagccaccccagatggcggcgtggtgctgatctctggaacaggcagcaactgccgcctcatcaacccagatggcagcgagagcggctgcggcggctggggccacatgatgggagatgagggcagcgcctactggatcgcccaccaggccgtgaagatcgtgtttgacagcattgacaacctggaggccgcccctcatgacatcggctacgtgaagcaggccatgttccactacttccaggtgcctgaccggctgggcatcctgacccacctgtacagagactttgacaagtgccgctttgctggcttctgcaggaagattgctgagggcgcccagcagggcgaccccctgagccgctacatcttcaggaaggccggggagatgctgggccgccacatcgtggccgtgctgcctgagattgatcctgtgctcttccagggcaagattggcctgcccatcctgtgtgtgggctctgtgtggaagtcctgggagctgctgaaggagggcttcctgctggccctgacccagggccgggagatccaggcccagaacttcttcagcagcttcaccctgatgaagctgcggcacagcagcgccctgggcggggccagcctgggcgcccggcacatcggccacctgctgcccatggactacagcgccaatgccatcgccttctacagctacaccttctcctag

SEQ ID NO: 161045 - DNA, 1173 bp, Artificial Sequence
  Description of Artificial Sequence: Synthetic coding sequence
atgaggaccaggacaggcagccagctggccgcccgggaggtgactggaagtggagctgtgccccggcagctggagggccgccgctgccaggccggcagagatgccaacggcggcaccagcagtgatggcagcagctccatggccgccatctatggaggagtggagggcggcggcaccaggtctgaggtgctgctggtgtctgaagatggcaagatcctggccgaggctgatggcctgagcaccaaccactggctgattggaacagacaagtgtgtggagcgcatcaatgagatggtgaacagagccaagaggaaggccggcgtggaccccctggtgcccctgcggagcctgggcctgagcctgagcggcggggaccaggaggatgctggccgcatcctgattgaggagctgcgggaccgcttcccctacctgtctgagagctacctgatcaccacagatgctgctggcagcatcgccacagccaccccagatggcggcgtggtgctgatctctggaacaggcagcaactgccgcctcatcaacccagatggcagcgagagcggctgcggcggctggggccacatgatgggagatgagggcagcgcctactggatcgcccaccaggccgtgaagatcgtgtttgacagcattgacaacctggaggccgcccctcatgacatcggctacgtgaagcaggccatgttccactacttccaggtgcctgaccggctgggcatcctgacccacctgtacagagactttgacaagtgccgctttgctggcttctgcaggaagattgctgagggcgcccagcagggcgaccccctgagccgctacatcttcaggaaggccggggagatgctgggccgccacatcgtggccgtgctgcctgagattgatcctgtgctcttccagggcaagattggcctgcccatcctgtgtgtgggctctgtgtggaagtcctgggagctgctgaaggagggcttcctgctggccctgacccagggccgggagatccaggcccagaacttcttcagcagcttcaccctgatgaagctgcggcacagcagcgccctgggcggggccagcctgggcgcccggcacatcggccacctgctgcccatggactacagcgccaatgccatcgccttctacagctacaccttctcctag

SEQ ID NO: 161046 - DNA, 1548 bp, Artificial Sequence
  Description of Artificial Sequence: Synthetic coding sequence
atggccaccagcacaggccgctggctgctgctgcggctggccctgtttggcttcctgtgggaggccagcggcggcctggacagcggggccagcagagatgatgacctgctgctgccctacccccgggcccgggcccggctgccccgggactgcaccagggtgcgggccggcaaccgggagcacgagagctggcccccacctccagccaccccaggagctgggggcctggccgtgaggacctttgtgagccacttccgggacagagctgtggccggccacctgaccagggctgtggagcccctgcggaccttctctgtgctggagcccggcggccctgggggctgtgccgccaggagaagagccaccgtggaggagacagcccgggctgctgactgccgggtggcccagaatggaggcttcttcaggatgaacagcggagaatgtctgggcaatgtggtgtctgatgaaagaagagtgagcagcagcggcggcctgcagaatgcccagtttggcatcagaagagatggcaccctggtgacaggctacctgtctgaggaggaggtgctggacacagagaacccctttgtgcagctgctgagcggcgtggtgtggctgatcagaaatggcagcatctacatcaatgaaagccaggccacagaatgtgatgagacccaggagaccggcagcttcagcaagtttgtgaatgtcatcagcgccaggacagccatcggccatgacaggaagggccagctggtgctcttccacgcagatggccagacagagcagaggggcatcaacctgtgggagatggccgagttcctgctgaagcaggatgtggtgaatgccatcaacctggatggcggcggcagcgccacctttgtgctgaatggcaccctggccagctaccccagcgaccactgccaggacaacatgtggcgctgcccccggcaggtgtccacagtggtgtgtgtgcatgagccccgctgccagcccccagactgccacggccacggcacctgtgtggatggccactgccagtgcaccggccacttctggaggggccctggctgtgatgagctggactgtggccccagcaactgcagccagcacggcctgtgcacagagaccggctgccgctgtgatgctggctggacaggcagcaactgcagcgaggagtgccccctgggctggcacggccctggctgccagaggccctgcaagtgtgagcaccactgcccctgtgaccccaagacaggcaactgcagcgtgtcccgggtgaagcagtgcctgcagcccccagaggccaccctgcgggccggggagctgtccttcttcaccaggacagcctggctggccctgaccctggccctggccttcctgctgctgatcagcacagctgccaacctgagcctgctgctgagcagagctgagaggaacagaaggctgcatggagactatgcctaccaccccctgcaggagatgaatggagagcccctggccgctgagaaggagcagcccggcggggcccacaaccccttcaaggactag

SEQ ID NO: 161047 - DNA, 1446 bp, Artificial Sequence
  Description of Artificial Sequence: Synthetic coding sequence
atggccaccagcacaggccgctggctgctgctgcggctggccctgtttggcttcctgtgggaggccagcggcggcctggacagcggggccagcagagatgatgacctgctgctgccctacccccgggcccgggcccggctgccccgggactgcaccagggtgcgggccggcaaccgggagcacgagagctggcccccacctccagccaccccaggagctgggggcctggccgtgaggacctttgtgagccacttccgggacagagctgtggccggccacctgaccagggctgtggagcccctgcggaccttctctgtgctggagcccggcggccctgggggctgtgccgccaggagaagagccaccgtggaggagacagcccgggctgctgactgccgggtggcccagaatggaggcttcttcaggatgaacagcggagaatgtctgggcaatgtggtgtctgatgaaagaagagtgagcagcagcggcggcctgcagaatgcccagtttggcatcagaagagatggcaccctggtgacaggctacctgtctgaggaggaggtgctggacacagagaacccctttgtgcagctgctgagcggcgtggtgtggctgatcagaaatggcagcatctacatcaatgaaagccaggccacagaatgtgatgagacccaggagaccggcagcttcagcaagtttgtgaatgtcatcagcgccaggacagccatcggccatgacaggaagggccagctggtgctcttccacgcagatggccagacagagcagaggggcatcaacctgtgggagatggccgagttcctgctgaagcaggatgtggtgaatgccatcaacctggatggcggcggcagcgccacctttgtgctgaatggcaccctggccagctaccccagcgaccactgccaggacaacatgtggcgctgcccccggcaggtgtccacagtggtgtgtgtgcatgagccccgctgccagcccccagactgccacggccacggcacctgtgtggatggccactgccagtgcaccggccacttctggaggggccctggctgtgatgagctggactgtggccccagcaactgcagccagcacggcctgtgcacagagaccggctgccgctgtgatgctggctggacaggcagcaactgcagcgaggtgaagcagtgcctgcagcccccagaggccaccctgcgggccggggagctgtccttcttcaccaggacagcctggctggccctgaccctggccctggccttcctgctgctgatcagcacagctgccaacctgagcctgctgctgagcagagctgagaggaacagaaggctgcatggagactatgcctaccaccccctgcaggagatgaatggagagcccctggccgctgagaaggagcagcccggcggggcccacaaccccttcaaggactag

SEQ ID NO: 161048 - DNA, 2514 bp, Artificial Sequence
  Description of Artificial Sequence: Synthetic coding sequence
atggccgagcccagccaggcccccaccccagccccagctgcccagccccggcccctgcagagccctgccccagcccccacccccaccccagcccccagccctgccagcgcccccatccccacccccaccccagccccagccccagccccagctgctgccccagctggcagcacaggcaccggcggccctggggtgggcagcggcggggccggcagcggcggggaccctgcccggcccggcctgagccagcagcagagggccagccagaggaaggcccaggtgcggggcctgccccgggccaagaagctggagaagctgggcgtcttcagcgcctgcaaggccaatgagacctgcaagtgcaatggctggaagaaccccaagccacccacagcccccaggatggacctgcagcagcctgctgccaacctgtctgagctgtgccgcagctgtgagcaccccctggccgaccacgtgagccacctggagaatgtgtctgaagatgagatcaaccggctgctgggcatggtggtggatgtggagaacctcttcatgtctgtgcacaaggaggaggacacagacaccaagcaggtgtacttctacctgttcaagctgctgaggaagtgcatcctgcagatgaccaggcctgtggtggagggcagcctgggcagccccccatttgagaagcccaacatcgagcagggcgtgctgaactttgtgcagtacaagttcagccacctggccccccgggagcggcagaccatgtttgagctgagcaagatgttcctgctgtgcctgaactactggaagctggagaccccagcccagttccggcagaggagccaggctgaagatgtggccacctacaaggtgaactacacccgctggctgtgctactgccacgtgccccagagctgtgacagcctgcccaggtatgagaccacccacgtgtttggccgcagcctgctgcggagcatcttcaccgtgacccggcggcagctgctggagaagttccgggtggagaaggacaagctggtgcctgagaagaggaccctcatcctgacccacttccccaagttcctgtccatgctggaggaggagatctacggggccaacagccccatctgggagagcggcttcaccatgccacccagcgagggcacccagctggtgcccaggcctgcctctgtgtctgctgctgtggtgcccagcacccccatcttcagccccagcatgggcggcggcagcaacagcagcctgagcctggacagcgctggagctgagcccatgcctggagagaagaggaccctgcctgagaacctgaccctggaggatgccaagaggctgcgggtgatgggagacatccccatggagctggtgaatgaggtgatgctgaccatcacagatcctgctgccatgctgggccctgagaccagcctgctgagcgccaatgctgccagagatgaaacagcccggctggaggagcggcggggcatcatcgagttccacgtgattggcaacagcctgacccccaaggccaacagaagagtgctgctgtggctggtgggcctgcagaatgtgttcagccaccagctgcccaggatgcccaaggagtacatcgcccggctggtgtttgaccccaagcacaagaccctggccctgatcaaggatggccgggtcatcggcggcatctgcttcaggatgttccccacccagggcttcacagagatcgtgttctgtgctgtgaccagcaatgagcaggtgaagggctacggcacccacctgatgaaccacctgaaggagtaccacatcaagcacaacatcctgtacttcctgacctatgcagatgaatatgccatcggctacttcaagaagcagggcttcagcaaggacatcaaggtgcccaagagccgctacctgggctacatcaaggactatgaaggagccaccctgatggagtgtgagctgaacccccgcatcccctacacagagctgagccacatcatcaagaagcagaaggagatcatcaagaagctgattgaaaggaagcaggcccagatcaggaaggtgtacccaggcctgagctgcttcaaggagggcgtgcggcagatccctgtggagagcgtgcccggcatccgggagaccggctggaagcccctgggcaaggagaagggcaaggagctgaaggaccctgaccagctgtacaccaccctgaagaacctgctggcccagatcaagagccaccccagcgcctggcccttcatggagcctgtgaagaagtctgaggccccagactactatgaggtgatccgcttccccatcgacctgaagaccatgacagagcggctgcggagccgctactacgtgaccaggaagctgtttgtggccgacctgcagagggtgattgccaactgccgggagtacaaccccccagacagcgagtactgccgctgtgccagcgccctggagaagttcttctacttcaagctgaaggagggcggcctgattgacaagtag

SEQ ID NO: 161049 - DNA, 1260 bp, Artificial Sequence
  Description of Artificial Sequence: Synthetic coding sequence
ccccagtgctgcctgcacagccggggcatgttcccccggctgagccctgtggacacagaagctgtgtggctgctgcagggctggctgttccagcaccagccccagttctggggccctgcccagatccgggctgtgctgggcgctgtgccccggggccgcctgctggtgctggacctgtttgctgagagccagcctgtgtacaccaggacagccagcttccagggccagcccttcatctggtgcatgctgcacaactttggaggcaaccacggcctgtttggagccctggaggccgtgaatggaggccctgaggccgcccggctcttccccaacagcaccatggtgggcaccggcatggcccctgagggcatcagccagaatgaggtggtgtacagcctgatggccgagctgggctggaggaaggaccctgtgcctgacctggccgcctgggtgaccagctttgctgccaggagatatggagtgagccacccagatgctggggccgcctggaggctgctgctgcggtctgtgtacaactgcagcggggaggcctgccggggccacaacagaagccccctggtgagaagacccagcctgcagatgaacaccagcatctggtacaacagaagtgatgtgtttgaggcctggaggctgctgctgaccagcgcccccagcctggccaccagccctgccttccgctatgacctgctggacctgacccggcaggccgtgcaggagctggtgtccctgtactatgaggaggcccggagcgcctacctgagcaaggagctggccagcctgctgcgggccggcggcgtgctggcctatgagctgctgcctgccctggatgaggtgctggccagtgacagccgcttcctgctgggctcctggctggagcaggcccgggctgctgctgtgtctgaggccgaggccgacttctatgagcagaacagccgctaccagctgaccctgtggggccctgagggcaacatcctggactatgccaacaagcagctggccggcctggtggccaactactacaccccccgctggaggctcttcctggaggccctggtggacagcgtggcccagggcatccccttccagcagcaccagtttgacaagaatgtgttccagctggagcaggcctttgtgctgagcaagcagcgctaccccagccagcccaggggggacacagtggacctggccaagaagatcttcctgaagtactacccccgctgggtggccggctcctggtag

SEQ ID NO: 161050 - DNA, 963 bp, Artificial Sequence
  Description of Artificial Sequence: Synthetic coding sequence
atggccttccccaagaagaagctgcagggcctggtggccgccaccatcacccccatgacagaaaatggagagatcaacttcagcgtcatcggccagtatgtggactacctggtgaaggagcagggcgtgaagaacatctttgtgaatggcaccaccggggagggcctgagcctgtctgtgtctgaaagacggcaggtggccgaggagtgggtgaccaagggcaaggacaagctggaccaggtgatcatccacgtgggcgccctgagcctgaaggagagccaggagctggcccagcacgccgctgagattggagcagatggcattgctgtgattgcccccttcttcctgaagccctggaccaaggacatcctgatcaacttcctgaaggaggtggccgccgccgccccagccctgcccttctactactaccacatcccagccctgactggagtgaagatccgggcagaggagctgctggatggcatcctggacaagatccccaccttccagggcctgaagttcagtgacacagacctgctggactttggccagtgtgtggaccagaaccggcagcagcagtttgccttcctgtttggagtggatgagcagctgctgagcgccctggtgatgggcgccactggagctgtgggcagcacctacaactacctgggcaagaagaccaaccagatgctggaggcctttgagcagaaggacttcagcctggccctgaactaccagttctgcatccagcgcttcatcaactttgtggtgaagctgggctttggagtgtcccagaccaaggccatcatgaccctggtgtctggcatccccatgggccccccccggctgcccctgcagaaggccagccgggagttcacagattctgctgaggccaagctgaagagcctggacttcctgtccttcacagacctgaaggatggcaacctggaggccggcagctag

SEQ ID NO: 161051 - DNA, 330 bp, Artificial Sequence
  Description of Artificial Sequence: Synthetic coding sequence
atggccttccccaagaagaagctgcagggcctggtggccgccaccatcacccccatgacagaaaatggagagatcaacttcagcgtcatcggccagtatgtggactacctggtgaaggagcagggcgtgaagaacatctttgtgaatggcaccaccggggagggcctgagcctgtctgtgtctgaaagacggcaggtggccgaggagtgggtgaccaagggcaaggacaagagcaaccaccacaagctgggcaccatccgcaccacccagagccgccgcagcagcttccggcggcagctgaaggcctggcacagcggcagccacctgtag

SEQ ID NO: 161052 - DNA, 558 bp, Artificial Sequence
  Description of Artificial Sequence: Synthetic coding sequence
atgagccgggcccctggcatcctggcctcctggaggcgggcccccagcctgtctgtgcagaagggcagccagacagcccggcacacctgccaccctgaggtgcccctgggcaactgcttcctgcctgtgtacaaggccagccccctgactgtgacccggctgtgggccgagcggctggaccaggtgatcatccacgtgggcgccctgagcctgaaggagagccaggagctggcccagcacgccgctgagatcggggctgatggcattgctgtgattgcccccttcttcctgaagccctggaccaaggacatcctgatcaacttcctgaaggaggtggccgctgctgccccagccctgcccttctactactaccacatcccagccctgactggagtgaagatccgggcagaggagctgctggatggcatcctggacaagatccccaccttccagggcctgaagttcagtgacacagacctgctggactttggccagtgtgtggaccagaaccggcagcagcagtttgccttcctgtttggagtggatgagcacctgtag

SEQ ID NO: 161053 - DNA, 723 bp, Artificial Sequence
  Description of Artificial Sequence: Synthetic coding sequence
atggccttccccaagaagaagctgcagggcctggtggccgccaccatcacccccatgacagaaaatggagagatcaacttcagcgtcatcggccagtatgtggactacctggtgaaggagcagggcgtgaagaacatctttgtgaatggcaccaccggggagggcctgagcctgtctgtgtctgaaagacggcaggtggccgaggagtgggtgaccaagggcaaggacaagctggaccaggtgatcatccacgtgggcgccctgagcctgaaggagagccaggagctggcccagcacgccgctgagattggagcagatggcattgctgtgattgcccccttcttcctgaagccctggaccaaggacatcctgatcaacttcctgaaggaggtggccgccgccgccccagccctgcccttctactactaccacatcccagccctgactggagtgaagatccgggcagaggagctgctggatggcatcctggacaagatccccaccttccagggcctgaagttcagtgacacagacctgctggactttggccagtgtgtggaccagaaccggcagcagcagtttgccttcctgtttggagtggatgagttctgcatccagcgcttcatcaactttgtggtgaagctggagaacagcaagctgaaggtgtccaagaaccagaggaccctgcccctgggcaccaccaacttccccttcctgcactag

SEQ ID NO: 161054 - DNA, 963 bp, Artificial Sequence; identical to SEQ ID NO: 161050
  Description of Artificial Sequence: Synthetic coding sequence

SEQ ID NO: 161055 - DNA, 906 bp, Artificial Sequence
  Description of Artificial Sequence: Synthetic coding sequence
atgagccgggcccctggcatcctggcctcctggaggcgggcccccagcctgtctgtgcagaagggcagccagacagcccggcacacctgccaccctgaggtgcccctgggcaactgcttcctgcctgtgtacaaggccagccccctgactgtgacccggctgtgggccgagcggctggaccaggtgatcatccacgtgggcgccctgagcctgaaggagagccaggagctggcccagcacgccgctgagatcggggctgatggcattgctgtgattgcccccttcttcctgaagccctggaccaaggacatcctgatcaacttcctgaaggaggtggccgctgctgccccagccctgcccttctactactaccacatcccagccctgactggagtgaagatccgggcagaggagctgctggatggcatcctggacaagatccccaccttccagggcctgaagttcagtgacacagacctgctggactttggccagtgtgtggaccagaaccggcagcagcagtttgccttcctgtttggagtggatgagcagctgctgagcgccctggtgatgggcgccaccggggctgtgggcagcacctacaactacctgggcaagaagaccaaccagatgctggaggcctttgagcagaaggacttcagcctggccctgaactaccagttctgcatccagcgcttcatcaactttgtggtgaagctgggcttcggcgtgtcccagaccaaggccatcatgaccctggtgtctggcatccccatgggccccccccggctgcccctgcagaaggccagccgggagttcacagacagcgctgaggccaagctgaagagcctggacttcctgtccttcacagacctgaaggatggcaacctggaggccggcagctag

SEQ ID NO: 161056 - DNA, 723 bp, Artificial Sequence; identical to SEQ ID NO: 161053
  Description of Artificial Sequence: Synthetic coding sequence

SEQ ID NO: 161057 - DNA, 624 bp, Artificial Sequence
  Description of Artificial Sequence: Synthetic coding sequence
cgggagggccagaagggcagccagacagcccggcacacctgccaccctgaggtgcccctgggcaactgcttcctgcctgtgtacaaggccagccccctgactgtgacccggctgtgggccgagcggctggaccaggtgatcatccacgtgggcgccctgagcctgaaggagagccaggagctggcccagcacgccgctgagatcggggctgatggcattgctgtgattgcccccttcttcctgaagccctggaccaaggacatcctgatcaacttcctgaaggaggtggccgctgctgccccagccctgcccttctactactaccacatcccagccctgactggagtgaagaccaccgtggagtgcagcggagatggcagcaactggagcagcggccagttctgcatccagcgcttcatcaactttgtggtgaagctgggcttcggcgtgtcccagaccaaggccatcatgaccctggtgtctggcatccccatgggccccccccggctgcccctgcagaaggccagccgggagttcacagacagcgctgaggccaagctgaagagcctggacttcctgtccttcacagacctgaaggatggcaacctggaggccggcagctag

SEQ ID NO: 161058 - DNA, 747 bp, Artificial Sequence
  Description of Artificial Sequence: Synthetic coding sequence
atgggcctgagccgggtgcgggctgtgttctttgacctggacaacaccctgattgacacagctggggccagcagaagaggcatgctggaggtgatcaagctgctgcagagcaagtaccactacaaggaggaggccgagatcatctgtgacaaggtgcaggtgaagctgagcaaagaatgcttccacccctacaacacctgcatcacagacctgcggaccagccactgggaggaggccatccaggagaccaagggcggggccgccaacaggaagctggccgaggagtgctacttcctgtggaagagcacccggctgcagcacatgaccctggccgaggatgtgaaggccatgctgacagagctgaggaaggaggtgcggctgctgctgctgaccaacggggaccggcagacccagcgggagaagattgaggcctgtgcctgccagagctactttgatgctgtggtggtgggcggggagcagcgggaggagaagccagcccccagcatcttctactactgctgcaacctgctgggcgtgcagcccggggactgtgtgatggtgggggacaccctggagacagacatccagggcggcctgaatgccggcctgaaggccaccgtgtggatcaacaagaatggcatcgtgcccctgaagagcagccctgtgccccactacatggtgtcctctgtgctggagctgcctgccctgctgcagagcattgactgcaaggtgtccatgagcacctag

SEQ ID NO: 161059 - DNA, 1515 bp, Artificial Sequence
  Description of Artificial Sequence: Synthetic coding sequence
atggccgcccaggccctggccctgctgcgggaggtggcccggctggaggcccccctggaggagctgcgggccctgcacagcgtgctgcaggccgtgcccctgaatgagctgcggcagcaggccgctgagctgcggctgggccccctcttcagcctgctgaatgaaaaccaccgggagaagaccaccctgtgtgtgtccatcctggagcggctgctgcaggccatggagcctgtgcacgtggccaggaacctgcgggtggacctgcagaggggcctcatccacccagatgacagcgtgaagatcctgaccctgagccagatcggccgcatcgtggagaacagtgatgctgtgacagagatcctgaacaatgctgagctgctgaagcagatcgtgtactgcattggaggagagaacctgtctgtggccaaggccgccatcaagagcctgagccgcatcagcctgacccaggccggcctggaggccctgtttgagagcaacctgctggatgacctgaagtctgtgatgaagaccaatgacatcgtgcgctacagagtgtatgagctgatcatcgagatcagctctgtgtccccagagagcctgaactactgcaccaccagcggcctggtgacccagctgctgcgggagctgactggagaagatgtgctggtgcgggccacctgcatcgagatggtgaccagcctggcctacacccaccacggccggcagtacctggcccaggagggcgtcatcgaccagatcagcaacatcatcgtgggcgctgacagcgaccccttcagcagcttctacctgcccggctttgtgaagttctttggaaacctggccgtgatggacagcccccagcagatctgtgagcgctaccccatctttgtggagaaggtgtttgagatgattgagagccaggaccccaccatgattggagtggccgtggacacagtgggcatcctgggcagcaatgtggagggcaagcaggtgctgcagaagacaggcaccaggtttgagcggctgctgatgagaattggccaccagagcaagaatgcccctgtggagctgaagatccgctgcctggatgccatcagcagcctgctgtacctgcccccagagcagcagacagatgacctgctgaggatgacagagagctggttcagcagcctgagccgggaccccctggagctgttccggggcatcagcagccagcccttccctgagctgcactgtgccgccctgaaggtgttcaccgccatcgccaaccagccctgggcccagaagctgatgttcaacagccctggctttgtggagtatgtggtggacagatctgtggagcatgacaaggccagcaaggatgccaagtatgagctggtgaaggccctggccaacagcaagaccatcgccgagatctttggaaaccccaactacctgcggctgcggacctacctgtctgagggcccctactacgtgaagcctgtgtccaccacagctgtggagggcgctgagtag

SEQ ID NO: 161060 - DNA, 423 bp, Artificial Sequence
  Description of Artificial Sequence: Synthetic coding sequence
atggtgctggtgctggactacagcggccggcccatggtgatcagcagcggcatgcagagcatggacaccatgaagcaggtgtaccagatcgtgaagcccctgaaccccaacttctgcttcctgcagtgcaccagcgcctaccccctgcagccagaagatgtgaacctgcgggtcatcagcgagtaccagaagctgttcccagacatccccatcggctacagcggccacgagaccggcatcgccatctctgtggccgctgtggccctgggcgccaaggtgctggagcggcacatcaccctggacaagacctggaagggcagtgaccacagcgccagcctggagcctggagagctggccgagctggtgcgctctgtgcggctggtggagcgggccctgggcagccccaccaagcagctgctgtag

SEQ ID NO: 161061 - DNA, 348 bp, Artificial Sequence
  Description of Artificial Sequence: Synthetic coding sequence
gaagatgtgaacctgcgggtcatcagcgagtaccagaagctgttcccagacatccccatcggctacagcggccatgaaacaggaattgccatctctgtggccgctgtggccctgggcgccaaggtgctggagcggcacatcaccctggacaagacctggaagggcagtgaccacagcgccagcctggagcccggggagctggccgagctggtgcgctctgtgcggctggtggagcgggccctgggcagccccaccaagcagctgctgccctgtgagatggcctgcaatgagaaggtgtgcccagctggcctgtacagcgtgctgctgccctgtgtggagaagggctag

SEQ ID NO: 161062 - DNA, 873 bp, Artificial Sequence
  Description of Artificial Sequence: Synthetic coding sequence
atggacatcgaggcctacctggagcgcatcggctacaagaagagcaggaacaagctggacctggagaccctgacagacatcctgcagcaccagatccgggctgtgccctttgagaacctgaacatccactgtggagatgccatggacctgggcctggaggccatctttgaccaggtggtgagaagaaacagaggaggctggtgcctgcaggtgaaccacctgctgtactgggccctgaccaccatcggctttgagaccaccatgctgggcggctacgtgtacagcaccccagccaagaagtacagcacaggcatgatccacctgctgctgcaggtgaccattgatggaagaaactacatcgtggatgctggcttcggccgcagctaccagatgtggcagcccctggagctgatcagcggcaaggaccagccccaggtgccctgtgtgttccggctgacagaagaaaatggcttctggtacctggaccagatcagaagagagcagtacatccccaatgaggagttcctgcacagcgacctgctggaggacagcaagtacaggaagatctacagcttcaccctgaagcccaggaccatcgaggactttgagagcatgaacacctacctgcagaccagccccagctctgtgttcaccagcaagagcttctgcagcctgcagaccccagatggagtgcactgcctggtgggcttcaccctgacccaccggcgcttcaactacaaggacaacacagacctgattgagttcaagaccctgtctgaggaggagattgagaaggtgctgaagaacatcttcaacatcagcctgcagaggaagctggtgcccaagcatggagaccgcttcttcaccatctag

SEQ ID NO: 161063 - DNA, 873 bp, Artificial Sequence; identical to SEQ ID NO: 161062
  Description of Artificial Sequence: Synthetic coding sequence

SEQ ID NO: 161064 - DNA, 873 bp, Artificial Sequence; identical to SEQ ID NO: 161062
  Description of Artificial Sequence: Synthetic coding sequence

SEQ ID NO: 161065 - DNA, 873 bp, Artificial Sequence; identical to SEQ ID NO: 161062
  Description of Artificial Sequence: Synthetic coding sequence

SEQ ID NO: 161066 - DNA, 873 bp, Artificial Sequence; identical to SEQ ID NO: 161062
  Description of Artificial Sequence: Synthetic coding sequence

SEQ ID NO: 161067 - DNA, 873 bp, Artificial Sequence; identical to SEQ ID NO: 161062
  Description of Artificial Sequence: Synthetic coding sequence

SEQ ID NO: 161068 - DNA, 873 bp, Artificial Sequence; identical to SEQ ID NO: 161062
  Description of Artificial Sequence: Synthetic coding sequence

SEQ ID NO: 161069 - DNA, 1059 bp, Artificial Sequence
  Description of Artificial Sequence: Synthetic coding sequence
atgctgctgctgctgctgcacaaggaggccgccctggagccccagggccctgctgtgggctacaacagcctgcctgtgtctgatgaccaccacgtgtctggcatccaggccaggaagaagcagcagagcgtcttctggatcaagacagaggaccagcccaccttcaacctgctgaggaagggcatcatggacatcgaggcctacctggagcgcatcggctacaagaagagcaggaacaagctggacctggagaccctgacagacatcctgcagcaccagatccgggctgtgccctttgagaacctgaacatccactgtggagatgccatggacctgggcctggaggccatctttgaccaggtggtgagaagaaacagaggaggctggtgcctgcaggtgaaccacctgctgtactgggccctgaccaccatcggctttgagaccaccatgctgggcggctacgtgtacagcaccccagccaagaagtacagcacaggcatgatccacctgctgctgcaggtgaccattgatggaagaaactacatcgtggatgctggcttcggccgcagctaccagatgtggcagcccctggagctgatcagcggcaaggaccagccccaggtgccctgtgtgttccggctgacagaagaaaatggcttctggtacctggaccagatcagaagagagcagtacatccccaatgaggagttcctgcacagcgacctgctggaggacagcaagtacaggaagatctacagcttcaccctgaagcccaggaccatcgaggactttgagagcatgaacacctacctgcagaccagccccagctctgtgttcaccagcaagagcttctgcagcctgcagaccccagatggagtgcactgcctggtgggcttcaccctgacccaccggcgcttcaactacaaggacaacacagacctgattgagttcaagaccctgtctgaggaggagattgagaaggtgctgaagaacatcttcaacatcagcctgcagaggaagctggtgcccaagcatggagaccgcttcttcaccatctag

SEQ ID NO: 161070 - DNA, 873 bp, Artificial Sequence
  Description of Artificial Sequence: Synthetic coding sequence
atggacatcgaggcctactttgagcgcatcggctacaagaacagcaggaacaagctggacctggagaccctgacagacatcctggagcaccagatccgggctgtgccctttgagaacctgaacatgcactgcggccaggccatggagctgggcctggaggccatctttgaccacatcgtgagaagaaacagaggaggctggtgcctgcaggtgaaccagctgctgtactgggccctgaccaccatcggcttccagaccaccatgctgggcggctacttctacatcccccctgtgaacaagtacagcacaggcatggtgcacctgctgctgcaggtgaccattgatggaagaaactacatcgtggatgctggcagcggcagcagcagccagatgtggcagcccctggagctgatcagcggcaaggaccagccccaggtgccctgcatcttctgcctgacagaggagcggggcatctggtacctggaccagatcagaagagagcagtacatcaccaacaaggagttcctgaacagccacctgctgcccaagaagaagcaccagaagatctacctgttcaccctggagcccaggaccatcgaggactttgagagcatgaacacctacctgcagaccagccccaccagcagcttcatcaccaccagcttctgcagcctgcagaccccagagggcgtgtactgcctggtgggcttcatcctgacctacaggaagttcaactacaaggacaacacagacctggtggagttcaagaccctgacagaggaggaggtggaggaggtgctgaggaacatcttcaagatcagcctgggcaggaacctggtgcccaagccaggagatggcagcctgaccatctag

SEQ ID NO: 161071 - DNA, 684 bp, Artificial Sequence
  Description of Artificial Sequence: Synthetic coding sequence
atggccccctgccacatcaggaagtaccaggagagtgaccggcagtgggtggtgggcctgctgagccggggcatggccgagcacgccccagccaccttccggcagctgctgaagctgcccaggaccctcatcctgctgctgggcggccccctggccctgctgctggtgtctggctcctggctgctggccctggtgttcagcatcagcctcttccctgccctgtggttcctggccaagaagccctggacagaatatgtggacatgaccctgtgcacagacatgtctgacatcaccaagagctacctgtctgagcggggcagctgcttctgggtggccgagagcgaggagaaggtggtgggcatggtgggcgccctgcctgtggatgaccccaccctgcgggagaagaggctgcagctgttccacctgtttgtggacagcgagcaccggcggcagggcatcgccaaggccctggtgaggacagtgctgcagtttgcccgggaccagggctacagcgaggtgatcctggacaccggcaccatccagctgagcgccatggccctgtaccagagcatgggcttcaagaagacaggccagagcttcttctgtgtgtgggcccggctggtggccctgcacacagtgcacttcatctaccacctgcccagcagcaaggtgggcagcctgtag

SEQ ID NO: 161072 - DNA, 405 bp, Artificial Sequence
  Description of Artificial Sequence: Synthetic coding sequence
atggctgacatcgagcagtactacatgaagcccccaggcagctgcttctgggtggccgtgctggatggaaatgtggtgggcatcgtggccgcccgggcccacgaggaggacaacacagtggagctgctgaggatgtctgtggacagccgcttccggggcaagggcatcgccaaggccctgggcaggaaggtgctggagtttgctgtggtgcacaactacagcgctgtggtgctgggcaccacagctgtgaaggtggccgcccacaagctgtatgagagcctgggcttccgccacatgggcgccagtgaccactacgtgctgcccggcatgaccctgagcctggccgagcggctcttcttccaggtgcgctaccaccgctaccgcctgcagctgcgggaggagtag

SEQ ID NO: 161073 - DNA, 909 bp, Artificial Sequence
  Description of Artificial Sequence: Synthetic coding sequence
atgcactgcggccccccagacatggtgtgtgagaccaagatcgtggccgctgaggaccacgaggccctgcccggggccaagaaggatgccctgctggccgctgctggggccatgtggccacccctgcctgctgcccctggccctgctgctgcccccccagcccctcctccagcccctgtggcccagccccacggcggggccggcggggccggccccccaggcggccggggcgtgtgcatccgggagttccgggctgctgagcaggaggccgcccggcgcatcttctatgatggcatcatggagcgcatccccaacacagccttccggggcctgcggcagcacccccgggcccagctgctgtatgccctgctggccgccctgtgctttgctgtgagccgcagcctgctgctgacctgcctggtgcctgctgccctgctgggcctgcgctactactacagcaggaaggtgatccgggcctacctggagtgtgccctgcacacagacatggctgacatcgagcagtactacatgaagcccccaggcagctgcttctgggtggccgtgctggatggaaatgtggtgggcatcgtggccgcccgggcccacgaggaggacaacacagtggagctgctgaggatgtctgtggacagccgcttccggggcaagggcatcgccaaggccctgggcaggaaggtgctggagtttgctgtggtgcacaactacagcgctgtggtgctgggcaccacagctgtgaaggtggccgcccacaagctgtatgagagcctgggcttccgccacatgggcgccagtgaccactacgtgctgcccggcatgaccctgagcctggccgagcggctcttcttccaggtgcgctaccaccgctaccgcctgcagctgcgggaggagtag

SEQ ID NO: 161074 - DNA, 1182 bp, Artificial Sequence
  Description of Artificial Sequence: Synthetic coding sequence
atggatgaaaatgaaagcaaccagagcctgatgaccagcagccagtaccccaaggaggccgtgaggaagaggcagaacagcgccagaaattctggggccagtgacagcagccgcttcagcaggaagagcttcaagctggactaccgcctggaggaggatgtgaccaagagcaagaagggcaaggatggccgctttgtgaacccctggcccacctggaagaaccccagcatccccaacgtgctgcgctggctgatcatggagaaggaccacagctctgtgcccagcagcaaggaggagctggacaaggagctgcctgtgctgaagccctacttcatcaccaaccctgaggaggccggcgtgcgggaggccggcctgcgggtgacctggctgggccacgccaccgtgatggtggagatggatgagctgatcttcctgacagaccccatcttcagcagccgggccagccccagccagtacatgggccccaagcgcttccgccgcagcccctgcaccatcagcgagctgccccccattgatgctgtgctgatcagccacaaccactatgaccacctggactacaacagcgtgattgccctgaatgaaagatttggaaatgagctgcgctggtttgtgcccctgggcctgctggactggatgcagaagtgtggctgtgaaaatgtcatcgagctggactggtgggaggagaactgtgtgcccggccatgacaaggtgacctttgtgttcacccccagccagcactggtgcaagaggaccctgatggatgacaacaaggtgctgtggggctcctggagcgtgctgggcccctggaaccgcttcttctttgctggggacaccggctactgcccagcctttgaggagatcggcaagcgcttcggcccctttgacctggccgccatccccatcggggcctatgagccccgctggttcatgaagtaccagcacgtggaccctgaggaggccgtgcgcatccacacagatgtgcagaccaagaagtccatggccatccactggggcacctttgccctggccaatgagcactacctggagccccctgtgaagctgaatgaggccctggagagatatggcctgaatgctgaggacttctttgtgctgaagcacggggagagccgctacctgaacaatgatgatgagaacttctag

SEQ ID NO: 161075 - DNA, 375 bp, Artificial Sequence
  Description of Artificial Sequence: Synthetic coding sequence
atggatgaaaatgaaagcaaccagagcctgatgaccagcagccagtaccccaaggaggccgtgaggaagaggcagaacagcgccagaaattctggggccagtgacagcagccgcttcagcaggaagagcttcaagctggactaccgcctggaggaggatgtgaccaagagcaagaagggcaaggatggccgctttgtgaacccctggcccacctggaagaaccccagcatccccaacgtgctgcgctggctgatcatggagaaggaccacagctctgtgcccagcagcaaggaggagctggacaaggagctgcctgtgctgaagccctacttcatcaccaaccctgaggaggccggcgtgcgggaggccggctag

SEQ ID NO: 161076 - DNA, 1182 bp, Artificial Sequence; identical to SEQ ID NO: 161074
  Description of Artificial Sequence: Synthetic coding sequence

SEQ ID NO: 161077 - DNA, 18 bp, Artificial Sequence
  Description of Artificial Sequence: Synthetic coding sequence
atggatgaaaatgaatag

SEQ ID NO: 161078 - DNA, 1182 bp, Artificial Sequence; identical to SEQ ID NO: 161074
  Description of Artificial Sequence: Synthetic coding sequence

SEQ ID NO: 161079 - DNA, 1401 bp, Artificial Sequence
  Description of Artificial Sequence: Synthetic coding sequence
atggcccggcggcgggagctgaagcgctgcctgcagctgctggccagcagcgctgagcccgcccggcgggcccgggtgaggaagaaccccagcgcctgccggggccggcccagccgctatgctgctgccctgtgtgccggcaccctgtggccagaggccgctgagctgcggcggcgggccctgcctgccacccccagcgccagcagcagccccaaggacatggatgaaaatgaaagcaaccagagcctgatgaccagcagccagtaccccaaggaggccgtgaggaagaggcagaacagcgccaggaacagcggggccagtgacagcagccgcttcagcaggaagagcttcaagctggactaccgcctggaggaggatgtgaccaagagcaagaagggcaaggatggccgctttgtgaacccctggcccacctggaagaaccccagcatccccaacgtgctgcgctggctgatcatggagaaggaccacagctctgtgcccagcagcaaggaggagctggacaaggagctgcctgtgctgaagccctacttcatcaccaaccctgaggaggccggcgtgcgggaggccggcctgcgggtgacctggctgggccacgccaccgtgatggtggagatggatgagctgatcttcctgacagaccccatcttcagcagccgggccagccccagccagtacatgggccccaagcgcttcagaagaagcccctgcaccatcagcgagctgccccccattgatgctgtgctgatcagccacaaccactatgaccacctggactacaacagcgtcatcgccctgaatgaaagatttggaaatgagctgcgctggtttgtgcccctgggcctgctggactggatgcagaagtgtggctgtgaaaatgtgattgagctggactggtgggaggagaactgtgtgcccggccatgacaaggtgacctttgtgttcacccccagccagcactggtgcaagaggaccctgatggatgacaacaaggtgctgtggggctcctggagcgtgctgggcccctggaaccgcttcttctttgctggggacaccggctactgcccagcctttgaggagatcggcaagagatttggcccctttgacctggccgccatccccatcggggcctatgagccccgctggttcatgaagtaccagcacgtggaccctgaggaggccgtgcgcatccacacagatgtgcagaccaagaagtccatggccatccactggggcacctttgccctggccaatgagcactacctggagccccctgtgaagctgaatgaggccctggagagatatggcctgaatgctgaggacttctttgtgctgaagcatggagagagccgctacctgaacaatgatgatgagaacttctag

SEQ ID NO: 161080 - DNA, 1182 bp, Artificial Sequence; identical to SEQ ID NO: 161074
  Description of Artificial Sequence: Synthetic coding sequence

SEQ ID NO: 161081 - DNA, 2199 bp, Artificial Sequence
  Description of Artificial Sequence: Synthetic coding sequence
atggagcggcaggtgctgctgtctgagcctgaggaggccgccgccctgtaccggggcctgagccggcagcctgccctgtctgctgcctgcctgggccctgaggtgaccacccagtatggaggccagtacagaacagtgcacacagagtggacccagagggacctggagaggatggagaacatccgcttctgccggcagtacctggtgttccatgatggagacagcgtggtgtttgctggccctgctggcaacagcgtggagaccagaggagagctgctgagccgggagagccccagcggcaccatgaaggctgtgctgaggaaggccggcggcaccggccctggagaggagaagcagttcctggaggtgtgggagaagaacaggaagctgaagagcttcaacctgagcgccctggagaagcacggccctgtgtatgaagatgactgcttcggctgcctgtcctggagccacagcgagacccacctgctgtatgtggccgagaagaagaggcccaaggccgagagcttcttccagaccaaggccctggatgtgtctgccagtgatgatgaaattgcccggctgaagaagccagaccaggccatcaagggggaccagtttgtgttctatgaggactggggcgagaacatggtgtccaagagcatccctgtgctgtgtgtgctggatgtggagagcggcaacatctctgtgctggagggcgtgcctgaaaatgtgtccccaggccaggccttctgggcccctggagatgctggggtggtgtttgtgggctggtggcatgagcccttccggctgggcatccgcttctgcaccaacagaagaagtgccctgtactacgtggacctgattggaggaaaatgtgagctgctgagtgatgacagcctggccgtgagcagcccccggctgagcccagaccagtgccgcatcgtgtacctgcagtaccccagcctcatcccccaccaccagtgcagccagctgtgcctgtatgactggtacaccaaggtgacctctgtggtggtggatgtggtgccccggcagctgggggagaacttcagcggcatctactgcagcctgctgcccctgggctgctggagcgctgacagccagagggtggtgtttgacagcgcccagaggagccggcaggacctgtttgctgtggacacccaggtgggcaccgtgaccagcctgacagctgggggcagcggcggctcctggaagctgctgaccatcgaccaggacctgatggtggcccagttcagcacccccagcctgccccccaccctgaaggtgggcttcctgcccagcgctgggaaggagcagagcgtgctgtgggtgtccctggaggaggccgagcccatcccagacatccactggggcatccgggtgctgcagcccccacctgagcaggagaatgtgcagtatgccggcctggactttgaggccatcctgctgcagcccggcagccccccagacaagacccaggtgcccatggtggtgatgcctcatggaggcccccacagcagctttgtgacagcctggatgctgtttcctgccatgctgtgcaagatgggctttgctgtgctgctggtgaactaccggggcagcactggatttggccaggacagcatcctgagcctgcctggaaatgtgggccaccaggatgtgaaggatgtgcagtttgctgtggagcaggtgctgcaggaggagcactttgatgccagccacgtggccctgatgggcggcagccacggcggcttcatcagctgccacctgattggccagtacccagagacctaccgggcctgtgtggccaggaaccctgtgatcaacatcgcctccatgctgggcagcacagacatcccagactggtgtgtggtggaggccggcttccccttcagcagtgactgcctgcctgacctgtctgtgtgggccgagatgctggacaagagccccatccgctacatcccccaggtgaagacccccctgctgctgatgctgggccaggaggaccggcgggtgcccttcaagcagggcatggagtactaccgggccctgaagaccagaaatgtgcctgtgcggctgctgctgtaccccaagagcacccacgccctgtctgaggtggaggtggagagtgacagcttcatgaatgctgtgctgtggctgcggacccacctgggcagctag

SEQ ID NO: 161082 - DNA, 1833 bp, Artificial Sequence
  Description of Artificial Sequence: Synthetic coding sequence
gtgctgaaccggctgcagagcaaatatggcagcctgtaccgccgggacaacgtcatcctgagcggcacccacacccacagcggccctgctggctacttccagtacacagtgtttgtgattgccagcgagggcttcagcaaccagaccttccagcacatggtgacaggcatcctgaagagcattgatattgcccacaccaacatgaagccaggcaagatcttcatcaacaagggaaatgtggatggagtgcagatcaacagaagcccctacagctacctgcagaacccccagagcgagcgggcccgctacagcagcaacacagacaaggagatgattgtgctgaagatggtggacctgaatggagatgacctgggcctcatctcctggtttgccatccaccctgtgtccatgaacaacagcaaccacctggtgaacagcgacaacgtgggctacgccagctacctgctggagcaggagaagaacaagggctacctgcccggccagggcccctttgtggccgccttcagcagcagcaacctgggagatgtgagccccaacatcctgggcccccgctgcatcaacacaggagagagctgtgacaatgccaacagcacctgccccatcggcggccccagcatgtgcatcgccaagggccctggccaggacatgtttgacagcacccagatcatcggccgggccatgtaccagagggccaaggagctgtatgccagcgccagccaggaggtgacaggccccctggccagcgcccaccagtgggtggacatgacagatgtgacagtgtggctgaacagcacccacgccagcaagacctgcaagccagccctgggctacagctttgctgctggcaccattgatggagtgggcggcctgaacttcacccagggcaagacagaaggagaccccttctgggacaccatccgggaccagatcctgggcaagcccagcgaggagatcaaggagtgccacaagcccaagcccatcctgctgcacactggagagctgagcaagccccacccctggcacccagacatcgtggatgtgcagatcatcaccctgggcagcctggccatcacagccatccctggagagttcaccaccatgtctggaagaaggctgcgggaggccgtgcaggccgagtttgccagccacggcatgcagaacatgacagtggtgatcagcggcctgtgcaatgtgtacacccactacatcaccacctatgaggagtaccaggcccagagatatgaagctgccagcaccatctacggcccccacaccctgagcgcctacatccagctgttcaggaacctggccaaggccatcgccacagacacagtggccaacctgagccggggccctgagccccccttcttcaagcagctgattgtgcccctcatccccagcatcgtggaccgggcccccaagggccgcacctttggagatgtgctgcagcctgccaagccagagtacagagtgggggaggtggccgaggtgatctttgtgggcgccaaccccaagaacagcgtgcagaaccagaaccaccagaccttcctgactgtggagaagtatgaggccaccagcacctcctggcagatcgtgtgcaatgatgcctcctgggagacccgcttctactggcacaagggcctgctgggcctgagcaatgccaccgtggagtggcacatcccagacacagcccagcccggcatctaccgcatccgctacttcggccacaacaggaagcaggacatcctgaagccagctgtgatcctgagctttgagggcaccagccctgcctttgaggtggtgaccatctag

SEQ ID NO: 161083 - DNA, 1869 bp, Artificial Sequence
  Description of Artificial Sequence: Synthetic coding sequence
atggattctgagaagagcagcgagtggaggagtgatgtgctgaaccggctgcagagcaaatatggcagcctgtaccgccgggacaacgtcatcctgagcggcacccacacccacagcggccctgctggctacttccagtacacagtgtttgtgattgccagcgagggcttcagcaaccagaccttccagcacatggtgacaggcatcctgaagagcattgatattgcccacaccaacatgaagccaggcaagatcttcatcaacaagggaaatgtggatggagtgcagatcaacagaagcccctacagctacctgcagaacccccagagcgagcgggcccgctacagcagcaacacagacaaggagatgattgtgctgaagatggtggacctgaatggagatgacctgggcctcatctcctggtttgccatccaccctgtgtccatgaacaacagcaaccacctggtgaacagcgacaacgtgggctacgccagctacctgctggagcaggagaagaacaagggctacctgcccggccagggcccctttgtggccgccttcagcagcagcaacctgggagatgtgagccccaacatcctgggcccccgctgcatcaacacaggagagagctgtgacaatgccaacagcacctgccccatcggcggccccagcatgtgcatcgccaagggccctggccaggacatgtttgacagcacccagatcatcggccgggccatgtaccagagggccaaggagctgtatgccagcgccagccaggaggtgacaggccccctggccagcgcccaccagtgggtggacatgacagatgtgacagtgtggctgaacagcacccacgccagcaagacctgcaagccagccctgggctacagctttgctgctggcaccattgatggagtgggcggcctgaacttcacccagggcaagacagaaggagaccccttctgggacaccatccgggaccagatcctgggcaagcccagcgaggagatcaaggagtgccacaagcccaagcccatcctgctgcacactggagagctgagcaagccccacccctggcacccagacatcgtggatgtgcagatcatcaccctgggcagcctggccatcacagccatccctggagagttcaccaccatgtctggaagaaggctgcgggaggccgtgcaggccgagtttgccagccacggcatgcagaacatgacagtggtgatcagcggcctgtgcaatgtgtacacccactacatcaccacctatgaggagtaccaggcccagagatatgaagctgccagcaccatctacggcccccacaccctgagcgcctacatccagctgttcaggaacctggccaaggccatcgccacagacacagtggccaacctgagccggggccctgagccccccttcttcaagcagctgattgtgcccctcatccccagcatcgtggaccgggcccccaagggccgcacctttggagatgtgctgcagcctgccaagccagagtacagagtgggggaggtggccgaggtgatctttgtgggcgccaaccccaagaacagcgtgcagaaccagaaccaccagaccttcctgactgtggagaagtatgaggccaccagcacctcctggcagatcgtgtgcaatgatgcctcctgggagacccgcttctactggcacaagggcctgctgggcctgagcaatgccaccgtggagtggcacatcccagacacagcccagcccggcatctaccgcatccgctacttcggccacaacaggaagcaggacatcctgaagccagctgtgatcctgagctttgagggcaccagccctgcctttgaggtggtgaccatctag

SEQ ID NO: 161084 - DNA, 1341 bp, Artificial Sequence
  Description of Artificial Sequence: Synthetic coding sequence
atggagatggagcaggagaagatgaccatgaacaaggagctgagcccagatgctgctgcctactgctgcagcgcctgccacggagatgagacctggagctacaaccaccccatccggggccgggccaagagccgcagcctgagcgccagccctgccctgggcagcaccaaggagttccggaggaccaggagcctgcacggcccctgccctgtgaccaccttcggccccaaggcctgtgtgctgcagaacccccagaccatcatgcacatccaggaccctgccagccagaggctgacctggaacaagagccccaagtctgtgctggtgatcaagaagatgagagatgccagcctgctgcagcccttcaaggagctgtgcacccacctgatggaggagaacatgattgtgtatgtggagaagaaggtgctggaggaccctgccatcgccagtgatgagagctttggagctgtgaagaagaagttctgcaccttccgggaggactatgatgacatcagcaaccagattgacttcatcatctgcctgggcggagatggcaccctgctgtatgccagcagcctcttccagggctctgtgccccctgtgatggccttccacctgggcagcctgggcttcctgacccccttctcctttgagaacttccagagccaggtgacccaggtgattgagggcaatgctgctgtggtgctgcggagccggctgaaggtgcgggtggtgaaggagctgcggggcaagaagacagctgtgcacaacggcctgggagaaaatggcagccaggccgccggcctggacatggatgtgggcaagcaggccatgcagtaccaggtgctgaatgaggtggtgattgaccggggccccagcagctacctgagcaatgtggatgtgtacctggatggccacctgatcaccaccgtgcagggagatggagtgattgtgtccacccccaccggcagcacagcctatgctgctgctgctggggcctccatgatccaccccaacgtgcctgccatcatgatcacccccatctgcccccacagcctgtccttccggcccatcgtggtgcctgctggggtggagctgaagatcatgctgagccctgaggccaggaacacagcctgggtgtcctttgatggcaggaagaggcaggagatccgccacggggacagcatcagcatcaccaccagctgctaccccctgcccagcatctgtgtgcgggaccctgtgtctgactggtttgagagcctggcccagtgcctgcactggaatgtgaggaagaagcaggcccactttgaggaggaggaggaggaggaggaggagggctag

SEQ ID NO: 161085 - DNA, 1341 bp, Artificial Sequence; identical to SEQ ID NO: 161084
  Description of Artificial Sequence: Synthetic coding sequence

SEQ ID NO: 161086 - DNA, 1245 bp, Artificial Sequence
  Description of Artificial Sequence: Synthetic coding sequence
atgggccggccccgggtgcggcaggcctggccaggctgctgcggccacacaggccgcctgcctgctggccggggctacctggccagccacatgtgtgaccctgctggagctgagctgattggagatggcatgtctgaccccaccccacccagcaatgcctgcaccggccacatccaggaccctgccagccagaggctgacctggaacaagagccccaagtctgtgctggtgatcaagaagatgagagatgccagcctgctgcagcccttcaaggagctgtgcacccacctgatggaggagaacatgattgtgtatgtggagaagaaggtgctggaggaccctgccatcgccagtgatgagagctttggagctgtgaagaagaagttctgcaccttccgggaggactatgatgacatcagcaaccagattgacttcatcatctgcctgggcggagatggcaccctgctgtatgccagcagcctcttccagggctctgtgccccctgtgatggccttccacctgggcagcctgggcttcctgacccccttctcctttgagaacttccagagccaggtgacccaggtgattgagggcaatgctgctgtggtgctgcggagccggctgaaggtgcgggtggtgaaggagctgcggggcaagaagacagctgtgcacaacggcctgggagaaaatggcagccaggccgccggcctggacatggatgtgggcaagcaggccatgcagtaccaggtgctgaatgaggtggtgattgaccggggccccagcagctacctgagcaatgtggatgtgtacctggatggccacctgatcaccaccgtgcagggagatggagtgattgtgtccacccccaccggcagcacagcctatgctgctgctgctggggcctccatgatccaccccaacgtgcctgccatcatgatcacccccatctgcccccacagcctgtccttccggcccatcgtggtgcctgctggggtggagctgaagatcatgctgagccctgaggccaggaacacagcctgggtgtcctttgatggcaggaagaggcaggagatccgccacggggacagcatcagcatcaccaccagctgctaccccctgcccagcatctgtgtgcgggaccctgtgtctgactggtttgagagcctggcccagtgcctgcactggaatgtgaggaagaagcaggcccactttgaggaggaggaggaggaggaggaggagggctag

SEQ ID NO: 161087 - DNA, 1776 bp, Artificial Sequence
  Description of Artificial Sequence: Synthetic coding sequence
atggagatggagcaggagaagatgaccatgaacaaggagctgagcccagatgctgctgcctactgctgcagcgcctgccacggagatgagacctggagctacaaccaccccatccggggccgggccaagagccgcagcctgagcgccagccctgccctgggcagcaccaaggagttccggaggaccaggagcctgcacggcccctgccctgtgaccaccttcggccccaaggcctgtgtgctgcagaacccccagaccatcatcgccacccccctgagcctggccagccagctgctgcccagccctgctgtgagccacagcggccagggcggcgtgacaggccaggtgcacgtgctgccccagcccagcgaccagggcgtgctgagcggccccagggctgcccggggccagacagccccccaggaggaggccgtgacccaggaggaggtggaggccctggtgtgtggccacacccagcgctgggtgcccggccctgtgtatgatgctgctgctgggggcagcggctgggcccagctgagcctgcgggccggcatgggcgtgggccaggccaccggccacatccaggaccctgccagccagaggctgacctggaacaagagccccaagtctgtgctggtgatcaagaagatgagagatgccagcctgctgcagcccttcaaggagctgtgcacccacctgatggaggcccggggagctgggggcaagggggcctggggcgcccacggcgtgggcggggccagcatccacatcacagccccccgggtgggcagcgctgggggcatgagccggctggccctgtgcttccaggagaacatgattgtgtatgtggagaagaaggtgctggaggaccctgccatcgccagtgatgagagctttggagctgtgaagaagaagttctgcaccttcagagaagattatgatgacatcagcaaccagattgacttcatcatctgcctgggcggagatggcaccctgctgtatgccagcagcctcttccagggctctgtgccccctgtgatggccttccacctgggcagcctgggcttcctgacccccttctcctttgagaacttccagagccaggtgacccaggtgattgagggcaatgctgctgtggtgctgcggagccggctgaaggtgcgggtggtgaaggagctgcggggcaagaagacagctgtgcacaacggcctgggggagaatggcagccaggccgccggcctggacatggatgtgggcaagcaggccatgcagtaccaggtgctgaatgaggtggtgattgaccggggccccagcagctacctgagcaatgtggatgtgtacctggatggccacctgatcaccaccgtgcagggagatggagtcatcgtgtccacccccaccggcagcacagcctatgctgctgctgctggggcctccatgatccaccccaacgtgcctgccatcatgatcacccccatctgcccccacagcctgtccttccggcccatcgtggtgcctgctggggtggagctgaagatcatgctgagccctgaggccaggaacacagcctgggtgtcctttgatggcaggaagaggcaggagatcagacatggagacagcatcagcatcaccaccagctgctaccccctgcccagcatctgtgtgcgggaccctgtgtctgactggtttgagagcctggcccagtgcctgcactggaatgtgaggaagaagcaggcccactttgaggaggaggaggaggaggaggaggagggctag

SEQ ID NO: 161088 - DNA, 1776 bp, Artificial Sequence; identical to SEQ ID NO: 161087
  Description of Artificial Sequence: Synthetic coding sequence

SEQ ID NO: 161089 - DNA, 621 bp, Artificial Sequence
  Description of Artificial Sequence: Synthetic coding sequence
atgggccggccccgggtgcggcaggcctggccaggctgctgcggccacacaggccgcctgcctgctggccggggctacctggccagccacatgtgtgaccctgctggagctgagctgattggagatggcatgtctgaccccaccccacccagcaatgcctgcaccggccacatccaggaccctgccagccagaggctgacctggaacaagagccccaagtctgtgctggtgatcaagaagatgagagatgccagcctgctgcagcccttcaaggagctgtgcacccacctgatggaggagaacatgattgtgtatgtggagaagaaggtgctggaggaccctgccatcgccagtgatgagagctttggagctgtgaagaagaagttctgcaccttccgggaggactatgatgacatcagcaaccagattgacttcatcatctgcctgggcggagatggcaccctgctgtatgccagcagcctcttccagggctctgtgccccctgtgatggccttccacctgggcagcctgggcttcctgacccccttctcctttgagaacttccagagccaggtgacccaggtgattgagggcaatgctgctgtggtgctgcggagctag

SEQ ID NO: 161090 - DNA, 2121 bp, Artificial Sequence
  Description of Artificial Sequence: Synthetic coding sequence
atgggcaggaaggtgacagtggccacctgtgccctgaaccagtgggccctggactttgagggcaacctgcagaggatcctgaagagcattgagatcgccaagaacagaggagcccgctaccgcctgggccctgagctggagatctgtggctacggctgctgggaccactactatgaaagtgacaccctgctgcacagcttccaggtgctggccgccctggtggagagccctgtgacccaggacatcatctgtgatgtgggcatgcctgtgatgcacagaaatgtgcgctacaactgcagggtcatcttcctgaacaggaagatcctgctgatccggcccaagatggccctggccaatgaaggcaactaccgggagctgcgctggttcaccccctggagccgcagccgccacacagaggagtacttcctgcccaggatgatccaggacctgaccaagcaggagaccgtgccctttggagatgctgtgctggtgacctgggacacctgcatcggcagcgagatctgtgaggagctgtggaccccccacagcccccacatcgacatgggcctggatggagtggagatcatcaccaatgccagcggcagccaccaggtgctgaggaaggccaacaccagggtggacctggtgaccatggtgaccagcaagaatggaggcatctacctgctggccaaccagaagggctgtgatggagaccggctgtactatgatggctgtgccatgattgccatgaatggatctgtgtttgcccagggcagccagttcagcctggatgatgtggaggtgctgacagccaccctggacctggaggatgtgcgcagctacagagctgagatcagcagcaggaacctggccgccagccgggccagcccctacccccgggtgaaggtggactttgccctgagctgccacgaggacctgctggcccccatcagcgagcccatcgagtggaagtaccacagccctgaggaggagatcagcctgggccctgcctgctggctgtgggacttcctgcggcgcagccagcaggccggcttcctgctgcccctgtctggaggagtggacagcgctgccacagcctgcctgatctacagcatgtgctgccaggtgtgtgaggccgtgcgctctggaaatgaggaggtgctggctgatgtgaggaccatcgtgaaccagatctcctacaccccccaggacccccgggacctgtgtggccgcatcctgaccacctgctacatggccagcaagaacagcagccaggagacctgcacccgggcccgggagctggcccagcagatcggcagccaccacatcagcctgaacattgatcctgctgtgaaggctgtgatgggcatcttcagcctggtgacaggcaagagccccctgtttgctgcccatggaggcagcagccgggagaacctggccctgcagaatgtgcaggcccgcatccgcatggtgctggcctacctgtttgcccagctgagcctgtggagcagaggagtgcatggaggcctgctggtgctgggcagcgccaacgtggatgagagcctgctgggctacctgaccaagtatgactgcagcagcgctgacatcaaccccatcggcggcatcagcaagacagacctgcgggcctttgtgcagttctgcatccagcgcttccagctgcctgccctgcagagcatcctgctggccccagccacagctgagctggagcccctggctgatggccaggtgtcccagacagatgaggaggacatgggcatgacctacgccgagctgtctgtgtatggcaagctgaggaaggtggccaagatgggcccctacagcatgttctgcaagctgctgggcatgtggaggcacatctgcaccccccggcaggtggccgacaaggtgaagcgcttcttcagcaagtacagcatgaacagacacaagatgaccaccctgaccccagcctaccacgccgagaactacagccctgaggacaacagatttgacctgcggcccttcctgtacaacacctcctggccctggcagttccgctgcatcgagaaccaggtgctgcagctggagagagctgagccccagagcctggatggagtggactag

SEQ ID NO: 161091 - DNA, 1341 bp, Artificial Sequence
  Description of Artificial Sequence: Synthetic coding sequence
atgggcatcagcggccaggaggtgctgacagccaccctggacctggaggatgtgcgcagctacagagctgagatcagcagcaggaacctggccgccagccgggccagcccctacccccgggtgaaggtggactttgccctgagctgccacgaggacctgctggcccccatcagcgagcccatcgagtggaagtaccacagccctgaggaggagatcagcctgggccctgcctgctggctgtgggacttcctgcggcgcagccagcaggccggcttcctgctgcccctgtctggaggagtggacagcgctgccacagcctgcctgatctacagcatgtgctgccaggtgtgtgaggccgtgcgctctggaaatgaggaggtgctggctgatgtgaggaccatcgtgaaccagatctcctacaccccccaggacccccgggacctgtgtggccgcatcctgaccacctgctacatggccagcaagaacagcagccaggagacctgcacccgggcccgggagctggcccagcagatcggcagccaccacatcagcctgaacattgatcctgctgtgaaggctgtgatgggcatcttcagcctggtgacaggcaagagccccctgtttgctgcccatggaggcagcagccgggagaacctggccctgcagaatgtgcaggcccgcatccgcatggtgctggcctacctgtttgcccagctgagcctgtggagcagaggagtgcatggaggcctgctggtgctgggcagcgccaacgtggatgagagcctgctgggctacctgaccaagtatgactgcagcagcgctgacatcaaccccatcggcggcatcagcaagacagacctgcgggcctttgtgcagttctgcatccagcgcttccagctgcctgccctgcagagcatcctgctggccccagccacagctgagctggagcccctggctgatggccaggtgtcccagacagatgaggaggacatgggcatgacctacgccgagctgtctgtgtatggcaagctgaggaaggtggccaagatgggcccctacagcatgttctgcaagctgctgggcatgtggaggcacatctgcaccccccggcaggtggccgacaaggtgaagcgcttcttcagcaagtacagcatgaacagacacaagatgaccaccctgaccccagcctaccacgccgagaactacagccctgaggacaacagatttgacctgcggcccttcctgtacaacacctcctggccctggcagttccgctgcatcgagaaccaggtgctgcagctggagagagctgagccccagagcctggatggagtggactag

SEQ ID NO: 161092 - DNA, 1122 bp, Artificial Sequence
  Description of Artificial Sequence: Synthetic coding sequence
atggagcctgctgtgtctgagcccatgagggaccaggtggcccggacccacctgacagaggacacccccaaggtgaatgctgacatcgagaaggtgaaccagaaccaggccaagcgctgcaccgtgattggaggcagcggcttcctgggccagcacatggtggagcagctgctggcccggggctatgctgtgaatgtgtttgacatccagcagggctttgacaacccccaggtgcgcttcttcctgggggacctgtgcagccggcaggacctgtacccagccctgaagggcgtgaacacagtgttccactgtgccagccccccacccagcagcaacaacaaggagctgttctacagagtgaactacatcggcaccaagaatgtgattgagacctgcaaggaggccggcgtgcagaagctgatcctgaccagcagcgccagcgtcatctttgagggcgtggacatcaagaatggaacagaggacctgccctatgccatgaagcccatcgactactacacagagaccaagatcctgcaggagagagctgtgctgggcgccaatgaccctgagaagaacttcctgaccacagccatccggccccacggcatcttcggcccccgggacccccagctggtgcccatcctgattgaggccgccagaaatggcaagatgaagtttgtgattggaaatggcaagaacctggtggacttcacctttgtggagaatgtggtgcacggccacatcctggccgctgagcagctgagccgggacagcaccctgggcggcaaggccttccacatcaccaatgatgagcccatccccttctggaccttcctgagccgcatcctgaccggcctgaactatgaggcccccaagtaccacatcccctactgggtggcctactacctggccctgctgctgagcctgctggtgatggtgatcagccctgtgatccagctgcagcccaccttcacccccatgagggtggccctggccggcaccttccactactacagctgtgagcgggccaagaaggccatgggctaccagcccctggtgaccatggatgatgccatggagaggacagtgcagagcttccgccacctgcggcgggtgaagtag

SEQ ID NO: 161093 - DNA, 765 bp, Artificial Sequence
  Description of Artificial Sequence: Synthetic coding sequence
atggagcctgctgtgtctgagcccatgagggaccaggtggcccggacccacctgacagaggacacccccaaggtgaatgctgacatcgagaaggtgaaccagaaccaggccaagcgctgcaccgtgattggaggcagcggcttcctgggccagcacatggtggagcagctgctggcccggggctatgctgtgaatgtgtttgacatccagcagggctttgacaacccccaggtgcgcttcttcctgggggacctgtgcagccggcaggacctgtacccagccctgaagggcgtgaacacagtgttccactgtgccagccccccacccagcagcaacaacaaggagctgttctacagagtgaactacatcggcaccaagaatgtgattgagacctgcaaggaggccggcgtgcagaagctgatcctgaccagcagcgccagcgtcatctttgagggcgtggacatcaagaatggaacagaggacctgccctatgccatgaagcccatcgactactacacagagaccaagatcctgcaggagagagctgtgctgggcgccaatgaccctgagaagaacttcctgaccacagccatccggccccacggcatcttcggcccccgggacccccagctggtgcccatcctgattgaggccgccagaaatggcaagatgaagtttgtgattggaaatggcaagaacctggtggacttcacctttgtggagaatgtggtgcacggccacatcctggccgctgagcagctgtag

SEQ ID NO: 161094 - DNA, 1122 bp, Artificial Sequence; identical to SEQ ID NO: 161092
  Description of Artificial Sequence: Synthetic coding sequence

SEQ ID NO: 161095 - DNA, 825 bp, Artificial Sequence
  Description of Artificial Sequence: Synthetic coding sequence
atggtgggccggcgggccctgattgtgctggcccacagcgagaggaccagcttcaactatgccatgaaggaggccgctgctgctgccctgaagaagaagggctgggaggtggtggagagtgacctgtatgccatgaacttcaaccccatcatcagcaggaaggacatcaccgggaagctgaaggaccctgccaacttccagtacccagctgagagcgtgctggcctacaaggagggccacctgagcccagacatcgtggccgagcagaagaagctggaggccgctgacctggtgatcttccagttccccctgcagtggtttggagtgcctgccatcctgaagggctggtttgagagggtcttcatcggggagtttgcctacacctacgccgccatgtatgacaagggccccttccgcagcaagaaggctgtgctgagcatcaccactggaggcagcggctccatgtacagcctgcagggcatccacggggacatgaatgtcatcctgtggcccatccagagcggcatcctgcacttctgtggcttccaggtgctggagccccagctgacctacagcatcggccacaccccagcagatgcccgcatccagatcctggagggctggaagaagaggctggagaacatctgggatgagacccccctgtactttgcccccagcagcctgtttgacctgaacttccaggccggcttcctgatgaagaaggaggtgcaggatgaggagaagaacaagaagtttggcctgtctgtgggccaccacctgggcaagagcatccccacagacaaccagatcaaggccaggaagtag

SEQ ID NO: 161096 - DNA, 711 bp, Artificial Sequence
  Description of Artificial Sequence: Synthetic coding sequence
atggtgggccggcgggccctgattgtgctggcccacagcgagaggaccagcttcaactatgccatgaaggaggccgctgctgctgccctgaagaagaagggctgggaggtggtggagagtgacctgtatgccatgaacttcaaccccatcatcagcaggaaggacatcaccgggaagctgaaggaccctgccaacttccagtacccagctgagagcgtgctggcctacaaggagggccacctgagcccagacatcgtggccgagcagaagaagctggaggccgctgacctggtgatcttccagagcaagaaggctgtgctgagcatcaccactggaggcagcggctccatgtacagcctgcagggcatccacggggacatgaatgtcatcctgtggcccatccagagcggcatcctgcacttctgtggcttccaggtgctggagccccagctgacctacagcatcggccacaccccagcagatgcccgcatccagatcctggagggctggaagaagaggctggagaacatctgggatgagacccccctgtactttgcccccagcagcctgtttgacctgaacttccaggccggcttcctgatgaagaaggaggtgcaggatgaggagaagaacaagaagtttggcctgtctgtgggccaccacctgggcaagagcatccccacagacaaccagatcaaggccaggaagtag

SEQ ID NO: 161097 - DNA, 723 bp, Artificial Sequence
  Description of Artificial Sequence: Synthetic coding sequence
atggtgggccggcgggccctgattgtgctggcccacagcgagaggaccagcttcaactatgccatgaaggaggccgctgctgctgccctgaagaagaagggctgggaggtggtggagagtgacctgtatgccatgaacttcaaccccatcatcagcaggaaggacatcaccgggaagctgaaggaccctgccaacttccagtacccagctgagagcgtgctggcctacaaggagggccacctgagcccagacatcgtggccgagcagaagaagctggaggccgctgacctggtgatcttccagttccccctgcagtggtttggagtgcctgccatcctgaagggctggtttgagagggtcttcatcggggagtttgcctacacctacgccgccatgtatgacaagggccccttccgcagcggcatcctgcacttctgtggcttccaggtgctggagccccagctgacctacagcatcggccacaccccagcagatgcccgcatccagatcctggagggctggaagaagaggctggagaacatctgggatgagacccccctgtactttgcccccagcagcctgtttgacctgaacttccaggccggcttcctgatgaagaaggaggtgcaggatgaggagaagaacaagaagtttggcctgtctgtgggccaccacctgggcaagagcatccccacagacaaccagatcaaggccaggaagtag

SEQ ID NO: 161098 - DNA, 609 bp, Artificial Sequence
  Description of Artificial Sequence: Synthetic coding sequence
atggtgggccggcgggccctgattgtgctggcccacagcgagaggaccagcttcaactatgccatgaaggaggccgctgctgctgccctgaagaagaagggctgggaggtggtggagagtgacctgtatgccatgaacttcaaccccatcatcagcaggaaggacatcaccgggaagctgaaggaccctgccaacttccagtacccagctgagagcgtgctggcctacaaggagggccacctgagcccagacatcgtggccgagcagaagaagctggaggccgctgacctggtgatcttccagagcggcatcctgcacttctgtggcttccaggtgctggagccccagctgacctacagcatcggccacaccccagcagatgcccgcatccagatcctggagggctggaagaagaggctggagaacatctgggatgagacccccctgtactttgcccccagcagcctgtttgacctgaacttccaggccggcttcctgatgaagaaggaggtgcaggatgaggagaagaacaagaagtttggcctgtctgtgggccaccacctgggcaagagcatccccacagacaaccagatcaaggccaggaagtag

SEQ ID NO: 161099 - DNA, 696 bp, Artificial Sequence
  Description of Artificial Sequence: Synthetic coding sequence
atggccggcaagaaggtgctgattgtgtatgcccaccaggagcccaagagcttcaacggcagcctgaagaatgtggccgtggatgagctgagccggcagggctgcaccgtgacagtgtctgacctgtatgccatgaacctggagccccgggccacagacaaggacatcaccggcaccctgagcaaccctgaggtgttcaactacggcgtggagacccatgaggcctacaagcagaggagcctggccagtgacatcacagatgagcagaagaaggtgcgggaggccgacctggtgatcttccagttccccctgtactggttctctgtgcctgccatcctgaagggctggatggacagagtgctgtgccagggctttgcctttgacatccctggcttctatgattctggcctgctgcagggcaagctggccctgctgtctgtgaccactggaggaacagctgagatgtacaccaagacaggagtgaatggagacagccgctacttcctgtggcccctgcagcacggcaccctgcacttctgtggcttcaaggtgctggccccccagatcagctttgcccctgagatcgccagcgaggaggagaggaagggcatggtggccgcctggagccagaggctgcagaccatctggaaggaggagcccatcccctgcacagcccactggcacttcggccagtag

SEQ ID NO: 161100 - DNA, 696 bp, Artificial Sequence; identical to SEQ ID NO: 161099
  Description of Artificial Sequence: Synthetic coding sequence

SEQ ID NO: 161101 - DNA, 582 bp, Artificial Sequence
  Description of Artificial Sequence: Synthetic coding sequence
atggccggcaagaaggtgctgattgtgtatgcccaccaggagcccaagagcttcaacggcagcctgaagaatgtggccgtggatgagctgagccggcagggctgcaccgtgacagtgtctgacctgtatgccatgaacctggagccccgggccacagacaaggacatcaccggcaccctgagcaaccctgaggtgttcaactacggcgtggagacccatgaggcctacaagcagaggagcctggccagtgacatcacagatgagcagaagaaggtgcgggaggccgacctggtgatcttccagggcaagctggccctgctgtctgtgaccactggaggaacagctgagatgtacaccaagacaggagtgaatggagacagccgctacttcctgtggcccctgcagcacggcaccctgcacttctgtggcttcaaggtgctggccccccagatcagctttgcccctgagatcgccagcgaggaggagaggaagggcatggtggccgcctggagccagaggctgcagaccatctggaaggaggagcccatcccctgcacagcccactggcacttcggccagtag

SEQ ID NO: 161102 - DNA, 582 bp, Artificial Sequence; identical to SEQ ID NO: 161101
  Description of Artificial Sequence: Synthetic coding sequence

SEQ ID NO: 161103 - DNA, 696 bp, Artificial Sequence; identical to SEQ ID NO: 161099
  Description of Artificial Sequence: Synthetic coding sequence

SEQ ID NO: 161104 - DNA, 420 bp, Artificial Sequence
  Description of Artificial Sequence: Synthetic coding sequence
atggccggcaagaaggtgctgattgtgtatgcccaccaggagcccaagagcttcaacggcagcctgaagaatgtggccgtggatgagctgagccggcagggctgcaccgtgacagtgtctgacctgtatgccatgaacctggagccccgggccacagacaaggacatcaccggcaccctgagcaaccctgaggtgttcaactacggcgtggagacccatgaggcctacaagcagaggagcctggccagtgacatcacagatgagcagaagaaggtgcgggaggccgacctggtgatcttccagttccccctgtactggttctctgtgcctgccatcctgaagggctggatggacagagtgctgtgccagggctttgcctttgacatccctggcttctatgattctggcctgctgcagtag

SEQ ID NO: 161105 - DNA, 420 bp, Artificial Sequence; identical to SEQ ID NO: 161104
  Description of Artificial Sequence: Synthetic coding sequence

SEQ ID NO: 161106 - DNA, 192 bp, Artificial Sequence
  Description of Artificial Sequence: Synthetic coding sequence
atggccggcaagaaggtgctgattgtgtatgcccaccaggagcccaagagcttcaacggcagcctgaagaatgtggccgtggatgagctgagccggcagggctgcaccgtgacagtgtctgacctgtatgccatgaacctggagccccgggccacagacaaggacatcaccggcaccctgagcaacccctag

SEQ ID NO: 161107 - DNA, 483 bp, Artificial Sequence
  Description of Artificial Sequence: Synthetic coding sequence
accccaggcctgaagcagagcagccacctgagcctgtggagctcctgggactaccgcctgctggacagcctgaagagggactatgccggcaagccccagccccccatcaagtctgagaggagaaatcctccttcctatgccatggccggcaagaaggtgctgattgtgtatgcccaccaggagcccaagagcttcaacggcagcctgaagaatgtggccgtggatgagctgagccggcagggctgcaccgtgacagtgtctgacctgtatgccatgaacctggagccccgggccacagacaaggacatcaccggcaccctgagcaaccctgaggtgttcaactatggagtggagacccatgaggcctacaagcagaggagcctggccagtgacatcacagatgagcagaagaaggtgcgggaggccgacctggtgatcttccagatgctgagcacagagctgagcctgaccagccgctgctag

SEQ ID NO: 161108 - DNA, 231 bp, Artificial Sequence
  Description of Artificial Sequence: Synthetic coding sequence
atggctgctgctgctgccagcagaggagtgggcgccaagctgggcctgcgggagatccgcatccacctgtgccagaggagccctggcagccagggcgtgcgggacttcatcgagaagagatatgtggagctgaagaaggccaacccagacctgcccatcctgatcagagaatgttctgatgtgcagcccaagctgtgggcccgctatgccagccgggtgcagaacagctag

SEQ ID NO: 161109 - DNA, 213 bp, Artificial Sequence
  Description of Artificial Sequence: Synthetic coding sequence
atgtggtttgagatcctgcccggcctgtctgtgatgggcgtgtgcctgctgatccctggcctggccacagcctacatccaccgcttcaccaatggaggcaaggagaagagggtggcccacttcggctaccactggagcctgatggagcgggaccggcgcatctctggagtggaccgctactacgtgtccaagggcctggagaacattgattag

SEQ ID NO: 161110 - DNA, 1068 bp, Artificial Sequence
  Description of Artificial Sequence: Synthetic coding sequence
atggccctgcggctgctgaagctggccgccaccagcgccagcgcccgggtggtggccgccggggcccagagggtgcggggcatccacagctctgtgcagtgcaagctgcgctatggcatgtggcacttcctgctgggggacaaggccagcaagaggctgacagagaggagcagggtcatcaccgtggatggcaacatctgcaccgggaagggcaagctggccaaggagattgctgagaagctgggcttcaagcacttccctgaggccggcatccactacccagacagcaccactggagatggcaagcccctggccacagactacaatggaaactgcagcctggagaagttctatgatgaccccaggagcaatgatggcaacagctaccgcctgcagagctggctgtacagcagccggctgctgcagtacagtgatgccctggagcacctgctgaccaccggccagggcgtggtgctggagaggagcatcttcagtgactttgtgttcctggaggccatgtacaaccagggcttcatcaggaagcagtgtgtggaccactacaatgaggtgaagtctgtgaccatctgtgactacctgcccccccacctggtgatctacattgatgtgcctgtgcctgaggtgcagaggcgcatccagaagaagggggacccccatgagatgaagatcaccagcgcctacctgcaggacattgaaaatgcctacaagaagaccttcctgcctgagatgtctgagaagtgtgaggtgctgcagtacagcgcccgggaggcccaggacagcaagaaggtggtggaggacatcgagtacctgaagtttgacaagggcccctggctgaagcaggacaacagaaccctgtaccacctgcggctgctggtgcaggacaagtttgaggtgctgaactacaccagcatccccatcttcctgcctgaggtgaccatcggggcccaccagacagacagagtgctgcaccagttccgggagctgcccggcaggaagtacagccctggctacaacacagaggtgggggacaagtggatctggctgaagtag

SEQ ID NO: 161111 - DNA, 1068 bp, Artificial Sequence
  Description of Artificial Sequence: Synthetic coding sequence
atggccctgcggctgctgaagctggccgccaccagcgccagcgcccgggtggtggcccgggcccccagcgcctggaggggcatccacagctctgtgcagtgcaagctgcgctatggcatgtggcacttcctgctgggggacaaggccagcaagaggctgacagagaggagcagggtcatcaccgtggatggcaacatctgcaccgggaagggcaagctggccaaggagattgctgagaagctgggcttcaagcacttccctgaggccggcatccactacccagacagcaccactggagatggcaagcccctggccacagactacaatggaaactgcagcctggagaagttctatgatgaccccaggagcaatgatggcaacagctaccgcctgcagagctggctgtacagcagccggctgctgcagtacagtgatgccctggagcacctgctgaccaccggccagggcgtggtgctggagaggagcatcttcagtgactttgtgttcctggaggccatgtacaaccagggcttcatcaggaagcagtgtgtggaccactacaatgaggtgaagtctgtgaccatctgtgactacctgcccccccacctggtgatctacattgatgtgcctgtgcctgaggtgcagaggcgcatccagaagaagggggacccccatgagatgaagatcaccagcgcctacctgcaggacattgaaaatgcctacaagaagaccttcctgcctgagatgtctgagaagtgtgaggtgctgcagtacagcgcccgggaggcccaggacagcaagaaggtggtggaggacatcgagtacctgaagtttgacaagggcccctggctgaagcaggacaacagaaccctgtaccacctgcggctgctggtgcaggacaagtttgaggtgctgaactacaccagcatccccatcttcctgcctgaggtgaccatcggggcccaccagacagacagagtgctgcaccagttccgggagctgcccggcaggaagtacagccctggctacaacacagaggtgggggacaagtggatctggctgaagtag

SEQ ID NO: 161112 - DNA, 426 bp, Artificial Sequence
  Description of Artificial Sequence: Synthetic coding sequence
atggcccccaaggtgttccggcagtactgggacatcccagatggaacagactgccacaggaaggcctacagcaccaccagcatcgcctctgtggccggcctgacagctgctgcctacagagtgaccctgaaccccccaggcaccttcctggagggcgtggccaaggtgggccagtacaccttcaccgctgctgctgtgggcgctgtgtttggcctgaccacctgcatcagcgcccacgtgcgggagaagccagatgaccccctgaactacttcctgggcggctgtgccggcggcctgaccctgggcgcccggacccacaactacggcatcggggctgctgcctgtgtgtacttcggcattgctgccagcctggtgaagatgggccgcctggagggctgggaggtgtttgccaagcccaaggtgtag

SEQ ID NO: 161113 - DNA, 687 bp, Artificial Sequence
  Description of Artificial Sequence: Synthetic coding sequence
atggcccccaaggtgttccggcagtactgggacatcccagatggaacagactgccacaggaaggcctacagcaccaccagcatcgcctctgtggccggcctgacagctgctgcctacagagtgaccctgaaccccccaggcaccttcctggagggcgtggccaaggtgggccagtacaccttcaccgctgctgctgtgggcgctgtgtttggcctgaccacctgcatcagcgcccacgtgcgggagaagccagatgaccccctgaactacttcctgggcggctgtgccggcggcctgaccctgggcgccaggaagacaggcagccactgtgtggtgcaggccggcctgaagctgctggccagcagcagcccccacaccagcgccagccagagcgctggcatcatcggcatgagccactgtgtgcagcgcttctgggtgcccagcagcagcgcctgcctggaggtgctgtctggagagagcacagatgtgcacgcctgcagcagcaccaggggggcctgcaacagcagcggcagccggcccctgcctgagctgggcgcccgggccagcggcagcctgaggaagggcggccacacccacccagcccccagaggagctggggccctgacccctgtgcaggccctgattgagagcctgctgaacaccctgggcagcaaccccaggacatag

SEQ ID NO: 161114 - DNA, 684 bp, Artificial Sequence
  Description of Artificial Sequence: Synthetic coding sequence
atgcaggagcccaggagagtgaccccctgcctgggcaagaggggcgtgaagaccccccagctgcagcccggcagcgccttcctgccccgggtgcggcggcagagcttccctgcccggagtgacagctacaccaccgtgcgggacttcctggccgtgcccaggaccatcagcagcgccagcgccaccctcatcatggctgtggccgtgagccacttccggcccggccctgaggtgtgggacacagcctccatggccgccagcaaggtgaagcaggacatgcctcctcctgggggctacggccccatcgactacaagaggaacctgccccggcggggcctgagcggctacagcatgctggccatcggcatcggcaccctcatctacggccactggagcatcatgaagtggaaccgggagcggcggcggctgcagatcgaggactttgaggcccgcatcgccctgctgcccctgctgcaggccgagacagacaggaggaccctgcagatgctgcgggagaacctggaggaggaggccatcatcatgaaggatgtgcctgactggaaggtgggggagagcgtcttccacaccacccgctgggtgcccccactcatcggggagctgtatggcctgcggaccacagaggaggccctgcacgccagccacggcttcatgtggtacacctag

SEQ ID NO: 161115 - DNA, 435 bp, Artificial Sequence
  Description of Artificial Sequence: Synthetic coding sequence
atggccgccagcaaggtgaagcaggacatgcctcctcctgggggctacggccccatcgactacaagaggaacctgccccggcggggcctgagcggctacagcatgctggccatcggcatcggcaccctcatctacggccactggagcatcatgaagtggaaccgggagcggcggcggctgcagattgaagattttgaggccagaattgccctgctgcccctgctgcaggccgagacagacaggaggaccctgcagatgctgcgggagaacctggaggaggaggccatcatcatgaaggatgtgcctgactggaaggtgggggagagcgtcttccacaccacccgctgggtgccccccctgattggagagctgtatggcctgcggaccacagaggaggccctgcacgccagccacggcttcatgtggtacacctag

SEQ ID NO: 161116 - DNA, 300 bp, Artificial Sequence
  Description of Artificial Sequence: Synthetic coding sequence
atggctgctgctgctgccagcagaggagtgggcgccaagctgggcctgcgggagatccgcatccacctgtgccagaggagccctggcagccagggcgtgcgggacttcatcgagaagagatatgtggagctgaagaaggccaacccagacctgcccatcctgatcagagaatgttctgatgtgcagcccaagctgtgggcccgctatgccttcggccaggagaccaacgtgcccctgaacaacttctctgctgaccaggtgacccgggccctggagaatgtgctgagcggcaaggcctag

SEQ ID NO: 161117 - DNA, 720 bp, Artificial Sequence
  Description of Artificial Sequence: Synthetic coding sequence
atggccggcgtgctgaagaagaccaccggcctggtgggcctggccgtgtgcaacacccctcatgaggtgtgcacctttgtgctgagcagcttcctgaacagccagggccgcctgaacagctgccactttgcctactgccgggtgaatggcatccagatgttccaggccctgaactacaagccccgggagctgctgcggcacggccgctgcccccccaccagcctcatccgctgccacatcttcatctacttctgccacgacctcttcatcaagcctgtgttcctgctgaccttcagcctgaccttctcctggctgcacctgtgcctgctgctgagcgcccccagccagatctacatcagcgtcttccacctgttcagcctgccctaccgcttctgcctgggcgccctggactacatctacctgggcctgctgaaggtgctgccccccttccccagcgtgcgctccttccccagcgtcttcaccaacgtgttcatcaagaagacccacaagttcttcatcctgctggtgcccagcatcatcacccccttcctgtgcttcaccctgcagatcacccagaagagctacctgtacttcctgcagttcctgagctacagccccctgaatgccctgagccacccctggaggttcagcagcagccccatcatctccatgctgcccaaccccatggtgagcagctacttcagccccagcctgacctag

SEQ ID NO: 161118 - DNA, 351 bp, Artificial Sequence
  Description of Artificial Sequence: Synthetic coding sequence
atggccggcgtgctgaagaagaccaccggcctggtgggcctggccgtgtgcaacacccctcatgagcggctgcgcatcctgtacaccaagatcctggatgtgctggaggagatccccaagaatgctgcctacaggaagtacacagagcagatcaccaatgagaagctggccatggtgaaggccgagccagatgtgaagaagctggaggaccagctgcagggcggccagctggaggaggtgatcctgcaggccgagcacgagctgaacctggccaggaagatgagggagtggaagctgtgggagcccctggtggaggagcccccagctgaccagtggaagtggcccatctag

SEQ ID NO: 161119 - DNA, 351 bp, Artificial Sequence
  Description of Artificial Sequence: Synthetic coding sequence
atgccctacagagtgggccagaccaccggcctggtgggcctggccgtgtgcaacacccctcatgagcggctgcgcatcctgtacaccaagatcctggatgtgctggaggagatccccaagaatgctgcctacaggaagtacacagagcagatcaccaatgagaagctggccatggtgaaggccgagccagatgtgaagaagctggaggaccagctgcagggcggccagctggaggaggtgatcctgcaggccgagcacgagctgaacctggccaggaagatgagggagtggaagctgtgggagcccctggtggaggagcccccagctgaccagtggaagtggcccatctag

SEQ ID NO: 161120 - DNA, 465 bp, Artificial Sequence
  Description of Artificial Sequence: Synthetic coding sequence
atgggcaaggacatccggcccaggtctgcccgggccgcctgcaagggcgtgggcctgtggagcggctgcttcggcaagatggccggcagcggcgtgcggcaggccaccagcacagccagcacctttgtgaagcccatcttcagccgggacatgaatgaggccaagagaagagtgcgggagctgtaccgggcctggtaccgggaggtgcccaacacagtgcaccagttccagctggacatcaccgtgaagatgggccgggacaaggtgcgggagatgttcatgaagaatgcccacgtgacagacccccgggtggtggacctgctggtgatcaagggcaagattgagctggaggagaccatcaaggtgtggaagcagaggacccacgtgatgaggttcttccacgagacagaggccccccggcccaaggacttcctgagcaagttctacgtgggccatgacccctag

SEQ ID NO: 161121 - DNA, 342 bp, Artificial Sequence
  Description of Artificial Sequence: Synthetic coding sequence
atggccagcgccaccaggctcatccagaggctgaggaactgggccagcggccatgacctgcagggcaagctgcagctgcgctaccaggagatcagcaagaggacccagcccccacccaagctgcctgtgggccccagccacaagctgagcaacaactactactgcaccagagatggccggcgggagagcgtgcccccatccatcatcatgagcagccagaaggccctggtgtctgggaagccagctgagagcagcgctgtggccgccacagagaagaaggctgtgaccccagccccacccatcaagcgctgggagctgagcagtgaccagccctacctgtag

SEQ ID NO: 161122 - DNA, 519 bp, Artificial Sequence
  Description of Artificial Sequence: Synthetic coding sequence
atgcctggcatcgtggagctgcccaccctggaggagctgaaggtggatgaggtgaagatcagcagcgctgtgctgaaggccgccgcccaccactacggggcccagtgtgacaagcccaacaaggagttcatgctgtgccgctgggaggagaaggacccccggcgctgcctggaggagggcaagctggtgaacaagtgtgccctggacttcttccggcagatcaagaggcactgtgccgagcccttcacagagtactggacctgcatcgactacacaggccagcagctgttccgccactgcaggaagcagcaggccaagtttgatgaatgtgtgctggacaagctgggctgggtgcggccagacctgggggagctgagcaaggtgaccaaggtgaagacagaccggcccctgcctgagaacccctaccacagccggcccaggccagaccccagccctgagattgaaggagacctgcagcctgccacccacggcagccgcttctacttctggaccaagtag

SEQ ID NO: 161123 - DNA, 387 bp, Artificial Sequence
  Description of Artificial Sequence: Synthetic coding sequence
atgcctggcatcgtggagctgcccaccctggaggagctgaaggtggatgaggtgaagatcagcagcgctgtgctgaaggccgccgcccaccactacggggcccagtgtgacaagcccaacaaggagttcatgctgtgccgctgggaggagaaggacccccggcgctgcctggaggagggcaagctggtgaacaagtgtgccctggacttcttccggcagatcaagaggcactgtgccgagcccttcacagagtactggacctgcatcgactacacaggccagcagctgttccgccactgcaggaagcagcaggccaagtttgatgaatgtgtgctggacaagctgggctgggtgcggccagacctgggggagctgagcaaaggatag

SEQ ID NO: 161124 - DNA, 1134 bp, Artificial Sequence
  Description of Artificial Sequence: Synthetic coding sequence
atggctgctgctgcccagagccgggtggtgcgggtgctgtccatgagccgcagcgccatcacagccatcgccacctctgtgtgccacggccccccctgccggcagctgcaccacgccctgatgcctcatggaaaaggaggccgcagctctgtgtctggcatcgtggccaccgtgtttggagccaccggcttcctgggccgctacgtggtgaaccacctgggccgcatgggcagccaggtgatcatcccctaccgctgtgacaagtatgacatcatgcacctgcggcccatgggagacctgggccagctgctcttcctggagtgggatgcccgggacaaggacagcatcagaagagtggtgcagcacagcaatgtggtgatcaacctgattggccgggactgggagaccaagaactttgattttgaagatgtgtttgtgaagatcccccaggccatcgcccagctgagcaaggaggccggcgtggagaagttcatccacgtgagccacctgaatgccaacatcaagagcagcagccgctacctgaggaacaaggctgtgggggagaaggtggtgagagatgccttccctgaggccatcatcgtgaagcccagcgacatcttcggccgggaggaccgcttcctgaacagctttgcctccatgcacagatttggccccatccccctgggcagcctgggctggaagacagtgaagcagcctgtgtatgtggtggatgtgtccaaaggaattgtgaatgctgtgaaggaccctgatgccaacgggaagagctttgcctttgtgggccccagccgctacctgctcttccacctggtgaagtacatctttgctgtggcccacaggctcttcctgcccttccccctgcccctgtttgcctaccgctgggtggcccgggtgtttgagatcagcccctttgagccctggatcacccgggacaaggtggagaggatgcacatcacagacatgaagctgccccacctgcccggcctggaggacctgggcatccaggccacccccctggagctgaaggccatcgaggtgctgcggcggcacaggacctaccgctggctgtctgctgagattgaagatgtgaagccagccaagacagtgaacatctag

SEQ ID NO: 161125 - DNA, 984 bp, Artificial Sequence
  Description of Artificial Sequence: Synthetic coding sequence
atggccctggtgcacaagctgctgcggggcacctacttcctgaggaagttcagcaagcccaccagcgccctgtaccccttcctgggcatccgctttgctgagtacagcagcagcctgcagaagcctgtggccagccctgggaaggccagcagccagaggaagacagaaggagacctgcagggcgaccaccagaaggaggtggccctggacatcaccagcagcgaggagaagccagatgtgtcctttgacaaggccatcagagatgaggccatctaccacttccggctgctgaaggatgaaattgtggaccactggaggggccctgagggccaccccctgcacgaggtgctgctggagcaggccaaggtggtgtggcagttccggggcaaggaggacctggacaagtggacagtgaccagtgacaagaccatcggcggccgctctgaggtgttcctgaagatgggcaagaacaaccagagcgccctgctgtatggcaccctgagcagcgaggccccccaggatggagagagcaccaggagcggctactgtgccatgatcagccgcatccccaggggggcctttgagaggaagatgtcctatgactggagccagttcaacaccctgtacctgcgggtgagaggagatggccggccctggatggtgaacatcaaggaggacacagacttcttccagaggaccaaccagatgtacagctacttcatgttcacccggggcggcccctactggcaggaggtgaagatccccttcagcaagttcttcttcagcaacagaggccgcatcagagatgtgcagcacgagctgcccctggacaagatcagcagcatcggcttcaccctggccgacaaggtggatggccccttcttcctggagattgacttcatcggggtcttcacagatcctgcccacacagaggagtttgcctatgagaacagccctgagctgaaccccaggctcttcaagtag

SEQ ID NO: 161126 - DNA, 576 bp, Artificial Sequence
  Description of Artificial Sequence: Synthetic coding sequence
atggccctggtgcacaagctgctgcggggcacctacttcctgaggaagttcagcaagcccaccagcgccctgtaccccttcctgggcatccgctttgctgagtacagcagcagcctgcagaagcctgtggccagccctgggaaggccagcagccagaggaagacagaaggagacctgcagggcgaccaccagaaggaggtggccctggacatcaccagcagcgaggagaagccagatgtgtcctttgacaaggccatcagagatgaggccatctaccacttccggctgctgaaggatgaaattgtggaccactggaggggccctgagggccaccccctgcacgaggtgctgctggagcaggccaaggtggtgtggcagttccggggcaaggaggacctggacaagtggacagtgaccagtgacaagaccatcggcggccgctctgaggtgttcctgaagatgggcaagaacaaccagagcgccctgctgtatggcaccctgagcagcgaggccccccaggatggagagagcaccaggagcggctactgtgccatgatcagccgcatccccaggtag

SEQ ID NO: 161127 - DNA, 630 bp, Artificial Sequence
  Description of Artificial Sequence: Synthetic coding sequence
atggccctggtgcacaagctgctgcggggcacctacttcctgaggaagttcagcaagcccaccagcgccctgtaccccttcctgggcatccgctttgctgagtacagcagcagcctgcagaagcctgtggccagccctgggaaggccagcagccagaggaagacagaaggagacctgcagggcgaccaccagaaggaggtggccctggacatcaccagcagcgaggagaagccagatgtgtcctttgacaaggccatcagagatgaggccatctaccacttccggctgctgaaggatgaaattgtggaccactggaggggccctgagggccaccccctgcacgaggtgctgctggagcaggccaaggtggtgtggcagttccggggcaaggaggacctggacaagtggacagtgaccagtgacaagaccatcggcggccgctctgaggtgttcctgaagatgggcaagaacaaccagagcgccctgctgtatggcaccctgagcagcgaggccccccaggatggagagagcaccaggagcggctactgtgccatgatcagccgcatccccaggggggcctttgagaggaagatgtcctatgactggagccagttcaacaccctgtactag

SEQ ID NO: 161128 - DNA, 510 bp, Artificial Sequence
  Description of Artificial Sequence: Synthetic coding sequence
atgggctggagccaggacctcttccgggccctgtggaggagcctgagccgggaggtgaaggagcacgtgggcacagaccagtttggaaacaagtactactacatcccccagtacaagaactggaggggccagaccatccgggagaagagaattgtggaggccgccaacaagaaggaggtggactatgaggccggggacatccccacagagtgggaggcctggatccggaggaccaggaagaccccacccaccatggaggagatcctgaagaatgagaagcaccgggaggagatcaagatcaagagccaggacttctatgagaaggagaagctgctgagcaaggagaccagcgaggagctgctgcccccacctgtgcagacccagatcaagggccacgccagcgccccctactttgggaaggaggagcccagcgtggcccccagcagcacaggcaagaccttccagcccggctcctggatgcccagagatggcaagagccacaaccagtag

SEQ ID NO: 161129 - DNA, 384 bp, Artificial Sequence
  Description of Artificial Sequence: Synthetic coding sequence
atgtacatcgacagctacaacagccggggcttcatgatcaatggaaacagagtgctgggcccctgtgccctgctgccccacagcgtggtgcagtggaatgtgggcagccaccaggacatcacagaggacagcttcagcctcttctggctgctggagcccagaattgaaattgtggtggtgggcaccggggacagaacagagcggctgcagagccaggtgctgcaggccatgaggcagaggggcattgctgtggaggtgcaggacaccccaaatgcctgtgccaccttcaacttcctgtgccacgagggccgggtgactggagctgccctgatccccccacctgggggcaccagcctgaccagcctgggccaggccgcccagtag

SEQ ID NO: 161130 - DNA, 555 bp, Artificial Sequence
  Description of Artificial Sequence: Synthetic coding sequence
atggccacagccctggccctgcggagcctgtaccgggcccggcccagcctgcgctgcccccctgtggagctgccctgggccccccggcggggccaccggctgagccctgcagatgatgagctgtaccagaggacccgcatcagcctgctgcagcgggaggccgcccaggccatgtacatcgacagctacaacagccggggcttcatgatcaatggaaacagagtgctgggcccctgtgccctgctgccccacagcgtggtgcagtggaatgtgggcagccaccaggacatcacagaagattccttcagcctcttctggctgctggagccccgcatcgagatcgtggtggtgggcactggagacagaacagagcggctgcagagccaggtgctgcaggccatgaggcagaggggcattgctgtggaggtgcaggacaccccaaatgcctgtgccaccttcaacttcctgtgccacgagggccgggtgactggagctgccctgatccccccacctgggggcaccagcctgaccagcctgggccaggccgcccagtag

SEQ ID NO: 161131 - DNA, 384 bp, Artificial Sequence; identical to SEQ ID NO: 161129
  Description of Artificial Sequence: Synthetic coding sequence

SEQ ID NO: 161132 - DNA, 384 bp, Artificial Sequence; identical to SEQ ID NO: 161129
  Description of Artificial Sequence: Synthetic coding sequence

SEQ ID NO: 161133 - DNA, 528 bp, Artificial Sequence
  Description of Artificial Sequence: Synthetic coding sequence
atgggcgccctggtgatccggggcatccggaacttcaacctggagaacagagctgagcgggagatcagcaagatgaagcccagcgtggcccccaggcaccccagcaccaacagcctgctgcgggagcagatcagcctgtacccagaggtgaagggggagatcgccaggaaggatgagaagctgctgtccttcctgaaggatgtgtatgtggacagcaaggaccctgtgagcagcctgcaggtgaaggctgctgagacctgccaggagcccaaggagttccggctgcccaaggaccaccactttgacatgatcaacatcaagagcatccccaagggcaagatcagcatcgtggaggccctgaccctgctgaacaaccacaagctgtttcctgagacctggacagctgagaagatcatgcaggagtaccagctggagcagaaggatgtgaacagcctgctgaagtactttgtgacctttgaggtggagatcttccccccagaggacaagaaggccatccgcagcaagtag

SEQ ID NO: 161134 - DNA, 519 bp, Artificial Sequence
  Description of Artificial Sequence: Synthetic coding sequence
atgccagacagctgggacaaggatgtgtacccagagccccccaggaggacccctgtgcagcccaaccccatcgtgtacatgatgaaggcctttgacctgattgtggacaggcctgtgaccctggtgcgggagttcatcgagcggcagcacgccaagaaccgctactactactaccaccggcagtacagaagagtgcctgacatcacagagtgcaaggaggaggacatcatgtgcatgtatgaggccgagatgcagtggaagagggactacaaggtggaccaggagatcatcaacatcatgcaggaccggctgaaggcctgccagcagcgggagggccagaactaccagcagaactgcatcaaggaggtggagcagttcacccaggtggccaaggcctaccaggaccgctaccaggacctgggcgcctacagcagcgccaggaagtgcctggccaagcagaggcagaggatgctgcaggagaggaaggccgccaaggaggccgctgctgccaccagctag

SEQ ID NO: 161135 - DNA, 507 bp, Artificial Sequence
  Description of Artificial Sequence: Synthetic coding sequence
atgccagacagctgggacaaggatgtgtacccagagccccccaggaggacccctgtgcagcccaaccccatcgtgtacatgatgaaggcctttgacctgattgtggacaggcctgtgaccctggtgcgggagttcatcgagcggcagcacgccaagaaccgctactactactaccaccggcagtacagaagagtgcctgacatcacagagtgcaaggaggaggacatcatgtgcatgtatgaggccgagatgcagtggaagagggactacaaggtggaccaggagatcatcaacatcatgcaggaccggctgaaggcctgccagcagcgggagggccagaactaccagcagaactgcatcaaggaggtggagcagttcacccaggtggccaaggcctaccaggacagatgtgcctgccccacccacccccagccccccaccatcctgctgcggcctgggggccagaaccactgcaagagcagcctgcccagcctggtgctgacctag

SEQ ID NO: 161136 - DNA, 492 bp, Artificial Sequence
  Description of Artificial Sequence: Synthetic coding sequence
atggctgctggcctgtttggcctgagcgcccggcggctgctggccgctgctgccacccggggcctgcctgctgcccgggtgcgctgggagagcagcttcagcaggacagtggtggcccccagcgctgtggccggcaagaggcctcctgagcccaccaccccctggcaggaggaccctgagccagaagatgagaacctgtatgagaagaacccagacagccacggctatgacaaggaccctgtgctggatgtgtggaacatgaggctggtgttcttctttggagtgtccatcatcctggtgctgggcagcacctttgtggcctacctgcctgactaccgctgcaccggctgcccccgggcctgggatggcatgaaggagtggagcagaagagaggccgagcggctggtgaagtaccgggaggccaacggcctgcccatcatggagagcaactgctttgaccccagcaagatccagctgcctgaagatgaatag

SEQ ID NO: 161137 - DNA, 462 bp, Artificial Sequence
  Description of Artificial Sequence: Synthetic coding sequence
atggctgctggcctgtttggcctgagcgcccggcggctgctggccgctgctgccacccggggcctgcctgctgcccgggtgcgctgggagagcagcttcagcaggacagtggtggcccccagcgctgtggccggcaagaggcctcctgagcccaccaccccctggcaggaggaccctgagccagaagatgagaacctgtatgagaagaacccagacagccacggctatgacaaggaccctgtgctggatgtgtggaacatgaggctggtgttcttctttggagtgtccatcatcctggtgctgggcagcacctttgtggcctacctgcctgactacaggatgaaggagtggagcagaagagaggccgagcggctggtgaagtaccgggaggccaacggcctgcccatcatggagagcaactgctttgaccccagcaagatccagctgcctgaagatgaatag

SEQ ID NO: 161138 - DNA, 474 bp, Artificial Sequence
  Description of Artificial Sequence: Synthetic coding sequence
gctgcccccagcgtgatggccgccggcctgtttggcctgagcgcccggcggctgctggccgccaggagaagaggcctgcctgctgcccgggtgcgctgggagagcagcttcagcaggacagtggtggcccccagcgctgtggccggcaagaggcctcctgagcccaccaccccctggcaggaggaccctgagccagaagatgagaacctgtatgagaagaacccagacagccacggctatgacaaggaccctgtgctggatgtgtggaacatgaggctggtgttcttctttggagtgtccatcatcctggtgctgggcagcacctttgtggcctacctgcctgactacaggatgaaggagtggagcagaagagaggccgagcggctggtgaagtaccgggaggccaacggcctgcccatcatggagagcaactgctttgaccccagcaagatccagctgcctgaagatgaatag

SEQ ID NO: 161139 - DNA, 297 bp, Artificial Sequence
  Description of Artificial Sequence: Synthetic coding sequence
atggcccatgaacatggccatgaacatggccaccacaagatggagctgcctgactaccggcagtggaagattgagggcacccccctggagaccatccagaagaagctggccgccaagggcctgcgggacccctggggcagaaatgaggcctggagatacatgggcggctttgccaagtctgtgtccttcagtgatgtgttcttcaagggcttcaagtggggctttgctgcctttgtggtggccgtgggcgctgagtactacctggagagcctgaacaaggacaagaagcaccactag

SEQ ID NO: 161140 - DNA, 297 bp, Artificial Sequence; identical to SEQ ID NO: 161139
  Description of Artificial Sequence: Synthetic coding sequence

SEQ ID NO: 161141 - DNA, 198 bp, Artificial Sequence
  Description of Artificial Sequence: Synthetic coding sequence
atggcccatgaacatggccatgaacatggccaccacaagatggagctgcctgactaccggcagtggaagattgagggcacccccctggagaccatccagaagaagctggccgccaagggcctgcgggacccctggggcagaaatgaggcctggagatacatgggcggctttgccaagtctgtgtccttcagtgactag

SEQ ID NO: 161142 - DNA, 297 bp, Artificial Sequence; identical to SEQ ID NO: 161139
  Description of Artificial Sequence: Synthetic coding sequence

SEQ ID NO: 161143 - DNA, 741 bp, Artificial Sequence; identical to SEQ ID NO: 159392
  Description of Artificial Sequence: Synthetic coding sequence

SEQ ID NO: 161144 - DNA, 561 bp, Artificial Sequence
  Description of Artificial Sequence: Synthetic coding sequence
atggctgtggcccgggccggcgtgctgggcgtgcagtggctgcagagggccagcagaaatgtgatgcccctgggcgccaggacagccagccacatgaccaaggacatgtttcctggcccctaccccaggaccccagaggagagagctgctgctgccaagaagtacaacatgagggtggaggactatgagccctacccagatgatggcatgggctacggggactaccccaagctgcctgacaggagccagcacgagcgggacccctggtacagctgggaccagcccggcctgcggctgaactggggcgagcccatgcactggcacctggacatgtacaacagaaacagagtggacaccagccccacccctgtgtcctggcacgtgatgtgcatgcagctgtttggcttcctggccttcatgatcttcatgtgctgggtgggagatgtgtaccctgtgtaccagcctgtgggccccaagcagtacccctacaacaacctgtacctggagcggggcggggaccccagcaaggagcctgagcgggtggtgcactatgagatctag

SEQ ID NO: 161145 - DNA, 519 bp, Artificial Sequence
  Description of Artificial Sequence: Synthetic coding sequence
atggctgtggcccgggccggcgtgctgggcgtgcagtggctgcagagggccagcagaaatgtgatgcccctgggcgccaggacagccagccacatgaccaaggacatgtttcctggcccctaccccaggaccccagaggagagagctgctgctgccaagaagtacaacatgagggtggaggactatgagccctacccagatgatggcatgggctacggggactaccccaagctgcctgacaggagccagcacgagcgggacccctggtacagctgggaccagcccggcctgcggctgaactggggcgagcccatgcactggcacctggacatgtacaacagaaacagagtggacaccagccccacccctgtgtcctggcacgtgatgtgcatgcagctgtttggcttcctggccttcatgatcttcatgtgctgggtgggagatgtgtaccctgtgtaccagcctgtgtgccgccaccacttctcctacaacctgggcttcctgagcgccctgggctag

SEQ ID NO: 161146 - DNA, 468 bp, Artificial Sequence
  Description of Artificial Sequence: Synthetic coding sequence
atgaccaaggacatgtttcctggcccctaccccaggaccccagaggagagagctgctgctgccaagaagtacaacatgagggtggaggactatgagccctacccagatgatggcatgggctatggagactaccccaagctgcctgacaggagccagcacgagcgggacccctggtacagctgggaccagcccggcctgcggctgaactggggcgagcccatgcactggcacctggacatgtacaacagaaacagagtggacaccagccccacccctgtgtcctggcacgtgatgtgcatgcagctgtttggcttcctggccttcatgatcttcatgtgctgggtgggagatgtgtaccctgtgtaccagcctgtgggccccaagcagtacccctacaacaacctgtacctggagcggggcggggaccccagcaaggagcctgagcgggtggtgcactatgagatctag

SEQ ID NO: 161147 - DNA, 519 bp, Artificial Sequence; identical to SEQ ID NO: 161145
  Description of Artificial Sequence: Synthetic coding sequence

SEQ ID NO: 161148 - DNA, 540 bp, Artificial Sequence
  Description of Artificial Sequence: Synthetic coding sequence
atggccttcctggccagcggcccctacctgacccaccagcagaaggtgctgcggctgtacaagagggccctgcggcacctggagagctggtgtgtgcagagggacaagtaccgctactttgcctgcctgatgagggccaggtttgaggagcacaagaatgagaaggacatggccaaggccacccagctgctgaaggaggccgaggaggagttctggtaccggcagcacccccagccctacatcttcccagacagccctgggggcaccagctatgaaagatatgactgctacaaggtgcctgagtggtgcctggatgactggcaccccagcgagaaggccatgtacccagactactttgccaagcgggagcagtggaagaagctgcggcgggagagctgggagcgggaggtgaagcagctgcaggaggagaccccacctgggggccccctgacagaggccctgcccccagccaggaaggagggggacctgccccccctgtggtggtacatcgtgacccggccccgggagcggcccatgtag

SEQ ID NO: 161149 - DNA, 471 bp, Artificial Sequence
  Description of Artificial Sequence: Synthetic coding sequence
atggccagccgggtgctgagcgcctacgtgtcccggctgcctgctgcctttgcccccctgccccgggtgaggatgctggccgtggcccggcccctgagcacagccctgtgcagcgctggcacccagacccggctgggcaccctgcagcctgccctggtgctggcccaggtgcccggccgggtgacccagctgtgccggcagtacagcgacatgccacccctgaccctggagggcatccaggacagagtgctgtatgtgctgaagctgtatgacaagattgatcctgagaagctgtctgtgaacagccacttcatgaaggacctgggcctggacagcctggaccaggtggagatcatcatggccatggaggatgaatttggatttgagatcccagacattgatgctgagaagctgatgtgcccccaggagatcgtggactacatcgctgacaagaaggatgtgtatgaatag

SEQ ID NO: 161150 - DNA, 231 bp, Artificial Sequence
  Description of Artificial Sequence: Synthetic coding sequence
atggcccccagcgccctgctgcggcccctgagccggctgctggccccagcccggctgcccagcggccccagcgtgcgcagcaagttctacgtgcgggagcccccaaatgccaagccagactggctgaaggtgggcttcaccctgggcaccaccgtcttcctgtggatctacctgatcaagcagcacaatgaagacatcctggagtacaagagaagaaatggcctggagtag

SEQ ID NO: 161151 - DNA, 231 bp, Artificial Sequence; identical to SEQ ID NO: 161150
  Description of Artificial Sequence: Synthetic coding sequence

SEQ ID NO: 161152 - DNA, 231 bp, Artificial Sequence; identical to SEQ ID NO: 161150
  Description of Artificial Sequence: Synthetic coding sequence

SEQ ID NO: 161153 - DNA, 231 bp, Artificial Sequence; identical to SEQ ID NO: 161150
  Description of Artificial Sequence: Synthetic coding sequence

SEQ ID NO: 161154 - DNA, 231 bp, Artificial Sequence; identical to SEQ ID NO: 161150
  Description of Artificial Sequence: Synthetic coding sequence

SEQ ID NO: 161155 - DNA, 231 bp, Artificial Sequence; identical to SEQ ID NO: 161150
  Description of Artificial Sequence: Synthetic coding sequence

SEQ ID NO: 161156 - DNA, 231 bp, Artificial Sequence; identical to SEQ ID NO: 161150
  Description of Artificial Sequence: Synthetic coding sequence

SEQ ID NO: 161157 - DNA, 231 bp, Artificial Sequence; identical to SEQ ID NO: 161150
  Description of Artificial Sequence: Synthetic coding sequence

SEQ ID NO: 161158 - DNA, 915 bp, Artificial Sequence
  Description of Artificial Sequence: Synthetic coding sequence
atgatctacaccatgaagaaggtgcacgccctgtgggcctctgtgtgcctgctgctgaacctggccccagcccccctgaatgctgacagcgaggaggatgaggagcacaccatcatcacagacacagagctgccccccctgaagctgatgcacagcttctgtgccttcaaggcagatgatggcccctgcaaggccatcatgaagcgcttcttcttcaacatcttcacccggcagtgtgaggagttcatctacggcggctgtgagggcaaccagaacagatttgagagcctggaggagtgcaagaagatgtgcacccgggacaatgccaaccgcatcatcaagaccaccctgcagcaggagaagccagacttctgcttcctggaggaggaccccggcatctgccggggctacatcacccgctacttctacaacaaccagaccaagcagtgtgagcgcttcaagtatggaggctgcctgggcaacatgaacaactttgagaccctggaggagtgcaagaacatctgtgaagatggccccaacggcttccaggtggacaactacggcacccagctgaatgctgtgaacaacagcctgaccccccagagcaccaaggtgcccagcctgtttgagttccacggccccagctggtgcctgaccccagctgaccggggcctgtgccgggccaatgaaaatcgcttctactacaacagcgtgattggaaaatgtcggcccttcaagtacagcggctgcggcggcaatgaaaacaacttcaccagcaagcaggagtgcctgcgggcctgcaagaagggcttcatccagaggatcagcaaaggaggcctcatcaagaccaagaggaagaggaagaagcagagggtgaagatcgcctatgaggagatctttgtgaagaacatgtag

SEQ ID NO: 161159 - DNA, 2013 bp, Artificial Sequence
  Description of Artificial Sequence: Synthetic coding sequence
atgcagatcccccgcttctgctaccacgagcggctgtctgtggccggcaactgcaggatgtgcctggtggagattgagaaggcccccaaggtggtggccgcctgtgccatgcctgtgatgaagggctggaacatcctgaccaacagcgagaagagcaagaaggcccgggagggcgtgatggagttcctgctggccaaccaccccctggactgccccatctgtgaccagggcggagaatgtgacctgcaggaccagagcatgatgtttggaaatgacaggagccgcttcctggagggcaagagagctgtggaggacaagaacatcggccccctggtgaagaccatcatgacccgctgcatccagtgcacccgctgcatccgctttgccagcgagattgctggggtggatgacctgggcaccaccggcagaggaaatgacatgcaggtgggcacctacatcgagaagatgttcatgtctgagctgagcggcaacatcatcgacatctgccctgtgggcgccctgaccagcaagccctatgccttcaccgcccggccctgggagaccaggaagacagagagcattgatgtgatggatgctgtgggcagcaacatcgtggtgtccaccaggactggagaggtgatgaggatcctgcccaggatgcatgaggacatcaatgaggagtggatcagtgacaagaccaggtttgcctatgatggcctgaagaggcagaggctgacagagcccatggtgagaaatgagaagggcctgctgacctacacctcctgggaggatgccctgagccgggtggccggcatgctgcagagcttccagggcaaggatgtggccgccatcgccggcggcctggtggatgctgaggccctggtggccctgaaggacctgctgaacagagtggacagcgacaccctgtgcacagaggaggtgttccccacagctggggccggcacagacctgcggagcaactacctgctgaacaccaccatcgccggcgtggaggaggctgatgtggtgctgctggtgggcaccaaccccaggtttgaggcccccctcttcaatgcccgcatcaggaagtcctggctgcacaatgacctgaaggtggccctgattggcagccctgtggacctgacctacacctatgaccacctgggggacagccccaagatcctgcaggacatcgccagcggcagccaccccttcagccaggtgctgaaggaggccaagaagcccatggtggtgctgggcagcagcgccctgcagagaaatgatggagctgccatcctggccgctgtgagcagcatcgcccagaagatccgcatgaccagcggcgtgactggagactggaaggtgatgaacatcctgcaccgcatcgccagccaggtggccgccctggacctgggctacaagccaggagtggaggccatcaggaagaacccccccaaggtgctcttcctgctgggcgcagatggcggctgcatcacccggcaggacctgcccaaggactgcttcatcatctaccagggccaccacggagatgtgggcgcccccatcgcagatgtgatcctgcccggggccgcctacacagagaagagcgccacctacgtgaacacagagggccgggcccagcagaccaaggtggccgtgaccccacctggcctggcccgggaggactggaagatcatccgggccctgtctgaaattgctggcatgaccctgccctatgacaccctggaccaggtgaggaaccggctggaggaggtgagccccaacctggtgcgctatgatgacatcgagggcgccaactacttccagcaggccaatgagctgagcaagctggtgaaccagcagctgctggccgaccccctggtgcccccccagctgaccatcaaggacttctacatgacagacagcatcagccgggccagccagaccatggccaagtgtgtgaaggctgtgacagagggcgcccaggccgtggaggagcccagcatctgctag

SEQ ID NO: 161160 - DNA, 1851 bp, Artificial Sequence
  Description of Artificial Sequence: Synthetic coding sequence
atgtgggagggcgtgatggagttcctgctggccaaccaccccctggactgccccatctgtgaccagggcggagaatgtgacctgcaggaccagagcatgatgtttggaaatgacaggagccgcttcctggagggcaagagagctgtggaggacaagaacatcggccccctggtgaagaccatcatgacccgctgcatccagtgcacccgctgcatccgctttgccagcgagattgctggggtggatgacctgggcaccaccggcagaggaaatgacatgcaggtgggcacctacatcgagaagatgttcatgtctgagctgagcggcaacatcatcgacatctgccctgtgggcgccctgaccagcaagccctatgccttcaccgcccggccctgggagaccaggaagacagagagcattgatgtgatggatgctgtgggcagcaacatcgtggtgtccaccaggactggagaggtgatgaggatcctgcccaggatgcatgaggacatcaatgaggagtggatcagtgacaagaccaggtttgcctatgatggcctgaagaggcagaggctgacagagcccatggtgagaaatgagaagggcctgctgacctacacctcctgggaggatgccctgagccgggtggccggcatgctgcagagcttccagggcaaggatgtggccgccatcgccggcggcctggtggatgctgaggccctggtggccctgaaggacctgctgaacagagtggacagcgacaccctgtgcacagaggaggtgttccccacagctggggccggcacagacctgcggagcaactacctgctgaacaccaccatcgccggcgtggaggaggctgatgtggtgctgctggtgggcaccaaccccaggtttgaggcccccctcttcaatgcccgcatcaggaagtcctggctgcacaatgacctgaaggtggccctgattggcagccctgtggacctgacctacacctatgaccacctgggggacagccccaagatcctgcaggacatcgccagcggcagccaccccttcagccaggtgctgaaggaggccaagaagcccatggtggtgctgggcagcagcgccctgcagagaaatgatggagctgccatcctggccgctgtgagcagcatcgcccagaagatccgcatgaccagcggcgtgactggagactggaaggtgatgaacatcctgcaccgcatcgccagccaggtggccgccctggacctgggctacaagccaggagtggaggccatcaggaagaacccccccaaggtgctcttcctgctgggcgcagatggcggctgcatcacccggcaggacctgcccaaggactgcttcatcatctaccagggccaccacggagatgtgggcgcccccatcgcagatgtgatcctgcccggggccgcctacacagagaagagcgccacctacgtgaacacagagggccgggcccagcagaccaaggtggccgtgaccccacctggcctggcccgggaggactggaagatcatccgggccctgtctgaaattgctggcatgaccctgccctatgacaccctggaccaggtgaggaaccggctggaggaggtgagccccaacctggtgcgctatgatgacatcgagggcgccaactacttccagcaggccaatgagctgagcaagctggtgaaccagcagctgctggccgaccccctggtgcccccccagctgaccatcaaggacttctacatgacagacagcatcagccgggccagccagaccatggccaagtgtgtgaaggctgtgacagagggcgcccaggccgtggaggagcccagcatctgctag

SEQ ID NO: 161161 - DNA, 2076 bp, Artificial Sequence
  Description of Artificial Sequence: Synthetic coding sequence
atgctgcgcatccctgtgaggaaggccctggtgggcctgagcaagagccccaagggctgtgtgaggaccacagccacagctgccagcaacctgattgaggtgtttgtggatggccagagcgtgatggtggagcccggcaccaccgtgctgcaggtggtggccgcctgtgccatgcctgtgatgaagggctggaacatcctgaccaacagcgagaagagcaagaaggcccgggagggcgtgatggagttcctgctggccaaccaccccctggactgccccatctgtgaccagggcggggagtgtgacctgcaggaccagagcatgatgtttggaaatgacaggagccgcttcctggagggcaagagagctgtggaggacaagaacatcggccccctggtgaagaccatcatgacccgctgcatccagtgcacccgctgcatccgctttgccagcgagattgctggggtggatgacctgggcaccaccggcagaggaaatgacatgcaggtgggcacctacatcgagaagatgttcatgtctgagctgagcggcaacatcatcgacatctgccctgtgggcgccctgaccagcaagccctatgccttcaccgcccggccctgggagaccaggaagacagagagcattgatgtgatggatgctgtgggcagcaacatcgtggtgtccaccaggactggagaggtgatgaggatcctgcccaggatgcatgaggacatcaatgaggagtggatcagtgacaagaccaggtttgcctatgatggcctgaagaggcagaggctgacagagcccatggtgagaaatgagaagggcctgctgacctacacctcctgggaggatgccctgagccgggtggccggcatgctgcagagcttccagggcaaggatgtggccgccatcgccggcggcctggtggatgctgaggccctggtggccctgaaggacctgctgaacagagtggacagcgacaccctgtgcacagaggaggtgttccccacagctggagctggaacagacctgcggagcaactacctgctgaacaccaccatcgccggcgtggaggaggctgatgtggtgctgctggtgggcaccaaccccaggtttgaggcccccctcttcaatgcccgcatcaggaagtcctggctgcacaatgacctgaaggtggccctgattggcagccctgtggacctgacctacacctatgaccacctgggggacagccccaagatcctgcaggacatcgccagcggcagccaccccttcagccaggtgctgaaggaggccaagaagcccatggtggtgctgggcagcagcgccctgcagagaaatgatggagctgccatcctggccgctgtgagcagcatcgcccagaagatccgcatgaccagcggcgtgactggagactggaaggtgatgaacatcctgcacagaattgccagccaggtggccgccctggacctgggctacaagccaggagtggaggccatcaggaagaacccccccaaggtgctcttcctgctgggcgcagatggcggctgcatcacccggcaggacctgcccaaggactgcttcatcatctaccagggccaccacggagatgtgggcgcccccatcgcagatgtgatcctgcctggagctgcctacacagagaagagcgccacctacgtgaacacagagggccgggcccagcagaccaaggtggccgtgaccccacctggcctggcccgggaggactggaagatcatccgggccctgtctgaaattgctggcatgaccctgccctatgacaccctggaccaggtgaggaaccggctggaggaggtgagccccaacctggtgcgctatgatgacattgaaggagccaactacttccagcaggccaatgagctgagcaagctggtgaaccagcagctgctggccgaccccctggtgcccccccagctgaccatcaaggacttctacatgacagacagcatcagccgggccagccagaccatggccaagtgtgtgaaggctgtgacagaaggagcccaggccgtggaggagcccagcatctgctag

SEQ ID NO: 161162 - DNA, 2184 bp, Artificial Sequence
  Description of Artificial Sequence: Synthetic coding sequence
atgctgcgcatccctgtgaggaaggccctggtgggcctgagcaagagccccaagggctgtgtgaggaccacagccacagctgccagcaacctgattgaggtgtttgtggatggccagagcgtgatggtggagcccggcaccaccgtgctgcaggcctgtgagaaggtgggcatgcagatcccccgcttctgctaccacgagcggctgtctgtggccggcaactgcaggatgtgcctggtggagattgagaaggcccccaaggtggtggccgcctgtgccatgcctgtgatgaagggctggaacatcctgaccaacagcgagaagagcaagaaggcccgggagggcgtgatggagttcctgctggccaaccaccccctggactgccccatctgtgaccagggcggggagtgtgacctgcaggaccagagcatgatgtttggaaatgacaggagccgcttcctggagggcaagagagctgtggaggacaagaacatcggccccctggtgaagaccatcatgacccgctgcatccagtgcacccgctgcatccgctttgccagcgagattgctggggtggatgacctgggcaccaccggcagaggaaatgacatgcaggtgggcacctacatcgagaagatgttcatgtctgagctgagcggcaacatcatcgacatctgccctgtgggcgccctgaccagcaagccctatgccttcaccgcccggccctgggagaccaggaagacagagagcattgatgtgatggatgctgtgggcagcaacatcgtggtgtccaccaggactggagaggtgatgaggatcctgcccaggatgcatgaggacatcaatgaggagtggatcagtgacaagaccaggtttgcctatgatggcctgaagaggcagaggctgacagagcccatggtgagaaatgagaagggcctgctgacctacacctcctgggaggatgccctgagccgggtggccggcatgctgcagagcttccagggcaaggatgtggccgccatcgccggcggcctggtggatgctgaggccctggtggccctgaaggacctgctgaacagagtggacagcgacaccctgtgcacagaggaggtgttccccacagctggagctggaacagacctgcggagcaactacctgctgaacaccaccatcgccggcgtggaggaggctgatgtggtgctgctggtgggcaccaaccccaggtttgaggcccccctcttcaatgcccgcatcaggaagtcctggctgcacaatgacctgaaggtggccctgattggcagccctgtggacctgacctacacctatgaccacctgggggacagccccaagatcctgcaggacatcgccagcggcagccaccccttcagccaggtgctgaaggaggccaagaagcccatggtggtgctgggcagcagcgccctgcagagaaatgatggagctgccatcctggccgctgtgagcagcatcgcccagaagatccgcatgaccagcggcgtgactggagactggaaggtgatgaacatcctgcacagaattgccagccaggtggccgccctggacctgggctacaagccaggagtggaggccatcaggaagaacccccccaaggtgctcttcctgctgggcgcagatggcggctgcatcacccggcaggacctgcccaaggactgcttcatcatctaccagggccaccacggagatgtgggcgcccccatcgcagatgtgatcctgcctggagctgcctacacagagaagagcgccacctacgtgaacacagagggccgggcccagcagaccaaggtggccgtgaccccacctggcctggcccgggaggactggaagatcatccgggccctgtctgaaattgctggcatgaccctgccctatgacaccctggaccaggtgaggaaccggctggaggaggtgagccccaacctggtgcgctatgatgacattgaaggagccaactacttccagcaggccaatgagctgagcaagctggtgaaccagcagctgctggccgaccccctggtgcccccccagctgaccatcaaggacttctacatgacagacagcatcagccgggccagccagaccatggccaagtgtgtgaaggctgtgacagaaggagcccaggccgtggaggagcccagcatctgctag

SEQ ID NO: 161163 - DNA, 393 bp, Artificial Sequence
  Description of Artificial Sequence: Synthetic coding sequence
atgctgcgcatccctgtgaggaaggccctggtgggcctgagcaagagccccaagggctgtgtgaggaccacagccacagctgccagcaacctgattgaggtgtttgtggatggccagagcgtgatggtggagcccggcaccaccgtgctgcaggcctgtgagaaggtgggcatgcagatcccccgcttctgctaccacgagcggctgtctgtggccggcaactgcaggatgtgcctggtggagattgagaaggcccccaaggtggtggccgcctgtgccatgcctgtgatgaagggctggaacatcctgaccaacagcgagaagagcaagaaggcccgggagggcgtgatggagttcctgctggccaaccaccccctggactgccccatctag

SEQ ID NO: 161164 - DNA, 2226 bp, Artificial Sequence
  Description of Artificial Sequence: Synthetic coding sequence
atgaggatccggggcagcagcggcaccctgagccgcatcaacatgctgcgcatccctgtgaggaaggccctggtgggcctgagcaagagccccaagggctgtgtgaggaccacagccacagctgccagcaacctgattgaggtgtttgtggatggccagagcgtgatggtggagcccggcaccaccgtgctgcaggcctgtgagaaggtgggcatgcagatcccccgcttctgctaccacgagcggctgtctgtggccggcaactgcaggatgtgcctggtggagattgagaaggcccccaaggtggtggccgcctgtgccatgcctgtgatgaagggctggaacatcctgaccaacagcgagaagagcaagaaggcccgggagggcgtgatggagttcctgctggccaaccaccccctggactgccccatctgtgaccagggcggggagtgtgacctgcaggaccagagcatgatgtttggaaatgacaggagccgcttcctggagggcaagagagctgtggaggacaagaacatcggccccctggtgaagaccatcatgacccgctgcatccagtgcacccgctgcatccgctttgccagcgagattgctggggtggatgacctgggcaccaccggcagaggaaatgacatgcaggtgggcacctacatcgagaagatgttcatgtctgagctgagcggcaacatcatcgacatctgccctgtgggcgccctgaccagcaagccctatgccttcaccgcccggccctgggagaccaggaagacagagagcattgatgtgatggatgctgtgggcagcaacatcgtggtgtccaccaggactggagaggtgatgaggatcctgcccaggatgcatgaggacatcaatgaggagtggatcagtgacaagaccaggtttgcctatgatggcctgaagaggcagaggctgacagagcccatggtgagaaatgagaagggcctgctgacctacacctcctgggaggatgccctgagccgggtggccggcatgctgcagagcttccagggcaaggatgtggccgccatcgccggcggcctggtggatgctgaggccctggtggccctgaaggacctgctgaacagagtggacagcgacaccctgtgcacagaggaggtgttccccacagctggagctggaacagacctgcggagcaactacctgctgaacaccaccatcgccggcgtggaggaggctgatgtggtgctgctggtgggcaccaaccccaggtttgaggcccccctcttcaatgcccgcatcaggaagtcctggctgcacaatgacctgaaggtggccctgattggcagccctgtggacctgacctacacctatgaccacctgggggacagccccaagatcctgcaggacatcgccagcggcagccaccccttcagccaggtgctgaaggaggccaagaagcccatggtggtgctgggcagcagcgccctgcagagaaatgatggagctgccatcctggccgctgtgagcagcatcgcccagaagatccgcatgaccagcggcgtgactggagactggaaggtgatgaacatcctgcacagaattgccagccaggtggccgccctggacctgggctacaagccaggagtggaggccatcaggaagaacccccccaaggtgctcttcctgctgggcgcagatggcggctgcatcacccggcaggacctgcccaaggactgcttcatcatctaccagggccaccacggagatgtgggcgcccccatcgcagatgtgatcctgcctggagctgcctacacagagaagagcgccacctacgtgaacacagagggccgggcccagcagaccaaggtggccgtgaccccacctggcctggcccgggaggactggaagatcatccgggccctgtctgaaattgctggcatgaccctgccctatgacaccctggaccaggtgaggaaccggctggaggaggtgagccccaacctggtgcgctatgatgacattgaaggagccaactacttccagcaggccaatgagctgagcaagctggtgaaccagcagctgctggccgaccccctggtgcccccccagctgaccatcaaggacttctacatgacagacagcatcagccgggccagccagaccatggccaagtgtgtgaaggctgtgacagaaggagcccaggccgtggaggagcccagcatctgctag

SEQ ID NO: 161165 - DNA, 1836 bp, Artificial Sequence
  Description of Artificial Sequence: Synthetic coding sequence
atggagttcctgctggccaaccaccccctggactgccccatctgtgaccagggcggggagtgtgacctgcaggaccagagcatgatgtttggaaatgacaggagccgcttcctggagggcaagagagctgtggaggacaagaacatcggccccctggtgaagaccatcatgacccgctgcatccagtgcacccgctgcatccgctttgccagcgagattgctggggtggatgacctgggcaccaccggcagaggaaatgacatgcaggtgggcacctacatcgagaagatgttcatgtctgagctgagcggcaacatcatcgacatctgccctgtgggcgccctgaccagcaagccctatgccttcaccgcccggccctgggagaccaggaagacagagagcattgatgtgatggatgctgtgggcagcaacatcgtggtgtccaccaggactggagaggtgatgaggatcctgcccaggatgcatgaggacatcaatgaggagtggatcagtgacaagaccaggtttgcctatgatggcctgaagaggcagaggctgacagagcccatggtgagaaatgagaagggcctgctgacctacacctcctgggaggatgccctgagccgggtggccggcatgctgcagagcttccagggcaaggatgtggccgccatcgccggcggcctggtggatgctgaggccctggtggccctgaaggacctgctgaacagagtggacagcgacaccctgtgcacagaggaggtgttccccacagctggagctggaacagacctgcggagcaactacctgctgaacaccaccatcgccggcgtggaggaggctgatgtggtgctgctggtgggcaccaaccccaggtttgaggcccccctcttcaatgcccgcatcaggaagtcctggctgcacaatgacctgaaggtggccctgattggcagccctgtggacctgacctacacctatgaccacctgggggacagccccaagatcctgcaggacatcgccagcggcagccaccccttcagccaggtgctgaaggaggccaagaagcccatggtggtgctgggcagcagcgccctgcagagaaatgatggagctgccatcctggccgctgtgagcagcatcgcccagaagatccgcatgaccagcggcgtgactggagactggaaggtgatgaacatcctgcacagaattgccagccaggtggccgccctggacctgggctacaagccaggagtggaggccatcaggaagaacccccccaaggtgctcttcctgctgggcgcagatggcggctgcatcacccggcaggacctgcccaaggactgcttcatcatctaccagggccaccacggagatgtgggcgcccccatcgcagatgtgatcctgcctggagctgcctacacagagaagagcgccacctacgtgaacacagagggccgggcccagcagaccaaggtggccgtgaccccacctggcctggcccgggaggactggaagatcatccgggccctgtctgaaattgctggcatgaccctgccctatgacaccctggaccaggtgaggaaccggctggaggaggtgagccccaacctggtgcgctatgatgacattgaaggagccaactacttccagcaggccaatgagctgagcaagctggtgaaccagcagctgctggccgaccccctggtgcccccccagctgaccatcaaggacttctacatgacagacagcatcagccgggccagccagaccatggccaagtgtgtgaaggctgtgacagaaggagcccaggccgtggaggagcccagcatctgctag

SEQ ID NO: 161166 - DNA, 1392 bp, Artificial Sequence
  Description of Artificial Sequence: Synthetic coding sequence
atggccgccctgcgggccctgtgtggcttccggggcgtggccgcccaggtgctgcggcctggggccggcgtgcggctgcccatccagcccagcagaggagtgcggcagtggcagccagatgtggagtgggcccagcagtttggaggagctgtgatgtaccccagcaaggagacagcccactggaagcccccaccctggaatgatgtggacccccccaaggacaccatcgtgaagaacatcaccctgaactttggcccccagcaccctgctgcccacggcgtgctgcggctggtgatggagctgagcggggagatggtgaggaaatgtgacccccacatcggcctgctgcaccggggcacagagaagctgattgagtacaagacctacctgcaggccctgccctactttgaccggctggactatgtgtccatgatgtgcaatgagcaggcctacagcctggccgtggagaagctgctgaacatccggcccccaccccgggcccagtggatccgggtgctgtttggagagatcacccggctgctgaaccacatcatggctgtgaccacccacgccctggacctgggcgccatgacccccttcttctggctgtttgaggagcgggagaagatgtttgagttctatgaaagagtgtctggggccaggatgcacgccgcctacatccggcctggaggagtgcaccaggacctgcccctgggcctgatggatgacatctaccagttcagcaagaacttcagcctgcggctggatgagctggaggagctgctgaccaacaaccgcatctggaggaacagaaccattgatattggagtggtgacagctgaggaggccctgaactacggcttctctggagtgatgctgcggggcagcggcatccagtgggacctgaggaagacccagccctatgatgtgtatgaccaggtggagtttgatgtgcctgtgggcagcagaggagactgctatgaccgctacctgtgccgggtggaggagatgaggcagagcctgcgcatcatcgcccagtgcctgaacaagatgcctcctggagagatcaaggtggatgatgccaaggtgtccccacccaagagagctgagatgaagacctccatggagagcctcatccaccacttcaagctgtacacagagggctaccaggtgcccccaggggccacctacacagccatcgaggcccccaagggggagtttggagtgtacctggtgtctgatggcagcagccggccctaccgctgcaagatcaaggcccctggctttgcccacctggccggcctggacaagatgagcaagggccacatgctggctgatgtggtggccatcatcggcacccaggacatcgtgtttggagaggtggacagatag

SEQ ID NO: 161167 - DNA, 1374 bp, Artificial Sequence
  Description of Artificial Sequence: Synthetic coding sequence
atggccgccctgcgggccctgtgtggcttccggggcgtggccgcccaggtgctgcggcctggggccggcgtgcggctgcccatccagcccagcagaggagtgcggcagtggcagccagatgtggagtgggcccagcagtttggaggagctgtgatgtaccccagcaaggagacagcccactggaagcccccaccctggaatgatgtggacccccccaaggacaccatcgtgaagaacatcaccctgaactttggcccccagcaccctgctgcccacggcgtgctgcggctggtgatggagctgagcggggagatggtgaggaaatgtgacccccacatcggcctgctgcaccggggcacagagaagctgattgagtacaagacctacctgcaggccctgccctactttgaccggctggactatgtgtccatgatgtgcaatgagcaggcctacagcctggccgtggagaagctgctgaacatccggcccccaccccgggcccagtggatccgggtgctgtttggagagatcacccggctgctgaaccacatcatggctgtgaccacccacgccctggacctgggcgccatgacccccttcttctggctgtttgaggagcgggagaagatgtttgagttctatgaaagagtgtctggggccaggatgcacgccgcctacatccggcctggaggagtgcaccaggacctgcccctgggcctgatggatgacatctaccagttcagcaagaacttcagcctgcggctggatgagctggaggagctgctgaccaacaaccgcatctggaggaacagaaccattgatattggagtggtgacagctgaggaggccctgaactacggcttctctggagtgatgctgcggggcagcggcatccagtgggacctgaggaagacccagccctatgatgtgtatgaccaggtggagtttgatgtgcctgtgggcagcagaggagactgctatgaccgctacctgtgccgggtggaggagatgaggcagagcctgcgcatcatcgcccagtgcctgaacaagatgcctcctggagagatcaaggtggatgatgccaaggtgtccccacccaagagagctgagatgaagacctccatggagagcctcatccaccacttcaagctgtacacagagggctaccaggtgcccccaggggccacctacacagccatcgaggcccccaagggggagtttggagtgtacctggtgtctgatggcagcagccggccctaccgctgcaagatcaaggcccctggctttgcccacctggccggcctggacaagatgagcaagggccacatgctggctgatgtggtggccatcatcggcacccggcccatcgtgtag

SEQ ID NO: 161168 - DNA, 696 bp, Artificial Sequence
  Description of Artificial Sequence: Synthetic coding sequence
atggagctgagcggggagatggtgaggaaatgtgacccccacatcggcctgctgcaccggggcacagagaagctgattgagtacaagacctacctgcaggccctgccctactttgaccggctggactatgtgtccatgatgtgcaatgagcaggcctacagcctggccgtggagaagctgctgaacatccggcccccaccccgggcccagtggatccgggtgctgtttggagagatcacccggctgctgaaccacatcatggctgtgaccacccacgccctggacctgggcgccatgacccccttcttctggctgtttgaggagcgggagaagatgtttgagttctatgaaagagtgtctggggccaggatgcacgccgcctacatccggcctggaggagtgcaccaggacctgcccctgggcctgatggatgacatctaccagttcagcaagaacttcagcctgcggctggatgagctggaggagctgctgaccaacaaccgcatctggaggaacagaaccattgatattggagtggtgacagctgaggaggccctgaactacggcttctctggagtgatgctgcggggcagcggcatccagtgggacctgaggaagacccagccctatgatgtgtatgaccaggtggagtttgatgtgcctgtgggcagcagaggagactgctatgacagatag

SEQ ID NO: 161169 - DNA, 162 bp, Artificial Sequence
  Description of Artificial Sequence: Synthetic coding sequence
atgtttgagttctatgagcgggtgtctggggccaggatgcatgctgcctacatccggcctgggggcgtgcaccaggacctgcccctgggcctgatggatgacatctaccagttcagcaagaacttcagcctgcggctggatgagctggaggaggtgtcctag

SEQ ID NO: 161170 - DNA, 795 bp, Artificial Sequence
  Description of Artificial Sequence: Synthetic coding sequence
atggctgctgctgctgtggcccggctgtggtggaggggcatcctgggcgccagcgccctgacccggggcaccggccggcccagcgtgctgctgctgcctgtgagaagagagagcgctggagctgacacccggcccaccgtgcggcccagaaatgatgtggcccacaagcagctgagcgcctttggagaatatgtggccgagatcctgcccaagtatgtgcagcaggtgcaggtgtcctgcttcaatgagctggaggtgtgcatccacccagatggagtcatccctgtgctgaccttcctgcgggaccacaccaatgcccagttcaagagcctggtggacctgacagctgtggatgtgcccacccggcagaacagatttgagatcgtgtacaacctgctgagcctgcgcttcaacagccgcatccgggtgaagacctacacagatgagctgacccccattgaatctgctgtgtctgtgttcaaggccgccaactggtatgaaagagagatctgggacatgtttggagtcttctttgccaaccacccagacctgcggcgcatcctgacagattatggctttgagggccaccccttcaggaaggacttccccctgagcggctacgtggagctgcgctatgatgatgaggtgaagagggtggtggccgagcctgtggagctggcccaggagttcaggaagtttgacctgaacagcccctgggaggccttccctgtgtaccggcagcccccagagagcctgaagctggaggccggggacaagaagccagatgccaagtag

SEQ ID NO: 161171 - DNA, 528 bp, Artificial Sequence
  Description of Artificial Sequence: Synthetic coding sequence
atggctgctgtgtccatgtctgtggtgctgcggcagaccctgtggaggagaagagctgtggccgtggccgccctgtctgtgtcccgggtgcccaccaggagcctgcggaccagcacctggaggctggcccaggaccagacccaggacacccagctgatcaccgtggatgagaagctggacatcaccaccctgactggagtgcctgaggagcacatcaagaccaggaaggtgcgcatctttgtgcctgccaggaacaacatgcagagcggcgtgaacaacaccaagaagtggaagatggagtttgacacccgggagcgctgggagaaccccctgatgggctgggccagcacagctgaccccctgagcaacatggtgctgaccttcagcaccaaggaggatgctgtgtcctttgctgagaagaatggctggagctatgacatcgaggagaggaaggtgcccaagcccaagagcaagagctatggagccaacttctcctggaacaagaggaccagggtgtccaccaagtag

SEQ ID NO: 161172 - DNA, 321 bp, Artificial Sequence
  Description of Artificial Sequence: Synthetic coding sequence
atgcccttcctggacatccagaagcgcttcggcctgaacatcgaccgctggctgaccatccagagcggggagcagccctacaagatggccggccgctgccacgcctttgagaaggagtggattgaatgtgcccatggaattggctacaccagggctgagaaggagtgcaagattgaatatgatgactttgtggagtgcctgctgcggcagaagaccatgaggcgggccggcaccatcaggaagcagagggacaagctgatcaaggagggcaagtacaccccaccaccccaccacatcggcaaaggagagccccggccctag

SEQ ID NO: 161173 - DNA, 321 bp, Artificial Sequence; identical to SEQ ID NO: 161172
  Description of Artificial Sequence: Synthetic coding sequence

SEQ ID NO: 161174 - DNA, 375 bp, Artificial Sequence
  Description of Artificial Sequence: Synthetic coding sequence
atggctgctgccatgaccttctgccgcctgctgaacagatgtggggaggccgcccggagcctgcccctgggcgcccgctgcttcggcgtgcgggtgagccccactggagagaaggtgacccacacaggccaggtgtatgatgacaaggactaccgccgcatccgctttgtgggccggcagaaggaggtgaatgaaaattttgccatcgacctgattgctgagcagcctgtgtctgaggtggagaccagggtgattgcctgtgatggcggcggcggggccctgggccaccccaaggtgtacatcaacctggacaaggagaccaagacaggcacctgtggctactgcggcctgcagttccggcagcaccaccactag

SEQ ID NO: 161175 - DNA, 1560 bp, Artificial Sequence
  Description of Artificial Sequence: Synthetic coding sequence
atggcccccatccccaagacagtgggccgcatcaagctggactgcagcctgcggcccagctgccccctggaggtggccgccgcccccaagctgtgcaaggagtttggacctgaggactatggagaagaagatattgtggacttcctgcggcggctggtggagagtgacccccagggcctgcaccgcatccacgtggatggcagcagcggccgcctgcagctgtggcaccacgactacctgctgggccacctggatgatgagggcaagagcacaggccagagcgaccggggcaaaggagctgagggcctgggcacctactgcggcctgaggaagagcttcctgtacccaccccaggagagcgagccctgcccccagagccccagcgccagcgccaccttccccagcgtgtctgacagcctgctgcaggtggccatgccccagaagctgctggtgacagaggaggaggccaaccggctggccgaggagctggtggccgaggaggagaggatgaagcagaaggccgagaagaagaggctgaagaagaagaggcagaaggagaggaagaggcaggagcggctggagcagtactgtggggagcccaaggccagcaccaccagtgatggagatgagagcccccccagcagccctggcaaccctgtgcagggccagtgtggggaggaggaggacagcctggacctgagcagcacctttgtgtccctggccctgaggaaggtgggggactggcccctgagcgcccggcgggagaagggcctgaaccaggagccccagggccggggcctggccctgcagaagatgggccaggaggaggagagccccccccgggaggagcggccccagcagagccccaaggtgcaggccagccctggcctgctggccgccgccctgcagcagagccaggagctggccaagctgggcaccagctttgcccagaatggcttctaccacgaggccgtggtgctcttcacccaggccctgaagctgaacccccaggaccaccggctgtttggaaacagaagcttctgccacgagcggctgggccagcctgcctgggccctggctgatgcccaggtggccctgaccctgcggcccggctggccccggggcctcttccggctgggcaaggccctgatgggcctgcagcgcttccgggaggccgctgctgtgttccaggagaccctgcggggcggcagccagccagatgctgcccgggagctgcggagctgcctgctgcacctgaccctgcagggccagaggggcggcatctgtgccccacccctgagccctggggccctgcagcccctgccccacgccgagctggcccccagcggcctgcccagcctgcgctgccccaggagcacagccctgcggagccctggcctgagccccctgctgcactaccccagctgccacaggagccaccccaaccagcccctgagccagacccagagcagaagaccccaccccctgaagccccaggaccccagcaagggctgggacatcctgggcctgggcctgcagcacctgagccaggccaggtag

SEQ ID NO: 161176 - DNA, 621 bp, Artificial Sequence
  Description of Artificial Sequence: Synthetic coding sequence
atggctgtgctgagcgcccctggcctgcggggcttccgcatcctgggcctgcggagctctgtgggccctgctgtgcaggcccggggcgtgcaccagagcgtggccacagatggccccagcagcacccagcctgccctgcccaaggcccgggctgtggcccccaagcccagcagcagaggagaatatgtggtggccaagctggatgacctggtgaactgggcccggcgcagcagcctgtggcccatgaccttcggcctggcctgctgtgctgtggagatgatgcacatggccgcccccaggtatgacatggaccgcttcggcgtggtgttccgggccagcccccggcagagtgatgtgatgattgtggccggcaccctgaccaacaagatggccccagccctgaggaaggtgtatgaccagatgcctgagccccgctacgtggtgtccatgggcagctgtgccaatggaggcggctactaccactacagctacagcgtggtgcggggctgtgacagaattgtgcctgtggacatctacatccctggccgggccggcacagccccacccacccgggagctggagactggacctgccccccacggggcccggcggcccctgtag

SEQ ID NO: 161177 - DNA, 885 bp, Artificial Sequence
  Description of Artificial Sequence: Synthetic coding sequence
atggctgtgctgagcgcccctggcctgcggggcttccgcatcctgggcctgcggagctctgtgggccctgctgtgcaggcccggggcgtgcaccagagcgtggccacagatggccccagcagcacccagcctgccctgcccaaggcccgggctgtggcccccaagcccagcagcagaggagaatatgtggtggccaagctggatgacctggtgaactgggccaggagagtgtccaccatgagctgccggcccagcagcagcgcccgggccagcctgcacacccaccgccacacccacacccacaccaacgtgcagaccaggacccacaccacccacgcctgcaccctgacctgtgcccacgtgcacgccagcagccacgtgtggacagatgtgtacacagaccacacccacacccacgcccacaatgcccacatgcacaccaggacccacgcccacctgcacacccacgcccacaccagcacctgtgcccacaccctggcccacatccacacctgcaccctggccctgatgcacacccacgcccacatctacacctgcaccaggaccctggcccacacctgcacctacatgcacagccacgcccacacctgcaccctgacccacatgcacacccggccctgtgtggacacctgcatgtgtgcctgctggcacgcctgcacccaggcccacagcctgatgcacacccacccctgtggccgcggggccggccgcaccctgcctgaggcccctgtgctggcctggtggcctgtggtgcccagtgaagattctgaccctgctggagatgaccccagcgtgtctgtcatcctcttcctggcctctgtgtgcagcagctgcttctccttcaaggtgaaggctgtgttctag

SEQ ID NO: 161178 - DNA, 645 bp, Artificial Sequence
  Description of Artificial Sequence: Synthetic coding sequence
atggctgtgctgagcgcccctggcctgcggggcttccgcatcctgggcctgcggagctctgtgggccctgctgtgcaggcccggggcgtgcaccagagcgtggccacagatggccccagcagcacccagcctgccctgcccaaggcccgggctgtggcccccaagcccagcagcagaggagaatatgtggtggccaagctggatgacctggtgaactgggcccggcgcagcagcctgtggcccatgaccttcggcctggcctgctgtgctgtggagatgatgcacatggccgcccccaggtatgacatggaccgcttcggcgtggtgttccgggccagcccccggcagagtgatgtgatgattgtggccggcaccctgaccaacaagatggccccagccctgaggaagagcagcctgcggccagatgctggagctgccctgcggggcctgcatggagagctgcggcagaggcggcggctgctgcccctcttcctgctgggcggggagggcctgcggccccaccgggcccggggccacctgcacccccggctgcccaccacagctgaggccctgctgtatggcatcctgcagctgcagaggaagatcaagcgggagcggcggctgcagatctggtacagaagatag

SEQ ID NO: 161179 - DNA, 621 bp, Artificial Sequence; identical to SEQ ID NO: 161176
  Description of Artificial Sequence: Synthetic coding sequence

SEQ ID NO: 161180 - DNA, 633 bp, Artificial Sequence
  Description of Artificial Sequence: Synthetic coding sequence
atgcgctgcctgaccacccccatgctgctgcgggccctggcccaggccgcccgggccggccccccaggcggccgcagcctgcacagcagcgctgtggccgccacctacaagtatgtgaacatgcaggaccctgagatggacatgaagtctgtgacagacagagctgcccggaccctgctgtggacagagctgttccggggcctgggcatgaccctgagctacctgttccgggagcccgccaccatcaactacccctttgagaagggccccctgagcccccgcttccggggggagcacgccctgcggcgctaccccagcggggaggagcgctgcatcgcctgcaagctgtgtgaggccatctgcccagcccaggccatcaccatcgaggccgagcccagggcagatggcagcaggaggaccaccaggtatgacatcgacatgaccaagtgcatctactgcggcttctgccaggaggcctgccctgtggatgccatcgtggagggccccaactttgagttcagcacagagacccatgaggagctgctgtacaacaaggagaagctgctgaacaatggagacaagtgggaggccgagattgctgccaacatccaggccgactacctgtacagatag

SEQ ID NO: 161181 - DNA, 375 bp, Artificial Sequence
  Description of Artificial Sequence: Synthetic coding sequence
atgcgctgcctgaccacccccatgctgctgcgggccctggcccaggccgcccgggccggccccccaggcggccgcagcctgcacagcagcgctgtggccgccacctacaagtatgtgaacatgcaggaccctgagatggacatgaagtctgtgacagacagagctgcccggaccctgctgtggacagagctgttccggggcctgggcatgaccctgagctacctgttccgggagcccgccaccatcaactacccctttgagaagggccccctgagcccccgcttccggggggagcacgccctgcggcgctaccccagcggggaggagcgctgcatcgcctgcaagctgtgtgaggccatctgcccagcccagtag

SEQ ID NO: 161182 - DNA, 333 bp, Artificial Sequence
  Description of Artificial Sequence: Synthetic coding sequence
atgcgctgcctgaccacccccatgctgctgcgggccctggcccaggccgcccgggccggccccccaggcggccgcagcctgcacagcagcgctgtggccgccacctacaagtatgtgaacatgcaggaccctgagatggacatgaagtctgtgacagacagagctgcccggaccctgctgtggacagagctgttccggggcctgggcatgaccctgagctacctgttccgggagcccgccaccatcaactacccctttgagaagggccccctgagcccccgcttccggggggagcacgccctgcggcgctaccccagcggggaggagaggtag

SEQ ID NO: 161183 - DNA, 555 bp, Artificial Sequence
  Description of Artificial Sequence: Synthetic coding sequence
atgcgctgcctgaccacccccatgctgctgcgggccctggcccaggccgcccgggccggccccccaggcggccgcagcctgcacagcagcgctgtggccgccacctacaagtatgtgaacatgcaggaccctgagatggacatgaagtctgtgacagacagagctgcccggaccctgctgtggacagagctgttccggggcctgggcatgaccctgagctacctgttccgggagcccgccaccatcaactacccctttgagaagggccccctgagcccccgcttccggggggagcacgccctgcggcgctaccccagcggggaggagcgctgcatcgcctgcaagctgtgtgaggccatctgcccagcccaggccatcaccatcgaggccgagcccagggcagatggcagcaggaggaccaccaggtatgacatcgacatgaccaagtgcatctactgcggcttctgccaggaggcctgccctgtggatgccatcgtggagggccccaactttgagttcagcacagagacccatgaggagctgctgtacaactag

SEQ ID NO: 161184 - DNA, 195 bp, Artificial Sequence
  Description of Artificial Sequence: Synthetic coding sequence
atgaccaagtgcatctactgcggcttctgccaggaggcctgccctgtggatgccatcgtggagggccccaactttgagttcagcacagagacccatgaggagctgctgtacaacaaggagaagctgctgaacaatggagacaagtgggaggccgagattgctgccaacatccaggccgactacctgtacagatag

SEQ ID NO: 161185 - DNA, 1395 bp, Artificial Sequence
  Description of Artificial Sequence: Synthetic coding sequence
atgctggccacccggcggctgctgggctggagcctgcctgcccgggtgtctgtgcgcttcagcggggacaccacagcccccaagaagaccagctttggcagcctgaaggatgaggaccgcatcttcaccaacctgtatggaagacatgactggaggctgaagggcagcctgagcagaggagactggtacaagaccaaggagatcctgctgaagggccctgactggatcctgggggagatcaagaccagcggcctgcggggccggggcggggccggcttccccaccggcctgaagtggagcttcatgaacaagcccagtgatggccggcccaagtacctggtggtgaatgctgatgaaggagagcccggcacctgcaaggaccgggagatcctgcggcatgacccccacaagctgctggagggctgcctggtgggcggccgggccatgggcgcccgggccgcctacatctacatccggggggagttctacaatgaggccagcaacctgcaggtggccatccgggaggcctatgaagctggcctcatcggcaagaatgcctgtggcagcggctatgactttgatgtgtttgtggtgagaggagctggggcctacatctgtggggaggagacagccctgattgagagcattgagggcaagcagggcaagccccggctgaagccacccttcccagcagatgtgggcgtgtttggctgccccaccaccgtggccaacgtggagaccgtggccgtgagccccaccatctgccggcggggcggcacctggtttgctggcttcggccgggagagaaattctggcaccaagctgttcaacatcagcggccacgtgaaccacccctgcaccgtggaggaggagatgtctgtgcccctgaaggagctgattgagaagcacgccggcggcgtgactggaggctgggacaacctgctggccgtcatccctgggggcagcagcacccccctcatccccaagtctgtgtgtgagaccgtgctgatggactttgatgccctggtgcaggcccagacaggcctgggcacagctgctgtgattgtgatggacaggagcacagacatcgtgaaggccatcgcccggctgattgagttctacaagcatgagagctgtggccagtgcaccccctgccgggagggcgtggactggatgaacaaggtgatggccaggtttgtgagaggagatgcccggcctgctgagattgacagcctgtgggagatcagcaagcagatcgagggccacaccatctgtgccctgggagatggagctgcctggcctgtgcagggcctcatccgccacttccggcctgagctggaggagaggatgcagagatttgcccagcagcaccaggcccggcaggccgccagctag

SEQ ID NO: 161186 - DNA, 1374 bp, Artificial Sequence
  Description of Artificial Sequence: Synthetic coding sequence
atgctggccacccggcggctgctgggctggagcctgcctgcccgggtgtccacagcccccaagaagaccagctttggcagcctgaaggatgaagatcgcatcttcaccaacctgtatggaagacatgactggaggctgaagggcagcctgagcagaggagactggtacaagaccaaggagatcctgctgaagggccctgactggatcctgggggagatcaagaccagcggcctgcggggccggggcggggccggcttccccaccggcctgaagtggagcttcatgaacaagcccagtgatggccggcccaagtacctggtggtgaatgctgatgaaggagagcccggcacctgcaaggaccgggagatcctgcggcatgacccccacaagctgctggagggctgcctggtgggcggccgggccatgggcgcccgggccgcctacatctacatccggggggagttctacaatgaggccagcaacctgcaggtggccatccgggaggcctatgaggccggcctgattggcaagaatgcctgtggcagcggctatgactttgatgtgtttgtggtgcggggggccggggcctacatctgtggggaggagacagccctgattgagagcattgagggcaagcagggcaagccccggctgaagccacccttcccagcagatgtgggcgtgtttggctgccccaccaccgtggccaacgtggagaccgtggccgtgagccccaccatctgcagaagaggaggcacctggtttgctggcttcggccgggagaggaacagcggcaccaagctgttcaacatcagcggccacgtgaaccacccctgcaccgtggaggaggagatgtctgtgcccctgaaggagctgattgagaagcatgctggaggagtgactggaggctgggacaacctgctggccgtcatccctgggggcagcagcacccccctcatccccaagtctgtgtgtgaaacagtgctgatggactttgatgccctggtgcaggcccagacaggcctgggcacagctgctgtgattgtgatggacaggagcacagacatcgtgaaggccatcgcccggctcatcgagttctacaagcatgagagctgtggccagtgcaccccctgccgggagggcgtggactggatgaacaaggtgatggccaggtttgtgagaggagatgcccggcctgctgagattgacagcctgtgggagatcagcaagcagatcgagggccacaccatctgtgccctgggagatggagctgcctggcctgtgcagggcctcatccgccacttccggcctgagctggaggagaggatgcagagatttgcccagcagcaccaggcccggcaggccgccagctag

SEQ ID NO: 161187 - DNA, 1008 bp, Artificial Sequence
  Description of Artificial Sequence: Synthetic coding sequence
atgctggccacccggcggctgctgggctggagcctgcctgcccgggtgtctgtgcgcttcagcggggacaccacagcccccaagaagaccagctttggcagcctgaaggatgaggaccgcatcttcaccaacctgtatggaagacatgactggaggctgaagggcagcctgagcagaggagactggtacaagaccaaggagatcctgctgaagggccctgactggatcctgggggagatcaagaccagcggcctgcggggccggggcggggccggcttccccaccggcctgaagtggagcttcatgaacaagcccagtgatggcagccccaccaccgtggccaacgtggagaccgtggccgtgagccccaccatctgcagaagaggaggcacctggtttgctggcttcggccgggagaggaacagcggcaccaagctgttcaacatcagcggccacgtgaaccacccctgcaccgtggaggaggagatgtctgtgcccctgaaggagctgattgagaagcatgctggaggagtgactggaggctgggacaacctgctggccgtcatccctgggggcagcagcacccccctcatccccaagtctgtgtgtgaaacagtgctgatggactttgatgccctggtgcaggcccagacaggcctgggcacagctgctgtgattgtgatggacaggagcacagacatcgtgaaggccatcgcccggctcatcgagttctacaagcatgagagctgtggccagtgcaccccctgccgggagggcgtggactggatgaacaaggtgatggccaggtttgtgagaggagatgcccggcctgctgagattgacagcctgtgggagatcagcaagcagatcgagggccacaccatctgtgccctgggagatggagctgcctggcctgtgcagggcctcatccgccacttccggcctgagctggaggagaggatgcagagatttgcccagcagcaccaggcccggcaggccgccagctag

SEQ ID NO: 161188 - DNA, 1368 bp, Artificial Sequence
  Description of Artificial Sequence: Synthetic coding sequence
atgctggccacccggcggctgctgggctggagcctgcctgccaggacagcccccaagaagaccagctttggcagcctgaaggatgaagatcgcatcttcaccaacctgtatggaagacatgactggaggctgaagggcagcctgagcagaggagactggtacaagaccaaggagatcctgctgaagggccctgactggatcctgggggagatcaagaccagcggcctgcggggccggggcggggccggcttccccaccggcctgaagtggagcttcatgaacaagcccagtgatggccggcccaagtacctggtggtgaatgctgatgaaggagagcccggcacctgcaaggaccgggagatcctgcggcatgacccccacaagctgctggagggctgcctggtgggcggccgggccatgggcgcccgggccgcctacatctacatccggggggagttctacaatgaggccagcaacctgcaggtggccatccgggaggcctatgaggccggcctgattggcaagaatgcctgtggcagcggctatgactttgatgtgtttgtggtgcggggggccggggcctacatctgtggggaggagacagccctgattgagagcattgagggcaagcagggcaagccccggctgaagccacccttcccagcagatgtgggcgtgtttggctgccccaccaccgtggccaacgtggagaccgtggccgtgagccccaccatctgcagaagaggaggcacctggtttgctggcttcggccgggagaggaacagcggcaccaagctgttcaacatcagcggccacgtgaaccacccctgcaccgtggaggaggagatgtctgtgcccctgaaggagctgattgagaagcatgctggaggagtgactggaggctgggacaacctgctggccgtcatccctgggggcagcagcacccccctcatccccaagtctgtgtgtgaaacagtgctgatggactttgatgccctggtgcaggcccagacaggcctgggcacagctgctgtgattgtgatggacaggagcacagacatcgtgaaggccatcgcccggctcatcgagttctacaagcatgagagctgtggccagtgcaccccctgccgggagggcgtggactggatgaacaaggtgatggccaggtttgtgagaggagatgcccggcctgctgagattgacagcctgtgggagatcagcaagcagatcgagggccacaccatctgtgccctgggagatggagctgcctggcctgtgcagggcctcatccgccacttccggcctgagctggaggagaggatgcagagatttgcccagcagcaccaggcccggcaggccgccagctag

SEQ ID NO: 161189 - DNA, 1092 bp, Artificial Sequence
  Description of Artificial Sequence: Synthetic coding sequence
atgaacaagcccagtgatggccggcccaagtacctggtggtgaatgctgatgaaggagagcccggcacctgcaaggaccgggagatcctgcggcatgacccccacaagctgctggagggctgcctggtgggcggccgggccatgggcgcccgggccgcctacatctacatccggggggagttctacaatgaggccagcaacctgcaggtggccatccgggaggcctatgaggccggcctgattggcaagaatgcctgtggcagcggctatgactttgatgtgtttgtggtgcggggggccggggcctacatctgtggggaggagacagccctgattgagagcattgagggcaagcagggcaagccccggctgaagccacccttcccagcagatgtgggcgtgtttggctgccccaccaccgtggccaacgtggagaccgtggccgtgagccccaccatctgcagaagaggaggcacctggtttgctggcttcggccgggagaggaacagcggcaccaagctgttcaacatcagcggccacgtgaaccacccctgcaccgtggaggaggagatgtctgtgcccctgaaggagctgattgagaagcatgctggaggagtgactggaggctgggacaacctgctggccgtcatccctgggggcagcagcacccccctcatccccaagtctgtgtgtgaaacagtgctgatggactttgatgccctggtgcaggcccagacaggcctgggcacagctgctgtgattgtgatggacaggagcacagacatcgtgaaggccatcgcccggctcatcgagttctacaagcatgagagctgtggccagtgcaccccctgccgggagggcgtggactggatgaacaaggtgatggccaggtttgtgagaggagatgcccggcctgctgagattgacagcctgtgggagatcagcaagcagatcgagggccacaccatctgtgccctgggagatggagctgcctggcctgtgcagggcctcatccgccacttccggcctgagctggaggagaggatgcagagatttgcccagcagcaccaggcccggcaggccgccagctag

SEQ ID NO: 161190 - DNA, 750 bp, Artificial Sequence
  Description of Artificial Sequence: Synthetic coding sequence
atgttcttctctgctgccctgcgggcccgggccgccggcctgacagcccactggggcagacatgtgaggaacctgcacaagacagtgatgcagaatggagctgggggcgccctgtttgtgcaccgggacaccccagagaacaacccagacaccccatttgacttcaccccagagaactacaagagaattgaggccatcgtgaagaactacccagagggccacaaggctgctgctgtgctgcctgtgctggacctggcccagaggcagaatggctggctgcccatcagcgccatgaacaaggtggccgaggtgctgcaggtgccccccatgagggtgtatgaggtggccaccttctacaccatgtacaacaggaagcctgtgggcaagtaccacatccaggtgtgcaccaccaccccctgcatgctgaggaacagcgacagcatcctggaggccatccagaagaagctgggcatcaaggtgggggagaccaccccagacaagctgttcaccctcatcgaggtggagtgcctgggcgcctgtgtgaatgcccccatggtgcagatcaatgacaactactatgaggacctgacagccaaggacatcgaggagatcattgatgagctgaaggccggcaagatccccaagccaggccccaggagcggccgcttcagctgtgagcctgctgggggcctgaccagcctgacagagccccccaagggccctggctttggagtgcaggccggcctgtag

SEQ ID NO: 161191 - DNA, 327 bp, Artificial Sequence
  Description of Artificial Sequence: Synthetic coding sequence
atggccgccccctgcctgctgcggcagggccgggccggggccctgaagaccatgctgcaggaggcccaggtgttccggggcctggccagcacagtgtccctgtctgctgagagcggcaagtctgagaagggccagccccagaacagcaagaagcagagcccccccaagaagccagcccctgtgcctgctgagccctttgacaacaccacctacaagaacctgcagcaccacgactacagcacctacaccttcctggacctgaacctggagctgagcaagttcaggatgccccagcccagcagcggccgggagagccccaggcactag

SEQ ID NO: 161192 - DNA, 1422 bp, Artificial Sequence
  Description of Artificial Sequence: Synthetic coding sequence
atggccgccccctgcctgctgcggcagggccgggccggggccctgaagaccatgctgcaggaggcccaggtgttccggggcctggccagcacagtgtccctgtctgctgagagcggcaagtctgagaagggccagccccagaacagcaagaagcagagcccccccaagaatgtggtggagcccaaggagcggggcaagctgctggccacccagacagctgctgagctgagcaagaacctgagcagccccagcagctacccacctgctgtgaacaagggcaggaaggtggccagccccagccccagcggctctgtgctcttcacagatgaaggagtgcccaagttcctgagcaggaagaccctggtggagttcccccagaaggtgctgagccccttcaggaagcagggcagtgacagcgaggcccggcaggtgggcaggaaggtgaccagccccagcagcagcagcagcagcagcagcagtgacagcgagagtgatgatgaagcagatgtgtctgaggtgaccccccgggtggtgtccaagggccggggcggcctgaggaagccagaggccagccacagctttgaaaatagagccccccgggtgacagtgtctgccaaggagaagaccctgctgcagaagccccacgtggacatcacagatcctgagaagccccaccagcccaagaagaagggcagccctgccaagcccagcgagggcagagaaaatgcccggcccaagaccaccatgcccaggagccaggtggatgaggagttcctgaagcagagcctgaaggagaagcagctgcagaagaccttccggctgaatgaaattgacaaggagagccagaagccctttgaggtgaagggccccctgcctgtgcacaccaagagcggcctgagcgccccacccaagggcagccctgccccagctgtgctggccgaggaggcccgggcagagggccagctgcaggccagccccccaggagctgctgagggccacctggagaagcctgtgcctgagccccagaggaaggccgccccacccctgcccaggaaggagaccagcggcacccagggcatcgagggccacctgaagggcggccaggccatcgtggaggaccagatcccccccagcaacctggagaccgtgcctgtggagaacaaccacggcttccacgagaagacagctgccctgaagctggaggccgagggggaggccatggaggatgctgctgcccctggagatgaccggggcggcacccaggagcccgcccctgtgcctgctgagccctttgacaacaccacctacaagaacctgcagcaccacgactacagcacctacaccttcctggacctgaacctggagctgagcaagttcaggatgccccagcccagcagcggccgggagagccccaggcactag

SEQ ID NO: 161193 - DNA, 339 bp, Artificial Sequence
  Description of Artificial Sequence: Synthetic coding sequence
atgctgcaggaggcccaggtgttccggggcctggccagcacagtgtccctgtctgctgagagcggcaagtctgagaagggccagccccagaacagcaagaagcagagcccccccaagtctgtgcccaccccccaccggcgctacagcccctgtggggactggaaggatgccagcagcctgaagccagcccctgtgcctgctgagccctttgacaacaccacctacaagaacctgcagcaccacgactacagcacctacaccttcctggacctgaacctggagctgagcaagttcaggatgccccagcccagcagcggccgggagagccccaggcactag

SEQ ID NO: 161194 - DNA, 2223 bp, Artificial Sequence
  Description of Artificial Sequence: Synthetic coding sequence
atggagaagctgggcgtggagcctgaggaggagggcggcggagatgatgatgaagaagatgctgaggcctgggccatggagctggctgatgtgggcgccgccgccagcagccagggcgtgcatgaccaggtgctgcccaccccaaatgccagcagccgggtgattgtgcacgtggacctggactgcttctacgcccaggtggagatgatcagcaaccctgagctgaaggacaagcccctgggcgtgcagcagaagtacctggtggtgacctgcaactatgaggccaggaagctgggcgtgaagaagctgatgaatgtgagagatgccaaggagaagtgcccccagctggtgctggtgaatggagaggacctgacccgctaccgggagatgagctacaaggtgacagagctgctggaggagttcagccctgtggtggagcggctgggctttgatgagaactttgtggacctgacagagatggtggagaagaggctgcagcagctgcagagtgatgagctgtctgctgtgacagtgtctggccacgtgtacaacaaccagagcatcaacctgctggatgtgctgcacatccggctgctggtgggcagccagattgctgctgagatgagggaggccatgtacaaccagctgggcctgaccggctgtgccggcgtggccagcaacaagctgctggccaagctggtgtctggagtcttcaagcccaaccagcagacagtgctgctgcctgagagctgccagcacctgatccacagcctgaaccacatcaaggagatccctggcatcggctacaagacagccaagtgcctggaggccctgggcatcaacagcgtgcgggacctgcagaccttcagccccaagatcctggagaaggagctgggcatctctgtggcccagaggatccagaagctgagctttggagaggacaacagccctgtgatcctgagcggccccccccagagcttcagcgaggaggacagcttcaagaagtgcagcagcgaggtggaggccaagaacaagattgaggagctgctggccagcctgctgaacagagtgtgccaggacggcaggaagccccacacagtgcggctcatcatccgccgctacagcagcgagaagcactacggccgggagagccggcagtgccccatccccagccacgtgatccagaagctgggcactggaaattatgatgtgatgacccccatggtggacatcctgatgaagctgttcaggaacatggtgaatgtgaagatgcccttccacctgaccctgctgtctgtgtgcttctgcaacctgaaggccctgaacacagccaagaagggcctgattgactactacctgatgcccagcctgagcaccaccagccgcagcggcaagcacagcttcaagatgaaggacacccacatggaggacttccccaaggacaaggagaccaacagagacttcctgcccagcggccgcatcgagagcaccaggacccgggagagccccctggacaccaccaacttcagcaaggagaaggacatcaatgagttccccctgtgcagcctgcctgagggcgtggaccaggaggtgttcaagcagctgcctgtggacatccaggaggagatcctgagcggcaagagccgggagaagttccagggcaaaggatctgtgtcctgccccctgcacgccagcagaggagtgctgtccttcttcagcaagaagcagatgcaggacatccccatcaacccccgggaccacctgagcagcagcaagcaggtgtcctctgtgagcccctgtgagcccggcaccagcggcttcaacagcagcagcagcagctacatgagcagccagaaggactacagctactacctggacaaccggctgaaggatgagcgcatcagccagggccccaaggagccccagggcttccacttcaccaacagcaacccagctgtgtctgccttccacagcttccccaacctgcagagcgagcagctgttcagcaggaaccacaccacagacagccacaagcagacagtggccacagacagccatgagggcctgacagaaaatcgggagccagattctgtggatgagaagatcaccttccccagcgacatcgacccccaggtgttctatgagctgcctgaggccgtgcagaaggagctgctggccgagtggaagagagctggcagtgacttccacatcggccacaagtag

SEQ ID NO: 161195 - DNA, 540 bp, Artificial Sequence
  Description of Artificial Sequence: Synthetic coding sequence
atgaacaagaggggcttctccatggaggtgggccagtacatctttgtgaactgccccagcatcagcctgctggagtggcaccccttcaccctgaccagcgcccctgaggaggacttcttcagcatccacatccgggctgctggggactggacagagaacctgatccgggcctttgagcagcagtacagccccatcccccgcatcgaggtggatggccccttcggcacagcctctgaagatgtgttccagtatgaggtggccgtgctggtgggcgccggcatcggcgtgaccccatttgccagcatcctgaagagcatctggtacaagttccagtgtgccgaccacaacctgaagaccaagaagatctacttctactggatctgccgggagactggagccttctcctggttcaacaacctgctgaccagcctggagcaggagatggaggagctgggcaagagcctgaggaagtgctgccaccgctacagcagcctggaccccaggaaggtgcagttctacttcaacaaggagaacttctag

SEQ ID NO: 161196 - DNA, 1584 bp, Artificial Sequence
  Description of Artificial Sequence: Synthetic coding sequence
atgggcaactgggtggtgaaccactggttctctgtgctcttcctggtggtgtggctgggcctgaatgtgttcctgtttgtggatgccttcctgaagtatgagaaggctgacaagtactactacaccaggaagatcctgggcttctgcagcaggaccctgaggaagcagctggaccacaacctgaccttccacaagctggtggcctacatgatctgcctgcacacagccatccacatcatcgcccacctgttcaactttgactgctacagccgcagccggcaggccacagatggcagcctggccagcatcctgagcagcctgagccatgatgagaagaagggcggctcctggctgaaccccatccagagcaggaacaccaccgtggagtatgtgaccttcaccagcattgctggcctgactggagtcatcatgaccatcgccctgatcctgatggtgaccagcgccacagagttcatccgccgcagctactttgaggtgttctggtacacccaccacctgttcatcttctacatcctgggcctgggcatccacggcatcggcggcatcgtgcggggccagacagaggagagcatgaatgaaagccaccccaggaaatgtgccgagagctttgagatgtgggatgaccgggacagccactgcagaagacccaagtttgagggccaccccccagagagctggaagtggatcctggcccctgtgatcctgtacatctgtgagcgcatcctgcgcttctaccgcagccagcagaaggtggtgatcaccaaggtggtgatgcaccccagcaaggtgctggagctgcagatgaacaagaggggcttctccatggaggtgggccagtacatctttgtgaactgccccagcatcagcctgctggagtggcaccccttcaccctgaccagcgcccctgaggaggacttcttcagcatccacatccgggctgctggggactggacagagaacctgatccgggcctttgagcagcagtacagccccatcccccgcatcgaggtggatggccccttcggcacagcctctgaagatgtgttccagtatgaggtggccgtgctggtgggcgccggcatcggcgtgaccccatttgccagcatcctgaagagcatctggtacaagttccagtgtgccgaccacaacctgaagaccaagaagatctacttctactggatctgccgggagactggagccttctcctggttcaacaacctgctgaccagcctggagcaggagatggaggagctgggcaaggtgggcttcctgaactaccgcctcttcctgaccggctgggacagcaacatcgtgggccacgccgccctgaactttgacaaggccacagacatcgtgacaggcctgaagcagaagaccagctttggccggcccatgtgggacaatgagttcagcaccatcgccaccagccaccccaagtctgtggtgggcgtcttcctgtgtggccccaggaccctggccaagagcctgaggaagtgctgccaccgctacagcagcctggaccccaggaaggtgcagttctacttcaacaaggagaacttctag

SEQ ID NO: 161197 - DNA, 579 bp, Artificial Sequence
  Description of Artificial Sequence: Synthetic coding sequence
atgggcaactgggtggtgaaccactggttctctgtgctcttcctggtggtgtggctgggcctgaatgtgttcctgtttgtggatgccttcctgaagtatgagaaggctgacaagtactactacaccaggaagatcctgggcagcaccctggcctgtgcccgggccagcgccctgtgcctgaacttcaacagcaccctcatcctgctgcctgtgtgcaggaacctgctgtccttcctgcggggcacctgcagcttctgcagcaggaccctgaggaagcagctggaccacaacctgaccttccacaagctggtggcctacatgatctgcctgcacacagccatccacatcatcgcccacctgttcaactttgactgctacagccgcagccggcaggccacagatggcagcctggccagcatcctgagcagcctgagccatgatgagaagaagggcggctcctggctgaaccccatccacccccacatcacccccaccgtgtacatgttcaccgtgacctttgacatggtgctgagctctgtgaacagcaacctcttcctgttcctgctgatcaagaagtag

SEQ ID NO: 161198 - DNA, 579 bp, Artificial Sequence; identical to SEQ ID NO: 161197
  Description of Artificial Sequence: Synthetic coding sequence

SEQ ID NO: 161199 - DNA, 1695 bp, Artificial Sequence
  Description of Artificial Sequence: Synthetic coding sequence
atgggcaactgggtggtgaaccactggttctctgtgctcttcctggtggtgtggctgggcctgaatgtgttcctgtttgtggatgccttcctgaagtatgagaaggctgacaagtactactacaccaggaagatcctgggcagcaccctggcctgtgcccgggccagcgccctgtgcctgaacttcaacagcaccctcatcctgctgcctgtgtgcaggaacctgctgtccttcctgcggggcacctgcagcttctgcagcaggaccctgaggaagcagctggaccacaacctgaccttccacaagctggtggcctacatgatctgcctgcacacagccatccacatcatcgcccacctgttcaactttgactgctacagccgcagccggcaggccacagatggcagcctggccagcatcctgagcagcctgagccatgatgagaagaagggcggctcctggctgaaccccatccagagcaggaacaccaccgtggagtatgtgaccttcaccagcattgctggcctgactggagtcatcatgaccatcgccctgatcctgatggtgaccagcgccacagagttcatcagaagaagctactttgaggtgttctggtacacccaccacctgttcatcttctacatcctgggcctgggcatccatggaattggaggcatcgtgcggggccagacagaggagagcatgaatgaaagccaccccaggaaatgtgccgagagctttgagatgtgggatgaccgggacagccactgccggcggcccaagtttgagggccaccccccagagagctggaagtggatcctggcccctgtgatcctgtacatctgtgagcgcatcctgcgcttctaccgcagccagcagaaggtggtgatcaccaaggtggtgatgcaccccagcaaggtgctggagctgcagatgaacaagaggggcttctccatggaggtgggccagtacatctttgtgaactgccccagcatcagcctgctggagtggcaccccttcaccctgaccagcgcccctgaggaggacttcttcagcatccacatccgggccgccggggactggacagaaaatctcatccgggcctttgagcagcagtacagccccatccccagaattgaggtggatggcccctttggaacagcctctgaagatgtgttccagtatgaggtggccgtgctggtgggcgccggcattggagtgaccccatttgccagcatcctgaagagcatctggtacaagttccagtgtgccgaccacaacctgaagaccaagaagatctacttctactggatctgccgggagaccggggccttctcctggttcaacaacctgctgaccagcctggagcaggagatggaggagctgggcaaggtgggcttcctgaactaccgcctcttcctgaccggctgggacagcaacatcgtgggccatgctgccctgaactttgacaaggccacagacatcgtgacaggcctgaagcagaagaccagctttggccggcccatgtgggacaatgagttcagcaccatcgccaccagccaccccaagtctgtggtgggcgtcttcctgtgtggccccaggaccctggccaagagcctgaggaagtgctgccaccgctacagcagcctggaccccaggaaggtgcagttctacttcaacaaggagaacttctag

SEQ ID NO: 161200 - DNA, 528 bp, Artificial Sequence
  Description of Artificial Sequence: Synthetic coding sequence
tgattctccatggaggtgggccagtacatctttgtgaactgccccagcatcagcctgctggagtggcaccccttcaccctgaccagcgcccctgaggaggacttcttcagcatccacatccgggctgctggggactggacagagaacctgatccgggcctttgagcagcagtacagccccatcccccgcatcgaggtggatggccccttcggcacagcctctgaagatgtgttccagtatgaggtggccgtgctggtgggcgccggcatcggcgtgaccccatttgccagcatcctgaagagcatctggtacaagttccagtgtgccgaccacaacctgaagaccaagaagatctacttctactggatctgccgggagactggagccttctcctggttcaacaacctgctgaccagcctggagcaggagatggaggagctgggcaagagcctgaggaagtgctgccaccgctacagcagcctggaccccaggaaggtgcagttctacttcaacaaggagaacttctag

SEQ ID NO: 161201 - DNA, 1707 bp, Artificial Sequence
  Description of Artificial Sequence: Synthetic coding sequence
atgatgggctgctggatcctgaatgaaggcctgagcaccatcctggtgctgtcctggctgggcatcaacttctacctgttcatcgacaccttctactggtatgaggaggaggagagcttccactacaccagggtcatcctgggcagcaccctggcctgggcccgggccagcgccctgtgcctgaacttcaactgcatgctgatcctgatccctgtgtccaggaacctgatctccttcatccggggcaccagcatctgctgccggggcccctggaggcggcagctggacaagaacctgcgcttccacaagctggtggcctatggaattgctgtgaatgccaccatccacatcgtggcccacttcttcaacctggagcgctaccactggagccagagcgaggaggcccagggcctgctggccgccctgagcaagctgggcaacaccccaaatgaaagctacctgaaccctgtgaggaccttccccaccaacaccaccacagagctgctgcggaccatcgccggcgtgacaggcctggtgatcagcctggccctggtgctgatcatgaccagcagcacagagttcatccggcaggccagctatgagctgttctggtacacccaccacgtgttcatcgtgttcttcctgagcctggccatccacggcaccggcagaattgtgcggggccagacccaggacagcctgagcctgcacaacatcaccttctgccgggacagatatgcagagtggcagacagtggcccagtgccctgtgccccagttcagcggcaaggagcccagcgcctggaagtggatcctgggccctgtggtgctgtatgcctgtgagcgcatcatccgcttctggaggttccagcaggaggtggtgatcaccaaggtggtgagccaccccagcggcgtgctggagctgcacatgaagaagaggggcttcaagatggcccctggccagtacatcctggtgcagtgcccagccatcagcagcctggagtggcaccccttcaccctgaccagcgccccccaggaggacttcttctctgtgcacatccgggccgccggggactggacagctgccctgctggaggcctttggagctgagggccaggccctgcaggagccctggagcctgccccggctggccgtggatggcccctttggaacagccctgacagatgtgttccactaccctgtgtgtgtgtgtgtggccgccggcattggagtgaccccatttgctgccctgctgaagagcatctggtacaagtgcagcgaggcccagacccccctgaagctgagcaaggtgtacttctactggatctgcagagatgcccgggcctttgagtggtttgctgacctgctgctgagcctggagaccaggatgtctgagcagggcaagacccacttcctgagctaccacatcttcctgaccggctgggatgagaaccaggccctgcacatcgccctgcactgggatgaaaatacagatgtgatcaccggcctgaagcagaagaccttctacggccggcccaactggaacaatgagttcaagcagatcgcctacaaccaccccagcagcagcattggagtcttcttctgtggccccaaggccctgagcaggaccctgcagaagatgtgccacctgtacagcagcgctgacccccggggcgtgcacttctactacaacaaggagagcttctag

SEQ ID NO: 161202 - DNA, 1737 bp, Artificial Sequence
  Description of Artificial Sequence: Synthetic coding sequence
atggctgtgtcctggaggtcctggctggccaatgaaggagtgaagcacctgtgcctcttcatctggctgtccatgaatgtgctgctcttctggaagaccttcctgctgtacaaccagggccctgagtaccactacctgcaccagatgctgggcctgggcctgtgcctgagccgggccagcgcctctgtgctgaacctgaactgcagcctcatcctgctgcccatgtgcaggaccctgctggcctacctgcggggcagccagaaggtgcccagcaggaggacccggcggctgctggacaagagcaggaccttccacatcacctgtggggtgaccatctgcatcttcagcggcgtgcacgtggccgcccacctggtgaatgccctgaacttctctgtgaactacagcgaggactttgtggagctgaatgctgcccgctacagagatgaggaccccaggaagctgctcttcaccaccgtgcccggcctgactggagtgtgcatggtggtggtgctcttcctgatgatcacagccagcacctacgccatccgggtgagcaactatgacatcttctggtacacccacaacctcttctttgtgttctacatgctgctgaccctgcacgtgtctgggggcctgctgaagtaccagaccaacctggacacccaccccccaggctgcatcagcctgaacagaaccagcagccagaacatcagcctgcctgagtacttcagcgagcacttccacgagcccttccctgagggcttcagcaagccagctgagttcacccagcacaagtttgtgaagatctgcatggaggagccccgcttccaggccaacttcccccagacctggctgtggatcagcggccccctgtgcctgtactgtgccgagcggctgtaccgctacatccgcagcaacaagcctgtgaccatcatctctgtgatgagccaccccagtgatgtgatggagatccgcatggtgaaggagaacttcaaggcccggcccggccagtacatcaccctgcactgccccagcgtgtctgccctggagaaccaccccttcaccctgaccatgtgccccacagagaccaaggccacctttggagtgcacctgaagatcgtgggggactggacagagcgcttccgggacctgctgctgccccccagcagccaggacagcgagatcctgcccttcatccagagcaggaactaccccaagctgtacattgatggccccttcggcagcccctttgaggagagcctgaactatgaggtgtccctgtgtgtggccggcggcattggagtgaccccatttgccagcatcctgaacaccctgctggatgactggaagccctacaagctgcggcggctgtacttcatctgggtgtgccgggacatccagagcttccgctggtttgctgacctgctgtgcatgctgcacaacaagttctggcaggagaacagaccagactatgtgaacatccagctgtacctgagccagacagatggcatccagaagatcatcggggagaagtaccacgccctgaacagccgcctcttcatcggccggccccgctggaagctgctgtttgatgaaattgccaagtacaacagaggcaagacagtgggcgtcttctgctgcggccccaacagcctgagcaagaccctgcacaagctgagcaaccagaacaacagctatggcaccaggtttgagtacaacaaggagagcttctcctag

SEQ ID NO: 161203 - DNA, 1665 bp, Artificial Sequence
  Description of Artificial Sequence: Synthetic coding sequence
atgaatgtgctgctcttctggaagaccttcctgctgtacaaccagggccctgagtaccactacctgcaccagatgctgggcctgggcctgtgcctgagccgggccagcgcctctgtgctgaacctgaactgcagcctcatcctgctgcccatgtgcaggaccctgctggcctacctgcggggcagccagaaggtgcccagcaggaggacccggcggctgctggacaagagcaggaccttccacatcacctgtggggtgaccatctgcatcttcagcggcgtgcacgtggccgcccacctggtgaatgccctgaacttctctgtgaactacagcgaggactttgtggagctgaatgctgcccgctacagagatgaggaccccaggaagctgctcttcaccaccgtgcccggcctgactggagtgtgcatggtggtggtgctcttcctgatgatcacagccagcacctacgccatccgggtgagcaactatgacatcttctggtacacccacaacctcttctttgtgttctacatgctgctgaccctgcacgtgtctgggggcctgctgaagtaccagaccaacctggacacccaccccccaggctgcatcagcctgaacagaaccagcagccagaacatcagcctgcctgagtacttcagcgagcacttccacgagcccttccctgagggcttcagcaagccagctgagttcacccagcacaagtttgtgaagatctgcatggaggagccccgcttccaggccaacttcccccagacctggctgtggatcagcggccccctgtgcctgtactgtgccgagcggctgtaccgctacatccgcagcaacaagcctgtgaccatcatctctgtgatgagccaccccagtgatgtgatggagatccgcatggtgaaggagaacttcaaggcccggcccggccagtacatcaccctgcactgccccagcgtgtctgccctggagaaccaccccttcaccctgaccatgtgccccacagagaccaaggccacctttggagtgcacctgaagatcgtgggggactggacagagcgcttccgggacctgctgctgccccccagcagccaggacagcgagatcctgcccttcatccagagcaggaactaccccaagctgtacattgatggccccttcggcagcccctttgaggagagcctgaactatgaggtgtccctgtgtgtggccggcggcattggagtgaccccatttgccagcatcctgaacaccctgctggatgactggaagccctacaagctgcggcggctgtacttcatctgggtgtgccgggacatccagagcttccgctggtttgctgacctgctgtgcatgctgcacaacaagttctggcaggagaacagaccagactatgtgaacatccagctgtacctgagccagacagatggcatccagaagatcatcggggagaagtaccacgccctgaacagccgcctcttcatcggccggccccgctggaagctgctgtttgatgaaattgccaagtacaacagaggcaagacagtgggcgtcttctgctgcggccccaacagcctgagcaagaccctgcacaagctgagcaaccagaacaacagctatggcaccaggtttgagtacaacaaggagagcttctcctag

SEQ ID NO: 161204 - DNA, 816 bp, Artificial Sequence
  Description of Artificial Sequence: Synthetic coding sequence
atggctgtgtcctggaggtcctggctggccaatgaaggagtgaagcacctgtgcctcttcatctggctgtccatgaatgtgctgctcttctggaagaccttcctgctgtacaaccagggccctgagtaccactacctgcaccagatgctgggctgccccacagagaccaaggccaccttcggcgtgcacctgaagatcgtgggggactggacagagcgcttccgggacctgctgctgccccccagcagccaggacagcgagatcctgcccttcatccagagcaggaactaccccaagctgtacattgatggccccttcggcagcccctttgaggagagcctgaactatgaggtgtccctgtgtgtggccggcggcatcggcgtgaccccatttgccagcatcctgaacaccctgctggatgactggaagccctacaagctgcggcggctgtacttcatctgggtgtgccgggacatccagagcttccgctggtttgctgacctgctgtgcatgctgcacaacaagttctggcaggagaacagaccagactatgtgaacatccagctgtacctgagccagacagatggcatccagaagatcattggagagaagtaccacgccctgaacagccgcctcttcatcggccggccccgctggaagctgctgtttgatgagatcgccaagtacaacagaggcaagacagtgggcgtcttctgctgcggccccaacagcctgagcaagaccctgcacaagctgagcaaccagaacaacagctatggcaccaggtttgagtacaacaaggagagcttctcctag

SEQ ID NO: 161205 - DNA, 165 bp, Artificial Sequence
  Description of Artificial Sequence: Synthetic coding sequence
atggctgtgtcctggaggtcctggctggccaatgaaggagtgaagcacctgtgcctcttcatctggctgtccatgaatgtgctgctcttctggaagaccttcctgctgtacaaccagggccctgagtaccactacctgcaccagatgctgggggagctgtcctag

SEQ ID NO: 161206 - DNA, 1800 bp, Artificial Sequence
  Description of Artificial Sequence: Synthetic coding sequence
atgggagagatgtggaggaagcgggaggaggtgatcttccgggagtacagcttctccttctaccccctgaacatctttgccccctttgtgctcttcccagactacttctgcctgctgggcttcatctggctgtccatgaatgtgctgctcttctggaagaccttcctgctgtacaaccagggccctgagtaccactacctgcaccagatgctgggcctgggcctgtgcctgagccgggccagcgcctctgtgctgaacctgaactgcagcctcatcctgctgcccatgtgcaggaccctgctggcctacctgcggggcagccagaaggtgcccagcaggaggacccggcggctgctggacaagagcaggaccttccacatcacctgtggggtgaccatctgcatcttctctggagtgcacgtggccgcccacctggtgaatgccctgaacttctctgtgaactacagtgaagattttgtggagctgaatgctgcccgctacagagatgaggaccccaggaagctgctcttcaccaccgtgcccggcctgactggagtgtgcatggtggtggtgctcttcctgatgatcacagccagcacctacgccatccgggtgagcaactatgacatcttctggtacacccacaacctcttctttgtgttctacatgctgctgaccctgcacgtgtctgggggcctgctgaagtaccagaccaacctggacacccaccccccaggctgcatcagcctgaacagaaccagcagccagaacatcagcctgcctgagtacttcagcgagcacttccacgagcccttccctgagggcttcagcaagccagctgagttcacccagcacaagtttgtgaagatctgcatggaggagccccgcttccaggccaacttcccccagacctggctgtggatcagcggccccctgtgcctgtactgtgccgagcggctgtaccgctacatccgcagcaacaagcctgtgaccatcatctctgtgatgagccaccccagtgatgtgatggagatccgcatggtgaaggagaacttcaaggcccggcccggccagtacatcaccctgcactgccccagcgtgtctgccctggagaaccaccccttcaccctgaccatgtgccccacagagaccaaggccaccttcggcgtgcacctgaagatcgtgggggactggacagagcgcttccgggacctgctgctgccccccagcagccaggacagcgagatcctgcccttcatccagagcaggaactaccccaagctgtacattgatggccccttcggcagcccctttgaggagagcctgaactatgaggtgtccctgtgtgtggccggcggcatcggcgtgaccccatttgccagcatcctgaacaccctgctggatgactggaagccctacaagctgcggcggctgtacttcatctgggtgtgccgggacatccagagcttccgctggtttgctgacctgctgtgcatgctgcacaacaagttctggcaggagaacagaccagactatgtgaacatccagctgtacctgagccagacagatggcatccagaagatcattggagagaagtaccacgccctgaacagccgcctcttcatcggccggccccgctggaagctgctgtttgatgagatcgccaagtacaacagaggcaagacagtgggcgtcttctgctgcggccccaacagcctgagcaagaccctgcacaagctgagcaaccagaacaacagctatggcaccaggtttgagtacaacaaggagagcttctcctag

SEQ ID NO: 161207 - DNA, 1665 bp, Artificial Sequence; identical to SEQ ID NO: 161203
  Description of Artificial Sequence: Synthetic coding sequence

SEQ ID NO: 161208 - DNA, 1665 bp, Artificial Sequence; identical to SEQ ID NO: 161203
  Description of Artificial Sequence: Synthetic coding sequence

SEQ ID NO: 161209 - DNA, 696 bp, Artificial Sequence
  Description of Artificial Sequence: Synthetic coding sequence
atggctgtgtcctggaggtcctggctggccaatgaaggagtgaagcacctgtgcctcttcatctggctgtccatgaatgtgctgctcttctggaagaccttcctgctgtacaaccagggccctgagtaccactacctgcaccagatgctgggctgccccacagagaccaaggccaccttcggcgtgcacctgaagatcgtgggggactggacagagcgcttccgggacctgctgctgccccccagcagccaggacagcgagatcctgcccttcatccagagcaggaactaccccaaggatgactggaagccctacaagctgcggcggctgtacttcatctgggtgtgccgggacatccagagcttccgctggtttgctgacctgctgtgcatgctgcacaacaagttctggcaggagaacagaccagactatgtgaacatccagctgtacctgagccagacagatggcatccagaagatcattggagagaagtaccacgccctgaacagccgcctcttcatcggccggccccgctggaagctgctgtttgatgagatcgccaagtacaacagaggcaagacagtgggcgtcttctgctgcggccccaacagcctgagcaagaccctgcacaagctgagcaaccagaacaacagctatggcaccaggtttgagtacaacaaggagagcttctcctag

SEQ ID NO: 161210 - DNA, 1617 bp, Artificial Sequence
  Description of Artificial Sequence: Synthetic coding sequence
atggctgtgtcctggaggtcctggctggccaatgaaggagtgaagcacctgtgcctcttcatctggctgtccatgaatgtgctgctcttctggaagaccttcctgctgtacaaccagggccctgagtaccactacctgcaccagatgctgggcctgggcctgtgcctgagccgggccagcgcctctgtgctgaacctgaactgcagcctcatcctgctgcccatgtgcaggaccctgctggcctacctgcggggcagccagaaggtgcccagcaggaggacccggcggctgctggacaagagcaggaccttccacatcacctgtggggtgaccatctgcatcttcagcggcgtgcacgtggccgcccacctggtgaatgccctgaacttctctgtgaactacagcgaggactttgtggagctgaatgctgcccgctacagagatgaggaccccaggaagctgctcttcaccaccgtgcccggcctgactggagtgtgcatggtggtggtgctcttcctgatgatcacagccagcacctacgccatccgggtgagcaactatgacatcttctggtacacccacaacctcttctttgtgttctacatgctgctgaccctgcacgtgtctgggggcctgctgaagtaccagaccaacctggacacccaccccccaggctgcatcagcctgaacagaaccagcagccagaacatcagcctgcctgagtacttcagcgagcacttccacgagcccttccctgagggcttcagcaagccagctgagttcacccagcacaagtttgtgaagatctgcatggaggagccccgcttccaggccaacttcccccagacctggctgtggatcagcggccccctgtgcctgtactgtgccgagcggctgtaccgctacatccgcagcaacaagcctgtgaccatcatctctgtgatgagccaccccagtgatgtgatggagatccgcatggtgaaggagaacttcaaggcccggcccggccagtacatcaccctgcactgccccagcgtgtctgccctggagaaccaccccttcaccctgaccatgtgccccacagagaccaaggccacctttggagtgcacctgaagatcgtgggggactggacagagcgcttccgggacctgctgctgccccccagcagccaggacagcgagatcctgcccttcatccagagcaggaactaccccaaggatgactggaagccctacaagctgcggcggctgtacttcatctgggtgtgccgggacatccagagcttccgctggtttgctgacctgctgtgcatgctgcacaacaagttctggcaggagaacagaccagactatgtgaacatccagctgtacctgagccagacagatggcatccagaagatcatcggggagaagtaccacgccctgaacagccgcctcttcatcggccggccccgctggaagctgctgtttgatgaaattgccaagtacaacagaggcaagacagtgggcgtcttctgctgcggccccaacagcctgagcaagaccctgcacaagctgagcaaccagaacaacagctatggcaccaggtttgagtacaacaaggagagcttctcctag

SEQ ID NO: 161211 - DNA, 1665 bp, Artificial Sequence; identical to SEQ ID NO: 161203
  Description of Artificial Sequence: Synthetic coding sequence

SEQ ID NO: 161212 - DNA, 1665 bp, Artificial Sequence; identical to SEQ ID NO: 161203
  Description of Artificial Sequence: Synthetic coding sequence

SEQ ID NO: 161213 - DNA, 2193 bp, Artificial Sequence
  Description of Artificial Sequence: Synthetic coding sequence
atggcctttgtgtgtgccggcctgagtgacaccatgtctgctgaggaggatgcccgctggctgcgctgggtgacccagcagttcaagaccatcgccggggaggatggagagatcagcctgcaggagttcaaggccgccctgcacgtgaaggagagcttctttgctgagcgcttctttgccctgtttgacagcgacagaagtggcaccatcaccctgcaggagctgcaggaggccctgaccctgctgatccacggcagccccatggacaagctgaagttcctgttccaggtgtatgacattgatggcagcggcagcattgatcctgatgagctgaggacagtgctgcagagctgcctgcgggagagcgccatcagcctgcctgatgagaagctggaccagctgaccctggccctgtttgaatctgcagatgctgatggaaatggagccatcacctttgaggagctgagagatgagctgcagcgcttccctggggtgatggagaacctgaccatctctgctgcccactggctgacagccccagccccccggccccggccccggcggccccggcagctgacccgggcctactggcacaaccacaggagccagctgttctgcctggccacctacgccggcctgcacgtgctgctgtttggcctggccgccagcgcccaccgggacctgggcgcctctgtgatggtggccaagggctgcggccagtgcctgaactttgactgcagcttcatcgctgtgctgatgctgcggcgctgcctgacctggctgcgggccacctggctggcccaggtgctgcccctggaccagaacatccagttccaccagctgatgggctacgtggtggtgggcctgagcctggtgcacacagtggcccacacagtgaactttgtgctgcaggcccaggccgaggccagccccttccagttctgggagctgctgctgaccaccaggcctggcatcggctgggtgcacggcagcgccagccccactggagtggccctgctgctgctgctgctgctgatgttcatctgcagcagcagctgcatcagaagaagtggccactttgaggtgttctactggacccacctgagctacctgctggtgtggctgctgctgatcttccacggccccaacttctggaagtggctgctggtgcccggcatcctcttcttcctggagaaggccatcggcctggccgtgtccaggatggctgctgtgtgcatcatggaggtgaacctgctgcccagcaaggtgacccacctgctgatcaagaggcctcccttcttccactacagacctggggactacctgtacctgaacatccccaccatcgcccgctatgagtggcaccccttcaccatcagcagcgcccctgagcagaaggacaccatctggctgcacatccgcagccagggccagtggaccaaccggctgtatgagagcttcaaggccagtgaccccctgggccggggcagcaagaggctgagccgctctgtgaccatgaggaagagccagaggagcagcaagggcagcgagatcctgctggagaagcacaagttctgcaacatcaagtgctacattgatggcccctacggcacccccacccggcgcatctttgccagcgagcacgctgtgctgattggagctggcatcggcatcaccccatttgccagcatcctgcagagcatcatgtaccgccaccagaagaggaagcacacctgccccagctgccagcacagctggattgaaggagtgcaggacaacatgaagctgcacaaggtggacttcatctggatcaacagagaccagaggagctttgagtggtttgtgtccctgctgaccaagctggagatggaccaggccgaggaggcccagtatggccgcttcctggagctgcacatgtacatgaccagcgccctgggcaagaatgacatgaaggccatcggcctgcagatggccctggacctgctggccaacaaggagaagaaggacagcatcaccggcctgcagaccaggacccagcccggccgcccagactggagcaaggtgttccagaaggtggccgctgagaagaagggcaaggtgcaggtgttcttctgtggcagccctgccctggccaaggtgctgaagggccactgtgagaagtttggcttccgcttcttccaggagaacttctag

SEQ ID NO: 161214 - DNA, 2298 bp, Artificial Sequence
  Description of Artificial Sequence: Synthetic coding sequence
atgaacaccagcggggaccctgcccagacaggccctgagggctgccggggcaccatgtctgcagaagaagatgcccgctggctgcgctgggtgacccagcagttcaagaccatcgctggagaagatggagagatcagcctgcaggagttcaaggccgccctgcacgtgaaggagagcttctttgctgagcgcttctttgccctgtttgacagcgacaggagcggcaccatcaccctgcaggagctgcaggaggccctgaccctgctgattcatggcagccccatggacaagctgaagttcctgttccaggtgtatgacattgatgtgtgtgcccggcagggcgccagcgctggaacagagtggggcgctggggccggcccccactgggccagcagccccctgggcaccggcagcggcagcattgatcctgatgagctgaggacagtgctgcagagctgcctgcgggagagcgccatcagcctgcctgatgagaagctggaccagctgaccctggccctgtttgagagcgcagatgctgatggaaatggagccatcacctttgaggagctgagagatgagctgcagcgcttccctggggtgatggagaacctgaccatctctgctgcccactggctgacagccccagccccccggccccggccccggcggccccggcagctgacccgggcctactggcacaaccacaggagccagctgttctgcctggccacctacgccggcctgcacgtgctgctgtttggcctggccgccagcgcccaccgggacctgggcgcctctgtgatggtggccaagggctgcggccagtgcctgaactttgactgcagcttcatcgctgtgctgatgctgcggcgctgcctgacctggctgcgggccacctggctggcccaggtgctgcccctggaccagaacatccagttccaccagctgatgggctacgtggtggtgggcctgagcctggtgcacacagtggcccacacagtgaactttgtgctgcaggcccaggccgaggccagccccttccagttctgggagctgctgctgaccacccggcccggcatcggctgggtgcacggcagcgccagccccaccggggtggccctgctgctgctgctgctgctgatgttcatctgcagcagcagctgcatccgccgcagcggccactttgaggtgttctactggacccacctgagctacctgctggtgtggctgctgctgatcttccacggccccaacttctggaagtggctgctggtgcccggcatcctcttcttcctggagaaggccatcggcctggccgtgtccaggatggctgctgtgtgcatcatggaggtgaacctgctgcccagcaaggtgacccacctgctgatcaagaggcctcccttcttccactacagacctggggactacctgtacctgaacatccccaccatcgcccgctatgagtggcaccccttcaccatcagcagcgcccctgagcagaaggacaccatctggctgcacatccgcagccagggccagtggaccaaccggctgtatgagagcttcaaggccagtgaccccctgggccggggcagcaagaggctgagccgctctgtgaccatgaggaagagccagaggagcagcaaaggaagtgagatcctgctggagaagcacaagttctgcaacatcaagtgctacattgatggcccctacggcacccccacccggcgcatctttgccagcgagcacgctgtgctgattggagctggcatcggcatcaccccatttgccagcatcctgcagagcatcatgtaccgccaccagaagaggaagcacacctgccccagctgccagcacagctggattgagggcgtgcaggacaacatgaagctgcacaaggtggacttcatctggatcaacagagaccagaggagctttgagtggtttgtgtccctgctgaccaagctggagatggaccaggccgaggaggcccagtatggccgcttcctggagctgcacatgtacatgaccagcgccctgggcaagaatgacatgaaggccatcggcctgcagatggccctggacctgctggccaacaaggagaagaaggacagcatcaccggcctgcagaccaggacccagcccggccgcccagactggagcaaggtgttccagaaggtggccgctgagaagaagggcaaggtgcaggtgttcttctgtggcagccctgccctggccaaggtgctgaagggccactgtgagaagtttggcttccgcttcttccaggagaacttctag

SEQ ID NO: 161215 - DNA, 2214 bp, Artificial Sequence
  Description of Artificial Sequence: Synthetic coding sequence
atgaacaccagcggggaccctgcccagacaggccctgagggctgccggggcaccatgtctgcagaagaagatgcccgctggctgcgctgggtgacccagcagttcaagaccatcgctggagaagatggagagatcagcctgcaggagttcaaggccgccctgcacgtgaaggagagcttctttgctgagcgcttctttgccctgtttgacagcgacaggagcggcaccatcaccctgcaggagctgcaggaggccctgaccctgctgattcatggcagccccatggacaagctgaagttcctgttccaggtgtatgacattgatggcagcggcagcattgatcctgatgagctgaggacagtgctgcagagctgcctgcgggagagcgccatcagcctgcctgatgagaagctggaccagctgaccctggccctgtttgagagcgcagatgctgatggaaatggagccatcacctttgaggagctgagagatgagctgcagcgcttccctggggtgatggagaacctgaccatctctgctgcccactggctgacagccccagccccccggccccggccccggcggccccggcagctgacccgggcctactggcacaaccacaggagccagctgttctgcctggccacctacgccggcctgcacgtgctgctgtttggcctggccgccagcgcccaccgggacctgggcgcctctgtgatggtggccaagggctgcggccagtgcctgaactttgactgcagcttcatcgctgtgctgatgctgcggcgctgcctgacctggctgcgggccacctggctggcccaggtgctgcccctggaccagaacatccagttccaccagctgatgggctacgtggtggtgggcctgagcctggtgcacacagtggcccacacagtgaactttgtgctgcaggcccaggccgaggccagccccttccagttctgggagctgctgctgaccacccggcccggcatcggctgggtgcacggcagcgccagccccaccggggtggccctgctgctgctgctgctgctgatgttcatctgcagcagcagctgcatccgccgcagcggccactttgaggtgttctactggacccacctgagctacctgctggtgtggctgctgctgatcttccacggccccaacttctggaagtggctgctggtgcccggcatcctcttcttcctggagaaggccatcggcctggccgtgtccaggatggctgctgtgtgcatcatggaggtgaacctgctgcccagcaaggtgacccacctgctgatcaagaggcctcccttcttccactacagacctggggactacctgtacctgaacatccccaccatcgcccgctatgagtggcaccccttcaccatcagcagcgcccctgagcagaaggacaccatctggctgcacatccgcagccagggccagtggaccaaccggctgtatgagagcttcaaggccagtgaccccctgggccggggcagcaagaggctgagccgctctgtgaccatgaggaagagccagaggagcagcaaaggaagtgagatcctgctggagaagcacaagttctgcaacatcaagtgctacattgatggcccctacggcacccccacccggcgcatctttgccagcgagcacgctgtgctgattggagctggcatcggcatcaccccatttgccagcatcctgcagagcatcatgtaccgccaccagaagaggaagcacacctgccccagctgccagcacagctggattgagggcgtgcaggacaacatgaagctgcacaaggtggacttcatctggatcaacagagaccagaggagctttgagtggtttgtgtccctgctgaccaagctggagatggaccaggccgaggaggcccagtatggccgcttcctggagctgcacatgtacatgaccagcgccctgggcaagaatgacatgaaggccatcggcctgcagatggccctggacctgctggccaacaaggagaagaaggacagcatcaccggcctgcagaccaggacccagcccggccgcccagactggagcaaggtgttccagaaggtggccgctgagaagaagggcaaggtgcaggtgttcttctgtggcagccctgccctggccaaggtgctgaagggccactgtgagaagtttggcttccgcttcttccaggagaacttctag

SEQ ID NO: 161216 - DNA, 4419 bp, Artificial Sequence
  Description of Artificial Sequence: Synthetic coding sequence
atggacaatgccctcttctgcctggccgctgtgagcaacctggacatcgagagcaagctgtctgtgtactaccgggccccctggcaccagcagaggaacatcttcctgcctgccaccaggcctccctgtgtggaggagctgcacagacatgcccggcagagcctgcaggccctgcggcgggagcacaggagcagaagtgaccggcgggagcagagagctgctgcccccctgagcattgctgccccacccctgcctgcctaccccccagcccacagccagaggagaagagagttcaaggacagacacttcctgaccttcaacagcaccaggagccccagccccacagagtgctgccacatgaccccctggagcaggaagagccaccccccagaagatgaggacacagatgtgatgctgggccagaggcccaagaaccccatccacaacatccccagcaccctggacaagcagaccaactggagcaaggccctgcccctgcccaccccagaggagaagatgaagcaggatgcccaggtgatcagcagctgcatcatccccatcaacgtgactggagtgggctttgaccgggaggccagcatccgctgcagcctggtgcacagccagagcgtgctgcagaggaggaggaagctgcggcggaggaagaccatcagcggcatcccccggcgggtgcagcaggagattgacagtgatgagagccctgtggcccgggagagaaatgtcatcgtgcacaccaacccagaccccagcaacacagtgaaccgcatcagcggcacccgggacagcgagtgccagacagaggacatcctgattgctgcccccagcagaagacgcatccgggcccagaggggccagagcattgctgccagcctgagccacagcgctggcaacatcagcgccctggccgacaagggggacaccatgttcaccccagctgtgagcagcaggaccaggagccgcagcctgccccgggagggcaacagaggaggagatgctgagcccaaggtgggcgccaagcccagcgcctatgaggagggggagagctttgtgggggaccacgagaggaccccaaatgacttcagcgaggcccccagcagccccagcgcccaggaccaccagcccaccctgggcctggcctgcagccagcacctgcacagcccccagcacaagctgtctgagcggggccgcagccggctgagcaggatggctgctgacagcggcagctgtgacatcagcagcaacagcgacaccttcggcagccccatccactgcatcagcacagctggggtgctgctgagcagccacatggaccagaaggatgaccaccagagcagcagcggcaactggagcggcagcagcagcacctgccccagccagaccagcgagaccatccccccagctgccagcccccccctgaccggcagcagccactgtgacagcgagctgagcctgaacacagcccctcatgccaatgaagatgcctctgtgtttgtgacagagcagtacaatgaccacctggacaaggtgcggggccaccgggccaacagcttcaccagcacagtggccgacctgctggatgaccccaacaacagcaacaccagtgacagcgagtggaactacctgcaccaccaccatgatgccagctgccggcaggacttcagccctgagcggcccaaggctgacagcctgggctgccccagcttcacctccatggccacctatgacagcttcctggagaagagccccagcgacaaggctgacaccagcagccacttctctgtggacacagagggctactacacctccatgcactttgactgtggcctgaagggcaacaagagctatgtgtgccactacgccgccctgggcccagaaaatggccagggcgtgggcgccagccctggcctgcctgactgtgcctggcaggactacctggaccacaagaggcagggccggcccagcatctccttcaggaagcccaaggccaagcccaccccacccaagaggagcagcagcctgaggaagagtgatggaaatgctgacatcagcgagaagaaggagcccaagatcagcagcggccagcacctgccccacagcagccgggagatgaagctgcccctggactttgccaacacccccagcaggatggagaatgccaacctgcccaccaagcaggagcccagctggatcaaccagagcgagcagggcatcaaggagccccagctggatgccagtgacatcccccccttcaaggatgaggtggccgagagcacccactatgctgacctgtggctgctgaatgacctgaagaccaatgacccctaccgcagcctgagcaacagcagcacagccaccggcaccaccgtgattgagtgcatcaagagccctgagagcagcgagagccagaccagccagagcgagagccgggccaccacccccagcctgcccagcgtggacaatgagttcaagctggccagccctgagaagctggccggcctggccagccccagcagcggctacagcagccagagcgagacccccaccagcagcttccccacagccttcttcagcggccccctgagccctgggggcagcaagaggaagcccaaggtgcctgagaggaagagcagcctgcagcagcccagcctgaaggatggcaccatcagcctgagcaaggacctggagctgcccatcatcccccccacccacctggacctgagcgccctgcacaacgtgctgaacaagcccttccaccaccgccaccccctgcacgtgttcacccacaacaagcagaacacagtgggggagaccctgcggagcaaccccccacccagcctggccatcacccccaccatcctgaagtctgtgaacctgcggagcatcaacaagtctgaggaggtgaagcagaaggaggagaacaacacagacctgccctacctggaggagagcaccctgaccacagctgccctgagccccagcaagatccggccccacacagccaacaagtctgtgtcccggcagtacagcacagaggacaccatcctgtccttcctggacagcagcgctgtggagatgggccctgacaagctgcacctggagaagaacagcacctttgatgtgaagaacagatgtgaccctgagaccatcaccagcgctggcagcagcctgctggacagcaatgtgaccaaggaccaggtgaggacagaaacagagcccatccctgagaacacccccaccaagaactgtgccttccccacagagggcttccagagggtgtctgctgcccggcccaatgacctggatggcaagatcatccagtatggccctggcccagatgagaccctggagcaggtgcagaaggcccccagcgctggcctggaggaggtggcccagcctgagagcgtggatgtgatcaccagccagagcgacagccccacccgggccacagatgtgagcaaccagttcaagcaccagtttgtgatgagccgccaccacgacaaggtgcccggcaccatctcctatgagagcgagatcacctctgtgaacagcttccctgagaagtgcagcaagcaggagaacatcgccagcggcatcagcgccaagagcgccagtgacaacagcaaggccgaggagacccagggcaatgtggatgaggccagcctgaaggagagcagccccagtgatgacagcatcatcagccccctgtctgaggacagccaggccgaggccgagggcgtgtttgtgagccccaacaagcccaggaccacagaggacctgtttgctgtgatccacaggagcaagaggaaggtgctgggcaggaaggacagcggggacatgtctgtgcgcagcaagagccgggcccccctgagcagcagcagcagcagcgccagcagcatcaccagccccagcagcaatgtgaccacccccaacagccagaggagccctggcctcatctacagaaatgccaagaagagcaacaccagcaatgaggagttcaagctgctgctgctgaagaagggcagcagaagtgacagcagctacaggatgtctgccacagagatcctgaagagccccatcctgcccaagcccccaggagagctgacagctgagagcccccagagcacagatgatgcccaccagggcagccagggcgctgaggccctgagccccctgagcccctgcagcccccgggtgaatgctgagggcttcagcagcaagagctttgccaccagcgccagcgcccgggtgggccgcagccgggcccccccagctgccagcagcagccgctacagcgtgcgctgccgcctgtacaacacccccatgcaggccatcagcgagggggagacagagaacagtgatggcagcccccatgatgacaggagcagccagagcagcacctag

SEQ ID NO: 161217 - DNA, 4893 bp, Artificial Sequence
  Description of Artificial Sequence: Synthetic coding sequence
atgccctttgccaagagaattgtggagccccagtggctgtgccggcagaggaggcctgcccctggccctgctgtggatgccagcggcggcagcgctgagcccccaccacccctgcagcccccaggaagaagagacctggatgaggtggaggcccctggccctgaggagcccgcccgggctgtgcctgcccccagcggcctgcccccacctcctccacccctgcctgccccagctgaccagacccagccccctcatggagaggcctctgtggccggggaggagagcacagctggcatccctgaggccgccccagctgctggggaggccagcagcgctgctgctgctgctgctgtgctgctgatgctggacctgtgtgctgtgtccaatgctgccctggcccgggtgctgcggcagctgagtgatgtggcccggcatgcctgcagcctcttccaggagctggagagtgacatccagctgacccaccggcgggtgtgggccctgcagggcaagctgggcggcgtgcagagggtgctgagcaccctggaccccaagcaggaggccgtgcctgtgagcaacctggacatcgagagcaagctgtctgtgtactaccgggccccctggcaccagcagaggaacatcttcctgcctgccacccggcccccctgtgtggaggagctgcacagacatgcccggcagagcctgcaggccctgcggcgggagcacaggagcagaagtgacagaagagagcagagagctgctgcccccctgagcattgctgccccacccctgcctgcctaccccccagcccacagccagaggcggcgggagttcaaggacagacacttcctgaccagccaccccccagaagatgaggacacagatgtgatgctgggccagaggcccaagaaccccatccacaacatccccagcaccctggacaagcagaccaactggagcaaggccctgcccctgcccaccccagaggagaagatgaagcaggatgcccaggtgatcagcagctgcatcatccccatcaacgtgactggagtgggctttgaccgggaggccagcatccgctgcagcctggtgcacagccagagcgtgctgcagaggaggaggaagctgcggcggaggaagaccatcagcggcatcccccggcgggtgcagcaggagattgacagtgatgagagccctgtggcccgggagagaaatgtcatcgtgcacaccaacccagaccccagcaacacagtgaaccgcatcagcggcacccgggacagcgagtgccagacagaggacatcctgattgctgcccccagcagaagacgcatccgggcccagaggggccagagcattgctgccagcctgagccacagcgctggcaacatcagcgccctggccgacaagggggacaccatgttcaccccagctgtgagcagcaggaccaggagccgcagcctgccccgggagggcaacagaggaggagatgctgagcccaaggtgggcgccaagcccagcgcctatgaggagggggagagctttgtgggggaccacgagaggaccccaaatgacttcagcgaggcccccagcagccccagcgcccaggaccaccagcccaccctgggcctggcctgcagccagcacctgcacagcccccagcacaagctgtctgagcggggccgcagccggctgagcaggatggctgctgacagcggcagctgtgacatcagcagcaacagcgacaccttcggcagccccatccactgcatcagcacagctggggtgctgctgagcagccacatggaccagaaggatgaccaccagagcagcagcggcaactggagcggcagcagcagcacctgccccagccagaccagcgagaccatccccccagctgccagcccccccctgaccggcagcagccactgtgacagcgagctgagcctgaacacagcccctcatgccaatgaagatgcctctgtgtttgtgacagagcagtacaatgaccacctggacaaggtgcggggccaccgggccaacagcttcaccagcacagtggccgacctgctggatgaccccaacaacagcaacaccagtgacagcgagtggaactacctgcaccaccaccatgatgccagctgccggcaggacttcagccctgagcggcccaaggctgacagcctgggctgccccagcttcacctccatggccacctatgacagcttcctggagaagagccccagcgacaaggctgacaccagcagccacttctctgtggacacagagggctactacacctccatgcactttgactgtggcctgaagggcaacaagagctatgtgtgccactacgccgccctgggcccagaaaatggccagggcgtgggcgccagccctggcctgcctgactgtgcctggcaggactacctggaccacaagaggcagggccggcccagcatctccttcaggaagcccaaggccaagcccaccccacccaagaggagcagcagcctgaggaagagtgatggaaatgctgacatcagcgagaagaaggagcccaagatcagcagcggccagcacctgccccacagcagccgggagatgaagctgcccctggactttgccaacacccccagcaggatggagaatgccaacctgcccaccaagcaggagcccagctggatcaaccagagcgagcagggcatcaaggagccccagctggatgccagtgacatcccccccttcaaggatgaggtggccgagagcacccactatgctgacctgtggctgctgaatgacctgaagaccaatgacccctaccgcagcctgagcaacagcagcacagccaccggcaccaccgtgattgagtgcatcaagagccctgagagcagcgagagccagaccagccagagcgagagccgggccaccacccccagcctgcccagcgtggacaatgagttcaagctggccagccctgagaagctggccggcctggccagccccagcagcggctacagcagccagagcgagacccccaccagcagcttccccacagccttcttcagcggccccctgagccctgggggcagcaagaggaagcccaaggtgcctgagaggaagagcagcctgcagcagcccagcctgaaggatggcaccatcagcctgagcaaggacctggagctgcccatcatcccccccacccacctggacctgagcgccctgcacaacgtgctgaacaagcccttccaccaccgccaccccctgcacgtgttcacccacaacaagcagaacacagtgggggagaccctgcggagcaaccccccacccagcctggccatcacccccaccatcctgaagtctgtgaacctgcggagcatcaacaagtctgaggaggtgaagcagaaggaggagaacaacacagacctgccctacctggaggagagcaccctgaccacagctgccctgagccccagcaagatccggccccacacagccaacaagtctgtgtcccggcagtacagcacagaggacaccatcctgtccttcctggacagcagcgctgtggagatgggccctgacaagctgcacctggagaagaacagcacctttgatgtgaagaacagatgtgaccctgagaccatcaccagcgctggcagcagcctgctggacagcaatgtgaccaaggaccaggtgaggacagaaacagagcccatccctgagaacacccccaccaagaactgtgccttccccacagagggcttccagagggtgtctgctgcccggcccaatgacctggatggcaagatcatccagtatggccctggcccagatgagaccctggagcaggtgcagaaggcccccagcgctggcctggaggaggtggcccagcctgagagcgtggatgtgatcaccagccagagcgacagccccacccgggccacagatgtgagcaaccagttcaagcaccagtttgtgatgagccgccaccacgacaaggtgcccggcaccatctcctatgagagcgagatcacctctgtgaacagcttccctgagaagtgcagcaagcaggagaacatcgccagcggcatcagcgccaagagcgccagtgacaacagcaaggccgaggagacccagggcaatgtggatgaggccagcctgaaggagagcagccccagtgatgacagcatcatcagccccctgtctgaggacagccaggccgaggccgagggcgtgtttgtgagccccaacaagcccaggaccacagaggacctgtttgctgtgatccacaggagcaagaggaaggtgctgggcaggaaggacagcggggacatgtctgtgcgcagcaagagccgggcccccctgagcagcagcagcagcagcgccagcagcatcaccagccccagcagcaatgtgaccacccccaacagccagaggagccctggcctcatctacagaaatgccaagaagagcaacaccagcaatgaggagttcaagctgctgctgctgaagaagggcagcagaagtgacagcagctacaggatgtctgccacagagatcctgaagagccccatcctgcccaagcccccaggagagctgacagctgagagcccccagagcacagatgatgcccaccagggcagccagggcgctgaggccctgagccccctgagcccctgcagcccccgggtgaatgctgagggcttcagcagcaagagctttgccaccagcgccagcgcccgggtgggccgcagccgggcccccccagctgccagcagcagccgctacagcgtgcgctgccgcctgtacaacacccccatgcaggccatcagcgagggggagacagagaacagtgatggcagcccccatgatgacaggagcagccagagcagcacctag

SEQ ID NO: 161218 - DNA, 4425 bp, Artificial Sequence
  Description of Artificial Sequence: Synthetic coding sequence
atggccctggcctgctgcatgcccaagaatgctgctgtgagcaacctggacatcgagagcaagctgtctgtgtactaccgggccccctggcaccagcagaggaacatcttcctgcctgccaccaggcctccctgtgtggaggagctgcacagacatgcccggcagagcctgcaggccctgcggcgggagcacaggagcagaagtgaccggcgggagcagagagctgctgcccccctgagcattgctgccccacccctgcctgcctaccccccagcccacagccagaggagaagagagttcaaggacagacacttcctgaccttcaacagcaccaggagccccagccccacagagtgctgccacatgaccccctggagcaggaagagccaccccccagaagatgaggacacagatgtgatgctgggccagaggcccaagaaccccatccacaacatccccagcaccctggacaagcagaccaactggagcaaggccctgcccctgcccaccccagaggagaagatgaagcaggatgcccaggtgatcagcagctgcatcatccccatcaacgtgactggagtgggctttgaccgggaggccagcatccgctgcagcctggtgcacagccagagcgtgctgcagaggaggaggaagctgcggcggaggaagaccatcagcggcatcccccggcgggtgcagcaggagattgacagtgatgagagccctgtggcccgggagagaaatgtcatcgtgcacaccaacccagaccccagcaacacagtgaaccgcatcagcggcacccgggacagcgagtgccagacagaggacatcctgattgctgcccccagcagaagacgcatccgggcccagaggggccagagcattgctgccagcctgagccacagcgctggcaacatcagcgccctggccgacaagggggacaccatgttcaccccagctgtgagcagcaggaccaggagccgcagcctgccccgggagggcaacagaggaggagatgctgagcccaaggtgggcgccaagcccagcgcctatgaggagggggagagctttgtgggggaccacgagaggaccccaaatgacttcagcgaggcccccagcagccccagcgcccaggaccaccagcccaccctgggcctggcctgcagccagcacctgcacagcccccagcacaagctgtctgagcggggccgcagccggctgagcaggatggctgctgacagcggcagctgtgacatcagcagcaacagcgacaccttcggcagccccatccactgcatcagcacagctggggtgctgctgagcagccacatggaccagaaggatgaccaccagagcagcagcggcaactggagcggcagcagcagcacctgccccagccagaccagcgagaccatccccccagctgccagcccccccctgaccggcagcagccactgtgacagcgagctgagcctgaacacagcccctcatgccaatgaagatgcctctgtgtttgtgacagagcagtacaatgaccacctggacaaggtgcggggccaccgggccaacagcttcaccagcacagtggccgacctgctggatgaccccaacaacagcaacaccagtgacagcgagtggaactacctgcaccaccaccatgatgccagctgccggcaggacttcagccctgagcggcccaaggctgacagcctgggctgccccagcttcacctccatggccacctatgacagcttcctggagaagagccccagcgacaaggctgacaccagcagccacttctctgtggacacagagggctactacacctccatgcactttgactgtggcctgaagggcaacaagagctatgtgtgccactacgccgccctgggcccagaaaatggccagggcgtgggcgccagccctggcctgcctgactgtgcctggcaggactacctggaccacaagaggcagggccggcccagcatctccttcaggaagcccaaggccaagcccaccccacccaagaggagcagcagcctgaggaagagtgatggaaatgctgacatcagcgagaagaaggagcccaagatcagcagcggccagcacctgccccacagcagccgggagatgaagctgcccctggactttgccaacacccccagcaggatggagaatgccaacctgcccaccaagcaggagcccagctggatcaaccagagcgagcagggcatcaaggagccccagctggatgccagtgacatcccccccttcaaggatgaggtggccgagagcacccactatgctgacctgtggctgctgaatgacctgaagaccaatgacccctaccgcagcctgagcaacagcagcacagccaccggcaccaccgtgattgagtgcatcaagagccctgagagcagcgagagccagaccagccagagcgagagccgggccaccacccccagcctgcccagcgtggacaatgagttcaagctggccagccctgagaagctggccggcctggccagccccagcagcggctacagcagccagagcgagacccccaccagcagcttccccacagccttcttcagcggccccctgagccctgggggcagcaagaggaagcccaaggtgcctgagaggaagagcagcctgcagcagcccagcctgaaggatggcaccatcagcctgagcaaggacctggagctgcccatcatcccccccacccacctggacctgagcgccctgcacaacgtgctgaacaagcccttccaccaccgccaccccctgcacgtgttcacccacaacaagcagaacacagtgggggagaccctgcggagcaaccccccacccagcctggccatcacccccaccatcctgaagtctgtgaacctgcggagcatcaacaagtctgaggaggtgaagcagaaggaggagaacaacacagacctgccctacctggaggagagcaccctgaccacagctgccctgagccccagcaagatccggccccacacagccaacaagtctgtgtcccggcagtacagcacagaggacaccatcctgtccttcctggacagcagcgctgtggagatgggccctgacaagctgcacctggagaagaacagcacctttgatgtgaagaacagatgtgaccctgagaccatcaccagcgctggcagcagcctgctggacagcaatgtgaccaaggaccaggtgaggacagaaacagagcccatccctgagaacacccccaccaagaactgtgccttccccacagagggcttccagagggtgtctgctgcccggcccaatgacctggatggcaagatcatccagtatggccctggcccagatgagaccctggagcaggtgcagaaggcccccagcgctggcctggaggaggtggcccagcctgagagcgtggatgtgatcaccagccagagcgacagccccacccgggccacagatgtgagcaaccagttcaagcaccagtttgtgatgagccgccaccacgacaaggtgcccggcaccatctcctatgagagcgagatcacctctgtgaacagcttccctgagaagtgcagcaagcaggagaacatcgccagcggcatcagcgccaagagcgccagtgacaacagcaaggccgaggagacccagggcaatgtggatgaggccagcctgaaggagagcagccccagtgatgacagcatcatcagccccctgtctgaggacagccaggccgaggccgagggcgtgtttgtgagccccaacaagcccaggaccacagaggacctgtttgctgtgatccacaggagcaagaggaaggtgctgggcaggaaggacagcggggacatgtctgtgcgcagcaagagccgggcccccctgagcagcagcagcagcagcgccagcagcatcaccagccccagcagcaatgtgaccacccccaacagccagaggagccctggcctcatctacagaaatgccaagaagagcaacaccagcaatgaggagttcaagctgctgctgctgaagaagggcagcagaagtgacagcagctacaggatgtctgccacagagatcctgaagagccccatcctgcccaagcccccaggagagctgacagctgagagcccccagagcacagatgatgcccaccagggcagccagggcgctgaggccctgagccccctgagcccctgcagcccccgggtgaatgctgagggcttcagcagcaagagctttgccaccagcgccagcgcccgggtgggccgcagccgggcccccccagctgccagcagcagccgctacagcgtgcgctgccgcctgtacaacacccccatgcaggccatcagcgagggggagacagagaacagtgatggcagcccccatgatgacaggagcagccagagcagcacctag

SEQ ID NO: 161219 - DNA, 255 bp, Artificial Sequence
  Description of Artificial Sequence: Synthetic coding sequence
cctgagctgcaggtgtgtgtgttctgcaggaacaacaaggaggccatggccctgtacaccacccacatcctgaagggcccagatggccgggtgctgtgccctgtgctgcggcgctacacctgccccctgtgtggggccagcggggacaatgcccacaccatcaagtactgccccctgagcaaggtgcccccacctccagcccggcccccacccaggtctgccagagatggccccccaggcaagaagctgaggtag

SEQ ID NO: 161220 - DNA, 879 bp, Artificial Sequence
  Description of Artificial Sequence: Synthetic coding sequence
atggaggccttcccctgggcccccaggagcccccggcggggccgggcccccccacccatggccctggtgcccagcgcccgctacgtgtctgcccctggccctgcccacccccagcccttcagctcctggaatgactacctgggcctggccaccctcatcaccaaggctgtggatggagagcccaggtttggctgtgcccggggcggcaatggaggcggcggcagcccccccagcagcagcagcagcagctgctgcagcccccacactggagctggccctggggccctgggccctgccctgggccccccagactatgatgaagatgatgatgatgacagtgatgagcccggcagccggggccgctacctgggcagcgccctggagctgcgggccctggagctgtgtgccggccctgctgaggccggcctgctggaggagagatttgctgagctgagcccctttgctggccgggctgctgctgtgctgctgggctgtgccccagctgctgctgctgctgccaccaccaccagcgaggccaccccccgggaggagcgggccccagcctgggccgctgagccccggctgcatgctgccagcggggctgctgctgcccggctgctgaagccagagctgcaggtgtgtgtgttctgcaggaacaacaaggaggccatggccctgtacaccacccacatcctgaagggcccagatggccgggtgctgtgccctgtgctgcggcgctacacctgccccctgtgtggggccagcggggacaatgcccacaccatcaagtactgccccctgagcaaggtgcccccacctccagcccggcccccacccaggtctgccagagatggccccccaggcaagaagctgaggtag

SEQ ID NO: 161221 - DNA, 3456 bp, Artificial Sequence
  Description of Artificial Sequence: Synthetic coding sequence
atgctgcggcgggtgacagtggccgctgtgtgtgccaccaggaggaagctgtgtgaggccggccgggagctggccgccctgtggggcatcgagacccggggccgctgtgaagattctgctgctgcccggcccttccccatcctggccatgcctggaagaaacaaggccaagagcacctgcagctgcccagacctgcagcccaacggccaggacctgggggagaacagccgggtggcccggctgggcgcagatgagagcgaggaggagggcagaagaggcagcctgagcaatgctggggaccctgagatcgtgaagagccccagcgaccccaagcagtaccgctacatcaagctgcagaatggcctgcaggccctgctgatcagtgacctgagcaacatggagggcaagacaggcaacaccacagatgatgaggaggaggaggaggtggaggaggaggaggaggatgatgatgaggacagcggggctgagattgaagatgatgatgaggagggctttgatgatgaagatgaatttgatgatgaacatgatgatgacctggacacagaagataatgagctggaggagctggaggagcgggcagaggccaggaagaagaccacagagaagcagagcgctgctgccctgtgtgtgggcgtgggcagctttgctgaccctgatgacctgcccggcctggcccacttcctggagcacatggtgttcatgggcagcctgaagtacccagatgaaaatggatttgatgccttcctgaagaagcatggaggcagtgacaatgccagcacagactgtgagaggacagtgttccagtttgatgtgcagaggaagtacttcaaggaggccctggaccgctgggcccagttcttcatccaccccctgatgatcagagatgccatcgaccgggaggtggaggccgtggacagcgagtaccagctggcccggcccagtgatgccaacaggaaggagatgctgtttggcagcctggcccggcccggccaccccatgggcaagttcttctggggcaatgctgagaccctgaagcatgagcccaggaagaacaacatcgacacccacgcccggctgcgggagttctggatgagatactacagcagccactacatgaccctggtggtgcagagcaaggagaccctggacaccctggagaagtgggtgacagagatcttcagccagatccccaacaacggcctgccccggcccaactttggccacctgacagacccctttgacaccccagccttcaacaagctgtacagagtggtgcccatcaggaagatccacgccctgaccatcacctgggccctgcccccccagcagcagcactacagagtgaagcccctgcactacatctcctggctggtgggccacgagggcaagggcagcatcctgtccttcctgaggaagaagtgctgggccctggccctgtttggaggaaatggagaaacaggctttgagcagaacagcacctacagcgtcttcagcatcagcatcaccctgacagatgagggctatgagcacttctatgaggtggcctacaccgtcttccagtacctgaagatgctgcagaagctgggccctgagaagaggatctttgaggagatcaggaagattgaagataatgagttccactaccaggagcagacagatcctgtggagtatgtggagaacatgtgtgagaacatgcagctgtaccccctgcaggacatcctgaccggggaccagctgctgtttgagtacaagccagaggtgattggagaggccctgaaccagctggtgccccagaaggccaacctggtgctgctgagcggggccaatgaaggaaaatgtgacctgaaggagaagtggtttggcacccagtacagcattgaggacattgaaaattcctgggccgagctgtggaacagcaactttgagctgaacccagacctgcacctgcctgctgagaacaagtacatcgccacagacttcaccctgaaggcctttgactgcccagagacagagtaccctgtgaagatcgtgaacaccccccagggctgcctgtggtacaagaaggacaacaagttcaagatccccaaggcctacatccgcttccacctgatcagccccctcatccagaagtctgctgccaacgtggtgctgtttgacatctttgtgaacatcctgacccacaacctggccgagcccgcctatgaagcagatgtggcccagctggagtacaagctggtggccggggagcacggcctcatcatccgggtgaagggcttcaaccacaagctgcccctgctcttccagctgatcatcgactacctggccgagttcaacagcaccccagctgtgttcaccatgatcacagagcagctgaagaagacctacttcaacatcctgatcaagccagagaccctggccaaggatgtgcggctgctgatcctggagtatgcccgctggagcatgattgacaagtaccaggccctgatggatggcctgagcctggagagcctgctgagctttgtgaaggagttcaagagccagctgtttgtggagggcctggtgcagggcaatgtgaccagcacagagagcatggacttcctgaagtatgtggtggacaagctgaacttcaagcccctggagcaggagatgcctgtgcagttccaggtggtggagctgcccagcggccaccacctgtgcaaggtgaaggccctgaacaagggagatgccaacagcgaggtgacagtgtactaccagagcggcaccaggagcctgcgggagtacaccctgatggagctgctggtgatgcacatggaggagccctgctttgacttcctgcggaccaagcagaccctgggctaccacgtgtaccccacctgcaggaacaccagcggcatcctgggcttctctgtgacagtgggcacccaggccaccaagtacaacagcgaggtggtggacaagaagattgaggagttcctgagcagctttgaggagaagattgagaacctgacagaggaggccttcaacacccaggtgacagccctgatcaagctgaaggaatgtgaggacacccacctgggggaggaggtggacaggaactggaatgaggtggtgacccagcagtacctgtttgaccggctggcccatgaaattgaggccctgaagagcttcagcaagagtgacctggtgaactggttcaaggcccaccggggccctggcagcaagatgctgtctgtgcacgtggtgggctacggcaagtatgagctggaggaggatggcacccccagcagcgaggacagcaacagcagctgtgaggtgatgcagctgacctacctgcccaccagccccctgctggccgactgcatcatccccatcacagacatccgggccttcaccaccaccctgaacctgctgccctaccacaagatcgtgaagtag

SEQ ID NO: 161222 - DNA, 3660 bp, Artificial Sequence
  Description of Artificial Sequence: Synthetic coding sequence
atgctgcggcgggtgacagtggccgctgtgtgtgccaccaggaggaagctgtgtgaggccggccgggagctggccgccctgtggggcatcgagacccggggccgctgtgaagattctgctgctgcccggcccttccccatcctggccatgcctggaagaaacaaggccaagagcacctgcagctgcccagacctgcagcccaacggccaggacctgggggagaacagccgggtggcccggctgggcgcagatgagagcgaggaggagggcagaagaggcagcctgagcaatgctggggaccctgagatcgtgaagagccccagcgaccccaagcagtaccgctacatcaagctgcagaatggcctgcaggccctgctgatcagtgacctgagcaacatggagggcaagacaggcaacaccacagatgatgaggaggaggaggaggtggaggaggaggaggaggatgatgatgaggacagcggggctgagattgaagatgatgatgaggagggctttgatgatgaagatgaatttgatgatgaacatgatgatgacctggacacagaagataatgagctggaggagctggaggagcgggcagaggccaggaagaagaccacagagaagcagcagctgcagagcctcttcctgctgtggagcaagctgacagaccggctgtggttcaagagcacctacagcaagatgagcagcaccctgctggtggagaccaggaacctgtatggagtggtgggcgctgagagccgcagcgcccctgtgcagcacctggccggctggcaggccgaggagcagcagggcgagacagacacagtgctgtctgctgctgccctgtgtgtgggcgtgggcagctttgctgaccctgatgacctgcccggcctggcccacttcctggagcacatggtgttcatgggcagcctgaagtacccagatgaaaatggatttgatgccttcctgaagaagcatggaggcagtgacaatgccagcacagactgtgagaggacagtgttccagtttgatgtgcagaggaagtacttcaaggaggccctggaccgctgggcccagttcttcatccaccccctgatgatcagagatgccatcgaccgggaggtggaggccgtggacagcgagtaccagctggcccggcccagtgatgccaacaggaaggagatgctgtttggcagcctggcccggcccggccaccccatgggcaagttcttctggggcaatgctgagaccctgaagcatgagcccaggaagaacaacatcgacacccacgcccggctgcgggagttctggatgagatactacagcagccactacatgaccctggtggtgcagagcaaggagaccctggacaccctggagaagtgggtgacagagatcttcagccagatccccaacaacggcctgccccggcccaactttggccacctgacagacccctttgacaccccagccttcaacaagctgtacagagtggtgcccatcaggaagatccacgccctgaccatcacctgggccctgcccccccagcagcagcactacagagtgaagcccctgcactacatctcctggctggtgggccacgagggcaagggcagcatcctgtccttcctgaggaagaagtgctgggccctggccctgtttggaggaaatggagaaacaggctttgagcagaacagcacctacagcgtcttcagcatcagcatcaccctgacagatgagggctatgagcacttctatgaggtggcctacaccgtcttccagtacctgaagatgctgcagaagctgggccctgagaagaggatctttgaggagatcaggaagattgaagataatgagttccactaccaggagcagacagatcctgtggagtatgtggagaacatgtgtgagaacatgcagctgtaccccctgcaggacatcctgaccggggaccagctgctgtttgagtacaagccagaggtgattggagaggccctgaaccagctggtgccccagaaggccaacctggtgctgctgagcggggccaatgaaggaaaatgtgacctgaaggagaagtggtttggcacccagtacagcattgaggacattgaaaattcctgggccgagctgtggaacagcaactttgagctgaacccagacctgcacctgcctgctgagaacaagtacatcgccacagacttcaccctgaaggcctttgactgcccagagacagagtaccctgtgaagatcgtgaacaccccccagggctgcctgtggtacaagaaggacaacaagttcaagatccccaaggcctacatccgcttccacctgatcagccccctcatccagaagtctgctgccaacgtggtgctgtttgacatctttgtgaacatcctgacccacaacctggccgagcccgcctatgaagcagatgtggcccagctggagtacaagctggtggccggggagcacggcctcatcatccgggtgaagggcttcaaccacaagctgcccctgctcttccagctgatcatcgactacctggccgagttcaacagcaccccagctgtgttcaccatgatcacagagcagctgaagaagacctacttcaacatcctgatcaagccagagaccctggccaaggatgtgcggctgctgatcctggagtatgcccgctggagcatgattgacaagtaccaggccctgatggatggcctgagcctggagagcctgctgagctttgtgaaggagttcaagagccagctgtttgtggagggcctggtgcagggcaatgtgaccagcacagagagcatggacttcctgaagtatgtggtggacaagctgaacttcaagcccctggagcaggagatgcctgtgcagttccaggtggtggagctgcccagcggccaccacctgtgcaaggtgaaggccctgaacaagggagatgccaacagcgaggtgacagtgtactaccagagcggcaccaggagcctgcgggagtacaccctgatggagctgctggtgatgcacatggaggagccctgctttgacttcctgcggaccaagcagaccctgggctaccacgtgtaccccacctgcaggaacaccagcggcatcctgggcttctctgtgacagtgggcacccaggccaccaagtacaacagcgaggtggtggacaagaagattgaggagttcctgagcagctttgaggagaagattgagaacctgacagaggaggccttcaacacccaggtgacagccctgatcaagctgaaggaatgtgaggacacccacctgggggaggaggtggacaggaactggaatgaggtggtgacccagcagtacctgtttgaccggctggcccatgaaattgaggccctgaagagcttcagcaagagtgacctggtgaactggttcaaggcccaccggggccctggcagcaagatgctgtctgtgcacgtggtgggctacggcaagtatgagctggaggaggatggcacccccagcagcgaggacagcaacagcagctgtgaggtgatgcagctgacctacctgcccaccagccccctgctggccgactgcatcatccccatcacagacatccgggccttcaccaccaccctgaacctgctgccctaccacaagatcgtgaagtag

SEQ ID NO: 161223 - DNA, 1662 bp, Artificial Sequence
  Description of Artificial Sequence: Synthetic coding sequence
atgctgcagaagctgggccctgagaagaggatctttgaggagatcaggaagattgaagataatgagttccactaccaggagcagacagatcctgtggagtatgtggagaacatgtgtgagaacatgcagctgtaccccctgcaggacatcctgaccggggaccagctgctgtttgagtacaagccagaggtgattggagaggccctgaaccagctggtgccccagaaggccaacctggtgctgctgagcggggccaatgaaggaaaatgtgacctgaaggagaagtggtttggcacccagtacagcattgaggacattgaaaattcctgggccgagctgtggaacagcaactttgagctgaacccagacctgcacctgcctgctgagaacaagtacatcgcctacatccgcttccacctgatcagccccctcatccagaagtctgctgccaacgtggtgctgtttgacatctttgtgaacatcctgacccacaacctggccgagcccgcctatgaagcagatgtggcccagctggagtacaagctggtggccggggagcacggcctcatcatccgggtgaagggcttcaaccacaagctgcccctgctcttccagctgatcatcgactacctggccgagttcaacagcaccccagctgtgttcaccatgatcacagagcagctgaagaagacctacttcaacatcctgatcaagccagagaccctggccaaggatgtgcggctgctgatcctggagtatgcccgctggagcatgattgacaagtaccaggccctgatggatggcctgagcctggagagcctgctgagctttgtgaaggagttcaagagccagctgtttgtggagggcctggtgcagggcaatgtgaccagcacagagagcatggacttcctgaagtatgtggtggacaagctgaacttcaagcccctggagcaggagatgcctgtgcagttccaggtggtggagctgcccagcggccaccacctgtgcaaggtgaaggccctgaacaagggagatgccaacagcgaggtgacagtgtactaccagagcggcaccaggagcctgcgggagtacaccctgatggagctgctggtgatgcacatggaggagccctgctttgacttcctgcggaccaagcagaccctgggcagcgaggtggtggacaagaagattgaggagttcctgagcagctttgaggagaagattgagaacctgacagaggaggccttcaacacccaggtgacagccctgatcaagctgaaggaatgtgaggacacccacctgggggaggaggtggacaggaactggaatgaggtggtgacccagcagtacctgtttgaccggctggcccatgaaattgaggccctgaagagcttcagcaagagtgacctggtgaactggttcaaggcccaccggggccctggcagcaagatgctgtctgtgcacgtggtgggctacggcaagtatgagctggaggaggatggcacccccagcagcgaggacagcaacagcagctgtgaggtgatgcagctgacctacctgcccaccagccccctgctggccgactgcatcatccccatcacagacatccgggccttcaccaccaccctgaacctgctgccctaccacaagatcgtgaagtag

SEQ ID NO: 161224 - DNA, 1617 bp, Artificial Sequence
  Description of Artificial Sequence: Synthetic coding sequence
tgaaaaattgaggacaatgagttccactaccaggagcagacagatcctgtggagtatgtggagaacatgtgtgagaacatgcagctgtaccccctgcaggacatcctgactggagaccagctgctgtttgagtacaagccagaggtgattggagaggccctgaaccagctggtgccccagaaggccaacctggtgctgctgagcggggccaatgaaggaaaatgtgacctgaaggagaagtggtttggcacccagtacagcattgaagatattgagaacagctgggccgagctgtggaacagcaactttgagctgaacccagacctgcacctgcctgctgagaacaagtacatcgcctacatccgcttccacctgatcagccccctcatccagaagtctgctgccaacgtggtgctgtttgacatctttgtgaacatcctgacccacaacctggccgagcccgcctatgaagcagatgtggcccagctggagtacaagctggtggccggggagcacggcctcatcatccgggtgaagggcttcaaccacaagctgcccctgctcttccagctgatcatcgactacctggccgagttcaacagcaccccagctgtgttcaccatgatcacagagcagctgaagaagacctacttcaacatcctgatcaagccagagaccctggccaaggatgtgcggctgctgatcctggagtatgcccgctggagcatgattgacaagtaccaggccctgatggatggcctgagcctggagagcctgctgagctttgtgaaggagttcaagagccagctgtttgtggagggcctggtgcagggcaatgtgaccagcacagagagcatggacttcctgaagtatgtggtggacaagctgaacttcaagcccctggagcaggagatgcctgtgcagttccaggtggtggagctgcccagcggccaccacctgtgcaaggtgaaggccctgaacaagggagatgccaacagcgaggtgacagtgtactaccagagcggcaccaggagcctgcgggagtacaccctgatggagctgctggtgatgcacatggaggagccctgctttgacttcctgcggaccaagcagaccctgggcagcgaggtggtggacaagaagattgaggagttcctgagcagctttgaggagaagattgagaacctgacagaggaggccttcaacacccaggtgacagccctgatcaagctgaaggaatgtgaggacacccacctgggggaggaggtggacaggaactggaatgaggtggtgacccagcagtacctgtttgaccggctggcccacgagattgaggccctgaagagcttcagcaagagtgacctggtgaactggttcaaggcccaccggggccctggcagcaagatgctgtctgtgcacgtggtgggctacggcaagtatgagctggaggaggatggcacccccagcagcgaggacagcaacagcagctgtgaggtgatgcagctgacctacctgcccaccagccccctgctggccgactgcatcatccccatcacagacatccgggccttcaccaccaccctgaacctgctgccctaccacaagatcgtgaagtag

SEQ ID NO: 161225 - DNA, 3264 bp, Artificial Sequence
  Description of Artificial Sequence: Synthetic coding sequence
atggagggcaagacaggcaacaccacagatgatgaggaggaggaggaggtggaggaggaggaggaggatgatgatgaggacagcggggctgagattgaagatgatgatgaggagggctttgatgatgaagatgaatttgatgatgaacatgatgatgacctggacacagaagataatgagctggaggagctggaggagcgggcagaggccaggaagaagaccacagagaagcagcagctgcagagcctcttcctgctgtggagcaagctgacagaccggctgtggttcaagagcacctacagcaagatgagcagcaccctgctggtggagaccaggaacctgtatggagtggtgggcgctgagagccgcagcgcccctgtgcagcacctggccggctggcaggccgaggagcagcagggcgagacagacacagtgctgtctgctgctgccctgtgtgtgggcgtgggcagctttgctgaccctgatgacctgcccggcctggcccacttcctggagcacatggtgttcatgggcagcctgaagtacccagatgaaaatggatttgatgccttcctgaagaagcatggaggcagtgacaatgccagcacagactgtgagaggacagtgttccagtttgatgtgcagaggaagtacttcaaggaggccctggaccgctgggcccagttcttcatccaccccctgatgatcagagatgccatcgaccgggaggtggaggccgtggacagcgagtaccagctggcccggcccagtgatgccaacaggaaggagatgctgtttggcagcctggcccggcccggccaccccatgggcaagttcttctggggcaatgctgagaccctgaagcatgagcccaggaagaacaacatcgacacccacgcccggctgcgggagttctggatgagatactacagcagccactacatgaccctggtggtgcagagcaaggagaccctggacaccctggagaagtgggtgacagagatcttcagccagatccccaacaacggcctgccccggcccaactttggccacctgacagacccctttgacaccccagccttcaacaagctgtacagagtggtgcccatcaggaagatccacgccctgaccatcacctgggccctgcccccccagcagcagcactacagagtgaagcccctgcactacatctcctggctggtgggccacgagggcaagggcagcatcctgtccttcctgaggaagaagtgctgggccctggccctgtttggaggaaatggagaaacaggctttgagcagaacagcacctacagcgtcttcagcatcagcatcaccctgacagatgagggctatgagcacttctatgaggtggcctacaccgtcttccagtacctgaagatgctgcagaagctgggccctgagaagaggatctttgaggagatcaggaagattgaagataatgagttccactaccaggagcagacagatcctgtggagtatgtggagaacatgtgtgagaacatgcagctgtaccccctgcaggacatcctgaccggggaccagctgctgtttgagtacaagccagaggtgattggagaggccctgaaccagctggtgccccagaaggccaacctggtgctgctgagcggggccaatgaaggaaaatgtgacctgaaggagaagtggtttggcacccagtacagcattgaggacattgaaaattcctgggccgagctgtggaacagcaactttgagctgaacccagacctgcacctgcctgctgagaacaagtacatcgccacagacttcaccctgaaggcctttgactgcccagagacagagtaccctgtgaagatcgtgaacaccccccagggctgcctgtggtacaagaaggacaacaagttcaagatccccaaggcctacatccgcttccacctgatcagccccctcatccagaagtctgctgccaacgtggtgctgtttgacatctttgtgaacatcctgacccacaacctggccgagcccgcctatgaagcagatgtggcccagctggagtacaagctggtggccggggagcacggcctcatcatccgggtgaagggcttcaaccacaagctgcccctgctcttccagctgatcatcgactacctggccgagttcaacagcaccccagctgtgttcaccatgatcacagagcagctgaagaagacctacttcaacatcctgatcaagccagagaccctggccaaggatgtgcggctgctgatcctggagtatgcccgctggagcatgattgacaagtaccaggccctgatggatggcctgagcctggagagcctgctgagctttgtgaaggagttcaagagccagctgtttgtggagggcctggtgcagggcaatgtgaccagcacagagagcatggacttcctgaagtatgtggtggacaagctgaacttcaagcccctggagcaggagatgcctgtgcagttccaggtggtggagctgcccagcggccaccacctgtgcaaggtgaaggccctgaacaagggagatgccaacagcgaggtgacagtgtactaccagagcggcaccaggagcctgcgggagtacaccctgatggagctgctggtgatgcacatggaggagccctgctttgacttcctgcggaccaagcagaccctgggctaccacgtgtaccccacctgcaggaacaccagcggcatcctgggcttctctgtgacagtgggcacccaggccaccaagtacaacagcgaggtggtggacaagaagattgaggagttcctgagcagctttgaggagaagattgagaacctgacagaggaggccttcaacacccaggtgacagccctgatcaagctgaaggaatgtgaggacacccacctgggggaggaggtggacaggaactggaatgaggtggtgacccagcagtacctgtttgaccggctggcccatgaaattgaggccctgaagagcttcagcaagagtgacctggtgaactggttcaaggcccaccggggccctggcagcaagatgctgtctgtgcacgtggtgggctacggcaagtatgagctggaggaggatggcacccccagcagcgaggacagcaacagcagctgtgaggtgatgcagctgacctacctgcccaccagccccctgctggccgactgcatcatccccatcacagacatccgggccttcaccaccaccctgaacctgctgccctaccacaagatcgtgaagtag

SEQ ID NO: 161226 - DNA, 2244 bp, Artificial Sequence
  Description of Artificial Sequence: Synthetic coding sequence
atggagggcaagacaggcaacaccacagatgatgaggaggaggaggaggtggaggaggaggaggaggatgatgatgaggacagcggggctgagattgaagatgatgatgaggagggctttgatgatgaagatgaatttgatgatgaacatgatgatgacctggacacagaagataatgagctggaggagctggaggagcgggcagaggccaggaagaagaccacagagaagcagagcgctgctgccctgtgtgtgggcgtgggcagctttgctgaccctgatgacctgcccggcctggcccacttcctggagcacatggtgttcatgggcagcctgaagtacccagatgaaaatggatttgatgccttcctgaagaagcatggaggcagtgacaatgccagcacagactgtgagaggacagtgttccagtttgatgtgcagaggaagtacttcaaggaggccctggaccgctgggcccagttcttcatccaccccctgatgatcagagatgccatcgaccgggaggtggaggccgtggacagcgagtaccagctggcccggcccagtgatgccaacaggaaggagatgctgtttggcagcctggcccggcccggccaccccatgggcaagttcttctggggcaatgctgagaccctgaagcatgagcccaggaagaacaacatcgacacccacgcccggctgcgggagttctggatgagatactacagcagccactacatgaccctggtggtgcagagcaaggagaccctggacaccctggagaagtgggtgacagagatcttcagccagatccccaacaacggcctgccccggcccaactttggccacctgacagacccctttgacaccccagccttcaacaagctgtacagagtggtgcccatcaggaagatccacgccctgaccatcacctgggccctgcccccccagcagcagcactacagagtgaagcccctgcactacatctcctggctggtgggccacgagggcaagggcagcatcctgtccttcctgaggaagaagtgctgggccctggccctgtttggaggaaatggagaaacaggctttgagcagaacagcacctacagcgtcttcagcatcagcatcaccctgacagatgagggctatgagcacttctatgaggtggcctacaccgtcttccagtacctgaagatgctgcagaagctgggccctgagaagaggatctttgaggagatcaggaagattgaagataatgagttccactaccaggagcagacagatcctgtggagtatgtggagaacatgtgtgagaacatgcagctgtaccccctgcaggacatcctgaccggggaccagctgctgtttgagtacaagccagaggtgattggagaggccctgaaccagctggtgccccagaaggccaacctggtgctgctgagcggggccaatgaaggaaaatgtgacctgaaggagaagtggtttggcacccagtacagcattgaggacattgaaaattcctgggccgagctgtggaacagcaactttgagctgaacccagacctgcacctgcctgctgagaacaagtacatcgccacagacttcaccctgaaggcctttgactgcccagagacagagtaccctgtgaagatcgtgaacaccccccagggctgcctgtggtacaagaaggacaacaagttcaagatccccaaggcctacatccgcttccacctgatcagccccctcatccagaagtctgctgccaacgtggtgctgtttgacatctttgtgaacatcctgacccacaacctggccgagcccgcctatgaagcagatgtggcccagctggagtacaagctggtggccggggagcacggcctcatcatccgggtgaagggcttcaaccacaagctgcccctgctcttccagctgatcatcgactacctggccgagttcaacagcaccccagctgtgttcaccatgatcacagagcagctgaagaagacctacttcaacatcctgatcaagccagagaccctggccaaggatgtgcggctgctgatcctggagtatgcccgctggagcatgattgacaagtaccaggccctgatggatggcctgagcctggagagcctgctgagctttgtgaaggagttcaagagccagctgtttgtggagggcctggtgcagggcaatgtgaccagcacagtgctgtgccagtgggcccaggacagcgagacctag

SEQ ID NO: 161227 - DNA, 3447 bp, Artificial Sequence
  Description of Artificial Sequence: Synthetic coding sequence
atgctgcggcgggtgacagtggccgctgtgtgtgccaccaggaggaagctgtgtgaggccggccgggagctggccgccctgtggggcatcgagacccggggccgctgtgaagattctgctgctgcccggcccttccccatcctggccatgcctggaagaaacaaggccaagagcacctgcagctgcccagacctgcagcccaacggccaggacctgggggagaacagccgggtggcccggctgggcgcagatgagagcgaggaggagggcagaagaggcagcctgagcaatgctggggaccctgagatcgtgaagagccccagcgaccccaagcagtaccgctacatcaagctgcagaatggcctgcaggccctgctgatcagtgacctgagcaacatggagggcaagacaggcaacaccacagatgatgaggaggaggaggaggtggaggaggaggaggaggatgatgatgaggacagcggggctgagattgaagatgatgatgaggagggctttgatgatgaagatgaatttgatgatgaacatgatgatgacctggacacagaagataatgagctggaggagctggaggagcgggcagaggccaggaagaagaccacagagaagcagagcgctgctgccctgtgtgtgggcgtgggcagctttgctgaccctgatgacctgcccggcctggcccacttcctggagcacatggtgttcatgggcagcctgaagtacccagatgaaaatggatttgatgccttcctgaagaagcatggaggcagtgacaatgccagcacagactgtgagaggacagtgttccagtttgatgtgcagaggaagtacttcaaggaggccctggaccgctgggcccagttcttcatccaccccctgatgatcagagatgccatcgaccgggaggtggaggccgtggacagcgagtaccagctggcccggcccagtgatgccaacaggaaggagatgctgtttggcagcctggcccggcccggccaccccatgggcaagttcttctggggcaatgctgagaccctgaagcatgagcccaggaagaacaacatcgacacccacgcccggctgcgggagttctggatgagatactacagcagccactacatgaccctggtggtgcagagcaaggagaccctggacaccctggagaagtgggtgacagagatcttcagccagatccccaacaacggcctgccccggcccaactttggccacctgacagacccctttgacaccccagccttcaacaagctgtacagagtggtgcccatcaggaagatccacgccctgaccatcacctgggccctgcccccccagcagcagcactacagagtgaagcccctgcactacatctcctggctggtgggccacgagggcaagggcagcatcctgtccttcctgaggaagaagtgctgggccctggccctgtttggaggaaatggagaaacaggctttgagcagaacagcacctacagcgtcttcagcatcagcatcaccctgacagatgagggctatgagcacttctatgaggtggcctacaccgtcttccagtacctgaagatgctgcagaagctgggccctgagaagaggatctttgaggagatcaggaagattgaagataatgagttccactaccaggagcagacagatcctgtggagtatgtggagaacatgtgtgagaacatgcagctgtaccccctgcaggacatcctgaccggggaccagctgctgtttgagtacaagccagaggtgattggagaggccctgaaccagctggtgccccagaaggccaacctggtgctgctgagcggggccaatgaaggaaaatgtgacctgaaggagaagtggtttggcacccagtacagcattgaggacattgaaaattcctgggccgagctgtggaacagcaactttgagctgaacccagacctgcacctgcctgctgagaacaagtacatcgccacagacttcaccctgaaggcctttgactgcccagagacagagtaccctgtgaagatcgtgaacaccccccagggctgcctgtggtacaagaaggacaacaagttcaagatccccaaggcctacatccgcttccacctgatcagccccctcatccagaagtctgctgccaacgtggtgctgtttgacatctttgtgaacatcctgacccacaacctggccgagcccgcctatgaagcagatgtggcccagctggagtacaagctggtggccggggagcacggcctcatcatccgggtgaagggcttcaaccacaagctgcccctgctcttccagctgatcatcgactacctggccgagttcaacagcaccccagctgtgttcaccatgatcacagagcagctgaagaagacctacttcaacatcctgatcaagccagagaccctggccaaggatgtgcggctgctgatcctggagtatgcccgctggagcatgattgacaagtaccaggccctgatggatggcctgagcctggagagcctgctgagctttgtgaaggagttcaagagccagctgtttgtggagggcctggtgcagggcaatgtgaccagcacagagagcatggacttcctgaagtatgtggtggacaagctgaacttcaagcccctggagcaggagatgcctgtgcagttccaggtggtggagctgcccagcggccaccacctgtgcaaggtgaaggccctgaacaagggagatgccaacagcgaggtgacagtgtactaccagagcggcaccaggagcctgcgggagtacaccctgatggagctgctggtgatgcacatggaggagccctgctttgacttcctgcggaccaagcagaccctgggctaccacgtgtaccccacctgcaggaacaccagcggcatcctgggcttctctgtgacagtgggcacccaggccaccaagtacaacagcgaggtggtggacaagaagattgaggagttcctgagcagctttgaggagaagattgagaacctgacagaggaggccttcaacacccaggtgacagccctgatcaagctgaaggaatgtgaggacacccacctgggggaggaggtggacaggaactggaatgaggtggtgacccagcagtacctgtttgaccggctggcccatgaaattgaggccctgaagagcttcagcaagagtgacctggtgaactggttcaaggcccaccggggccctggcagcaagatgctgtctgtgcacgtggtgggctacggcaagtatgagctggaggaggatggcacccccagcagcgaggacagcaacagcagctgtgaggtgatgcagctgacctacctgcccaccagccccctgctggccatcgtgagcagccccctgctgatcagcggcctgagccagcagcacagcaccttcagccccaccatcaagtag

SEQ ID NO: 161228 - DNA, 1587 bp, Artificial Sequence
  Description of Artificial Sequence: Synthetic coding sequence
atgggcgccgccgccagcagaagaagagccctgcggtctgaggccatgagctctgtggccgccaaggtgcgggccgcccgggcctttggagagtacctgagccagagccacccagaaaatagaaatggagctgaccacctgctggctgatgcctacagcggccatgatggcagccctgagatgcagcctgccccccagaacaagaggcggctgagcctggtgtccaatggctgctatgagggcagcctgtctgaggagcccagcatcaggaagccagctggggagggcccccagccccgggtgtacaccatctctggagagcccgccctgctgcccagccctgaggccgaggccatcgagctggccgtggtgaagggccggcggcagaggcacccccaccaccacagccagcccctgcgggccagccctgggggcagccgggaggatgtgtcccggccctgccagagctgggccggcagccggcagggcagcaaggagtgccccggctgtgcccagctggcccctggccccaccccccgggccttcggcctggaccagccccccctgcctgagaccagcggccgcaggaagaagctggagaggatgtacagcgtggacagagtgtctgatgacatccccatccgcacctggttccccaaggaaaatctcttctccttccagacagccaccaccaccatgcaggccgtgttccggggctatgcagagaggaagaggaggaagagagaaaatgacagcgccagcgtcatccagaggaacttcaggaagcacctgaggatggtgggcagccggcgggtgaaggcccagacctttgctgagcggcgggagaggagcttcagccgctcctggagcgaccccacccccatgaaggctgacaccagccatgacagccgggacagcagtgacctgcagagcagccactgcaccctggatgaggcctttgaggacctggactgggacacagagaagggcctggaggccgtggcctgtgacacagagggctttgtgccccccaaggtgatgctgatcagcagcaaggtgcccaaggccgagtacatccccaccatcatcagaagagatgaccccagcatcatccccatcctgtatgaccatgaacatgccacctttgaggacatcctggaggagattgaaaggaagctgaatgtgtaccacaagggggccaagatctggaagatgctgatcttctgccagggcggccctggccacctgtacctgctgaagaacaaggtggccacctttgccaaggtggagaaggaggaggacatgatccacttctggaagaggctgagccggctgatgagcaaggtgaaccctgagcccaacgtcatccacatcatgggctgctacatcctgggcaaccccaacggggagaagctgttccagaacctgcggaccctgatgaccccctacagagtgacctttgagagccccctggagctgagcgcccagggcaagcagatgattgagacctactttgacttccggctgtaccgcctgtggaagagccggcagcacagcaagctgctggactttgatgatgtgctgtag

SEQ ID NO: 161229 - DNA, 984 bp, Artificial Sequence
  Description of Artificial Sequence: Synthetic coding sequence
atgtacagcgtggacagagtgtctgatgacatccccatccgcacctggttccccaaggagaacctcttctccttccagacagccaccaccaccatgcaggccgtgttccggggctacgccgagaggaagaggaggaagcgggagaatgattctgccagcgtcatccagaggaacttcaggaagcacctgaggatggtgggcagcagaagagtgaaggcccagacctttgctgagcggcgggagaggagcttcagccgctcctggagcgaccccacccccatgaaggctgacaccagccatgacagccgggacagcagtgacctgcagagcagccactgcaccctggatgaggcctttgaggacctggactgggacacagagaagggcctggaggccgtggcctgtgacacagagggctttgtgccccccaaggtgatgctgatcagcagcaaggtgcccaaggccgagtacatccccaccatcatcagaagagatgaccccagcatcatccccatcctgtatgaccacgagcacgccacctttgaggacatcctggaggagattgaaaggaagctgaatgtgtaccacaagggggccaagatctggaagatgctgatcttctgccagggcggccctggccacctgtacctgctgaagaacaaggtggccacctttgccaaggtggagaaggaggaggacatgatccacttctggaagaggctgagccggctgatgagcaaggtgaaccctgagcccaacgtcatccacatcatgggctgctacatcctgggcaaccccaatggagagaagctgttccagaacctgcggaccctgatgaccccctacagagtgacctttgagagccccctggagctgagcgcccagggcaagcagatgattgagacctactttgacttccggctgtaccgcctgtggaagagccggcagcacagcaagctgctggactttgatgatgtgctgtag

SEQ ID NO: 161230 - DNA, 438 bp, Artificial Sequence
  Description of Artificial Sequence: Synthetic coding sequence
atggtgggcagcagaagagtgaaggcccagacctttgctgagcggcgggagaggagcttcagccgctcctggagcgaccccacccccatgaaggctgacaccagccatgacagccgggacagcagtgacctgcagagcagccactgcaccctggatgaggcctttgaggacctggactgggacacagagaagggcctggaggccgtggcctgtgacacagagggctttgtgccccccaaggtgatgctgatcagcagcaaggtgcccaaggccgagtacatccccaccatcatcagaagagatgaccccagcatcatccccatcctgtatgtgtccccagcccctggcctgcccccaacagatgccctgctgcggccccaccctggccctgccccagccccccaggtgccccgggtgctgtggcgctgctggctgtag

SEQ ID NO: 161231 - DNA, 1587 bp, Artificial Sequence; identical to SEQ ID NO: 161228
  Description of Artificial Sequence: Synthetic coding sequence

SEQ ID NO: 161232 - DNA, 1503 bp, Artificial Sequence
  Description of Artificial Sequence: Synthetic coding sequence
atgggcgccgccgccagcagaagaagagccctgcggtctgaggccatgagctctgtggccgccaaggtgcgggccgcccgggcctttggagagtacctgagccagagccacccagaaaatagaaatggagctgaccacctgctggctgatgcctacagcggccatgatggcagccctgagatgcagcctgccccccagaacaagaggcggctgagcctggtgtccaatggctgctatgagggcagcctgtctgaggagcccagcatcaggaagccagctggggagggcccccagccccgggtgtacaccatctctggagagcccgccctgctgcccagccctgaggccgaggccatcgagctggccgtggtgaagggccggcggcagaggcacccccaccaccacagccagcccctgcgggccagccctgggggcagccgggaggatgtgtcccggccctgccagagctgggccggcagccggcagggcagcaaggagtgccccggctgtgcccagctggcccctggccccaccccccgggccttcggcctggaccagccccccctgcctgagaccagcggccgcaggaagaagctggagaggatgtacagcgtggacagagtgtctgatgacatccccatccgcacctggttccccaaggaaaatctcttctccttccagacagccaccaccaccatgcaggccatctctgtgttccggggctatgcagagaggaagaggaggaagagagaaaatgacagcgccagcgtcatccagaggaacttcaggaagcacctgaggatggtgggcagccggcgggtgaaggcccagagcagtgacctgcagagcagccactgcaccctggatgaggcctttgaggacctggactgggacacagagaagggcctggaggccgtggcctgtgacacagagggctttgtgccccccaaggtgatgctgatcagcagcaaggtgcccaaggccgagtacatccccaccatcatcagaagagatgaccccagcatcatccccatcctgtatgaccatgaacatgccacctttgaggacatcctggaggagattgaaaggaagctgaatgtgtaccacaagggggccaagatctggaagatgctgatcttctgccagggcggccctggccacctgtacctgctgaagaacaaggtggccacctttgccaaggtggagaaggaggaggacatgatccacttctggaagaggctgagccggctgatgagcaaggtgaaccctgagcccaacgtcatccacatcatgggctgctacatcctgggcaaccccaacggggagaagctgttccagaacctgcggaccctgatgaccccctacagagtgacctttgagagccccctggagctgagcgcccagggcaagcagatgattgagacctactttgacttccggctgtaccgcctgtggaagagccggcagcacagcaagctgctggactttgatgatgtgctgtag

SEQ ID NO: 161233 - DNA, 1518 bp, Artificial Sequence
  Description of Artificial Sequence: Synthetic coding sequence
atgggcgccgccgccagcagaagaagagccctgcggtctgaggccatgagctctgtggccgccaaggtgcgggccgcccgggcctttggagagtacctgagccagagccacccagaaaatagaaatggagctgaccacctgctggctgatgcctacagcggccatgatggcagccctgagatgcagcctgccccccagaacaagaggcggctgagcctggtgtccaatggctgctatgagggcagcctgtctgaggagcccagcatcaggaagccagctggggagggcccccagccccgggtgtacaccatctctggagagcccgccctgctgcccagccctgaggccgaggccatcgagctggccgtggtgaagggccggcggcagaggcacccccaccaccacagccagcccctgcgggccagccctgggggcagccgggaggatgtgtcccggccctgccagagctgggccggcagccggcagggcagcaaggagtgccccggctgtgcccagctggcccctggccccaccccccgggccttcggcctggaccagccccccctgcctgagaccagcggccgcaggaagaagctggagaggatgtacagcgtggacagagtgtctgatgacatccccatccgcacctggttccccaaggaaaatctcttctccttccagacagccaccaccaccatgcaggccaacttcaggaagcacctgaggatggtgggcagcagaagagtgaaggcccagacctttgctgagcggcgggagaggagcttcagccgctcctggagcgaccccacccccatgaaggctgacaccagccatgacagccgggacagcagtgacctgcagagcagccactgcaccctggatgaggcctttgaggacctggactgggacacagagaagggcctggaggccgtggcctgtgacacagagggctttgtgccccccaaggtgatgctgatcagcagcaaggtgcccaaggccgagtacatccccaccatcatcagaagagatgaccccagcatcatccccatcctgtatgaccacgagcacgccacctttgaggacatcctggaggagattgaaaggaagctgaatgtgtaccacaagggggccaagatctggaagatgctgatcttctgccagggcggccctggccacctgtacctgctgaagaacaaggtggccacctttgccaaggtggagaaggaggaggacatgatccacttctggaagaggctgagccggctgatgagcaaggtgaaccctgagcccaacgtcatccacatcatgggctgctacatcctgggcaaccccaatggagagaagctgttccagaacctgcggaccctgatgaccccctacagagtgacctttgagagccccctggagctgagcgcccagggcaagcagatgattgagacctactttgacttccggctgtaccgcctgtggaagagccggcagcacagcaagctgctggactttgatgatgtgctgtag

SEQ ID NO: 161234 - DNA, 1593 bp, Artificial Sequence
  Description of Artificial Sequence: Synthetic coding sequence
atgggcgccgccgccagcagaagaagagccctgcggtctgaggccatgagctctgtggccgccaaggtgcgggccgcccgggcctttggagagtacctgagccagagccacccagaaaatagaaatggagctgaccacctgctggctgatgcctacagcggccatgatggcagccctgagatgcagcctgccccccagaacaagaggcggctgagcctggtgtccaatggctgctatgagggcagcctgtctgaggagcccagcatcaggaagccagctggggagggcccccagccccgggtgtacaccatctctggagagcccgccctgctgcccagccctgaggccgaggccatcgagctggccgtggtgaagggccggcggcagaggcacccccaccaccacagccagcccctgcgggccagccctgggggcagccgggaggatgtgtcccggccctgccagagctgggccggcagccggcagggcagcaaggagtgccccggctgtgcccagctggcccctggccccaccccccgggccttcggcctggaccagccccccctgcctgagaccagcggccgcaggaagaagctggagaggatgtacagcgtggacagagtgtctgatgacatccccatccgcacctggttccccaaggaaaatctcttctccttccagacagccaccaccaccatgcaggccatctctgtgttccggggctatgcagagaggaagaggaggaagagagaaaatgacagcgccagcgtcatccagaggaacttcaggaagcacctgaggatggtgggcagccggcgggtgaaggcccagacctttgctgagcggcgggagaggagcttcagccgctcctggagcgaccccacccccatgaaggctgacaccagccatgacagccgggacagcagtgacctgcagagcagccactgcaccctggatgaggcctttgaggacctggactgggacacagagaagggcctggaggccgtggcctgtgacacagagggctttgtgccccccaaggtgatgctgatcagcagcaaggtgcccaaggccgagtacatccccaccatcatcagaagagatgaccccagcatcatccccatcctgtatgaccatgaacatgccacctttgaggacatcctggaggagattgaaaggaagctgaatgtgtaccacaagggggccaagatctggaagatgctgatcttctgccagggcggccctggccacctgtacctgctgaagaacaaggtggccacctttgccaaggtggagaaggaggaggacatgatccacttctggaagaggctgagccggctgatgagcaaggtgaaccctgagcccaacgtcatccacatcatgggctgctacatcctgggcaaccccaacggggagaagctgttccagaacctgcggaccctgatgaccccctacagagtgacctttgagagccccctggagctgagcgcccagggcaagcagatgattgagacctactttgacttccggctgtaccgcctgtggaagagccggcagcacagcaagctgctggactttgatgatgtgctgtag

SEQ ID NO: 161235 - DNA, 585 bp, Artificial Sequence
  Description of Artificial Sequence: Synthetic coding sequence
atgggcctgggccccctgagcagcagcctgagcccccagctgatcagcagcaaggtgcccaaggccgagtacatccccaccatcatcagaagagatgaccccagcatcatccccatcctgtatgaccatgaacatgccacctttgaggacatcctggaggagattgaaaggaagctgaatgtgtaccacaagggggccaagatctggaagatgctgatcttctgccagggcggccctggccacctgtacctgctgaagaacaaggtggccacctttgccaaggtggagaaggaggaggacatgatccacttctggaagaggctgagccggctgatgagcaaggtgaaccctgagcccaacgtcatccacatcatgggctgctacatcctgggcaaccccaacggggagaagctgttccagaacctgcggaccctgatgaccccctacagagtgacctttgagagccccctggagctgagcgcccagggcaagcagatgattgagacctactttgacttccggctgtaccgcctgtggaagagccggcagcacagcaagctgctggactttgatgatgtgctgtag

SEQ ID NO: 161236 - DNA, 1524 bp, Artificial Sequence
  Description of Artificial Sequence: Synthetic coding sequence
atgggcgccgccgccagcagaagaagagccctgcggtctgaggccatgagctctgtggccgccaaggtgcgggccgcccgggcctttggagagtacctgagccagagccacccagaaaatagaaatggagctgaccacctgctggctgatgcctacagcggccatgatggcagccctgagatgcagcctgccccccagaacaagaggcggctgagcctggtgtccaatggctgctatgagggcagcctgtctgaggagcccagcatcaggaagccagctggggagggcccccagccccgggtgtacaccatctctggagagcccgccctgctgcccagccctgaggccgaggccatcgagctggccgtggtgaagggccggcggcagaggcacccccaccaccacagccagcccctgcgggccagccctgggggcagccgggaggatgtgtcccggccctgccagagctgggccggcagccggcagggcagcaaggagtgccccggctgtgcccagctggcccctggccccaccccccgggccttcggcctggaccagccccccctgcctgagaccagcggccgcaggaagaagctggagaggatgtacagcgtggacagagtgtctgatgacatccccatccgcacctggttccccaaggaaaatctcttctccttccagacagccaccaccaccatgcaggccgtgggcaacttcaggaagcacctgaggatggtgggcagcagaagagtgaaggcccagacctttgctgagcggcgggagaggagcttcagccgctcctggagcgaccccacccccatgaaggctgacaccagccatgacagccgggacagcagtgacctgcagagcagccactgcaccctggatgaggcctttgaggacctggactgggacacagagaagggcctggaggccgtggcctgtgacacagagggctttgtgccccccaaggtgatgctgatcagcagcaaggtgcccaaggccgagtacatccccaccatcatcagaagagatgaccccagcatcatccccatcctgtatgaccacgagcacgccacctttgaggacatcctggaggagattgaaaggaagctgaatgtgtaccacaagggggccaagatctggaagatgctgatcttctgccagggcggccctggccacctgtacctgctgaagaacaaggtggccacctttgccaaggtggagaaggaggaggacatgatccacttctggaagaggctgagccggctgatgagcaaggtgaaccctgagcccaacgtcatccacatcatgggctgctacatcctgggcaaccccaatggagagaagctgttccagaacctgcggaccctgatgaccccctacagagtgacctttgagagccccctggagctgagcgcccagggcaagcagatgattgagacctactttgacttccggctgtaccgcctgtggaagagccggcagcacagcaagctgctggactttgatgatgtgctgtag

SEQ ID NO: 161237 - DNA, 1524 bp, Artificial Sequence
  Description of Artificial Sequence: Synthetic coding sequence
atgggcgccgccgccagcagaagaagagccctgcggtctgaggccatgagctctgtggccgccaaggtgcgggccgcccgggcctttggagagtacctgagccagagccacccagaaaatagaaatggagctgaccacctgctggctgatgcctacagcggccatgatggcagccctgagatgcagcctgccccccagaacaagaggcggctgagcctggtgtccaatggctgctatgagggcagcctgtctgaggagcccagcatcaggaagccagctggggagggcccccagccccgggtgtacaccatctctggagagcccgccctgctgcccagccctgaggccgaggccatcgagctggccgtggtgaagggccggcggcagaggcacccccaccaccacagccagcccctgcgggccagccctgggggcagccgggaggatgtgtcccggccctgccagagctgggccggcagccggcagggcagcaaggagtgccccggctgtgcccagctggcccctggccccaccccccgggccttcggcctggaccagccccccctgcctgagaccagcggccgcaggaagaagctggagaggatgtacagcgtggacagagtgtctgatgacatccccatccgcacctggttccccaaggaaaatctcttctccttccagacagccaccaccaccatgcaggccatcagcaacttcaggaagcacctgaggatggtgggcagcagaagagtgaaggcccagacctttgctgagcggcgggagaggagcttcagccgctcctggagcgaccccacccccatgaaggctgacaccagccatgacagccgggacagcagtgacctgcagagcagccactgcaccctggatgaggcctttgaggacctggactgggacacagagaagggcctggaggccgtggcctgtgacacagagggctttgtgccccccaaggtgatgctgatcagcagcaaggtgcccaaggccgagtacatccccaccatcatcagaagagatgaccccagcatcatccccatcctgtatgaccacgagcacgccacctttgaggacatcctggaggagattgaaaggaagctgaatgtgtaccacaagggggccaagatctggaagatgctgatcttctgccagggcggccctggccacctgtacctgctgaagaacaaggtggccacctttgccaaggtggagaaggaggaggacatgatccacttctggaagaggctgagccggctgatgagcaaggtgaaccctgagcccaacgtcatccacatcatgggctgctacatcctgggcaaccccaatggagagaagctgttccagaacctgcggaccctgatgaccccctacagagtgacctttgagagccccctggagctgagcgcccagggcaagcagatgattgagacctactttgacttccggctgtaccgcctgtggaagagccggcagcacagcaagctgctggactttgatgatgtgctgtag

SEQ ID NO: 161238 - DNA, 984 bp, Artificial Sequence
  Description of Artificial Sequence: Synthetic coding sequence
atgcagctgggccgccgcctggaccctgagcggcaggccctgcacctgtgcagcggcgtggagggggagccctggaaggctgtggccggccgggccctgggcggcatctgcctgtgggtgggcggcggggcccggagccagggcgagcactggctgcccacccccaagggcaacttcaggaagcacctgaggatggtgggcagcagaagagtgaaggcccagacctttgctgagcggcgggagaggagcttcagccgctcctggagcgaccccacccccatgaaggctgacaccagccatgacagccgggacagcagtgacctgcagagcagccactgcaccctggatgaggcctttgaggacctggactgggacacagagaagggcctggaggccgtggcctgtgacacagagggctttgtgccccccaaggtgatgctgatcagcagcaaggtgcccaaggccgagtacatccccaccatcatcagaagagatgaccccagcatcatccccatcctgtatgaccacgagcacgccacctttgaggacatcctggaggagattgaaaggaagctgaatgtgtaccacaagggggccaagatctggaagatgctgatcttctgccagggcggccctggccacctgtacctgctgaagaacaaggtggccacctttgccaaggtggagaaggaggaggacatgatccacttctggaagaggctgagccggctgatgagcaaggtgaaccctgagcccaacgtcatccacatcatgggctgctacatcctgggcaaccccaatggagagaagctgttccagaacctgcggaccctgatgaccccctacagagtgacctttgagagccccctggagctgagcgcccagggcaagcagatgattgagacctactttgacttccggctgtaccgcctgtggaagagccggcagcacagcaagctgctggactttgatgatgtgctgtag

SEQ ID NO: 161239 - DNA, 648 bp, Artificial Sequence
  Description of Artificial Sequence: Synthetic coding sequence
atgcctggagaggccacagagaccgtgcctgccacagagcaggagctgccccagccccaggccgagactggaagtggcacagaaagtgacagtgatgagagcgtgcctgagctggaggagcaggacagcacccaggccaccacccagcaggcccagctggccgctgctgctgagattgatgaggagcctgtgtccaaggccaagcagagccgctctgagaagaaggccaggaaggccatgagcaagctgggcctgcggcaggtgactggagtgaccagggtgaccatcaggaagagcaagaacatcctcttcgtcatcaccaagccagatgtgtacaagagccctgccagtgacacctacatcgtgtttggagaggccaagattgaggacctgagccagcaggcccagctggccgctgctgagaagttcaaggtgcagggcgaggccgtgagcaacatccaggagaacacccagacccccaccgtgcaggaggagagcgaggaggaggaggtggatgagaccggggtggaggtgaaggacatcgagctggtgatgagccaggccaacgtgtcccgggccaaggctgtgcgggccctgaagaacaacagcaatgacatcgtgaatgccatcatggagctgaccatgtag

SEQ ID NO: 161240 - DNA, 648 bp, Artificial Sequence; identical to SEQ ID NO: 161239
  Description of Artificial Sequence: Synthetic coding sequence

SEQ ID NO: 161241 - DNA, 6237 bp, Artificial Sequence
  Description of Artificial Sequence: Synthetic coding sequence
atgcctggagaggccacagagaccgtgcctgccacagagcaggagctgccccagccccaggccgagacagctgtgctgcccatgagcagcgccctgtctgtgacagctgccctgggccagcccggccccaccctgcccccaccctgcagccctgccccccagcagtgccccctgtctgctgccaaccaggccagccccttccccagccccagcaccatcgccagcacccccctggaggtgcccttcccccagagcagcagcggcacagccctgcccctgggcacagcccctgaggcccccaccttcctgcccaacctgattggcccccccatcagccctgctgccctggccctggccagccccatgattgcccccaccctgaagggcacccccagcagcagcgcccccctggccctggtggccctggccccccacagcgtgcagaagagcagcgccttcccccccaacctgctgaccagccccccatctgtggccgtggccgagagcggcagcgtcatcaccctgagcgcccccatcgcccccagcgagcccaagaccaacctgaacaaggtgcccagcgaggtggtgcccaaccccaagggcacccccagccccccctgcatcgtgtccacagtgccctaccactgtgtgacccccatggccagcatccagagcggcgtggccagcctgccccagaccacccccaccaccaccctggccatcgccagcccccaggtgaaggacaccaccatcagctctgtgctgatcagcccccagaaccctggcagcctgagcctgaagggccctgtgagccccccagctgccctgagcctgagcacccagagcctgcctgtggtgaccagcagccagaagacagctggccccaacaccccaccagacttccccatcagcctgggcagccacctggcccccctgcaccagagcagctttggatctgtgcagctgctgggccagacaggccccagcgccctgagtgaccccaccgtgaagaccatctctgtggaccacagcagcactggagccagctaccccagccagaggagcgtcatcccccccctgcccagcagaaatgaggtggtgcctgccaccgtggccgccttccctgtggtggcccccagcgtggacaagggccccagcaccatcagcagcatcacctgcagccccagcggcagcctgaatgtggccaccagcttcagcctgagccccaccaccagcctcatcctgaagagcagccccaatgccacctaccactaccccctggtggcccagatgcctgtgtcctctgtgggcaccacccccctggtggtgaccaacccctgcaccatcgctgctgcccccaccaccacctttgaggtggccacctgtgtgtccccacccatgagcagcggccccatcagcaacatcgagcccaccagccctgctgccctggtgatggcccctgtggcccccaaggagcccagcacccaggtggccaccaccctgcgcatccctgtgtccccacccctgcctgaccctgaggacctgaagaacctgcccagctctgtgctggtgaagttccccacccagaaggacctgcagacagtgcctgccagcctggagggcgcccccttcagccctgcccaggccggcctgaccaccaagaaggaccccaccgtgctgcccctggtgcaggccgcccccaagaacagccccagcttccagagcaccagcagcagccctgagatccccctgagccctgaggccaccctggccaagaagagcctgggggagcccctgcccatcggcaagccagccagctccatgaccagccccctgggcgtgaacagcagcgccagcgtcatcaagacagacagctatgccggcccagattctgctggccccctgctgaagagcagcctcatcacccccaccgtggccgccttccccctggagagcgctgaccctgctggggtggcccccaccacagccaagggcaccagcacctacaccaccacagccagccccttcctggagggcaccgtgtccctggcccccaagaaccaccctgtgaaggagggcaccctgaccaccctgcccctggtgcccacagccagcgagaactgccctgtggcccccagcccccagaacacctgtgcccccctggccaccctggtgctggcccctgagatccccaagtctgtgcccagccccagcctgcccccagctggcaccccacctggcaccaagaaggtggatggcatcagccacaccagcgccctggcccctgtggccagcagccccaaggaatgtcccacagaagattctggggccagcgccacagccagcagcaagggcaccctgacctacctggccgacagccccagccccctgggcgtgtctgtgagcccccagaccaagaggcctcccaccaagaagggcagcgctggccctgacacccccatcggcaacctgagcagccctgtgtcccctgtggaggccagcttcctgcctgagaacagcctgtccttccagggcagcaaggacagccctgccaccacccacagccccaccccacccagccccaagggggcccccacccccagcgctgtgacccccctgagccccaagggcgtgaccctgccccccaaggagacccccaccccatctgtggtgaacctgcccttccccaaggagggccctgccaccccagcccccaagcaggccccagccctgtccatgaccagcagcagccccaagaaggcccgggccaccccagcccccaagggcatcccagccagccccagccccaagggggcccccaccccacctgctgccaccccacccagccccaagggcggccctgccacccccagccccaagtgggcccccaccccacctgctgccaccccacccagccccaagggcggccctgccacccccagccccaagggggcccccaccccacctgctgccaccccacccagccccaagggcggccctgccacccccagccccaagggggcccccaccccacctgctgtgaccccacccagccccaagggcagccctgctgccacccccttccccaagggggccagcaccccacctgctgccaccccacccagccccaagggcagccctgctgccacccccctgcccaagggggcccccaccaccccagctgccaccctgcccagccccaagggcggccctgccacccccagcctgaagggggcccccaccccacctgctgccaccccacccagccccaagggcggccctgccacccccagccccaagggggcccccatgcctcctgctgccaccccacccagccccaagggcggcctggccaccccaccccacaagggggcccccaccaccccagctgccaccccacccagccccaagggcggcctggccaccccaccacccaagggggcccccaccaccccagctgccaccccacccagccccaagggcggcctggccaccccaccacccaagggggcccccaccaccccagctgccaccccacccagccccaagggcggcctggccacccccagccccaagggggcccccaccaccccagctgccaccccacccagccccaagggcggcctggccacccccagccccaagggggcccccaccaccccagctgccaccccacccagccccaagggcggcctggccacccccagccccaagggggcccccaccaccccagctgccaccccacccagccccaagggcggccctgccaccccaccacccaagggggcccccaccccacctgctgccaccccacccagcctgaagggcggcctggccaccccaccccacaagggggcccccaacccagctgtggtgaccccacccagccccaagggcggccctgccaccagcccccccaagggggcccccaccccacctgctgccaccccacccagccccaagggcagccctggcaccccaccacccaagggggcccccaccccacctgctgtgaccccacccagccccaagggcacccccaccctgcctgccaccacccccagcagcaaaggaggccccaccacccccagcagcaaggagggccccaccccacctgctgccacccccagccacaagggcggccctgccatgaccccacccagccccaagaggggccctgccatccccagccccaagggggaccccaccagccctgctgtgatccccctgagccccaagaaggccccagccacccctgtgacccgggagggcgccgccacccccagcaagggggacctgaccccacctgctgtgacccctgtgtccctgaagaaggccccagccaccagcgcccccaagggcggccctgccacccccagcagcaagggggaccccaccctgcctgctgtgaccccacccagccccaaggagcccccagcccccaagcaggtggccaccagcagcagccccaagaaggccccagccaccccagcccccatgggcgcccccaccctgcctgctgtgatccccagcagccccaaggaggtgcctgccacccccagcagcagaagagaccccatcgcccccacagccaccctgctgagcaagaagaccccagccaccctggcccccaaggaggccctgatccccccagccatgacagtgcccagccccaagaagaccccagccatccccacccccaaggaggccccagccacccccagcagcaaggaggccagcagccccccagctgtgacccccagcacctacaagggggcccccagccccaaggagctgctgatccccccagctgtgaccagccccagccccaaggaggcccccaccccacctgctgtgaccccacccagccctgagaagggccctgccaccccagcccccaagggcacccccaccagcccccctgtgacccccagcagcctgaaggacagccccaccagccctgcctctgtgacctgcaagatgggcgccaccgtgccccaggccagcaagggcctgcctgccaagaagggccccacagccctgaaggaggtgctggtggccccagcccctgagagcacccccatcatcacagcccccaccaggaagggcccccagaccaagaagagcagcgccaccagcccccccatctgcccagaccccagcgccaagaatggcagcaagggccccctgagcacagtggccccagcccccctgctgcctgtgcagaaggacagcagcaagacagccaagggcaaggatgccagccacagccccaagggccccctggcccctcctgagagcaaggccagcacccccctgacagctgctgcctttgagaaggtgctgcccaagccagagagcgcctctgtgtctgctgcccccagcccccctgtgtccctgcccctggcccccagccctgtgcccaccctgccccccaagcagcagttcctgcccagcagccctggcctggtgctggagagccccagcaagcccctggccccagcagatgaagatgagctgctgcccctcatccccccagagcccatcagcggcggcgtgcccttccagagcgtgctggtgaacatgcccacccccaagtctgctggcatccctgtgcccacccccagcgccaagcagcctgtgaccaagaacaacaagggcagcggcacagaaagtgacagtgatgaatctgtgcctgagctggaggagcaggacagcacccaggccaccacccagcaggcccagctggccgctgctgctgagattgatgaggagcctgtgtccaaggccaagcagagccgctctgagaagaaggccaggaaggccatgagcaagctgggcctgcggcaggtgactggagtgaccagggtgaccatcaggaagagcaagaacatcctgtttgtgatcaccaagccagatgtgtacaagagccctgccagtgacacctacatcgtgtttggagaggccaagattgaggacctgagccagcaggcccagctggccgctgctgagaagttcaaggtgcagggcgaggccgtgagcaacatccaggagaacacccagacccccaccgtgcaggaggagagcgaggaggaggaggtggatgaaacaggagtggaggtgaaggacatcgagctggtgatgagccaggccaacgtgtcccgggccaaggctgtgcgggccctgaagaacaacagcaatgacatcgtgaatgccatcatggagctgaccatgtag

SEQ ID NO: 161242 - DNA, 648 bp, Artificial Sequence; identical to SEQ ID NO: 161239
  Description of Artificial Sequence: Synthetic coding sequence

SEQ ID NO: 161243 - DNA, 21 bp, Artificial Sequence
  Description of Artificial Sequence: Synthetic coding sequence
atgcctggagaggccacctag

SEQ ID NO: 161244 - DNA, 597 bp, Artificial Sequence
  Description of Artificial Sequence: Synthetic coding sequence
atgcctggagaggccacagagaccgtgcctgccacagagcaggagctgccccagccccaggccgagactggaagtggcacagaaagtgacagtgatgagagcgtgcctgagctggaggagcaggacagcacccaggccaccacccagcaggcccagctggccgctgctgctgagattgatgaggagcctgtgtccaaggccaagcagagccgctctgagaagaaggccaggaaggccatgagcaagctgggcctgcggcaggtgactggagtgaccagggtgaccatcaggaagagcaagaacatcctcttcgtcatcaccaagccagatgtgtacaagagccctgccagtgacacctacatcgtgtttggagaggccaagattgaggacctgagccagcaggcccagctggccgctgctgagaagttcaaggtgcagggcgaggccgtgagcaacatccaggagaacacccagacccccaccgtgcaggaggagagcgaggaggaggaggtggatgagaccggggtggaggtgaaggacatcgagctggtgatgagccaggccaacgtgtcccgggccaaggctgtgcgggcctag

SEQ ID NO: 161245 - DNA, 381 bp, Artificial Sequence
  Description of Artificial Sequence: Synthetic coding sequence
atgcctggagaggccacagagaccgtgcctgccacagagcaggagctgccccagccccaggccgagactggaagtggcacagaaagtgacagtgatgagagcgtgcctgagctggaggagcaggacagcacccaggccaccacccagcaggcccagctggccgctgctgctgagattgatgaggagcctgtgtccaaggccaagcagagccgctctgagaagaaggccaggaaggccatgagcaagctgggcctgcggcaggtgactggagtgaccagggtgaccatcaggaagagcaagaacatcctcttcgtcatcaccaagccagatgtgtacaagagccctgccagtgacacctacatcgtgtttggagaggcctag

SEQ ID NO: 161246 - DNA, 648 bp, Artificial Sequence; identical to SEQ ID NO: 161239
  Description of Artificial Sequence: Synthetic coding sequence

SEQ ID NO: 161247 - DNA, 2778 bp, Artificial Sequence
  Description of Artificial Sequence: Synthetic coding sequence
atgcctggagaggccacagagaccgtgcctgccacagagcaggagctgccccagccccaggccgagacagctgtgctgcccatgagcagcgccctgtctgtgacagctgccctgggccagcccggccccaccctgcccccaccctgcagccctgccccccagcagtgccccctgtctgctgccaaccaggccagccccttccccagccccagcaccatcgccagcacccccctggaggtgcccttcccccagagcagcagcggcacagccctgcccctgggcacagcccctgaggcccccaccttcctgcccaacctgattggcccccccatcagccctgctgccctggccctggccagccccatgattgcccccaccctgaagggcacccccagcagcagcgcccccctggccctggtggccctggccccccacagcgtgcagaagagcagcgccttcccccccaacctgctgaccagccccccatctgtggccgtggccgagagcggcagcgtcatcaccctgagcgcccccatcgcccccagcgagcccaagaccaacctgaacaaggtgcccagcgaggtggtgcccaaccccaagggcacccccagccccccctgcatcgtgtccacagtgccctaccactgtgtgacccccatggccagcatccagagcggcgtggccagcctgccccagaccacccccaccaccaccctggccatcgccagcccccaggtgaaggacaccaccatcagctctgtgctgatcagcccccagaaccctggcagcctgagcctgaagggccctgtgagccccccagctgccctgagcctgagcacccagagcctgcctgtggtgaccagcagccagaagacagctggccccaacaccccaccagacttccccatcagcctgggcagccacctggcccccctgcaccagagcagctttggatctgtgcagctgctgggccagacaggccccagcgccctgagtgaccccaccgtgaagaccatctctgtggaccacagcagcactggagccagctaccccagccagaggagcgtcatcccccccctgcccagcagaaatgaggtggtgcctgccaccgtggccgccttccctgtggtggcccccagcgtggacaagggccccagcaccatcagcagcatcacctgcagccccagcggcagcctgaatgtggccaccagcttcagcctgagccccaccaccagcctcatcctgaagagcagccccaatgccacctaccactaccccctggtggcccagatgcctgtgtcctctgtgggcaccacccccctggtggtgaccaacccctgcaccatcgctgctgcccccaccaccacctttgaggtggccacctgtgtgtccccacccatgagcagcggccccatcagcaacatcgagcccaccagccctgctgccctggtgatggcccctgtggcccccaaggagcccagcacccaggtggccaccaccctgcgcatccctgtgtccccacccctgcctgaccctgaggacctgaagaacctgcccagctctgtgctggtgaagttccccacccagaaggacctgcagacagtgcctgccagcctggagggcgcccccttcagccctgcccaggccggcctgaccaccaagaaggaccccaccgtgctgcccctggtgcaggccgcccccaagaacagccccagcttccagagcaccagcagcagccctgagatccccctgagccctgaggccaccctggccaagaagagcctgggggagcccctgcccatcgtggccgccttccccctggagagcgctgaccctgctggggtggcccccaccacagccaaggctgctgcctttgagaaggtgctgcccaagccagagagcgcctctgtgtctgctgcccccagcccccctgtgtccctgcccctggcccccagccctgtgcccaccctgccccccaagcagcagttcctgcccagcagccctggcctggtgctggagagccccagcaagcccctggccccagcagatgaagatgagctgctgcccctcatccccccagagcccatctctggaggagtgcccttccagagcgtgctggtgaacatgcccacccccaagtctgctggcatccctgtgcccaccccatctgccaagcagcctgtgaccaagaacaacaagggcagcggcacagaaagtgacagtgatgagagcgtgcctgagctggaggagcaggacagcacccaggccaccacccagcaggcccagctggccgctgctgctgagattgatgaggagcctgtgtccaaggccaagcagagccgctctgagaagaaggccaggaaggccatgagcaagctgggcctgcggcaggtgactggagtgaccagggtgaccatcaggaagagcaagaacatcctcttcgtcatcaccaagccagatgtgtacaagagccctgccagtgacacctacatcgtgtttggagaggccaagattgaggacctgagccagcaggcccagctggccgctgctgagaagttcaaggtgcagggcgaggccgtgagcaacatccaggagaacacccagacccccaccgtgcaggaggagagcgaggaggaggaggtggatgagaccggggtggaggtgaaggacatcgagctggtgatgagccaggccaacgtgtcccgggccaaggctgtgcgggccctgaagaacaacagcaatgacatcgtgaatgccatcatggagctgaccatgtag

SEQ ID NO: 161248 - DNA, 306 bp, Artificial Sequence
  Description of Artificial Sequence: Synthetic coding sequence
atgcccctggaggatgaggtggtgcccccccaggtgctgtctgagcccaatgaggaggccggggccgccctgagccccctgcctgaggtgcccccctggacaggagaggtgtccccagcccagagagatggaggagccctgggccggggcccctgggacagcagtgacagaagtgccctgctgaagagcaagctgcgggccctgctgacagcccccaggagcctgcggcgcagcagctgctttggaggccgcatggaccgcatcggggcccagagcggcctgggctgcaacagcttccgctactag

SEQ ID NO: 161249 - DNA, 456 bp, Artificial Sequence
  Description of Artificial Sequence: Synthetic coding sequence
atgagcagcttcagcaccaccaccgtgtccttcctgctgctgctggccttccagctgctgggccagacccgggccaaccccatgtacaatgctgtgtccaatgctgacctgatggacttcaagaacctgctggaccacctggaggagaagatgcccctggaggatgaggtggtgcccccccaggtgctgtctgagcccaatgaggaggccggggccgccctgagccccctgcctgaggtgcccccctggacaggagaggtgtccccagcccagagagatggaggagccctgggccggggcccctgggacagcagtgacagaagtgccctgctgaagagcaagctgcgggccctgctgacagcccccaggagcctgcggcgcagcagctgctttggaggccgcatggaccgcatcggggcccagagcggcctgggctgcaacagcttccgctactag

SEQ ID NO: 161250 - DNA, 768 bp, Artificial Sequence
  Description of Artificial Sequence: Synthetic coding sequence
atggagcagtatgccaacaacctggaggagctggtggaggagaggacccaggcctacctggaggagaagaggaaggccgaggccctgctgtaccagatcctgccccacagcgtggccgagcagctgaagagaggagaaacagtgcaggccgaggcctttgattctgtgaccatctacttcagtgacatcgtgggcttcaccgccctgtctgctgagagcacccccatgcaggtggtgaccctgctgaatgacctgtacacctgctttgatgctgtgattgacaactttgatgtgtacaaggtggagaccatcggagatgcctacatggtggtgtctggcctgcctgtgagaaatggccgcctgcacgcctgtgaggtggccaggatggccctggccctgctggatgctgtgcgctccttccgcatccgccaccggccccaggagcagctgcggctgcgcatcggcatccacacaggccctgtgtgtgccggcgtggtgggcctgaagatgccccgctactgcctgtttggagacacagtgaacacagccagcaggatggagagcaatggagaggccctgaagatccacctgagcagcgagaccaaggctgtgctggaggagtttggaggctttgagctggagctgcggggagatgtggagatgaaggtggagggggaggccagcgccctgcccaccttctggggcccccggggcagctaccccagccaggccgccaatgccacccccatccccaaggccctgatctag

SEQ ID NO: 161251 - DNA, 3186 bp, Artificial Sequence
  Description of Artificial Sequence: Synthetic coding sequence
atgcctggccccaggaggcctgctggcagccggctgcggctgctgctgctgctgctgctgccccccctgctgctgctgctgcggggcagccacgccggcaacctgactgtggccgtggtgctgcccctggccaacaccagctacccctggagctgggcccgggtgggccctgctgtggagctggccctggcccaggtgaaggcccggccagacctgctgcccggctggacagtgaggacagtgctgggcagcagtgaaaatgccctgggcgtgtgcagcgacacagctgcccccctggccgctgtggacctgaagtgggagcacaacccagctgtgttcctgggccctggctgtgtgtatgctgctgcccctgtgggccgcttcaccgcccactggagggtgcccctgctgacagctggggccccagccctgggcttcggcgtgaaggatgaatatgccctgaccacccgggccggccccagctatgccaagctgggggactttgtggccgccctgcaccggcggctgggctgggagcggcaggccctgatgctgtatgcctacagacctggagatgaggagcactgcttcttcctggtggagggcctcttcatgagggtgcgggaccggctgaacatcaccgtggaccacctggagtttgctgaagatgacctgagccactacacccggctgctgcggaccatgcccaggaagggccgggtcatctacatctgcagcagcccagatgccttccgcaccctgatgctgctggccctggaggccggcctgtgtggggaggactatgtgttcttccacctggacatcttcggccagagcctgcagggcggccagggccctgccccccggcggccctgggagagaggagatggccaggatgtgtctgcccggcaggccttccaggccgccaagatcatcacctacaaggaccctgacaaccctgagtacctggagttcctgaagcagctgaagcacctggcctatgagcagttcaacttcaccatggaggatggcctggtgaacaccatcccagccagcttccatgatggcctgctgctgtacatccaggccgtgacagagaccctggcccacggcggcaccgtgacagatggagagaacatcacccagaggatgtggaacagaagcttccagggcgtgacaggctacctgaagattgacagcagcggggaccgggagacagacttcagcctgtgggacatggaccctgaaaatggagccttccgggtggtgctgaactacaacggcaccagccaggagctggtggccgtgtctggcaggaagctgaactggcccctgggctacccacctccagacatccccaagtgtggctttgacaatgaagatcctgcctgcaaccaggaccacctgagcaccctggaggtgctggccctggtgggcagcctgagcctgctgggcatcctgattgtgtccttcttcatctacaggaagatgcagctggagaaggagctggccagcgagctgtggagggtgcgctgggaggatgtggagcccagcagcctggagcggcacctgcggtctgctggcagccggctgaccctgagcggccggggcagcaactacggcagcctgctgaccacagagggccagttccaggtgtttgccaagacagcctactacaagggcaacctggtggccgtgaagagggtgaacaggaagagaattgagctgaccaggaaggtgctgtttgagctgaagcacatgagagatgtgcagaatgagcacctgaccaggtttgtgggcgcctgcacagatcctcccaacatctgcatcctgacagagtactgcccccggggcagcctgcaggacatcctggagaatgaaagcatcaccctggactggatgttccgctacagcctgaccaatgacatcgtgaagggcatgctgttcctgcacaacggggccatctgcagccacggcaacctgaagagcagcaactgtgtggtggatggccgctttgtgctgaagatcacagattatggcctggagagcttccgggacctggaccctgagcagggccacacagtgtatgccaagaagctgtggacagcccctgagctgctgaggatggccagcccccctgtgcggggcagccaggccggagatgtgtacagctttggcatcatcctgcaggagatcgccctgcggtctggagtcttccacgtggagggcctggacctgagccccaaggagatcatcgagcgggtgaccagaggagagcagccccccttccggcccagcctggccctgcagagccacctggaggagctgggcctgctgatgcagcgctgctgggccgaggacccccaggagcggccccccttccagcagatccggctgaccctgaggaagttcaaccgggagaacagcagcaacatcctggacaacctgctgagcaggatggagcagtatgccaacaacctggaggagctggtggaggagaggacccaggcctacctggaggagaagaggaaggccgaggccctgctgtaccagatcctgccccacagcgtggccgagcagctgaagagaggagagaccgtgcaggccgaggcctttgacagcgtgaccatctacttcagtgacatcgtgggcttcaccgccctgtctgctgagagcacccccatgcaggtggtgaccctgctgaatgacctgtacacctgctttgatgctgtgattgacaactttgatgtgtacaaggtggagaccatcggagatgcctacatggtggtgtctggcctgcctgtgagaaatggccgcctgcacgcctgtgaggtggccaggatggccctggccctgctggatgctgtgcgctccttccgcatccgccaccggccccaggagcagctgcggctgagaattggcatccacactggacctgtgtgtgccggcgtggtgggcctgaagatgccccgctactgcctgtttggagacacagtgaacacagccagcaggatggagagcaatggagaggccctgaagatccacctgagcagcgagaccaaggctgtgctggaggagtttggaggctttgagctggagctgcggggagatgtggagatgaagggcaagggcaaggtgaggacctactggctgctgggggagcggggcagcagcacccggggctag

SEQ ID NO: 161252 - DNA, 1623 bp, Artificial Sequence
  Description of Artificial Sequence: Synthetic coding sequence
aagatgcagctggagaaggagctggccagcgagctgtggagggtgcgctgggaggatgtggagcccagcagcctggagcggcacctgcggtctgctggcagccggctgaccctgagcggccggggcagcaactacggcagcctgctgaccacagagggccagttccaggtgtttgccaagacagcctactacaagatgagagatgtgcagaatgagcacctgaccaggtttgtgggcgcctgcacagacccccccaacatctgcatcctgacagagtactgcccccggggcagcctgcaggacatcctggagaatgaaagcatcaccctggactggatgttccgctacagcctgaccaatgacatcgtgaagggcatgctgttcctgcacaatggagccatctgcagccacggcaacctgaagagcagcaactgtgtggtggatggccgctttgtgctgaagatcacagattatggcctggagagcttccgggacctggaccctgagcagggccacacagtgtatgccaagaagctgtggacagcccctgagctgctgaggatggccagcccccctgtgcggggcagccaggccggagatgtgtacagctttggcatcatcctgcaggagatcgccctgcggtctggagtcttccacgtggagggcctggacctgagccccaaggagatcatcgagcgggtgaccagaggagagcagccccccttccggcccagcctggccctgcagagccacctggaggagctgggcctgctgatgcagcgctgctgggccgaggacccccaggagaggcctcccttccagcagatccggctgaccctgaggaagttcaaccgggagaacagcagcaacatcctggacaacctgctgagcaggatggagcagtatgccaacaacctggaggagctggtggaggagaggacccaggcctacctggaggagaagaggaaggccgaggccctgctgtaccagatcctgccccacagcgtggccgagcagctgaagagaggagaaacagtgcaggccgaggcctttgattctgtgaccatctacttcagtgacatcgtgggcttcaccgccctgtctgctgagagcacccccatgcaggtggtgaccctgctgaatgacctgtacacctgctttgatgctgtgattgacaactttgatgtgtacaaggtggagaccatcggagatgcctacatggtggtgtctggcctgcctgtgagaaatggccgcctgcacgcctgtgaggtggccaggatggccctggccctgctggatgctgtgcgctccttccgcatccgccaccggccccaggagcagctgcggctgcgcatcggcatccacacaggccctgtgtgtgccggcgtggtgggcctgaagatgccccgctactgcctgtttggagacacagtgaacacagccagcaggatggagagcaatggagaggccctgaagatccacctgagcagcgagaccaaggctgtgctggaggagtttggaggctttgagctggagctgcggggagatgtggagatgaagggcaagggcaaggtgaggacctactggctgctgggggagcggggcagcagcacccggggctag

SEQ ID NO: 161253 - DNA, 3144 bp, Artificial Sequence
  Description of Artificial Sequence: Synthetic coding sequence
atggccctgcccagcctgctgctgctggtggccgccctggccggcggcgtgcggcccccaggggccaggaacctgaccctggccgtggtgctgcctgagcacaacctgtcctatgcctgggcctggccccgggtgggccctgctgtggccctggccgtggaggccctgggccgggccctgcctgtggacctgcgctttgtgtcctctgagctggagggcgcctgcagcgagtacctggcccccctgtctgctgtggacctgaagctgtaccatgaccctgacctgctgctgggccctggctgtgtgtacccagctgcctctgtggccaggtttgccagccactggaggctgcccctgctgacagctggagctgtggccagcggcttcagcgccaagaatgaccactaccgcaccctggtgaggacaggccccagcgcccccaagctgggggagtttgtggtgaccctgcacggccacttcaactggacagcccgggccgccctgctgtacctggatgccaggacagatgaccggccccactacttcaccatcgagggcgtgtttgaggccctgcagggcagcaacctgtctgtgcagcaccaggtgtatgcccgggagcccggcggccctgagcaggccacccacttcatccgggccaacggcagaattgtgtacatctgtggccccctggagatgctgcacgagatcctgctgcaggcccagcgggagaacctgaccaatggagactatgtgttcttctacctggatgtgtttggagagagcctgcgggccggccccacccgggccaccggccggccctggcaggacaacagaacccgggagcaggcccaggccctgcgggaggccttccagacagtgctggtgatcacctaccgggagccccccaaccctgagtaccaggagttccagaaccggctgctgatccgggccagagaagattttggagtggagctgggccccagcctgatgaacctgattgctggctgcttctatgatggcatcctgctgtatgcagaggtgctgaatgagaccatccaggagggcggcaccagagaagatggcctgcgcatcgtggagaagatgcagggccgccgctaccacggcgtgacaggcctggtggtgatggacaagaacaatgaccgggagacagactttgtgctgtgggccatgggagacctggacagcggggacttccagcctgctgcccactacagcggggctgagaagcagatctggtggacaggccggcccatcccctgggtgaagggggccccacccagcgacaaccccccctgtgcctttgacctggatgaccccagctgtgacaagacccccctgagcaccctggccatcgtggccctgggcaccggcatcaccttcatcatgtttggagtgagcagcttcctgatcttcaggaagctgatgctggagaaggagctggcctccatgctgtggaggatccgctgggaggagctgcagtttggaaacagcgagcgctaccacaagggagctggcagccggctgaccctgagcctgcggggcagcagctatggcagcctgatgacagcccacggcaagtaccagatctttgccaacacaggccacttcaagggaaatgtggtggccatcaagcacgtgaacaagaagagaattgagctgacccggcaggtgctgtttgagctgaagcacatgagagatgtgcagttcaaccacctgacccgcttcatcggggcctgcattgatcctcccaacatctgcatcgtgacagagtactgcccccggggcagcctgcaggacatcctggagaatgacagcatcaacctggactggatgttccgctacagcctcatcaatgacctggtgaagggcatggccttcctgcacaacagcatcatcagcagccacggcagcctgaagagcagcaactgtgtggtggacagcagatttgtgctgaagatcacagattatggcctggccagcttccgcagcacagctgagccagatgacagccacgccctgtatgccaagaagctgtggacagcccctgagctgctgagcggcaaccccctgcccaccaccggcatgcagaaggcagatgtgtacagctttggcatcatcctgcaggagatcgccctgcggagcggccccttctacctggagggcctggacctgagccccaaggagatcgtgcagaaggtgagaaatggccagaggccctacttccggcccagcattgacaggacccagctgaatgaggagctggtgctgctgatggagcgctgctgggcccaggaccctgctgagaggccagactttggccagatcaagggcttcatccgccgcttcaacaaggagggcggcaccagcatcctggacaacctgctgctgaggatggagcagtatgccaacaacctggagaagctggtggaggagaggacccaggcctacctggaggagaagaggaaggccgaggccctgctgtaccagatcctgccccacagcgtggccgagcagctgaagagaggagaaacagtgcaggccgaggcctttgattctgtgaccatctacttcagtgacatcgtgggcttcaccgccctgtctgctgagagcacccccatgcaggtggtgaccctgctgaatgacctgtacacctgctttgatgccatcatcgacaactttgatgtgtacaaggtggagaccatcggagatgcctacatggtggtgtctggcctgcctggaagaaatggccagagacatgcccctgagatcgccaggatggccctggccctgctggatgctgtgtcctccttccgcatccgccaccggccccatgaccagctgcggctgcgcatcggcgtgcacacaggccctgtgtgtgccggcgtggtgggcctgaagatgccccgctactgcctgtttggagacacagtgaacacagccagcaggatggagagcaatggccaggccctgaagatccacgtgagcagcaccaccaaggatgccctggatgagctgggctgcttccagctggagctgcggggagatgtggagatgaagggcaagggcaagatgaggacctactggctgctgggggagaggaaaggacctcctggcctgctgtag

SEQ ID NO: 161254 - DNA, 1626 bp, Artificial Sequence
  Description of Artificial Sequence: Synthetic coding sequence
atgcccagcctgctggtgctgaccttcagcccctgtgtgctgctgggctgggccctgctggccggcggcaccggcggcggcggcgtgggcggcggcggcggcggggccggcatcggcggcggccggcaggagcgggaggccctgcccccccagaagattgaggtgctggtgctgctgccccaggatgacagctacctgttcagcctgaccagggtgcggcctgccatcgagtatgccctgcggtctgtggagggcaatggcaccggccggcggctgctgcccccaggcacccgcttccaggtggcctatgaggacagcgactgtggcaacagagccctcttcagcctggtggacagagtggccgccgcccggggggccaagccagacctgatcctgggccctgtgtgtgaatatgctgctgcccctgtggcccggctggccagccactgggacctgcccatgctgtctgctggggccctggccgccggcttccagcacaaggacagcgagtacagccacctgaccagggtggccccagcctatgccaagatgggagagatgatgctggccctcttccgccaccaccactggagccgggccgccctggtgtacagtgatgacaagctggagaggaactgctacttcaccctggagggcgtgcatgaggtgttccaggaggagggcctgcacaccagcatctacagctttgatgagaccaaggacctggacctggaggacatcgtgaggaacatccaggccagcgagcgggtggtgatcatgtgtgccagcagtgacaccatccgcagcatcatgctggtggcccacagacatggcatgaccagcggggactatgccttcttcaacatcgagctgttcaacagcagcagctatggagatggctcctggaagagaggagacaagcatgactttgaggccaagcaggcctacagcagcctgcagacagtgaccctgctgaggacagtgaagccagagtttgagaagttctccatggaggtgaagagctctgtggagaagcagggcctgaacatggaggactatgtgaacatgtttgtggagggcttccatgatgccatcctgctgtatgtgctggccctgcacgaggtgctgcgggccggctacagcaagaaggatggcggcaagatcatccagcagacctggaacagaacatttgagggcattgctggccaggtgtccattgatgccaatggagacagatatggagacttctctgtgattgccatgacagatgtggaggccggcacccaggaggtgattggagactactttgggaaggagggccgctttgagatgaggcccaacgtgaagtacccctggggccccctgaagctgagaattgatgaaaatcgcatcgtggagcacaccaacagcagcccctgcaagagcagcggcggcctggaggagagcgctgtgactggaattgtggtgggcgccctgctgggcgccggcctgctgatggccttctacttcttcaggaagaagtaccgcatcaccatcgagaggaggacccagcaggaggagagcaacctgggcaagcaccgggagctgagagaagattccatccgcagccacttctctgtggcctag

SEQ ID NO: 161255 - DNA, 1623 bp, Artificial Sequence
  Description of Artificial Sequence: Synthetic coding sequence
atgcccagcctgctggtgctgaccttcagcccctgtgtgctgctgggctgggccctgctggccggcggcaccggcggcggcggcgtgggcggcggcggcggcggggccggcatcggcggcggccggcaggagcgggaggccctgcccccccagaagattgaggtgctggtgctgctgccccaggatgacagctacctgttcagcctgaccagggtgcggcctgccatcgagtatgccctgcggtctgtggagggcaatggcaccggccggcggctgctgcccccaggcacccgcttccaggtggcctatgaggacagcgactgtggcaacagagccctcttcagcctggtggacagagtggccgccgcccggggggccaagccagacctgatcctgggccctgtgtgtgaatatgctgctgcccctgtggcccggctggccagccactgggacctgcccatgctgtctgctggggccctggccgccggcttccagcacaaggacagcgagtacagccacctgaccagggtggccccagcctatgccaagatgggagagatgatgctggccctcttccgccaccaccactggagccgggccgccctggtgtacagtgatgacaagctggagaggaactgctacttcaccctggagggcgtgcatgaggtgttccaggaggagggcctgcacaccagcatctacagctttgatgagaccaaggacctggacctggaggacatcgtgaggaacatccaggccagcgagcgggtggtgatcatgtgtgccagcagtgacaccatccgcagcatcatgctggtggcccacagacatggcatgaccagcggggactatgccttcttcaacatcgagctgttcaacagcagcagctatggagatggctcctggaagagaggagacaagcatgactttgaggccaagcaggcctacagcagcctgcagacagtgaccctgctgaggacagtgaagccagagtttgagaagttctccatggaggtgaagagctctgtggagaagcagggcctgaacatggaggactatgtgaacatgtttgtggagggcttccatgatgccatcctgctgtatgtgctggccctgcacgaggtgctgcgggccggctacagcaagaaggatggcggcaagatcatccagcagacctggaacagaacatttgagggcattgctggccaggtgtccattgatgccaatggagacagatatggagacttctctgtgattgccatgacagatgtggaggccggcacccaggaggtgattggagactactttgggaaggagggccgctttgagatgaggcccaacgtgaagtacccctggggccccctgaagctgagaattgatgaaaatcgcatcgtggagcacaccaacagcagcccctgcaagagctgtggcctggaggagagcgctgtgacaggcatcgtggtgggcgccctgctgggcgccggcctgctgatggccttctacttcttcaggaagaagtaccgcatcaccattgaaagaaggacccagcaggaggagagcaacctgggcaagcaccgggagctgcgggaggacagcatccgcagccacttctctgtggcctag

SEQ ID NO: 161256 - DNA, 975 bp, Artificial Sequence
  Description of Artificial Sequence: Synthetic coding sequence
atggagcccagcgccctgggcccctggagcctcttcccagacctggccccccgggaccaggagggccaggtgctggccccccggcgctgcttccggcgggagtgtggccagaatgagaaggtggtgatcatgtgtgccagcagtgacaccatccgcagcatcatgctggtggcccacagacatggcatgaccagcggggactatgccttcttcaacatcgagctgttcaacagcagcagctatggagatggctcctggaagagaggagacaagcatgactttgaggccaagcaggcctacagcagcctgcagacagtgaccctgctgaggacagtgaagccagagtttgagaagttctccatggaggtgaagagctctgtggagaagcagggcctgaacatggaggactatgtgaacatgtttgtggagggcttccatgatgccatcctgctgtatgtgctggccctgcacgaggtgctgcgggccggctacagcaagaaggatggcggcaagatcatccagcagacctggaacagaacatttgagggcattgctggccaggtgtccattgatgccaatggagacagatatggagacttctctgtgattgccatgacagatgtggaggccggcacccaggaggtgattggagactactttgggaaggagggccgctttgagatgaggcccaacgtgaagtacccctggggccccctgaagctgagaattgatgaaaatcgcatcgtggagcacaccaacagcagcccctgcaagagctgtggcctggaggagagcgctgtgacaggcatcgtggtgggcgccctgctgggcgccggcctgctgatggccttctacttcttcaggaagaagtaccgcatcaccattgaaagaaggacccagcaggaggagagcaacctgggcaagcaccgggagctgcgggaggacagcatccgcagccacttctctgtggcctag

SEQ ID NO: 161257 - DNA, 915 bp, Artificial Sequence
  Description of Artificial Sequence: Synthetic coding sequence
atgagcagcaccctgcctgccctgctgtgtgtgggcctgtgcctgagccagaggatcagcgcccagcagcagaccctgcccaagcccttcatctgggccgagccccacttcatggtgcccaaggagaagcaggtgaccatctgctgccagggcaactatggagctgtggagtaccagctgcactttgagggcagcctgtttgctgtggaccggcccaagcccccagagcgcatcaacaaggtgaagttctacatcccagacatgaacagcaggatggccggccagtacagctgcatctacagagtgggggagctgtggagcgagcccagcaacctgctggacctggtggtgacagagatgtatgacacccccaccctgtctgtgcaccctggccctgaggtgatcagcggggagaaggtgaccttctactgccgcctggacacagccacctccatgttcctgctgctgaaggagggccgcagcagccacgtgcagaggggctacggcaaggtgcaggccgagttccccctgggccctgtgaccacagcccaccggggcacctaccgctgcttcggcagctacaacaaccacgcctggagcttccccagcgagcctgtgaagctgctggtgactggagacatcgagaacaccagcctggcccctgaggaccccaccttccctgctgacacctggggcacctacctgctgaccacagagaccggcctgcagaaggaccacgccctgtgggaccacacagcccagaacctgctgaggatgggcctggccttcctggtgctggtggccctggtgtggttcctggtggaggactggctgagcaggaagaggacccgggagcgggccagccgggccagcacctgggagggcagaagaaggctgaacacccagaccctgtag

SEQ ID NO: 161258 - DNA, 864 bp, Artificial Sequence
  Description of Artificial Sequence: Synthetic coding sequence
atgagcagcaccctgcctgccctgctgtgtgtgggcctgtgcctgagccagaggatcagcgcccagcagcagaccctgcccaagcccttcatctgggccgagccccacttcatggtgcccaaggagaagcaggtgaccatctgctgccagggcaactatggagctgtggagtaccagctgcactttgagggcagcctgtttgctgtggaccggcccaagcccccagagcgcatcaacaaggtgaagttctacatcccagacatgaacagcaggatggccggccagtacagctgcatctacagagtgggggagctgtggagcgagcccagcaacctgctggacctggtggtgacagagatgtatgacacccccaccctgtctgtgcaccctggccctgaggtgatcagcggggagaaggtgaccttctactgccgcctggacacagccacctccatgttcctgctgctgaaggagggccgcagcagccacgtgcagaggggctacggcaaggtgcaggccgagttccccctgggccctgtgaccacagcccaccggggcacctaccgctgcttcggcagctacaacaaccacgcctggagcttccccagcgagcctgtgaagctgctggtgactggagacatcgagaacaccagcctggcccctgaggaccccaccttcccagaccacgccctgtgggaccacacagcccagaacctgctgaggatgggcctggccttcctggtgctggtggccctggtgtggttcctggtggaggactggctgagcaggaagaggacccgggagcgggccagccgggccagcacctgggagggcagaagaaggctgaacacccagaccctgtag

SEQ ID NO: 161259 - DNA, 630 bp, Artificial Sequence
  Description of Artificial Sequence: Synthetic coding sequence
atgagcagcaccctgcctgccctgctgtgtgtgggcctgtgcctgagccagaggatcagcgcccagcagcagatgtatgacacccccaccctgtctgtgcaccctggccctgaggtgatctctggagagaaggtgaccttctactgccgcctggacacagccacctccatgttcctgctgctgaaggagggccgcagcagccacgtgcagaggggctacggcaaggtgcaggccgagttccccctgggccctgtgaccacagcccaccggggcacctaccgctgcttcggcagctacaacaaccacgcctggagcttccccagcgagcctgtgaagctgctggtgactggagacatcgagaacaccagcctggcccctgaggaccccaccttccctgctgacacctggggcacctacctgctgaccacagaaacaggcctgcagaaggaccacgccctgtgggaccacacagcccagaacctgctgaggatgggcctggccttcctggtgctggtggccctggtgtggttcctggtggaggactggctgagcaggaagaggacccgggagcgggccagccgggccagcacctgggagggcagaagaaggctgaacacccagaccctgtag

SEQ ID NO: 161260 - DNA, 594 bp, Artificial Sequence
  Description of Artificial Sequence: Synthetic coding sequence
atgagcagcaccctgcctgccctgctgtgtgtggagatgtatgacacccccaccctgtctgtgcaccctggccctgaggtgatctctggagagaaggtgaccttctactgccgcctggacacagccacctccatgttcctgctgctgaaggagggccgcagcagccacgtgcagaggggctacggcaaggtgcaggccgagttccccctgggccctgtgaccacagcccaccggggcacctaccgctgcttcggcagctacaacaaccacgcctggagcttccccagcgagcctgtgaagctgctggtgactggagacatcgagaacaccagcctggcccctgaggaccccaccttccctgctgacacctggggcacctacctgctgaccacagaaacaggcctgcagaaggaccacgccctgtgggaccacacagcccagaacctgctgaggatgggcctggccttcctggtgctggtggccctggtgtggttcctggtggaggactggctgagcaggaagaggacccgggagcgggccagccgggccagcacctgggagggcagaagaaggctgaacacccagaccctgtag

SEQ ID NO: 161261 - DNA, 912 bp, Artificial Sequence
  Description of Artificial Sequence: Synthetic coding sequence
atgagcagcaccctgcctgccctgctgtgtgtgggcctgtgcctgagccagaggatcagcgcccagcagcagaccctgcccaagcccttcatctgggccgagccccacttcatggtgcccaaggagaagcaggtgaccatctgctgccagggcaactatggagctgtggagtaccagctgcactttgagggcagcctgtttgctgtggaccggcccaagcccccagagcgcatcaacaaggtgaagttctacatcccagacatgaacagcaggatggccggccagtacagctgcatctacagagtgggggagctgtggagcgagcccagcaacctgctggacctggtggtgacagagatgtatgacacccccaccctgtctgtgcaccctggccctgaggtgatcagcggggagaaggtgaccttctactgccgcctggacacagccacctccatgttcctgctgctgaaggagggccgcagcagccacgtgcagaggggctacggcaaggtgcaggccgagttccccctgggccctgtgaccacagcccaccggggcacctaccgctgcttcggcagctacaacaaccacgcctggagcttccccagcgagcctgtgaagctgctggtgactggagacatcgagaacaccagcctggcccctgaggaccccaccttcccagacacctggggcacctacctgctgaccacagaaacaggcctgcagaaggaccacgccctgtgggaccacacagcccagaacctgctgaggatgggcctggccttcctggtgctggtggccctggtgtggttcctggtggaggactggctgagcaggaagaggacccgggagcgggccagccgggccagcacctgggagggcagaagaaggctgaacacccagaccctgtag

SEQ ID NO: 161262 - DNA, 777 bp, Artificial Sequence
  Description of Artificial Sequence: Synthetic coding sequence
atggcctggagggccctgcaccccctgctgctgctgctgctgctcttccctggcagccaggcccagagcaaggcccaggtgctgcagagcgtggccggccagaccctgactgtgcgctgccagtacccacccaccggcagcctgtatgagaagaagggctggtgcaaggaggccagcgccctggtgtgcatccggctggtgaccagcagcaagcccaggaccatggcctggaccagccgcttcaccatctgggatgatcctgatgctggcttcttcaccgtgaccatgacagacctgcgggaggaggacagcggccactactggtgccgcatctaccggcccagcgacaacagcgtgtccaagtctgtgcgcttctacctggtggtgtccccagccagcgccagcacccagacctcctggaccccccgggacctggtgagcagccagacccagacccagagctgtgtgcccccaacagctggggcccggcaggcccctgagagccccagcaccatccctgtgcccagccagccccagaacagcaccctgcggcccggccctgctgcccccatcgccctggtgcctgtgttctgtggcctgctggtggccaagagcctggtgctgagcgccctgctggtgtggtgggtgctgaggaacagacacatgcagcaccagggccgcagcctgctgcacccagcccagccccggccccaggcccaccgccacttccccctgagccaccgggcccctgggggcacctacggcggcaagccctag

SEQ ID NO: 161263 - DNA, 813 bp, Artificial Sequence
  Description of Artificial Sequence: Synthetic coding sequence
atggcctggagggccctgcaccccctgctgctgctgctgctgctcttccctggcagccaggcccagagcaaggcccaggtgctgcagagcgtggccggccagaccctgactgtgcgctgccagtacccacccaccggcagcctgtatgagaagaagggctggtgcaaggaggccagcgccctggtgtgcatccggctggtgaccagcagcaagcccaggaccatggcctggaccagccgcttcaccatctgggatgatcctgatgctggcttcttcaccgtgaccatgacagacctgcgggaggaggacagcggccactactggtgccgcatctaccggcccagcgacaacagcgtgtccaagtctgtgcgcttctacctggtggtgtccccagccagcgccagcacccagacctcctggaccccccgggacctggtgagcagccagacccagacccagagctgtgtgcccccaacagctggggcccggcaggcccctgagagccccagcaccatccctgtgcccagccaccccagcagccccctgcctgtgcccctgcccagccggccccagaacagcaccctgcggcccggccctgctgcccccatcgccctggtgcctgtgttctgtggcctgctggtggccaagagcctggtgctgagcgccctgctggtgtggtgggtgctgaggaacagacacatgcagcaccagggccgcagcctgctgcacccagcccagccccggccccaggcccaccgccacttccccctgagccaccgggcccctgggggcacctacggcggcaagccctag

SEQ ID NO: 161264 - DNA, 831 bp, Artificial Sequence
  Description of Artificial Sequence: Synthetic coding sequence
atggcctggagggccctgcaccccctgctgctgctgctgctgctcttccctggcagccaggcccagagcaaggcccaggtgctgcagagcgtggccggccagaccctgactgtgcgctgccagtacccacccaccggcagcctgtatgagaagaagggctggtgcaaggaggccagcgccctggtgtgcatccggctggtgaccagcagcaagcccaggaccatggcctggaccagccgcttcaccatctgggatgatcctgatgctggcttcttcaccgtgaccatgacagacctgcgggaggaggacagcggccactactggtgccgcatctaccggcccagcgacaacagcgtgtccaagtctgtgcgcttctacctggtggtgtccccagccagcgccagcacccagacctcctggaccccccgggacctggtgagcagccagacccagacccagagctgtgtgcccccaacagctggggcccggcaggcccctgagagccccagcaccatccctgtgcccagccagccccagaacagcaccctgcggcccggccctgctgcccccatcgccctggtgcctgtgttctgtggcctgctggtggccaagagcctggtgctgagcgccctgctggtgtggtggggagacatctggtggaagaccatgatggagctgcggagcctggacacccagaaggccacctgccacctgcagcaggtgacagacctgccctggacctctgtgagcagccctgtggagcgggagatcctgtaccacacagtggcccggaccaagatcagtgatgatgatgatgagcacaccctgtag

SEQ ID NO: 161265 - DNA, 606 bp, Artificial Sequence
  Description of Artificial Sequence: Synthetic coding sequence
atggcctggatgctgctgctgatcctgatcatggtgcaccctggcagctgtgccctgtgggtgtcccagcccccagagatccgcaccctggagggcagcagcgccttcctgccctgcagcttcaatgccagccagggccgcctggccatcggctctgtgacctggttcagagatgaggtggtgcctgggaaggaggtgagaaatggcaccccagagttccggggccgcctggcccccctggccagcagccgcttcctgcatgaccaccaggccgagctgcacatcagagatgtgcggggccatgatgccagcatctacgtgtgccgggtggaggtgctgggcctgggcgtgggcactggaaatggcacccggctggtggtggagaaggagcacccccagctgggcgccggcaccgtgctgctgctgcgggccggcttctatgctgtgtccttcctgtctgtggccgtgggcagcacagtgtactaccagggcaagtgcctgacctggaagggcccccggcggcagctgcctgctgtggtgcctgcccccctgcccccaccctgtggcagcagcgcccacctgctgccccctgtgcctgggggctag

SEQ ID NO: 161266 - DNA, 498 bp, Artificial Sequence
  Description of Artificial Sequence: Synthetic coding sequence
atggcctggatgctgctgctgatcctgatcatggtgcaccctggcagctgtgccctgtgggtgtcccagcccccagagatccgcaccctggagggcagcagcgccttcctgccctgcagcttcaatgccagccagggccgcctggccatcggctctgtgacctggttcagagatgaggtggtgcctgggaaggaggccgagctgcacatcagagatgtgcggggccatgatgccagcatctacgtgtgccgggtggaggtgctgggcctgggcgtgggcactggaaatggcacccggctggtggtggagaaggagcacccccagctgggcgccggcaccgtgctgctgctgcgggccggcttctatgctgtgtccttcctgtctgtggccgtgggcagcacagtgtactaccagggcaagtgccactgccacatgggcacccactgccacagcagtgatggcccccggggcgtcatccctgagccccgctgcccctag

SEQ ID NO: 161267 - DNA, 573 bp, Artificial Sequence
  Description of Artificial Sequence: Synthetic coding sequence
atggcctggatgctgctgctgatcctgatcatggtgcaccctggcagctgtgccctgtgggtgtcccagcccccagagatccgcaccctggagggcagcagcgccttcctgccctgcagcttcaatgccagccagggccgcctggccatcggctctgtgacctggttcagagatgaggtggtgcctgggaaggaggtgagaaatggcaccccagagttccggggccgcctggcccccctggccagcagccgcttcctgcatgaccaccaggccgagctgcacatcagagatgtgcggggccatgatgccagcatctacgtgtgccgggtggaggtgctgggcctgggcgtgggcactggaaatggcacccggctggtggtggagaaggagcacccccagctgggcgccggcaccgtgctgctgctgcgggccggcttctatgctgtgtccttcctgtctgtggccgtgggcagcacagtgtactaccagggcaagtgccactgccacatgggcacccactgccacagcagtgatggcccccggggcgtcatccctgagccccgctgcccctag

SEQ ID NO: 161268 - DNA, 534 bp, Artificial Sequence
  Description of Artificial Sequence: Synthetic coding sequence
atggcctggatgctgctgctgatcctgatcatggtgcaccctggcagctgtgccctgtgggtgtcccagcccccagagatccgcaccctggagggcagcagcgccttcctgccctgcagcttcaatgccagccagggccgcctggccatcggctctgtgacctggttcagagatgaggtggtgcctgggaaggaggtgagaaatggcaccccagagttccggggccgcctggcccccctggccagcagccgcttcctgcatgaccaccaggccgagctgcacatcagagatgtgcggggccatgatgccagcatctacgtgtgccgggtggaggtgctgggcctgggcgtgggcactggaaatggcacccggctggtggtggagaaggagcacccccagctgggcgccggcaccgtgctgctgctgcgggccggcttctatgctgtgtccttcctgtctgtggccgtgggcagcacagtgtactaccagggcaagtatgccaagagcaccctgagcggcttcccccagctgtag

SEQ ID NO: 161269 - DNA, 573 bp, Artificial Sequence; identical to SEQ ID NO: 161267
  Description of Artificial Sequence: Synthetic coding sequence

SEQ ID NO: 161270 - DNA, 606 bp, Artificial Sequence; identical to SEQ ID NO: 161265
  Description of Artificial Sequence: Synthetic coding sequence

SEQ ID NO: 161271 - DNA, 534 bp, Artificial Sequence; identical to SEQ ID NO: 161268
  Description of Artificial Sequence: Synthetic coding sequence

SEQ ID NO: 161272 - DNA, 498 bp, Artificial Sequence; identical to SEQ ID NO: 161266
  Description of Artificial Sequence: Synthetic coding sequence

SEQ ID NO: 161273 - DNA, 573 bp, Artificial Sequence; identical to SEQ ID NO: 161267
  Description of Artificial Sequence: Synthetic coding sequence

SEQ ID NO: 161274 - DNA, 606 bp, Artificial Sequence; identical to SEQ ID NO: 161265
  Description of Artificial Sequence: Synthetic coding sequence

SEQ ID NO: 161275 - DNA, 573 bp, Artificial Sequence; identical to SEQ ID NO: 161267
  Description of Artificial Sequence: Synthetic coding sequence

SEQ ID NO: 161276 - DNA, 498 bp, Artificial Sequence; identical to SEQ ID NO: 161266
  Description of Artificial Sequence: Synthetic coding sequence

SEQ ID NO: 161277 - DNA, 498 bp, Artificial Sequence; identical to SEQ ID NO: 161266
  Description of Artificial Sequence: Synthetic coding sequence

SEQ ID NO: 161278 - DNA, 498 bp, Artificial Sequence; identical to SEQ ID NO: 161266
  Description of Artificial Sequence: Synthetic coding sequence

SEQ ID NO: 161279 - DNA, 606 bp, Artificial Sequence; identical to SEQ ID NO: 161265
  Description of Artificial Sequence: Synthetic coding sequence

SEQ ID NO: 161280 - DNA, 606 bp, Artificial Sequence; identical to SEQ ID NO: 161265
  Description of Artificial Sequence: Synthetic coding sequence

SEQ ID NO: 161281 - DNA, 534 bp, Artificial Sequence; identical to SEQ ID NO: 161268
  Description of Artificial Sequence: Synthetic coding sequence

SEQ ID NO: 161282 - DNA, 534 bp, Artificial Sequence; identical to SEQ ID NO: 161268
  Description of Artificial Sequence: Synthetic coding sequence

SEQ ID NO: 161283 - DNA, 606 bp, Artificial Sequence; identical to SEQ ID NO: 161265
  Description of Artificial Sequence: Synthetic coding sequence

SEQ ID NO: 161284 - DNA, 534 bp, Artificial Sequence; identical to SEQ ID NO: 161268
  Description of Artificial Sequence: Synthetic coding sequence

SEQ ID NO: 161285 - DNA, 573 bp, Artificial Sequence; identical to SEQ ID NO: 161267
  Description of Artificial Sequence: Synthetic coding sequence

SEQ ID NO: 161286 - DNA, 606 bp, Artificial Sequence; identical to SEQ ID NO: 161265
  Description of Artificial Sequence: Synthetic coding sequence

SEQ ID NO: 161287 - DNA, 498 bp, Artificial Sequence; identical to SEQ ID NO: 161266
  Description of Artificial Sequence: Synthetic coding sequence

SEQ ID NO: 161288 - DNA, 534 bp, Artificial Sequence; identical to SEQ ID NO: 161268
  Description of Artificial Sequence: Synthetic coding sequence

SEQ ID NO: 161289 - DNA, 573 bp, Artificial Sequence; identical to SEQ ID NO: 161267
  Description of Artificial Sequence: Synthetic coding sequence

SEQ ID NO: 161290 - DNA, 534 bp, Artificial Sequence; identical to SEQ ID NO: 161268
  Description of Artificial Sequence: Synthetic coding sequence

SEQ ID NO: 161291 - DNA, 606 bp, Artificial Sequence; identical to SEQ ID NO: 161265
  Description of Artificial Sequence: Synthetic coding sequence

SEQ ID NO: 161292 - DNA, 573 bp, Artificial Sequence; identical to SEQ ID NO: 161267
  Description of Artificial Sequence: Synthetic coding sequence

SEQ ID NO: 161293 - DNA, 498 bp, Artificial Sequence; identical to SEQ ID NO: 161266
  Description of Artificial Sequence: Synthetic coding sequence

SEQ ID NO: 161294 - DNA, 498 bp, Artificial Sequence; identical to SEQ ID NO: 161266
  Description of Artificial Sequence: Synthetic coding sequence

SEQ ID NO: 161295 - DNA, 534 bp, Artificial Sequence; identical to SEQ ID NO: 161268
  Description of Artificial Sequence: Synthetic coding sequence

SEQ ID NO: 161296 - DNA, 573 bp, Artificial Sequence; identical to SEQ ID NO: 161267
  Description of Artificial Sequence: Synthetic coding sequence

SEQ ID NO: 161297 - DNA, 486 bp, Artificial Sequence
  Description of Artificial Sequence: Synthetic coding sequence
atggatgacatctacaaggctgctgtggagcagctgacagaggagcagaagaatgagttcaaggccgcctttgacatctttgtgctgggcgcagaagatggctgcatcagcaccaaggagctgggcaaggtgatgaggatgctgggccagaaccccaccccagaggagctgcaggagatgattgatgaggtggatgaagatggcagcggcaccgtggactttgatgagttcctggtgatgatggtgcgctgcatgaaggatgacagcaagggcaagtctgaggaggagctgagtgacctcttcaggatgtttgacaagaatgctgatggctacatcgacctggatgagctgaagatcatgctgcaggccaccggggagaccatcacagaagatgacatcgaggagctgatgaaggatggagacaagaacaatgatggaagaattgattatgatgagttcctggagttcatgaagggcgtggagtag

SEQ ID NO: 161298 - DNA, 315 bp, Artificial Sequence
  Description of Artificial Sequence: Synthetic coding sequence
atgggcgcccaggaccggccccagtgccactttgatattgagatcaaccgggagcctgtgggccgcatcatgttccagctgttcagtgacatctgccccaagacctgcaagaacttcctgtgcctgtgcagcggggagaagggcctgggcaagaccaccgggaagaagctgtgctacaagggcagcaccttccaccgggtggtgaagaacttcatgatccagggcggggacttcagcgagggcaatggcaagggcggggagagcatctacggcggctacttcaaggaaaatgtggtgttctgcaagatgaagtag

SEQ ID NO: 161299 - DNA, 2805 bp, Artificial Sequence
  Description of Artificial Sequence: Synthetic coding sequence
atggctgtgcagcccaaggagaccctgcagctggagagcgctgctgaggtgggctttgtgcgcttcttccagggcatgcctgagaagcccaccaccaccgtgcggctgtttgacagaggagacttctacacagcccacggggaggatgccctgctggccgcccgggaggtgttcaagacccagggcgtcatcaagtacatgggccctgctggggccaagaacctgcagagcgtggtgctgagcaagatgaactttgagagctttgtgaaggacctgctgctggtgcggcagtacagagtggaggtgtacaagaacagagctggcaacaaggccagcaaagaaaatgactggtacctggcctacaaggccagccctggcaacctgagccagtttgaggacatcctgtttggaaataatgacatgtctgccagcattggagtggtgggcgtgaagatgtctgctgtggatggccagaggcaggtgggcgtgggctacgtggacagcatccagaggaagctgggcctgtgtgagttcccagacaatgaccagttcagcaacctggaggccctgctgatccagatcggccccaaggaatgtgtgctgcccggcggggagacagctggggacatgggcaagctgcggcagatcatccagaggggcggcatcctgatcacagagaggaagaaggctgacttcagcaccaaggacatctaccaggacctgaaccggctgctgaagggcaagaagggggagcagatgaacagcgctgtgctgcctgagatggagaaccaggtggccgtgagcagcctgtctgctgtgatcaagttcctggagctgctgagtgatgacagcaactttggccagtttgagctgaccacctttgacttcagccagtacatgaagctggacattgctgctgtgcgggccctgaacctcttccagggctctgtggaggacaccaccggcagccagagcctggccgccctgctgaacaagtgcaagaccccccagggccagaggctggtgaaccagtggatcaagcagcccctgatggacaagaaccgcatcgaggagcggctgaacctggtggaggcctttgtggaggatgctgagctgcggcagaccctgcaggaggacctgctgcggcgcttcccagacctgaaccggctggccaagaagttccagaggcaggccgccaacctgcaggactgctaccgcctgtaccagggcatcaaccagctgcccaacgtcatccaggccctggagaagcatgagggcaagcaccagaagctgctgctggccgtgtttgtgacccccctgacagacctgcggagtgacttcagcaagttccaggagatgattgagaccaccctggacatggaccaggtggagaaccacgagttcctggtgaagcccagctttgaccccaacctgtctgagctgcgggagatcatgaatgacctggagaagaagatgcagagcaccctcatctctgctgcccgggacctgggcctggaccccgggaagcagatcaagctggacagcagcgcccagtttggctactacttccgggtgacctgcaaggaggagaaggtgctgaggaacaacaagaacttcagcacagtggacatccagaagaatggagtgaagttcaccaacagcaagctgaccagcctgaatgaggagtacaccaagaacaagacagaatatgaggaggcccaggatgccatcgtgaaggagatcgtgaacatcagcagcggctacgtggagcccatgcagaccctgaatgatgtgctggcccagctggatgctgtggtgtcctttgcccacgtgtccaatggagcccctgtgccctacgtgcggcctgccatcctggagaagggccagggccgcatcatcctgaaggccagcagacatgcctgtgtggaggtgcaggatgagatcgccttcatccccaatgatgtgtactttgagaaggacaagcagatgttccacatcatcaccggccccaacatgggcggcaagagcacctacatccggcagacaggagtgattgtgctgatggcccagatcggctgctttgtgccctgtgagagcgctgaggtgtccatcgtggactgcatcctggcccgggtgggcgctggggacagccagctgaagggcgtgtccaccttcatggccgagatgctggagacagccagcatcctgcggagcgccaccaaggacagcctcatcatcattgatgagctgggccggggcaccagcacctatgatggcttcggcctggcctgggccatcagcgagtacatcgccaccaagatcggggccttctgcatgtttgccacccacttccacgagctgacagccctggccaaccagatccccaccgtgaacaacctgcacgtgacagccctgaccacagaggagaccctgaccatgctgtaccaggtgaagaagggcgtgtgtgaccagagctttggcatccacgtggccgagctggccaacttccccaagcacgtgattgaatgtgccaagcagaaggccctggagctggaggagttccagtacatcggggagagccagggctatgacatcatggagcctgctgccaagaagtgctacctggagcgggagcagggcgagaagatcatccaggagttcctgagcaaggtgaagcagatgcccttcacagagatgtctgaggagaacatcaccatcaagctgaagcagctgaaggccgaggtgattgccaagaacaacagctttgtgaatgagatcatcagccgcatcaaggtgaccacctag

SEQ ID NO: 161300 - DNA, 435 bp, Artificial Sequence
  Description of Artificial Sequence: Synthetic coding sequence
atgacagaggaggtgattgtcatcgccaagtgggactacacagcccagcaggaccaggagctggacatcaagaagaatgaaaggctgtggctgctggatgacagcaagacctggtggagggtgagaaatgctgccaacagaacaggctacgtgcccagcaactacgtggagaggaagaacagcctgaagaagggcagcctggtgaagaacctgaaggacaccctgggcctgggcaagaccaggaggaagaccagcgccagagatgccagccccacccccagcacagatgctgagtacccagccaacggcagcggggctgaccgcatctatgacctgaacatcccagcctttgtgaagtttgcctacgtggccgagagagaagatgagctgagcctggtgaagggcagccgggtgacagtgatggagaagtgctag

SEQ ID NO: 161301 - DNA, 1143 bp, Artificial Sequence
  Description of Artificial Sequence: Synthetic coding sequence
atgacagaggaggtgattgtcatcgccaagtgggactacacagcccagcaggaccaggagctggacatcaagaagaatgaaaggctgtggctgctggatgacagcaagacctggtggagggtgagaaatgctgccaacagaacaggctacgtgcccagcaactacgtggagaggaagaacagcctgaagaagggcagcctggtgaagaacctgaaggacaccctgggcctgggcaagaccaggaggaagaccagcgccagagatgccagccccacccccagcacagatgctgagtacccagccaacggcagcggggctgaccgcatctatgacctgaacatcccagcctttgtgaagtttgcctacgtggccgagagagaagatgagctgagcctggtgaagggcagccgggtgacagtgatggagaagtgcagtgatggctggtggaggggcagctacaacggccagatcggctggttccccagcaactacgtgctggaggaggtggatgaggccgctgctgagagccccagcttcctgagcctgaggaagggggccagcctgagcaatggccagggcagccgggtgctgcacgtggtgcagaccctgtaccccttcagctctgtgacagaggaggagctgaactttgagaagggggagaccatggaggtgattgagaagccagaaaatgaccctgagtggtggaagtgcaagaatgcccggggccaggtgggcctggtgcccaagaactacgtggtggtgctgagtgatggccctgccctgcacccagcccacgccccccagatctcctacacaggccccagcagcagcggccgctttgctggccgggagtggtactatggaaatgtgaccaggcaccaggccgagtgtgccctgaatgaaagaggagtggagggggacttcctgatccgggacagcgagagcagccccagcgacttctctgtgtccctgaaggccagcggcaagaacaagcacttcaaggtgcagctggtggacaacgtgtactgcatcggccagaggcgcttccacaccatggatgagctggtggagcactacaagaaggcccccatcttcaccagcgagcacggggagaagctgtacctggtgcgggccctgcagtag

SEQ ID NO: 161302 - DNA, 333 bp, Artificial Sequence
  Description of Artificial Sequence: Synthetic coding sequence
atgacagaggaggtgattgtcatcgccaagtgggactacacagcccagcaggaccaggagctggacatcaagaagaatgaaaggctgtggctgctggatgacagcaagacctggtggagggtgagaaatgctgccaacagaacaggctacgtgcccagcaactacgtggagaggaagaacagcctgaagaagggcagcctggtgaagaacctgaaggacaccctgggcctgggcaagaccaggaggaagaccagcgccagagatgccagccccacccccagcacagatgctgagtacccagccaacggcagcggggctgaccgcatctactag

SEQ ID NO: 161303 - DNA, 252 bp, Artificial Sequence
  Description of Artificial Sequence: Synthetic coding sequence
atgacagaggaggtgattgtcatcgccaagtgggactacacagcccagcaggaccaggagctggacatcaagaagaatgaaaggctgtggctgctggatgacagcaagacctggtggagggtgagaaatgctgccaacagaacaggctacgtgcccagcaactacgtggagaggaagaacagcctgaagaagggcagcctggtgaagaacctgaaggacaccctggcccagaggctgctgcgggtgccctag

SEQ ID NO: 161304 - DNA, 252 bp, Artificial Sequence; identical to SEQ ID NO: 161303
  Description of Artificial Sequence: Synthetic coding sequence

SEQ ID NO: 161305 - DNA, 2169 bp, Artificial Sequence
  Description of Artificial Sequence: Synthetic coding sequence
atgtaccgggccctgtatgccttccgctctgctgagcccaatgccctggcctttgctgctggggagaccttcctggtgctggagaggagcagcgcccactggtggctggccgcccgggcccggagcggggagaccggctacgtgcccccagcctacctgcggcggctgcagggcctggagcaggatgtgctgcaggccatcgaccgggccattgaagctgtgcacaacacagccatgagagatggcggcaagtacagcctggagcagaggggcgtgctgcagaagctgatccaccacaggaaggagaccctgagccggcggggccccagcgccagctctgtggccgtgatgaccagcagcaccagtgaccaccacctggatgctgctgctgcccggcagcccaatggagtgtgccgggccggctttgagcggcagcacagcctgcccagcagcgagcacctgggcgcagatggcggcctgtaccagatccccctgcccagcagccagatccccccccagcccaggagagctgcccccaccaccccacctcctcctgtgaagaggcgggaccgggaggccctgatggccagcggcagcggcggccacaacaccatgcccagcggcggcaacagcgtgagcagcggcagctctgtgagcagcaccagcctggacaccctgtacaccagcagcagccccagcgagcccggcagcagctgcagccccaccccacctcctgtgccccggcggggcacccacaccaccgtgtcccaggtgcagcccccacccagcaaggccagcgcccctgagcccccagctgaggaggaggtggccaccggcaccaccagcgccagtgatgacctggaggccctgggcaccctgagcctgggcaccacagaggagaaggctgctgctgaggccgctgtgcccaggaccatcggggctgagctgatggagctggtgagaagaaacacaggcctgagccatgagctgtgccgggtggccatcggcatcatcgtgggccacatccaggcctctgtgcctgccagcagccctgtgatggagcaggtgctgctgagcctggtggagggcaaggacctgtccatggccctgcccagcggccaggtgtgccacgaccagcagaggctggaggtgatctttgctgacctggcccggaggaaggatgatgcccagcagaggtcctgggccctgtatgaagatgagggcgtcatccgctgctacctggaggagctgctgcacatcctgacagatgctgaccctgaggtgtgcaagaagatgtgcaagagaaatgaatttgagagcgtgctggccctggtggcctactaccagatggagcaccgggccagcctgcggctgctgctgctgaagtgcttcggggccatgtgcagcctggatgctgccatcatcagcaccctggtgtcctctgtgctgcctgtggagctggcccgggacatgcagacagacacccaggaccaccagaagctgtgctacagcgccctgatcctggccatggtgttctccatgggagaggccgtgccctatgcccactatgagcacctgggcaccccatttgcccagttcctgctgaacatcgtggaggatggcctgcccctggacaccacagagcagctgcctgacctgtgtgtgaacctgctgctggccctgaacctgcacctgcctgctgctgaccagaatgtcatcatggccgccctgagcaagcacgccaacgtgaagatcttcagcgagaagctgctgctgctgctgaacagaggagatgatcctgtgcgcatcttcaagcatgagccccagcccccccacagcgtgctgaagttcctgcaggatgtgtttggcagccctgccacagctgccatcttctaccacacagacatgatggccctgattgacatcaccgtgcgccacatcgctgacctgagccctggggacaagctgaggatggagtacctgagcctgatgcacgccatcgtgaggaccaccccctacctgcagcaccgccaccggctgcctgacctgcaggccatcctgcggcgcatcctgaatgaggaggagaccagcccccagtgccagatggacaggatgattgtgcgggagatgtgcaaggagttcctggtgctgggggaggcccccagctag

SEQ ID NO: 161306 - DNA, 2169 bp, Artificial Sequence
  Description of Artificial Sequence: Synthetic coding sequence
atgtaccgggccctgtatgccttccgctctgctgagcccaatgccctggcctttgctgctggggagaccttcctggtgctggagaggagcagcgcccactggtggctggccgcccgggcccggagcggggagaccggctacgtgcccccagcctacctgcggcggctgcagggcctggagcaggatgtgctgcaggccatcgaccgggccattgaagctgtgcacaacacagccatgagagatggcggcaagtacagcctggagcagaggggcgtgctgcagaagctgatccaccacaggaaggagaccctgagccggcggggccccagcgccagctctgtggccgtgatgaccagcagcaccagtgaccaccacctggatgctgctgctgcccggcagcccaatggagtgtgccgggccggctttgagcggcagcacagcctgcccagcagcgagcacctgggcgcagatggcggcctgtaccagatccccctgcccagcagccagatccccccccagcccaggagagctgcccccaccaccccacctcctcctgtgaagaggcgggaccgggaggccctgatggccagcggcagcggcggccacaacaccatgcccagcggcggcaacagcgtgagcagcggcagctctgtgagcagcaccagcctggacaccctgtacaccagcagcagccccagcgagcccggcagcagctgcagccccaccccacctcctgtgccccggcggggcacccacaccaccgtgtcccaggtgcagcccccacccagcaaggccagcgcccctgagcccccagctgaggaggaggtggccaccggcaccaccagcgccagtgatgacctggaggccctgggcaccctgagcctgggcaccacagaggagaaggctgctgctgaggccgctgtgcccaggaccatcggggctgagctgatggagctggtgagaagaaacacaggcctgagccatgagctgtgccgggtggccatcggcatcatcgtgggccacatccaggcctctgtgcctgccagcagccctgtgatggagcaggtgctgctgagcctggtggagggcaaggacctgtccatggccctgcccagcggccaggtgtgccacgaccagcagaggctggaggtgatctttgctgacctggcccggaggaaggatgatgcccagcagaggtcctgggccctgtatgaagatgagggcgtcatccgctgctacctggaggagctgctgcacatcctgacagatgctgaccctgaggtgtgcaagaagatgtgcaagagaaatgaatttgagagcgtgctggccctggtggcctactaccagatggagcaccgggccagcctgcggctgctgctgctgaagtgcttcggggccatgtgcagcctggatgctgccatcatcagcaccctggtgtcctctgtgctgcctgtggagctggcccgggacatgcagacagacacccaggaccaccagaagctgtgctacagcgccctgatcctggccatggtgttctccatgggagaggccgtgccctatgcccactatgagcacctgggcaccccatttgcccagttcctgctgaacatcgtggaggatggcctgcccctggacaccacagagcagctgcctgacctgtgtgtgaacctgctgctggccctgaacctgcacctgcctgctgctgaccagaatgtcatcatggccgccctgagcaagcacgccaacgtgaagatcttcagcgagaagctgctgctgctgctgaacagaggagatgatcctgtgcgcatcttcaagcatgagccccagcccccccacagcgtgctgaagttcctgcaggatgtgtttggcagccctgccacagctgccatcttctaccacacagacatgatggccctgattgacatcaccgtgcgccacatcgctgacctgagccctggggacaagggcccctttggagctggccagaggccctggccaggagtgccccggctgctggagcccggcagcacccccagccgggagccccaccctgtggagaggtctggagtgcctgccctgaccagctcctgggccagcggctgcccccggcccctgcacccagccctgcagctggtgattgattctgcctttggaggccgctctgtgtag

SEQ ID NO: 161307 - DNA, 2148 bp, Artificial Sequence
  Description of Artificial Sequence: Synthetic coding sequence
atgtaccgggccctgtatgccttccgctctgctgagcccaatgccctggcctttgctgctggggagaccttcctggtgctggagaggagcagcgcccactggtggctggccgcccgggcccggagcggggagaccggctacgtgcccccagcctacctgcggcggctgcagggcctggagcaggatgtgctgcaggccatcgaccgggccattgaagctgtgcacaacacagccatgagagatggcggcaagtacagcctggagcagaggggcgtgctgcagaagctgatccaccacaggaaggagaccctgagccggcggggccccagcgccagctctgtggccgtgatgaccagcagcaccagtgaccaccacctggatgctgctgctgcccggcagcccaatggagtgtgccgggccggctttgagcggcagcacagcctgcccagcagcgagcacctgggcgcagatggcggcctgtaccagatccccccccagccccggcgggccgcccccaccaccccacctcctcctgtgaagagaagagaccgggaggccctgatggccagcggcagcggcggccacaacaccatgcccagcggcggcaacagcgtgagcagcggcagctctgtgagcagcaccagcctggacaccctgtacaccagcagcagccccagcgagcccggcagcagctgcagccccaccccacctcctgtgccccggcggggcacccacaccaccgtgtcccaggtgcagcccccacccagcaaggccagcgcccctgagcccccagctgaggaggaggtggccaccggcaccaccagcgccagtgatgacctggaggccctgggcaccctgagcctgggcaccacagaggagaaggctgctgctgaggccgctgtgcccaggaccatcggggctgagctgatggagctggtgagaagaaacacaggcctgagccatgagctgtgccgggtggccatcggcatcatcgtgggccacatccaggcctctgtgcctgccagcagccctgtgatggagcaggtgctgctgagcctggtggagggcaaggacctgtccatggccctgcccagcggccaggtgtgccacgaccagcagaggctggaggtgatctttgctgacctggcccggaggaaggatgatgcccagcagaggtcctgggccctgtatgaagatgaaggagtcatccgctgctacctggaggagctgctgcacatcctgacagatgctgaccctgaggtgtgcaagaagatgtgcaagagaaatgaatttgaatctgtgctggccctggtggcctactaccagatggagcaccgggccagcctgcggctgctgctgctgaagtgctttggagccatgtgcagcctggatgctgccatcatcagcaccctggtgtcctctgtgctgcctgtggagctggcccgggacatgcagacagacacccaggaccaccagaagctgtgctacagcgccctgatcctggccatggtgttctccatgggagaggccgtgccctatgcccactatgagcacctgggcaccccatttgcccagttcctgctgaacatcgtggaggatggcctgcccctggacaccacagagcagctgcctgacctgtgtgtgaacctgctgctggccctgaacctgcacctgcctgctgctgaccagaatgtcatcatggccgccctgagcaagcacgccaacgtgaagatcttcagcgagaagctgctgctgctgctgaacagaggagatgatcctgtgcgcatcttcaagcatgagccccagcccccccacagcgtgctgaagttcctgcaggatgtgtttggcagccctgccacagctgccatcttctaccacacagacatgatggccctgattgacatcaccgtgcgccacatcgctgacctgagccctggggacaagctgaggatggagtacctgagcctgatgcacgccatcgtgaggaccaccccctacctgcagcaccgccaccggctgcctgacctgcaggccatcctgcggcgcatcctgaatgaggaggagaccagcccccagtgccagatggacaggatgattgtgcgggagatgtgcaaggagttcctggtgctgggggaggcccccagctag

SEQ ID NO: 161308 - DNA, 3405 bp, Artificial Sequence
  Description of Artificial Sequence: Synthetic coding sequence
atgagccgctctgtgctgcagcccagccagcagaagctggccgagaagctgaccatcctgaatgaccggggcgtgggcatgctgacccggctgtacaacatcaagaagcagggccaggtgtggaaggcctgtggggaccccaaggccaagcccagctacctgattgacaagaacctggagagcgctgtgaagttcatcgtgaggaagtttcctgctgtggagaccaggaacaacaaccagcagctggcccagctgcagaaggagaagtctgagatcctgaagaacctggccctgtactacttcacctttgtggatgtgatggagttcaaggaccacgtgtgtgagctgctgaacaccattgatgtgtgccaggtgttctttgacatcaccgtgaactttgacctgaccaagaactacctggacctgatcatcacctacaccaccctgatgatcctgctgagccgcatcgaggagaggaaggccatcatcggcctgtacaactatgcccacgagatgacccacggggccagtgaccgggagtacccccggctgggccagatgattgtggactatgagaaccccctgaagaagatgatggaggagtttgtgccccacagcaagagcctgagtgatgccctgatcagcctgcagatggtgtaccccaggaggaacctgtctgctgaccagtggagaaatgcccagctgctgagcctcatcagcgcccccagcaccatgctgaacccagcccagagcgacaccatgccctgtgagtacctgagcctggatgccatggagaagtggatcatcttcggcttcatcctgtgccacggcatcctgaacacagatgccacagccctgaacctgtggaagctggccctgcagagcagcagctgcctgagcctcttcagagatgaggtgttccacatccacaaggctgctgaggacctgtttgtgaacatccggggctacaacaagaggatcaatgacatccgggagtgcaaggaggccgctgtgtcccatgctggctccatgcaccgggagaggaggaagttcctgcggagcgccctgaaggagctggccaccgtgctgagtgaccagcccggcctgctgggccccaaggccctgtttgtgttcatggccctgagctttgccagagatgagatcatctggctgctgcggcatgctgacaacatgcccaagaagtctgcagatgacttcatcgacaagcacatcgccgagctgatcttctacatggaggagctgcgggcccacgtgaggaaatatggccctgtgatgcagcgctactacgtgcagtacctgagcggctttgatgctgtggtgctgaatgagctggtgcagaacctgtctgtgtgcccagaagatgagagcatcatcatgagcagctttgtgaacaccatgaccagcctgtctgtgaagcaggtggaggatggagaggtgtttgacttccggggcatgaggctggactggttccggctgcaggcctacacctctgtgtccaaggccagcctgggcctggccgaccaccgggagctgggcaagatgatgaacaccatcatcttccacaccaagatggtggacagcctggtggagatgctggtggagaccagtgacctgagcatcttctgcttctacagccgggcctttgagaagatgttccagcagtgcctggagctgcccagccagagccgctacagcatcgccttccccctgctgtgcacccacttcatgagctgcacccatgagctgtgcccagaggagcggcaccacatcggggacaggagcctgagcctgtgcaacatgttcctggatgagatggccaagcaggccaggaacctgatcacagacatctgcacagagcagtgcaccctgagtgaccagctgctgcccaagcactgtgccaagaccatcagccaggccgtgaacaagaagagcaagaagcagacaggcaagaagggggagcctgagcgggagaagccaggagtggagagcatgaggaagaaccggctggtggtgaccaacctggacaagctgcacacagccctgtctgagctgtgcttcagcatcaactacgtgcccaacatggtggtgtgggagcacaccttcaccccccgggagtacctgaccagccacctggagatccgcttcaccaagagcatcgtgggcatgaccatgtacaaccaggccacccaggagatcgccaagcccagcgagctgctgacctctgtgcgggcctacatgacagtgctgcagagcattgagaactacgtgcagattgacatcaccagggtcttcaacaacgtgctgctgcagcagacccagcacctggacagccatggagagcccaccatcaccagcctgtacaccaactggtacctggagaccctgctgcggcaggtgtccaatggccacatcgcctacttccctgccatgaaggcctttgtgaacctgcccacagaaaatgagctgaccttcaatgctgaggagtacagcgacatcagcgagatgaggagcctgtctgagctgctgggcccctacggcatgaagttcctgtctgagagcctgatgtggcacatcagcagccaggtggccgagctgaagaagctggtggtggagaatgtggatgtgctgacccagatgaggaccagctttgacaagccagaccagatggccgccctcttcaagaggctgagctctgtggacagcgtgctgaagaggatgaccatcatcggggtcatcctgtccttccgcagcctggcccaggaggccctgagagatgtgctgagctaccacatccccttcctggtgagcagcattgaggacttcaaggaccacatcccccgggagacagacatgaaggtggccatgaatgtgtatgagctgagcagcgctgctggcctgccctgtgaaattgatcctgccctggtggtggccctgagcagccagaagtctgagaacatcagccctgaggaggagtacaagatcgcctgcctgctgatggtgtttgtggccgtgtccctgcccaccctggccagcaatgtgatgagccagtacagccctgccatcgagggccactgcaacaacatccactgcctggccaaggccatcaaccagattgctgctgccctcttcaccatccacaagggcagcattgaggaccggctgaaggagttcctggccctggccagcagcagcctgctgaagattggccaggagacagacaagaccaccaccaggaaccgggagagcgtgtacctgctgctggacatgattgtgcaggagagccccttcctgaccatggacctgctggagagctgcttcccctacgtgctgctgagaaatgcctaccacgctgtgtacaagcagagcgtgaccagcagcgcctag

SEQ ID NO: 161309 - DNA, 3387 bp, Artificial Sequence
  Description of Artificial Sequence: Synthetic coding sequence
atgagccgctctgtgctgcagcccagccagcagaagctggccgagaagctgaccatcctgaatgaccggggcgtgggcatgctgacccggctgtacaacatcaagaaggcctgtggggaccccaaggccaagcccagctacctgattgacaagaacctggagagcgctgtgaagttcatcgtgaggaagtttcctgctgtggagaccaggaacaacaaccagcagctggcccagctgcagaaggagaagtctgagatcctgaagaacctggccctgtactacttcacctttgtggatgtgatggagttcaaggaccacgtgtgtgagctgctgaacaccattgatgtgtgccaggtgttctttgacatcaccgtgaactttgacctgaccaagaactacctggacctgatcatcacctacaccaccctgatgatcctgctgagccgcatcgaggagaggaaggccatcatcggcctgtacaactatgcccacgagatgacccacggggccagtgaccgggagtacccccggctgggccagatgattgtggactatgagaaccccctgaagaagatgatggaggagtttgtgccccacagcaagagcctgagtgatgccctgatcagcctgcagatggtgtaccccaggaggaacctgtctgctgaccagtggagaaatgcccagctgctgagcctcatcagcgcccccagcaccatgctgaacccagcccagagcgacaccatgccctgtgagtacctgagcctggatgccatggagaagtggatcatcttcggcttcatcctgtgccacggcatcctgaacacagatgccacagccctgaacctgtggaagctggccctgcagagcagcagctgcctgagcctcttcagagatgaggtgttccacatccacaaggctgctgaggacctgtttgtgaacatccggggctacaacaagaggatcaatgacatccgggagtgcaaggaggccgctgtgtcccatgctggctccatgcaccgggagaggaggaagttcctgcggagcgccctgaaggagctggccaccgtgctgagtgaccagcccggcctgctgggccccaaggccctgtttgtgttcatggccctgagctttgccagagatgagatcatctggctgctgcggcatgctgacaacatgcccaagaagtctgcagatgacttcatcgacaagcacatcgccgagctgatcttctacatggaggagctgcgggcccacgtgaggaaatatggccctgtgatgcagcgctactacgtgcagtacctgagcggctttgatgctgtggtgctgaatgagctggtgcagaacctgtctgtgtgcccagaagatgagagcatcatcatgagcagctttgtgaacaccatgaccagcctgtctgtgaagcaggtggaggatggagaggtgtttgacttccggggcatgaggctggactggttccggctgcaggcctacacctctgtgtccaaggccagcctgggcctggccgaccaccgggagctgggcaagatgatgaacaccatcatcttccacaccaagatggtggacagcctggtggagatgctggtggagaccagtgacctgagcatcttctgcttctacagccgggcctttgagaagatgttccagcagtgcctggagctgcccagccagagccgctacagcatcgccttccccctgctgtgcacccacttcatgagctgcacccatgagctgtgcccagaggagcggcaccacatcggggacaggagcctgagcctgtgcaacatgttcctggatgagatggccaagcaggccaggaacctgatcacagacatctgcacagagcagtgcaccctgagtgaccagctgctgcccaagcactgtgccaagaccatcagccaggccgtgaacaagaagagcaagaagcagacaggcaagaagggggagcctgagcgggagaagccaggagtggagagcatgaggaagaaccggctggtggtgaccaacctggacaagctgcacacagccctgtctgagctgtgcttcagcatcaactacgtgcccaacatggtggtgtgggagcacaccttcaccccccgggagtacctgaccagccacctggagatccgcttcaccaagagcatcgtgggcatgaccatgtacaaccaggccacccaggagatcgccaagcccagcgagctgctgacctctgtgcgggcctacatgacagtgctgcagagcattgagaactacgtgcagattgacatcaccagggtcttcaacaacgtgctgctgcagcagacccagcacctggacagccatggagagcccaccatcaccagcctgtacaccaactggtacctggagaccctgctgcggcaggtgtccaatggccacatcgcctacttccctgccatgaaggcctttgtgaacctgcccacagaaaatgagctgaccttcaatgctgaggagtacagcgacatcagcgagatgaggagcctgtctgagctgctgggcccctacggcatgaagttcctgtctgagagcctgatgtggcacatcagcagccaggtggccgagctgaagaagctggtggtggagaatgtggatgtgctgacccagatgaggaccagctttgacaagccagaccagatggccgccctcttcaagaggctgagctctgtggacagcgtgctgaagaggatgaccatcatcggggtcatcctgtccttccgcagcctggcccaggaggccctgagagatgtgctgagctaccacatccccttcctggtgagcagcattgaggacttcaaggaccacatcccccgggagacagacatgaaggtggccatgaatgtgtatgagctgagcagcgctgctggcctgccctgtgaaattgatcctgccctggtggtggccctgagcagccagaagtctgagaacatcagccctgaggaggagtacaagatcgcctgcctgctgatggtgtttgtggccgtgtccctgcccaccctggccagcaatgtgatgagccagtacagccctgccatcgagggccactgcaacaacatccactgcctggccaaggccatcaaccagattgctgctgccctcttcaccatccacaagggcagcattgaggaccggctgaaggagttcctggccctggccagcagcagcctgctgaagattggccaggagacagacaagaccaccaccaggaaccgggagagcgtgtacctgctgctggacatgattgtgcaggagagccccttcctgaccatggacctgctggagagctgcttcccctacgtgctgctgagaaatgcctaccacgctgtgtacaagcagagcgtgaccagcagcgcctag

SEQ ID NO: 161310 - DNA, 2649 bp, Artificial Sequence
  Description of Artificial Sequence: Synthetic coding sequence
atgcctgccctggcctgcctgcggcggctgtgcagacatgtgagcccccaggccgtgctcttcctgctcttcatcttctgcctcttcagcgtcttcatcagcgcctactacctgtatggctggaagaggggcctggagcccagcgcagatgcccctgagccagactgtggggaccccccacctgtggcccccagccggctgctgcccctgaagcctgtgcaggccgccacccccagcaggacagaccccctggtgctggtgtttgtggagagcctgtacagccagctgggccaggaggtggtggccatcctggagagcagccgcttcaagtacagaacagaaattgcccctggaaaaggagacatgcccaccctgacagacaagggccggggccgctttgccctgatcatctatgagaacatcctgaagtatgtgaacctggatgcctggaaccgggagctgctggacaagtactgtgtggcctacggcgtgggcatcatcggcttcttcaaggccaatgaaaacagcctgctgagcgcccagctgaagggcttccccctcttcctgcacagcaacctgggcctgaaggactgcagcatcaaccccaagagccccctgctgtatgtgacccggcccagcgaggtggagaagggcgtgctgcctggagaggactggacagtgttccagagcaaccacagcacctatgagcctgtgctgctggccaagaccaggagcagcgagagcatcccccacctgggcgcagatgctggcctgcacgccgccctgcacgccaccgtggtgcaggacctgggcctgcatgatggcatccagagggtgctgtttggaaacaacctgaacttctggctgcacaagctggtgtttgtggatgctgtggccttcctgaccgggaagaggctgagcctgcccctggaccgctacatcctggtggacattgatgacatctttgtgggcaaggagggcaccaggatgaaggtggaggatgtgaaggccctgtttgacacccagaatgagctgcgggcccacatccccaacttcaccttcaacctgggctacagcggcaagttcttccacacaggcaccaatgcagaagatgctggagatgacctgctgctgtcctatgtgaaggagttctggtggttcccccacatgtggagccacatgcagccccacctgttccacaaccagagcgtgctggccgagcagatggccctgaacaagaagtttgctgtggagcacggcatccccacagacatgggctatgctgtggccccccaccacagcggcgtgtaccctgtgcacgtgcagctgtatgaggcctggaagcaggtgtggagcatccgggtgaccagcacagaggagtacccccacctgaagccagcccgctaccgccggggcttcatccacaacggcatcatggtgctgccccggcagacctgtggcctcttcacccacaccatcttctacaatgagtacccaggcggcagcagcgagctggacaagatcatcaatggaggagagctgttcctgactgtgctgctgaaccccatcagcatcttcatgacccacctgagcaactatggaaatgaccggctgggcctgtacaccttcaagcacctggtgcgcttcctgcacagctggaccaacctgcggctgcagaccctgccccctgtgcagctggcccagaagtacttccagatcttcagcgaggagaaggaccccctgtggcaggacccctgtgaggacaagaggcacaaggacatctggagcaaggagaagacctgtgaccgcttccccaagctgctgatcatcggcccccagaagacaggcaccacagccctgtacctgttcctgggcatgcacccagacctgagcagcaactaccccagcagcgagacctttgaggagatccagttcttcaacggccacaactaccacaagggcatcgactggtacatggagttcttccccatccccagcaacaccaccagtgacttctactttgagaagagcgccaactactttgattctgaggtggccccccggcgggctgctgccctgctgcccaaggccaaggtgctgaccatcctgatcaacccagctgaccgggcctacagctggtaccagcaccagagggcccatgatgatcctgtggccctgaagtacaccttccatgaagtcatcacagctggcagtgatgccagcagcaagctgcgggccctgcagaaccgctgcctggtgcccggctggtacgccacccacatcgagcgctggctgagcgcctaccacgccaaccagatcctggtgctggatggcaagctgctgaggacagagcccgccaaggtgatggacatggtgcagaagttcctgggcgtgaccaacaccatcgactaccacaagaccctggcctttgaccccaagaagggcttctggtgccagctgctggagggcggcaagaccaagtgcctgggcaagagcaaaggaaggaagtacccagagatggacctggacagccgggccttcctgaaggactactacagagaccacaacatcgagctgagcaagctgctgtacaagatgggccagaccctgcccacctggctgcgggaggacctgcagaacaccaggtag

SEQ ID NO: 161311 - DNA, 72 bp, Artificial Sequence
  Description of Artificial Sequence: Synthetic coding sequence
atgcctgccctggcctgcctgcggcggctgtgcagacatgtgagcccccaggccgtgctcttcctgctgtag

SEQ ID NO: 161312 - DNA, 480 bp, Artificial Sequence
  Description of Artificial Sequence: Synthetic coding sequence
atgcctgccctggcctgcctgcggcggctgtgcagacatgtgagcccccaggccgtgctcttcctgctcttcatcttctgcctcttcagcgtcttcatcagcgcctactacctgtatggctggaagaggggcctggagcccagcgcagatgcccctgagccagactgtggggaccccccacctgtggcccccagccggctgctgcccctgaagcctgtgcaggccgccacccccagcaggacagaccccctggtgctggtgtttgtggagagcctgtacagccagctgggccaggaggtggtggccatcctggagagcagccgcttcaagtacagaacagaaattgcccctggaaaaggagacatgcccaccctgacagacaagggccggggccgctttgccctgatcatctatgagaacatcctgaagtatgtgaacctggatgcctggaaccgggagctgctggacaagtactgctag

SEQ ID NO: 161313 - DNA, 207 bp, Artificial Sequence
  Description of Artificial Sequence: Synthetic coding sequence
atgcctgccctggcctgcctgcggcggctgtgcagacatgtgagcccccaggccgtgctcttcctgctcttcatcttctgcctcttcagcgtcttcatcagcgcctactacctgtatggctggaagaggggcctggagcccagcgcagatgcccctgagccagactgtggggaccccccacctgtggcccccagccggctgctgtag

SEQ ID NO: 161314 - DNA, 2283 bp, Artificial Sequence
  Description of Artificial Sequence: Synthetic coding sequence
atgcccaccctgacagacaacacccacggccgctacgtgctggtgatctatgagaacctgctgaagtatgtgaacctggatgcctggagccgggagctgctggaccgctactgtgtggagtatggagtgggcatcatcggcttcttccgggcccacgagcacagcctgctgagcgcccagctgaagggcttccccctcttcctgcacagcaacctgggcctgcgggactaccaggtgaaccccagcgcccccctgctgcacctgacccggcccagccggctggagcccggccccctgcctggagatgactggaccatcttccagagcaaccacagcacctatgagcctgtgctgctggccagcctgcggcctgctgagcctgctgtgcccggccctgtgctgcggcgggcccggctgcccaccgtggtgcaggacctgggcctgcatgatggcatccagagggtgctgtttggacatggcctgtccttctggctgcacaagctgatctttgtggatgctgtggcctacctgaccgggaagaggctgtgcctggacctggaccgctacatcctggtggacattgatgacatctttgtgggcaaggagggcaccaggatgaaggtggctgatgtggaggccctgctgaccacccagaacaagctgcggaccctggtgcccaacttcaccttcaacctgggcttcagcggcaagttctaccacactggaacagaggaggaggatgctggagatgacatgctgctgaagcacaggaaggagttctggtggttcccccacatgtggagccacatgcagccccacctgttccacaacagatctgtgctggccgaccagatgaggctgaacaagcagtttgccctggagcacggcatccccacagacctgggctatgctgtggccccccaccacagcggcgtgtaccccatccacacccagctgtatgaggcctggaagtctgtgtggggcatccaggtgaccagcacagaggagtacccccacctgcggcctgcccgctaccgccggggcttcatccacaacggcatcatggtgctgccccggcagacctgtggcctcttcacccacaccatcttctacaatgagtacccaggcggcagccgggagctggacaggagcatccggggcggggagctgttcctgactgtgctgctgaaccccatcagcatcttcatgacccacctgagcaactatggaaatgaccggctgggcctgtacacctttgagagcctggtgcgcttcctgcagtgctggacccggctgcggctgcagaccctgccccctgtgcccctggcccagaagtactttgagctgttcccccaggagaggagccccctgtggcagaacccctgtgatgacaagaggcacaaggacatctggagcaaggagaagacctgtgaccggctgcccaagttcctgattgtgggcccccagaagacaggcaccacagccatccacttcttcctgagcctgcaccctgctgtgaccagcagcttccccagccccagcacctttgaggagatccagttcttcaacagccccaactaccacaagggcatcgactggtacatggacttcttccctgtgcccagcaatgccagcacagacttcctgtttgagaagagcgccacctactttgattctgaggtggtgcccaggagaggagctgccctgctgccccgggccaagatcatcaccgtgctgaccaacccagctgaccgggcctacagctggtaccagcaccagagggcccacggggaccctgtggccctgaactacaccttctaccaggtgatcagcgccagcagccagacccccctggccctgcggagcctgcagaaccgctgcctggtgcccggctactacagcacccacctgcagcgctggctgacctactaccccagcggccagctgctgattgtggatggccaggagctgcggaccaacccagctgcctccatggagagcatccagaagttcctgggcatcacccccttcctgaactacaccaggaccctgcgctttgatgatgacaagggcttctggtgccagggcctggagggcggcaagacccgctgcctgggccgcagcaaaggaagacgctacccagacatggacacagagagccgcctcttcctgacagacttcttcaggaaccacaacctggagctgagcaagctgctgagccggctgggccagcctgtgcccagctggctgcgggaggagctgcagcacagcagcctgggctag

SEQ ID NO: 161315 - DNA, 2652 bp, Artificial Sequence
  Description of Artificial Sequence: Synthetic coding sequence
atgctgcagctgtggaaggtggtgcggcctgcccggcagctggagctgcacaggctcatcctgctgctgattgccttcagcctgggctccatgggcttcctggcctactacgtgtccaccagccccaaggccaaggagcccctgcccctgcccctgggggactgcagcagtggaggagctgctggccctggccctgcccggccccctgtgcccccccggccccccaggcctcctgagacagccaggacagagcctgtggtgctggtgtttgtggagagcgcctacagccagctgggccaggagatcgtggccatcctggagagcagccgcttccgctacagcacagagctggcccctggccgcggggacatgcccaccctgacagacaacacccacggccgctacgtgctggtgatctatgagaacctgctgaagtatgtgaacctggatgcctggagccgggagctgctggaccgctactgtgtggagtatggagtgggcatcatcggcttcttccgggcccacgagcacagcctgctgagcgcccagctgaagggcttccccctcttcctgcacagcaacctgggcctgcgggactaccaggtgaaccccagcgcccccctgctgcacctgacccggcccagccggctggagcccggccccctgcctggagatgactggaccatcttccagagcaaccacagcacctatgagcctgtgctgctggccagcctgcggcctgctgagcctgctgtgcccggccctgtgctgcggcgggcccggctgcccaccgtggtgcaggacctgggcctgcatgatggcatccagagggtgctgtttggccacggcctgtccttctggctgcacaagctgatctttgtggatgctgtggcctacctgaccgggaagaggctgtgcctggacctggaccgctacatcctggtggacattgatgacatctttgtgggcaaggagggcaccaggatgaaggtggctgatgtggaggccctgctgaccacccagaacaagctgcggaccctggtgcccaacttcaccttcaacctgggcttcagcggcaagttctaccacactggaacagaggaggaggatgctggagatgacatgctgctgaagcacaggaaggagttctggtggttcccccacatgtggagccacatgcagccccacctgttccacaacagatctgtgctggccgaccagatgaggctgaacaagcagtttgccctggagcacggcatccccacagacctgggctatgctgtggccccccaccacagcggcgtgtaccccatccacacccagctgtatgaggcctggaagtctgtgtggggcatccaggtgaccagcacagaggagtacccccacctgcggcctgcccgctacagaagaggcttcatccacaacggcatcatggtgctgccccggcagacctgtggcctcttcacccacaccatcttctacaatgagtacccaggcggcagccgggagctggacaggagcatccggggcggggagctgttcctgactgtgctgctgaaccccatcagcatcttcatgacccacctgagcaactatggaaatgaccggctgggcctgtacacctttgagagcctggtgcgcttcctgcagtgctggacccggctgcggctgcagaccctgccccctgtgcccctggcccagaagtactttgagctgttcccccaggagaggagccccctgtggcagaacccctgtgatgacaagaggcacaaggacatctggagcaaggagaagacctgtgaccggctgcccaagttcctgattgtgggcccccagaagacaggcaccacagccatccacttcttcctgagcctgcaccctgctgtgaccagcagcttccccagccccagcacctttgaggagatccagttcttcaacagccccaactaccacaagggcatcgactggtacatggacttcttccctgtgcccagcaatgccagcacagacttcctgtttgagaagagcgccacctactttgacagcgaggtggtgcccaggagaggagctgccctgctgccccgggccaagatcatcaccgtgctgaccaacccagctgaccgggcctacagctggtaccagcaccagagggcccatggagaccctgtggccctgaactacaccttctaccaggtgatcagcgccagcagccagacccccctggccctgcggagcctgcagaaccgctgcctggtgcccggctactacagcacccacctgcagcgctggctgacctactaccccagcggccagctgctgattgtggatggccaggagctgcggaccaacccagctgcctccatggagagcatccagaagttcctgggcatcacccccttcctgaactacaccaggaccctgcgctttgatgatgacaagggcttctggtgccagggcctggagggcggcaagacccgctgcctgggccgcagcaagggccgccgctacccagacatggacacagagagccgcctcttcctgacagacttcttcaggaaccacaacctggagctgagcaagctgctgagccggctgggccagcctgtgcccagctggctgcgggaggagctgcagcacagcagcctgggctag

SEQ ID NO: 161316 - DNA, 450 bp, Artificial Sequence
  Description of Artificial Sequence: Synthetic coding sequence
ggggaccctgtggccctgaactacaccttctaccaggtgatcagcgccagcagccagacccccctggccctgcggagcctgcagaaccgctgcctggtgcccggctactacagcacccacctgcagcgctggctgacctactaccccagcggccagctgctgattgtggatggccaggagctgcggaccaacccagctgcctccatggagagcatccagaagttcctgggcatcacccccttcctgaactacaccaggaccctgcgctttgatgatgacaagggcttctggtgccagggcctggagggcggcaagacccgctgcctgggccgcagcaaaggaagacgctacccagacatggacacagaggtgtccaaggcccggggccggggcatccccctgcacttccaggacctgatcctgtgccccaccagctaccacttctgctag

SEQ ID NO: 161317 - DNA, 696 bp, Artificial Sequence
  Description of Artificial Sequence: Synthetic coding sequence
atgagggtgcctgtgtttgaggacatcaaggatgaaacagaggaggagaagatcggggaggaggagaatgaggaggaccaggtgttctacaagcctgtgattgaggacctgtccatggagctggccaggaagtgcacagagctgatcagtgacatccgctacaaggaggagttcaagaagagcaaggacaagtgcacctttgtgacagacagccccatgctgaaccacgtgaagaacatcggggccttcatcagcgaggccaagtacaagggcaccatcaaggctgacctgagcaacagcctgtacaagaggatgcctgccaccattgattctgtgtttgctggggaggtgacccagctgcagagcgaggtggcctacaagcagaagcatgatgctgccaagggcttcagtgactatgcccacatgaaggagcccccagaggtgaagcacgccatggaggtgaacaagcaccagagcaacatctcctacaggaaggatgtgcaggacacccacacctacagcgctgagctggacagaccagacatcaagatggccacccagatcagcaagatcatcagcaatgctgagtacaagaagggccagggcatcatgaacaaggagcctgctgtgattggccgcccagactttgagcacgctgtggaggccagcaagctgagcagccaggtgcggctgtag

SEQ ID NO: 161318 - DNA, 3045 bp, Artificial Sequence
  Description of Artificial Sequence: Synthetic coding sequence
atgagggtgcctgtgtttgaggacatcaaggatgaaacagaggaggagaagatcggggaggaggagaatgaggaggaccaggtgttctacaagcctgtgattgaggacctgtccatggagctggccaggaagtgcacagagctgatcagtgacatccgctacaaggaggagttcaagaagagcaaggacaagtgcacctttgtgacagacagccccatgctgaaccacgtgaagaacatcggggccttcatcagcgaggccaagtacaagggcaccatcaaggctgacctgagcaacagcctgtacaagaggatgcctgccaccattgattctgtgtttgctggggaggtgacccagctgcagagcgaggtggcctacaagcagaagcatgatgctgccaagggcttcagtgactatgcccacatgaaggagcccccagaggtgaagcacgccatggaggtgaacaagcaccagagcaacatctcctacaggaaggatgtgcaggacacccacacctacagcgctgagctggacagaccagacatcaagatggccacccagatcagcaagatcatcagcaatgctgagtacaagaagggccagggcatcatgaacaaggagcctgctgtgattggccgcccagactttgagcacgctgtggaggccagcaagctgagcagccagatcaagtacaaggagaagtttgacaatgagatgaaggacaagaagcaccactacaaccccctggagagcgccagcttccggcagaaccagctggccgccaccctggccagcaatgtgaagtacaagaaggacatccagaacatgcatgaccctgtgtctgacctgcccaacctgctcttcctggaccacgtgctgaaggccagcaagatgctgagcggccgggagtacaagaagctgtttgaggagaacaagggcatgtaccactttgatgctgatgctgtggagcacctgcaccacaagggaaatgctgtgctgcagagccaggtgaagtacaaggaggagtatgagaagaacaagggcaagcccatgctggagtttgtggagacccccagctaccaggccagcaaggaggcccagaagatgcagagcgagaaggtgtacaaggaggactttgagaaggagatcaagggccgcagcagcctggacctggacaagaccccagagttcctgcacgtgaagtacatcaccaacctgctgcgggagaaggagtacaagaaggacctggagaatgagatcaagggcaagggcatggagctgaacagcgaggtgctggacatccagagggccaagagggccagcgagatggccagcgagaaggagtacaagaaggacctggagagcatcatcaagggcaagggcatgcaggccggcacagacaccctggagatgcagcacgccaagaaggctgctgagatcgccagcgagaaggactacaagagggacctggagacagagatcaagggcaagggcatgcaggtgtccacagacaccctggatgtgcagagggccaagaaggccagcgagatggccagccagaagcagtacaagaaggacctggagaatgagatcaagggcaagggcatgcaggtgtccatggacatcccagacatcctgcgggccaagaggaccagcgagatctacagccagaggaagtacaaggatgaggccgagaagatgctgagcaactacagcaccatcgctgacaccccagagatccagaggatcaagaccacccagcagaacatctctgctgtgttctacaagaaggaggtgggcgccggcacagctgtgaaggacagccctgagattgagcgggtgaagaagaaccagcagaacatcagctctgtgaagtacaaggaggagatcaagcacgccacagccatcagtgaccccccagagctgaagagggtgaaggagaaccagaagaacatcagcaacctgcagtacaaggagcagaactacaaggccacccctgtgtccatgaccccagaaattgagcgggtgagaagaaaccaggagcagctgtctgctgtgaagtacaagggggagctgcagaggggcacagccatcagtgaccccccagagctgaagagggccaaggagaaccagaagaacatcagcaatgtgtactaccggggccagctgggccgggccaccaccctgtctgtgaccccagagatggagcgggtgaagaagaaccaggagaacatcagctctgtgaagtacacccaggaccacaagcagatgaagggccggcccagcctcatcctggacaccccagccatgagacatgtgaaggaggcccagaaccacatctccatggtgaagtaccatgaagattttgagaagaccaagggccggggcttcacccctgtggtggatgatcctgtgacagagcgggtgaggaagaacacccaggtggtgtctgatgctgcctacaagggcgtgcacccccacatcgtggagatggacagaagacctggcatcatcgtggacctgaaggtgtggaggacagaccccggcagcatctttgacctggaccccctggaggacaacatccagagccgcagcctgcacatgctgtctgagaaggccagccactacagaagacactggagccgcagccacagcagcagcacctttggaacaggcctgggagatgacagaagtgagatcagcgagatctaccccagcttcagctgctgcagcgaggtgacccggcccagtgatgagggcgcccctgtgctgcccggggcctaccagcagagccacagccagggctacggctacatgcaccagacctctgtgtcctccatgaggtccatgcagcacagccccaacctgcggacctaccgggccatgtatgactacagcgcccaggatgaagatgaggtgtccttcagagatggagactacatcgtgaatgtgcagcccattgatgatggctggatgtatggaacagtgcagaggactggaagaacaggcatgctgcctgccaactacatcgagtttgtgaactag

SEQ ID NO: 161319 - DNA, 711 bp, Artificial Sequence
  Description of Artificial Sequence: Synthetic coding sequence
atgctgcacttctactatgagtggctgcacagcggcagcagaggagctgtgcccaagcccctgcactaccccaagcagagcttcaccaccgtggccgacaccccagagaacctgcggctgaagcagcagagcgagctgcagagccaggtgaagtacaagagggactttgaggagagcaagggccggggcttcagcatcgtgacagacaccccagagctgcagaggctgaagaggacccaggagcagatcagcaatgtgaagtaccacgaggactttgagaagaccaagggccggggcttcacccctgtggtggatgatcctgtgacagagcgggtgaggaagaacacccaggtggtgtctgatgctgcctacaagggcgtgcacccccacatcgtggagatggaccggcggcccggcatcatcgtggcccctgtgctgcccggggcctaccagcagagccacagccagggctacggctacatgcaccagacctctgtgtcctccatgaggtccatgcagcacagccccaacctgcggacctaccgggccatgtatgactacagcgcccaggatgaagatgaggtgtccttcagagatggagactacatcgtgaatgtgcagcccattgatgatggctggatgtatggaacagtgcagaggactggaagaacaggcatgctgcctgccaactacatcgagtttgtgaactag

SEQ ID NO: 161320 - DNA, 813 bp, Artificial Sequence
  Description of Artificial Sequence: Synthetic coding sequence
atgaacccccagtgtgcccgctgtgggaaggtggtgtaccccacagagaaggtgaactgcctggacaagtactggcacaagggctgcttccactgtgaggtgtgcaagatggccctgaacatgaacaactacaagggctatgagaagaagccctactgcaatgcccactaccccaagcagagcttcaccaccgtggccgacaccccagagaacctgcggctgaagcagcagagcgagctgcagagccaggtgaagtacaagagggactttgaggagagcaagggccggggcttcagcatcgtgacagacaccccagagctgcagaggctgaagaggacccaggagcagatcagcaatgtgaagtaccacgaggactttgagaagaccaagggccggggcttcacccctgtggtggatgatcctgtgacagagcgggtgaggaagaacacccaggtggtgtctgatgctgcctacaagggcgtgcacccccacatcgtggagatggaccggcggcccggcatcatcgtggcccctgtgctgcccggggcctaccagcagagccacagccagggctacggctacatgcaccagacctctgtgtcctccatgaggtccatgcagcacagccccaacctgcggacctaccgggccatgtatgactacagcgcccaggatgaagatgaggtgtccttcagagatggagactacatcgtgaatgtgcagcccattgatgatggctggatgtatggaacagtgcagaggactggaagaacaggcatgctgcctgccaactacatcgagtttgtgaactag

SEQ ID NO: 161321 - DNA, 354 bp, Artificial Sequence
  Description of Artificial Sequence: Synthetic coding sequence
atgaggaacaactgcacagccagcctgatgaaggtgttctacaagcctgtgattgaggacctgtccatggagctggccaggaagtgcacagagctgatcagtgacatccgctacaaggaggagttcaagaagagcaaggacaagtgcacctttgtgacagacagccccatgctgaaccacgtgaagaacatcggggccttcatcagcgaggccaagtacaagggcaccatcaaggctgacctgagcaacagcctgtacaagaggatgcctgccaccattgattctgtgtttgctggggaggtgacccagctgcagagcgaggtggcctacaagcagaagcatgatgctgcctag

SEQ ID NO: 161322 - DNA, 20010 bp, Artificial Sequence
  Description of Artificial Sequence: Synthetic coding sequence
atggctgatgatgaagattatgaggaggtggtggagtactacacagaggaggtggtgtatgaggaggtgcctggagagaccatcaccaagatctatgagaccaccaccaccaggaccagtgactatgagcagagcgagaccagcaagccagccctggcccagcctgccctggcccagcctgccagcgccaagcctgtggagaggaggaaggtgatcaggaagaaggtggaccccagcaagttcatgaccccctacatcgcccacagccagaagatgcaggacctcttcagccccaacaagtacaaggagaagtttgagaagaccaagggccagccctatgccagcaccacagacaccccagagctgcggcgcatcaagaaggtgcaggaccagctgtctgaggtgaagtacaggatggatggagatgtggccaagaccatctgccacgtggatgagaaggccaaggacattgaacatgccaagaaggtgtcccagcaggtgtccaaggtgctgtacaagcagaactgggaggacaccaaggacaagtacctgctgcccccagatgcccctgagctggtgcaggccgtgaagaacacagccatgttcagcaagaagctgtacacagaggactgggaggccgacaagagcctcttctacccctacaatgacagccctgagctgcggcgggtggcccaggcccagaaggccctgagtgatgtggcctacaagaagggcctggccgagcagcaggcccagttcacccccctggccgaccccccagacatcgagtttgccaagaaggtgaccaaccaggtgtccaagcagaagtacaaggaggactatgagaacaagatcaagggcaagtggagcgagaccccctgctttgaggtggccaatgccaggatgaatgctgacaacatcagcaccaggaagtaccaggaggactttgagaacatgaaggaccagatctacttcatgcagacagagaccccagagtacaagatgaacaagaaggccggcgtggccgccagcaaggtgaagtacaaggaggactatgagaagaacaagggcaaggctgactacaacgtgctgcctgccagcgagaacccccagctgcggcagctgaaggctgctggagatgccctgagtgacaagctgtacaaggaaaattatgagaagaccaaggccaagagcatcaactactgtgagacccccaagttcaagctggacacagtgctgcagaacttcagcagtgacaagaagtacaaggacagctacctgaaggacatcctgggccactacgtgggcagctttgaggacccctaccacagccactgcatgaaggtgacagcccagaacagcgacaagaactacaaggccgagtatgaggaggaccggggcaagggcttcttcccccagaccatcacccaggagtatgaggccatcaagaagctggaccagtgcaaggaccacacctacaaggtgcacccagacaagaccaagttcacccaggtgacagacagccctgtgctgctgcaggcccaggtgaacagcaagcagctgagtgacctgaactacaaggccaagcatgagagcgagaagttcaagtgccacatccccccagacaccccagccttcatccagcacaaggtgaatgcctacaacctgagtgacaacctgtacaagcaggactgggagaagagcaaggccaagaagtttgacatcaaggtggatgccatccccctgctggccgccaaggccaacaccaagaacaccagtgatgtgatgtacaagaaggactatgagaagaacaagggcaagatgattggagtgctgagcatcaatgatgaccccaagatgctgcacagcctgaaggtggccaagaaccagagcgaccggctgtacaaggaaaattatgagaagaccaaggccaagtccatgaactactgtgagacccccaagtaccagctggacacccagctgaagaacttcagcgaggcccgctacaaggacctgtatgtgaaggatgtgctgggccactacgtgggctccatggaggacccctaccacacccactgcatgaaggtggccgcccagaacagcgacaagagctacaaggccgagtatgaagaagataaaggcaagtgctacttcccccagaccatcacccaggagtatgaggccatcaagaagctggaccagtgcaaggaccacacctacaaggtgcacccagacaagaccaagttcaccgctgtgacagacagccctgtgctgctgcaggcccagctgaacaccaagcagctgagtgacctgaactacaaggccaagcatgaaggagagaagttcaagtgccacatcccagcagatgccccccagttcatccagcaccgggtgaatgcctacaacctgagtgacaacgtgtacaagcaggactgggagaagagcaaggccaagaagtttgacatcaaggtggatgccatccccctgctggccgccaaggccaacaccaagaacaccagtgatgtgatgtacaagaaggactatgagaagagcaagggcaagatgattggagccctgagcatcaatgatgaccccaagatgctgcacagcctgaagacagccaagaaccagagcgaccgggagtacaggaaggactatgagaagagcaagaccatctacacagcccccctggacatgctgcaggtgacccaggccaagaagagccaggccatcgccagtgatgtggactacaagcacatcctgcacagctacagctaccccccagacagcatcaacgtggacctggccaagaaggcctatgccctgcagagtgatgtggagtacaaggctgactacaacagctggatgaagggctgcggctgggtgcccttcggcagcctggagatggagaaggccaagagggccagtgacatcctgaatgagaagaagtaccggcagcacccagacaccctgaagttcaccagcattgaagatgcccccatcaccgtgcagagcaagatcaaccaggcccagaggagtgacatcgcctacaaggccaagggggaggagatcatccacaagtacaacctgcccccagacctgccccagttcatccaggccaaggtgaatgcctacaacatcagcgagaacatgtacaaggctgacctgaaggacctgagcaagaagggctatgacctgaggacagatgccatccccatccgggccgccaaggccgcccggcaggccgccagtgatgtgcagtacaagaaggactatgagaaggccaagggcaagatggtgggcttccagagcctgcaggatgaccccaagctggtgcactacatgaatgtggccaagatccagagcgaccgggagtacaagaaggactatgagaagaccaagagcaagtacaacacccctcatgacatgtttaatgtggtggccgccaagaaggcccaggatgtggtgtccaatgtgaactacaagcacagcctgcaccactacacctacctgcctgatgccatggacctggagctgagcaagaacatgatgcagatccagagcgacaacgtgtacaaggaggactacaacaactggatgaagggcatcggctggatccccatcggcagcctggatgtggagaaggtgaagaaggctggagatgccctgaatgagaagaagtaccggcagcacccagacaccctgaagttcaccagcatcgtggacagccctgtgatggtgcaggccaagcagaacaccaagcaggtgtctgacatcctgtacaaggccaagggggaggatgtgaagcacaagtacaccatgagcccagacctgccccagttcctgcaggccaagtgcaatgcctacaacatcagtgatgtgtgctacaagagggactggtatgacctgattgccaagggcaacaacgtgctgggagatgccatccccatcacagctgccaaggccagcaggaacatcgccagtgactacaagtacaaggaggcctatgagaagagcaagggcaagcacgtgggcttccgcagcctgcaggatgaccccaagctggtgcactacatgaatgtggccaagctgcagagcgaccgggagtacaagaagaactatgagaacaccaagaccagctaccacacccctggggacatggtgtccatcacagctgccaagatggcccaggatgtggccaccaacgtgaactacaagcagcccctgcaccactacacctacctgcctgatgccatgagcctggagcacaccagaaatgtgaaccagatccagagcgacaacgtgtacaaggatgagtacaacagcttcctgaagggcatcggctggatccccatcggcagcctggaggtggagaaggtgaagaaggctggagatgccctgaatgaaaggaagtaccggcagcacccagacacagtgaagttcacctctgtgcctgacagcatgggcatggtgctggcccagcacaacaccaagcagctgagtgacctgaactacaaggtggagggggagaagctgaagcacaagtacaccatcgaccctgagctgccccagttcatccaggccaaggtgaatgccctgaacatgtctgatgcccactacaaggctgactggaagaagaccatcgccaagggctatgacctgcggccagatgccatccccatcgtggccgccaagagcagcaggaacatcgccagtgactgcaagtacaaggaggcctatgagaaggccaagggcaagcaggtgggcttcctgagcctgcaggatgaccccaagctggtgcactacatgaatgtggccaagatccagagcgaccgggagtacaagaagggctatgaggccagcaagaccaagtaccacacccccctggacatggtgtctgtgacagctgccaagaagagccaggaggtggccaccaatgccaactaccggcagagctaccaccactacaccctgctgcctgatgccctgaatgtggagcacagcagaaatgccatgcagatccagagcgacaacctgtacaagagtgacttcaccaactggatgaagggcatcggctgggtgcccatcgagagcctggaggtggagaaggccaagaaggccggggagatcctgtctgagaagaagtaccggcagcaccctgagaagctgaagttcacctacgccatggacaccatggagcaggccctgaacaagagcaacaagctgaacatggacaagaggctgtacacagagaagtggaacaaggacaagaccaccatccacgtgatgccagacaccccagacatcctgctgagccgggtgaaccagatcaccatgtctgacaagctgtacaaggccggctgggaggaggagaagaagaagggctatgacctgcggccagatgccatcgccatcaaggccgcccgggccagccgggacatcgccagtgactacaagtacaagaaggcctatgagcaggccaagggcaagcacatcggcttccgcagcctggaggatgaccccaagctggtgcacttcatgcaggtggccaagatgcagagcgaccgggagtacaagaagggctatgagaagagcaagaccagcttccacacccctgtggacatgctgtctgtggtggccgccaagaagagccaggaggtggccaccaatgccaactacagaaatgtcatccacacctacaacatgctgcctgatgccatgagctttgagctggccaagaacatgatgcagatccagagcgacaaccagtacaaggctgactatgctgacttcatgaagggcatcggctggctgcccctgggcagcctggaggccgagaagaacaagaaggccatggagatcatcagcgagaagaagtaccggcagcacccagacaccctgaagtacagcaccctgatggacagcatgaacatggtgctggcccagaacaatgccaagatcatgaatgagcacctgtacaagcaggcctgggaggccgacaagaccaaggtgcacatcatgccagacatcccccagatcatcctggccaaggccaatgccatcaacatgtctgacaagctgtacaagctgagcctggaggagagcaagaagaagggctatgacctgcggccagatgccatccccatcaaggccgccaaggccagccgggacatcgccagtgactacaagtacaagtacaactatgagaagggcaagggcaagatggtgggcttccgcagcctggaggatgaccccaagctggtgcacagcatgcaggtggccaagatgcagagcgaccgggagtacaagaagaactatgagaacaccaagaccagctaccacaccccagctgacatgctgtctgtgacagctgccaaggatgcccaggccaacatcaccaacaccaactacaagcacctgatccacaagtacatcctgctgcctgatgccatgaacatcgagctgaccaggaacatgaaccgcatccagagcgacaatgagtacaagcaggactacaatgagtggtacaagggcctgggctggagccctgctggcagcctggaggtggagaaggccaagaaggccacagaatatgccagtgaccagaagtaccggcagcaccccagcaacttccagttcaagaagctgacagacagcatggacatggtgctggccaagcagaatgcccacaccatgaacaagcacctgtacaccatcgactggaacaaggacaagaccaagatccacgtgatgccagacaccccagacatcctgcaggccaagcagaaccagaccctgtacagccagaagctgtacaagctgggctgggaggaggccctgaagaagggctatgacctgcctgtggatgccatctctgtgcagctggccaaggccagccgggacatcgccagtgactacaagtacaagcagggctacaggaagcagctgggccaccacgtgggcttccgcagcctgcaggatgaccccaagctggtgctgtccatgaatgtggccaagatgcagagcgagcgggagtacaagaaggactttgagaagtggaagaccaagttcagcagccctgtggacatgctgggcgtggtgctggccaagaagtgccaggagctggtgtctgatgtggactacaagaactacctgcaccagtggacctgcctgcctgaccagaatgatgtggtgcaggccaagaaggtgtatgagctgcagagtgaaaatctctacaagagtgacctggagtggctgcggggcatcggctggagccccctgggcagcctggaggccgagaagaacaagagggccagcgagatcatcagcgagaagaagtaccggcagcccccagacaggaacaagttcaccagcatcccagatgccatggacatcgtgctggccaagaccaatgccaagaacagaagtgaccggctgtaccgggaggcctgggacaaggacaagacccagatccacatcatgccagacaccccagacatcgtgctggccaaggccaacctgatcaacaccagtgacaagctgtacaggatgggctatgaggagctgaagaggaagggctatgacctgcctgtggatgccatccccatcaaggccgccaaggccagccgggagatcgccagcgagtacaagtacaaggagggcttcaggaagcagctgggccaccacatcggggccaggaacattgaagatgaccccaagatgatgtggagcatgcacgtggccaagatccagagcgaccgggagtacaagaaggactttgagaagtggaagaccaagttcagcagccctgtggacatgctgggcgtggtgctggccaagaagtgccagaccctggtgtctgatgtggactacaagaactacctgcaccagtggacctgcctgcctgaccagagtgatgtgatccacgcccggcaggcctatgacctgcagagcgacaacctgtacaagagtgacctgcagtggctgaagggcatcggctggatgaccagcggcagcctggaggatgagaagaacaagagggccacccagatcctgagtgaccacgtgtaccggcagcacccagaccagttcaagttcagcagcctgatggacagcatccccatggtgctggccaagaacaatgccatcaccatgaaccaccggctgtacacagaggcctgggacaaggacaagaccaccgtgcacatcatgccagacaccccagaggtgctgctggccaagcagaacaaggtgaactacagcgagaagctgtacaagctgggcctggaggaggccaagaggaagggctatgacatgagggtggatgccatccccatcaaggccgccaaggccagccgggacatcgccagcgagttcaagtacaaggagggctacaggaagcagctgggccaccacatcggggcccgggccatcagagatgaccccaagatgatgtggagcatgcacgtggccaagatccagagcgaccgggagtacaagaaggactttgagaagtggaagaccaagttcagcagccctgtggacatgctgggcgtggtgctggccaagaagtgccagaccctggtgtctgatgtggactacaagaactacctgcaccagtggacctgcctgcctgaccagagtgatgtgattcatgcccggcaggcctatgacctgcagagcgacaacatgtacaagagtgacctgcagtggatgaggggcatcggctgggtgtccatcggcagcctggatgtggagaagtgcaagagggccacagagatcctgagtgacaagatctaccggcagcccccagaccgcttcaagttcacctctgtgacagacagcctggagcaggtgctggccaagaacaatgccatcaccatgaacaagaggctgtacacagaggcctgggacaaggacaagacccagatccacatcatgccagacaccccagagatcatgctggcccggcagaacaagatcaactacagcgagaccctgtacaagctggccaatgaggaggccaagaagaagggctatgacctgcggagtgatgccatccccatcgtggccgccaaggccagcagagatgtgatcagtgactacaagtacaaggatggctacaggaagcagctgggccaccacatcggggccaggaacattgaagatgaccccaagatgatgtggagcatgcacgtggccaagatccagagcgaccgggagtacaagaaggactttgagaagtggaagaccaagttcagcagccctgtggacatgctgggcgtggtgctggccaagaagtgccagaccctggtgtctgatgtggactacaagaactacctgcacgagtggacctgcctgcctgaccagaatgatgtgatccacgcccggcaggcctatgacctgcagagcgacaacatctacaagagtgacctgcagtggctgcggggcatcggctgggtgcccatcggctccatggatgtggtgaagtgcaagagagctgctgagatcctgagtgacaacatctaccggcagcccccagacaagctgaagttcacctctgtgacagacagcctggagcaggtgctggccaagaacaatgccctgaacatgaacaagaggctgtacacagaggcctgggacaaggacaagacccaggtgcacatcatgccagacaccccagagatcatgctggcccggcagaacaagatcaactacagcgagagcctgtaccggcaggccatggaggaggccaagaaggagggctatgacctgcggagtgatgccatccccatcgtggccgccaaggccagccgggacatcgccagtgactacaagtacaaggaggcctacaggaagcagctgggccaccacatcggggcccgggctgtgcatgatgaccccaagatcatgtggagcctgcacatcgccaaggtgcagagcgaccgggagtacaagaaggactttgagaagtacaagacccgctacagcagccctgtggacatgctgggcatcgtgctggccaagaagtgccagaccctggtgtctgatgtggactacaagcaccccctgcacgagtggatctgcctgcctgaccagaatgacatcatccacgccaggaaggcctatgacctgcagagcgacaacctgtacaagagtgacctggagtggatgaagggcatcggctgggtgcccatcgacagcctggaggtggtgcgggccaagagagctggggagctgctgagtgacaccatctaccggcagaggcctgagaccctgaagttcaccagcatcacagacaccccagagcaggtgctggccaagaacaatgccctgaacatgaacaagaggctgtacacagaggcctgggacaatgacaagaagaccatccacgtgatgccagacaccccagagatcatgctggccaagctgaaccgcatcaactacagcgacaagctgtacaagctggccctggaggagagcaagaaggagggctatgacctgcggctggatgccatccccatccaggccgccaaggccagccgggacatcgccagtgactacaagtacaaggagggctacaggaagcagctgggccaccacatcggggccaggaacatcaaggatgaccccaagatgatgtggagcatccacgtggccaagatccagagcgaccgggagtacaagaaggagtttgagaagtggaagaccaagttcagcagccctgtggacatgctgggcgtggtgctggccaagaagtgccagatcctggtgtctgacatcgactacaagcaccccctgcacgagtggacctgcctgcctgaccagaatgatgtgatccaggccaggaaggcctatgacctgcagagtgatgccatctacaagagtgacctggagtggctgcggggcatcggctgggtgcccatcggctctgtggaggtggagaaggtgaagagagctggggagatcctgagtgacaggaagtaccggcagcctgctgaccagctgaagttcacctgcatcacagacaccccagagatcgtgctggccaagaacaatgccctgaccatgagcaagcacctgtacacagaggcctgggatgctgacaagaccagcatccacgtgatgccagacaccccagacatcctgctggccaagagcaacagcgccaacatcagccagaagctgtacaccaagggctgggatgagagcaagatgaaggactatgacctgcgggcagatgccatcagcatcaagagcgccaaggccagccgggacatcgccagtgactacaagtacaaggaggcctatgagaagcagaagggccaccacatcggggcccagagcattgaagatgaccccaagatcatgtgtgccatccatgctgggaagatccagagcgagcgggagtacaagaaggagttccagaagtggaagaccaagttcagcagccctgtggacatgctgagcatcctgctggccaagaagtgccagaccctggtgacagacatcgactacagaaactacctgcacgagtggacctgcatgccagaccagaatgacatcatccaggccaagaaggcctatgacctgcagagtgatgccctgtacaaggctgacctggagtggctgcggggcatcggctggatgccccagggcagccctgaggtgctgcgggtgaagaatgcccagaacatcttctgtgacagcgtgtaccgcacccctgtggtgaacctgaagtacaccagcatcgtggacaccccagaggtggtgctggccaagagcaatgctgagaacatcagcatccccaagtaccgggaggtgtgggacaaggacaagaccagcatccacatcatgccagacaccccagagatcaacctggcccgggccaatgccctgaatgtgagcaacaagctgtaccgggagggctgggatgagatgaaggccggctgtgatgtgcggctggatgccatccccatccaggccgccaaggccagccgggagatcgccagtgactacaagtacaagctggaccacgagaagcagaagggccactacgtgggcaccctgacagccagagatgacaacaagatccgctgggccctgattgctgacaagctgcagaatgaaagagagtaccgcctggactgggccaagtggaaggccaagatccagagccctgtggacatgctgagcatcctgcacagcaagaacagccaggccctggtgtctgacatggactacagaaactacctgcaccagtggacctgcatgccagaccagaatgatgtgatccaggccaagaaggcctatgagctgcagagcgacaacgtgtacaaggctgacctggagtggctgcggggcatcggctggatgcccaatgattctgtgtctgtgaaccacgccaagcacgccgctgacatcttcagcgagaagaagtaccgcaccaagattgagaccctgaacttcacccctgtggatgacagagtggactatgtgacagccaagcagagcggggagatcctggatgacatcaagtacaggaaggactggaatgccaccaagagcaagtacaccctgacagagacccccctgctgcacacagcccaggaggccgcccgcatcctggaccagtacctgtacaaggagggctgggagcggcagaaggccaccggctacatcctgcccccagatgctgtgccctttgtgcacgcccaccactgcaatgatgtgcagagcgagctgaagtacaaggccgagcacgtgaagcagaagggccactacgtgggcgtgcccaccatgagagatgaccccaagctggtgtggtttgagcacgccggccagatccagaatgaaagactctacaaggaggactaccacaagaccaaggccaagatcaacatcccagctgacatggtgtctgtgctggccgccaagcagggccagaccctggtgtctgacatcgactacagaaactacctgcaccagtggatgtgccacccagaccagaatgatgtgatccaggccaggaaggcctatgacctgcagagcgacaacgtgtacagagctgacctggagtggctgcggggcatcggctggatccccctggacagcgtggaccacgtgcgggtgaccaagaaccaggagatgatgagccagatcaagtacaagaagaatgccctggagaactaccccaacttccgctctgtggtggaccccccagaaattgtgctggccaagatcaacagcgtgaaccagagtgatgtgaagtacaaggagaccttcaacaaggccaagggcaagtacaccttctccccagacaccccccacatcagccacagcaaggacatgggcaagctgtacagcaccatcctgtacaagggggcctgggagggcaccaaggcctacggctacaccctggatgagcgctacatccccatcgtgggcgccaagcacgccgacctggtgaacagcgagctgaagtacaaggagacctatgagaagcagaagggccactacctggccggcaaggtgattggagagttccctggggtggtgcactgcctggacttccagaagatgaggtctgccctgaactacaggaagcactatgaggacaccaaggccaacgtgcacatccccaatgacatgatgaaccacgtgctggccaagcgctgccagtacatcctgagtgacctggagtaccgccactacttccaccagtggaccagcctgctggaggagcccaacgtcatccgggtgagaaatgcccaggagatcctgagtgacaacgtgtacaaggatgacctgaactggctgaagggcatcggctgctacgtgtgggacaccccccagatcctgcacgccaagaagagctatgacctgcagagccagctgcagtacacagctgctgggaaggagaacctgcagaactacaacctggtgacagacacccccctgtatgtgacagctgtgcagagcggcatcaatgccagcgaggtgaagtacaaggagaactaccaccagatcaaggacaagtacaccaccgtgctggagaccgtggactatgacaggaccaggaacctgaagaacctgtacagcagcaacctgtacaaggaggcctgggacagagtgaaggccaccagctacatcctgcccagcagcaccctgagcctgacccacgccaagaaccagaagcacctggccagccacatcaagtaccgggaggagtatgagaagttcaaggccctgtacaccctgcccaggtctgtggatgatgaccccaacacagcccgctgcctgcgggtgggcaagctgaacatcgaccggctgtacagatctgtgtatgagaagaacaagatgaagatccacatcgtgcctgacatggtggagatggtgacagccaaggacagccagaagaaggtgtctgaaattgactaccgcctgcggctgcacgagtggatctgccacccagacctgcaggtgaatgaccacgtgaggaaggtgacagaccagatcagtgacatcgtgtacaaggatgacctgaactggctgaagggcatcggctgctacgtgtgggacaccccagagatcctgcacgccaagcacgcctatgacctgagagatgacatcaagtacaaggcccacatgctgaagaccagaaatgactacaagctggtgacagacacccctgtgtatgtgcaggccgtgaagagcggcaagcagctgagtgatgctgtgtaccactatgactatgtgcacagcgtgcggggcaaggtggcccccaccaccaagacagtggacctggaccgggccctgcacgcctacaagctgcagagcagcaacctgtacaagaccagcctgcggaccctgcccaccggctaccgcctgcccggggacaccccccacttcaagcacatcaaggacacccgctacatgagcagctacttcaagtacaaggaggcctatgagcacaccaaggcctacggctacaccctgggccccaaggatgtgccctttgtgcacgtgcggcgggtgaacaacgtgaccagcgagcggctgtaccgggagctgtaccacaagctgaaggacaagatccacaccaccccagacaccccagagatccggcaggtgaagaagacccaggaggccgtgtctgagctgatctacaagagtgacttcttcaagatgcagggccacatgatcagcctgccctacaccccccaggtgatccactgccgctacgtgggggacatcaccagtgacatcaagtacaaggaggacctgcaggtgctgaagggcttcggctgcttcctgtatgacaccccagacatggtgcgcagccgccacctgaggaagctgtggagcaactacctgtacacagacaaggccaggaagatgagggacaagtacaaggtggtgctggacaccccagagtacaggaaggtgcaggagctgaagacccacctgtctgagctggtgtacagagctgctgggaagaagcagaagagcatcttcacctctgtgcctgacaccccagacctgctgcgggccaagaggggccagaagctgcagagccagtacctgtatgtggagctggccaccaaggagcggccccaccaccacgccggcaaccagaccacagccctgaagcacgccaaggatgtgaaggacatggtgtctgagaagaagtacaagatccagtatgagaagatgaaggacaagtacacccctgtgcctgacacccccatcctgatccgggccaagagggcctactggaatgccagtgacctgcgctacaaggagaccttccagaagaccaagggcaagtaccacacagtgaaggatgccctggacatcgtgtaccacaggaaggtgacagatgacatcagcaagatcaagtacaaggagaactacatgagccagctgggcatctggaggagcatcccagacaggcctgagcacttccaccacagagctgtgacagacacagtgtctgatgtgaagtacaaggaggacctgacctggctgaagggcatcggctgctacgcctatgacaccccagacttcaccctggccgagaagaacaagaccctgtacagcaagtacaagtacaaggaggtgtttgagaggaccaagagtgacttcaagtatgtggccgacagccccatcaacagacacttcaagtatgccacccagctgatgaatgagaagaagtacagagctgactatgagcagaggaaggacaagtaccacctggtggtggatgagcccaggcacctgctggccaagacagctggggaccagatcagccagatcaagtacaggaagaactatgagaagagcaaggacaagttcaccagcatcgtggacaccccagagcacctgcggaccaccaaggtgaacaagcagatcagtgacatcctgtacaagctggagtacaacaaggccaagccccggggctacaccaccatccatgacacccccatgctgctgcacgtgaggaaggtgaaggatgaggtgtctgacctgaagtacaaggaggtgtaccagaggaacaagagcaactgcaccattgaaccagatgctgtgcacatcaaggccgccaaggatgcctacaaggtgaacaccaacctggactacaagaagcagtatgaggccaacaaggcccactggaagtggaccccagacagaccagacttcctgcaggccgccaagagcagcctgcagcagagcgactttgagtacaagctggaccgggagttcctgaagggctgcaagctgtctgtgacagatgacaagaacacagtgctggccctgaggaacaccctgattgaaagtgacctgaagtacaaggagaagcacgtgaaggagcggggcacctgccacgctgtgcctgacaccccccagatcctgctggccaagacagtgagcaacctggtgtctgagaacaagtacaaggaccacgtgaagaagcacctggcccagggcagctacaccaccctgcctgagacccgggacacagtgcacgtgaaggaggtgaccaagcacgtgtctgacaccaactacaagaagaagtttgtgaaggagaagggcaagagcaactacagcatcatgctggagcccccagaggtgaagcacgccatggaggtggccaagaagcagagtgatgtggcctacaggaaggatgccaaggagaacctgcactacaccaccgtggccgacagaccagacatcaagaaggccacccaggccgccaagcaggccagcgaggtggagtaccgggccaagcacaggaaggagggcagccacggcctgtccatgctgggccgcccagacatcgagatggccaagaaggccgccaagctgagcagccaggtgaagtacagagaaaattttgacaaggagaagggcaagacccccaagtacaaccccaaggacagccagctgtacaaggtgatgaaggatgccaacaacctggccagcgaggtgaagtacaaggctgacctgaagaagctgcacaagcctgtgacagacatgaaggagagcctcatcatgaaccacgtgctgaacaccagccagctggccagcagctaccagtacaagaagaagtatgagaagagcaagggccactaccacaccatcccagacaacctggagcagctgcacctgaaggaggccacagagctgcagagcatcgtgaagtacaaggagaagtatgagaaggagcggggcaagcccatgctggactttgagacccccacctacatcacagccaaggagagccagcagatgcagagcggcaaggagtacaggaaggactatgaggagagcatcaagggcaggaacctgaccggcctggaggtgaccccagccctgctgcacgtgaagtatgccaccaagatcgccagcgagaaggagtacaggaaggacctggaggagagcatccggggcaagggcctgacagagatggaggacaccccagacatgctgcgggccaagaatgccacccagatcctgaatgagaaggagtacaagagggacctggagctggaggtgaagggccggggcctgaatgccatggccaatgagaccccagacttcatgagggccagaaatgccacagacatcgccagccagatcaagtacaagcagagcgctgagatggagaaggccaacttcacctctgtggtggacaccccagagatcatccacgcccagcaggtgaagaacctgagcagccagaagaagtacaaggaggatgctgagaagtccatgagctactatgaaacagtgctggacaccccagagatccagagggtgcgggagaaccagaagaacttcagcctgctgcagtaccagtgtgacctgaagaacagcaagggcaagatcaccgtggtgcaggacaccccagagatcctgcgggtgaaggagaaccagaagaacttcagctctgtgctgtacaaggaggatgtgtccccaggcacagccatcggcaagaccccagagatgatgagggtgaagcagacccaggaccacatcagctctgtgaagtacaaggaggccatcggccagggcacccccatcccagacctgcctgaggtgaagagggtgaaggagacccagaagcacatcagctctgtgatgtacaaggagaacctgggcaccggcatccccaccaccgtgaccccagaaattgaaagagtgaagaggaaccaggagaacttcagctctgtgctgtacaaggagaacctgggcaagggcatccccacccccatcaccccagagatggagcgggtgaagaggaaccaggagaacttcagctctgtgctgtacaaggagaacatgggcaagggcacccccctggccgtgaccccagagatggagcgggtgaagcacaaccaggagaacatcagctctgtgctgtacaaggaaaatgtgggcaaggccacagccacccctgtgaccccagagatgcagagggtgaagaggaaccaggagaacatcagctctgtgctgtacaaggagaacctgggcaaggccacccccacccccttcaccccagagatggagcgggtgaagaggaaccaggagaacttcagctctgtgctgtacaaggagaacatgaggaaggccacccccacccctgtgaccccagagatggagcgggccaagaggaaccaggagaacatcagctctgtgctgtacagcgacagcttcaggaagcagatccagggcaaggccgcctacgtgctggacaccccagagatgagaagagtgcgggagacccagaggcacatcagcacagtgaagtaccacgaggactttgagaagcacaagggctgcttcacccctgtggtgacagaccccatcacagagcgggtgaagaagaacatgcaggacttcagtgacatcaactaccggggcatccagaggaaggtggtggagatggagcagaagagaaatgaccaggaccaggagaccatcaccggcctgcgggtgtggaggaccaaccctggctctgtgtttgattatgaccctgctgaggacaacatccagagccgcagcctgcacatgatcaacgtgcaggcccagaggaggagccgggagcagagccgcagcgccagcgccctgagcatctctggaggagaggagaagtctgagcacagcgaggccccagaccaccacctgagcacctacagtgatggcggcgtgtttgctgtgtccacagcctacaagcacgccaagaccacagagctgccccagcagaggagcagctctgtggccacccagcagaccaccgtgagcagcatccccagccaccccagcacagctgggaagatcttccgggccatgtatgactacatggccgcagatgctgatgaggtgtccttcaaggatggagatgccatcatcaacgtgcaggccattgatgagggctggatgtatggaacagtgcagaggactggaagaacaggcatgctgcctgccaactacgtggaggccatctag

SEQ ID NO: 161323 - DNA, 1503 bp, Artificial Sequence
  Description of Artificial Sequence: Synthetic coding sequence
atggagcgggtgaagaggaaccaggagaacttcagctctgtgctgtacaaggagaacctgggcaccggcatccccatccccatcaccccagagatgcagagggtgaagcacaaccaggagaacctgagctctgtgctgtacaaggagaacatgggcaagggcacccccctgcctgtgaccccagagatggagcgggtgaagcacaaccaggagaacatcagctctgtgctgtacaaggagaacatgggcaagggcacccccctgcctgtgaccccagagatggagcgggtgaagcacaaccaggagaacatcagctctgtgctgtacaaggagaacatgggcaagggcacccccctggccgtgaccccagagatggagcgggtgaagcacaaccaggagaacatcagctctgtgctgtacaaggaaaatgtgggcaaggccacagccacccctgtgaccccagagatgcagagggtgaagaggaaccaggagaacatcagctctgtgctgtacaaggagaacctgggcaaggccacccccacccccttcaccccagagatggagcgggtgaagaggaaccaggagaacttcagctctgtgctgtacaaggagaacatgaggaaggccacccccacccctgtgaccccagagatggagcgggccaagaggaaccaggagaacatcagctctgtgctgtacagcgacagcttcaggaagcagatccagggcaaggccgcctacgtgctggacaccccagagatgagaagagtgcgggagacccagaggcacatcagcacagtgaagtaccatgaagattttgagaagcacaagggctgcttcacccctgtggtgacagaccccatcacagagcgggtgaagaagaacatgcaggacttcagtgacatcaactaccggggcatccagaggaaggtggtggagatggagcagaagagaaatgaccaggaccaggagaccatcaccggcctgcgggtgtggaggaccaaccctggctctgtgtttgattatgaccctgctgaggacaacatccagagccgcagcctgcacatgatcaacgtgcaggcccagaggaggagccgggagcagagccgcagcgccagcgccctgagcatcagcggcggggaggagaagtctgagcacagcgaggccccagaccaccacctgagcacctacagtgatggaggagtgtttgctgtgtccacagcctacaagcacgccaagaccacagagctgccccagcagaggagcagctctgtggccacccagcagaccaccgtgagcagcatccccagccaccccagcacagctgggaagatcttccgggccatgtatgactacatggctgctgatgctgatgaggtgtccttcaaggatggagatgccatcatcaacgtgcaggccattgatgagggctggatgtatggcaccgtgcagaggacaggccgcacaggcatgctgcctgccaactacgtggaggccatctag

SEQ ID NO: 161324 - DNA, 7878 bp, Artificial Sequence
  Description of Artificial Sequence: Synthetic coding sequence
atgccagacaccccagagatcaacctggcccgggccaatgccctgaatgtgagcaacaagctgtaccgggagggctgggatgagatgaaggccggctgtgatgtgcggctggatgccatccccatccaggccgccaaggccagccgggagatcgccagtgactacaagtacaagctggaccacgagaagcagaagggccactacgtgggcaccctgacagccagagatgacaacaagatccgctgggccctgattgctgacaagctgcagaatgaaagagagtaccgcctggactgggccaagtggaaggccaagatccagagccctgtggacatgctgagcatcctgcacagcaagaacagccaggccctggtgtctgacatggactacagaaactacctgcaccagtggacctgcatgccagaccagaatgatgtgatccaggccaagaaggcctatgagctgcagagcgacaacgtgtacaaggctgacctggagtggctgcggggcatcggctggatgcccaatgacagcgtgtctgtgaaccacgccaagcatgctgctgacatcttcagcgagaagaagtaccgcaccaagattgagaccctgaacttcacccctgtggatgacagagtggactatgtgacagccaagcagagcggggagatcctggatgacatcaagtacaggaaggactggaatgccaccaagagcaagtacaccctgacagagacccccctgctgcacacagcccaggaggccgcccgcatcctggaccagtacctgtacaaggagggctgggagcggcagaaggccaccggctacatcctgcccccagatgctgtgccctttgtgcacgcccaccactgcaatgatgtgcagagcgagctgaagtacaaggccgagcacgtgaagcagaagggccactacgtgggcgtgcccaccatgagagatgaccccaagctggtgtggtttgaacatgctggccagatccagaatgaaaggctgtacaaggaggactaccacaagaccaaggccaagatcaacatcccagctgacatggtgtctgtgctggccgccaagcagggccagaccctggtgtctgacatcgactacagaaactacctgcaccagtggatgtgccacccagaccagaatgatgtgatccaggccaggaaggcctatgacctgcagagcgacaacgtgtacagagctgacctggagtggctgcggggcatcggctggatccccctggacagcgtggaccacgtgcgggtgaccaagaaccaggagatgatgagccagatcaagtacaagaagaatgccctggagaactaccccaacttccgctctgtggtggaccccccagagatcgtgctggccaagatcaacagcgtgaaccagagtgatgtgaagtacaaggagaccttcaacaaggccaagggcaagtacaccttctccccagacaccccccacatcagccacagcaaggacatgggcaagctgtacagcaccatcctgtacaagggggcctgggagggcaccaaggcctacggctacaccctggatgagcgctacatccccatcgtgggcgccaagcatgctgacctggtgaacagcgagctgaagtacaaggagacctatgagaagcagaagggccactacctggccggcaaggtgattggagagttccctggggtggtgcactgcctggacttccagaagatgaggtctgccctgaactacaggaagcactatgaggacaccaaggccaacgtgcacatccccaatgacatgatgaaccacgtgctggccaagcgctgccagtacatcctgagtgacctggagtaccgccactacttccaccagtggaccagcctgctggaggagcccaacgtcatccgggtgagaaatgcccaggagatcctgagtgacaacgtgtacaaggatgacctgaactggctgaagggcatcggctgctacgtgtgggacaccccccagatcctgcacgccaagaagagctatgacctgcagagccagctgcagtacacagctgctgggaaggagaacctgcagaactacaacctggtgacagacacccccctgtatgtgacagctgtgcagagcggcatcaatgccagcgaggtgaagtacaaggagaactaccaccagatcaaggacaagtacaccaccgtgctggagaccgtggactatgacaggaccaggaacctgaagaacctgtacagcagcaacctgtacaaggaggcctgggacagagtgaaggccaccagctacatcctgcccagcagcaccctgagcctgacccacgccaagaaccagaagcacctggccagccacatcaagtaccgggaggagtatgagaagttcaaggccctgtacaccctgcccaggtctgtggatgatgaccccaacacagcccgctgcctgcgggtgggcaagctgaacatcgaccggctgtacagatctgtgtatgagaagaacaagatgaagatccacatcgtgcctgacatggtggagatggtgacagccaaggacagccagaagaaggtgtctgaaattgactaccgcctgcggctgcacgagtggatctgccacccagacctgcaggtgaatgaccacgtgaggaaggtgacagaccagatcagtgacatcgtgtacaaggatgacctgaactggctgaagggcatcggctgctacgtgtgggacaccccagagatcctgcacgccaagcacgcctatgacctgagagatgacatcaagtacaaggcccacatgctgaagaccagaaatgactacaagctggtgacagacacccctgtgtatgtgcaggccgtgaagagcggcaagcagctgagtgatgctgtgtaccactatgactatgtgcacagcgtgcggggcaaggtggcccccaccaccaagacagtggacctggaccgggccctgcacgcctacaagctgcagagcagcaacctgtacaagaccagcctgcggaccctgcccaccggctaccgcctgcccggggacaccccccacttcaagcacatcaaggacacccgctacatgagcagctacttcaagtacaaggaggcctatgagcacaccaaggcctacggctacaccctgggccccaaggatgtgccctttgtgcacgtgagaagagtgaacaacgtgaccagcgagcggctgtaccgggagctgtaccacaagctgaaggacaagatccacaccaccccagacaccccagagatccggcaggtgaagaagacccaggaggccgtgtctgagctgatctacaagagtgacttcttcaagatgcagggccacatgatcagcctgccctacaccccccaggtgatccactgccgctacgtgggggacatcaccagtgacatcaagtacaaggaggacctgcaggtgctgaagggcttcggctgcttcctgtatgacaccccagacatggtgcgcagccgccacctgaggaagctgtggagcaactacctgtacacagacaaggccaggaagatgagggacaagtacaaggtggtgctggacaccccagagtacaggaaggtgcaggagctgaagacccacctgtctgagctggtgtacagagctgctgggaagaagcagaagagcatcttcacctctgtgcctgacaccccagacctgctgcgggccaagaggggccagaagctgcagagccagtacctgtatgtggagctggccaccaaggagcggccccaccaccacgccggcaaccagaccacagccctgaagcacgccaaggatgtgaaggacatggtgtctgagaagaagtacaagatccagtatgagaagatgaaggacaagtacacccctgtgcctgacacccccatcctgatccgggccaagagggcctactggaatgccagtgacctgcgctacaaggagaccttccagaagaccaagggcaagtaccacacagtgaaggatgccctggacatcgtgtaccacaggaaggtgacagatgacatcagcaagatcaagtacaaggagaactacatgagccagctgggcatctggaggagcatcccagacaggcctgagcacttccaccacagagctgtgacagacacagtgtctgatgtgaagtacaaggaggacctgacctggctgaagggcatcggctgctacgcctatgacaccccagacttcaccctggccgagaagaacaagaccctgtacagcaagtacaagtacaaggaggtgtttgagaggaccaagagtgacttcaagtatgtggccgacagccccatcaacagacacttcaagtatgccacccagctgatgaatgagaagaagtacagagctgactatgagcagaggaaggacaagtaccacctggtggtggatgagcccaggcacctgctggccaagacagctggggaccagatcagccagatcaagtacaggaagaactatgagaagagcaaggacaagttcaccagcatcgtggacaccccagagcacctgcggaccaccaaggtgaacaagcagatcagtgacatcctgtacaagctggagtacaacaaggccaagccccggggctacaccaccatccatgacacccccatgctgctgcacgtgaggaaggtgaaggatgaggtgtctgacctgaagtacaaggaggtgtaccagaggaacaagagcaactgcaccatcgagccagatgctgtgcacatcaaggccgccaaggatgcctacaaggtgaacaccaacctggactacaagaagcagtatgaggccaacaaggcccactggaagtggaccccagacagaccagacttcctgcaggccgccaagagcagcctgcagcagagcgactttgagtacaagctggaccgggagttcctgaagggctgcaagctgtctgtgacagatgacaagaacacagtgctggccctgaggaacaccctcatcgagagtgacctgaagtacaaggagaagcacgtgaaggagcggggcacctgccacgctgtgcctgacaccccccagatcctgctggccaagacagtgagcaacctggtgtctgagaacaagtacaaggaccacgtgaagaagcacctggcccagggcagctacaccaccctgcctgagacccgggacacagtgcacgtgaaggaggtgaccaagcacgtgtctgacaccaactacaagaagaagtttgtgaaggagaagggcaagagcaactacagcatcatgctggagcccccagaggtgaagcacgccatggaggtggccaagaagcagagtgatgtggcctacaggaaggatgccaaggagaacctgcactacaccaccgtggccgacagaccagacatcaagaaggccacccaggccgccaagcaggccagcgaggtggagtaccgggccaagcacaggaaggagggcagccacggcctgtccatgctgggccgcccagacatcgagatggccaagaaggccgccaagctgagcagccaggtgaagtaccgggagaactttgacaaggagaagggcaagacccccaagtacaaccccaaggacagccagctgtacaaggtgatgaaggatgccaacaacctggccagcgaggtgaagtacaaggctgacctgaagaagctgcacaagcctgtgacagacatgaaggagagcctcatcatgaaccacgtgctgaacaccagccagctggccagcagctaccagtacaagaagaagtatgagaagagcaagggccactaccacaccatcccagacaacctggagcagctgcacctgaaggaggccacagagctgcagagcatcgtgaagtacaaggagaagtatgagaaggagcggggcaagcccatgctggactttgagacccccacctacatcacagccaaggagagccagcagatgcagagcggcaaggagtacaggaaggactatgaggagagcatcaagggcaggaacctgaccggcctggaggtgaccccagccctgctgcacgtgaagtatgccaccaagatcgccagcgagaaggagtacaggaaggacctggaggagagcatccggggcaagggcctgacagagatggaggacaccccagacatgctgcgggccaagaatgccacccagatcctgaatgagaaggagtacaagagggacctggagctggaggtgaagggccggggcctgaatgccatggccaatgagaccccagacttcatgagggccagaaatgccacagacatcgccagccagatcaagtacaagcagagcgctgagatggagaaggccaacttcacctctgtggtggacaccccagagatcatccacgcccagcaggtgaagaacctgagcagccagaagaagtacaaggaggatgctgagaagtccatgagctactatgagaccgtgctggacaccccagagatccagagggtgcgggagaaccagaagaacttcagcctgctgcagtaccagtgtgacctgaagaacagcaagggcaagatcaccgtggtgcaggacaccccagagatcctgcgggtgaaggagaaccagaagaacttcagctctgtgctgtacaaggaggatgtgtccccaggcacagccatcggcaagaccccagagatgatgagggtgaagcagacccaggaccacatcagctctgtgaagtacaaggaggccatcggccagggcacccccatcccagacctgcctgaggtgaagagggtgaaggagacccagaagcacatcagctctgtgatgtacaaggagaacctgggcaccggcatccccaccaccgtgaccccagaaattgagcgggtgaagaggaaccaggagaacttcagctctgtgctgtacaaggagaacatgggcaagggcacccccctgcctgtgaccccagagatggagcgggtgaagcacaaccaggagaacatcagctctgtgctgtacaaggaaaatgtgggcaaggccacagccacccctgtgaccccagagatgcagagggtgaagaggaaccaggagaacatcagctctgtgctgtacagcgacagcttcaggaagcagatccagggcaaggccgcctacgtgctggacaccccagagatgagaagagtgcgggagacccagaggcacatcagcacagtgaagtaccacgaggactttgagaagcacaagggctgcttcacccctgtggtgacagaccccatcacagagcgggtgaagaagaacatgcaggacttcagtgacatcaactaccggggcatccagaggaaggtggtggagatggagcagaagagaaatgaccaggaccaggagaccatcaccggcctgcgggtgtggaggaccaaccctggctctgtgtttgattatgaccctgctgaggacaacatccagagccgcagcctgcacatgatcaacgtgcaggcccagaggaggagccgggagcagagccgcagcgccagcgccctgagcatctctggaggagaggagaagtctgagcacagcgaggccccagaccaccacctgagcacctacagtgatggcggcgtgtttgctgtgtccacagcctacaagcacgccaagaccacagagctgccccagcagaggagcagctctgtggccacccagcagaccaccgtgagcagcatccccagccaccccagcacagctgggaagatcttccgggccatgtatgactacatggccgcagatgctgatgaggtgtccttcaaggatggagatgccatcatcaacgtgcaggccattgatgagggctggatgtatggaacagtgcagaggactggaagaacaggcatgctgcctgccaactacgtggaggccatctag

SEQ ID NO: 161325 - DNA, 25578 bp, Artificial Sequence
  Description of Artificial Sequence: Synthetic coding sequence
atggctgatgatgaagattatgaggaggtggtggagtactacacagaggaggtggtgtatgaggaggtgcctggagagaccatcaccaagatctatgagaccaccaccaccaggaccagtgactatgagcagagcgagaccagcaagccagccctggcccagcctgccctggcccagcctgccagcgccaagcctgtggagaggaggaaggtgatcaggaagaaggtggaccccagcaagttcatgaccccctacatcgcccacagccagaagatgcaggacctcttcagccccaacaagtacaaggagaagtttgagaagaccaagggccagccctatgccagcaccacagacaccccagagctgcggcgcatcaagaaggtgcaggaccagctgtctgaggtgaagtacaggatggatggagatgtggccaagaccatctgccacgtggatgagaaggccaaggacattgaacatgccaagaaggtgtcccagcaggtgtccaaggtgctgtacaagcagaactgggaggacaccaaggacaagtacctgctgcccccagatgcccctgagctggtgcaggccgtgaagaacacagccatgttcagcaagaagctgtacacagaggactgggaggccgacaagagcctcttctacccctacaatgacagccctgagctgcggcgggtggcccaggcccagaaggccctgagtgatgtggcctacaagaagggcctggccgagcagcaggcccagttcacccccctggccgaccccccagacatcgagtttgccaagaaggtgaccaaccaggtgtccaagcagaagtacaaggaggactatgagaacaagatcaagggcaagtggagcgagaccccctgctttgaggtggccaatgccaggatgaatgctgacaacatcagcaccaggaagtaccaggaggactttgagaacatgaaggaccagatctacttcatgcagacagagaccccagagtacaagatgaacaagaaggccggcgtggccgccagcaaggtgaagtacaaggaggactatgagaagaacaagggcaaggctgactacaacgtgctgcctgccagcgagaacccccagctgcggcagctgaaggctgctggagatgccctgagtgacaagctgtacaaggaaaattatgagaagaccaaggccaagagcatcaactactgtgagacccccaagttcaagctggacacagtgctgcagaacttcagcagtgacaagaagtacaaggacagctacctgaaggacatcctgggccactacgtgggcagctttgaggacccctaccacagccactgcatgaaggtgacagcccagaacagcgacaagaactacaaggccgagtatgaggaggaccggggcaagggcttcttcccccagaccatcacccaggagtatgaggccatcaagaagctggaccagtgcaaggaccacacctacaaggtgcacccagacaagaccaagttcacccaggtgacagacagccctgtgctgctgcaggcccaggtgaacagcaagcagctgagtgacctgaactacaaggccaagcatgagagcgagaagttcaagtgccacatccccccagacaccccagccttcatccagcacaaggtgaatgcctacaacctgagtgacaacctgtacaagcaggactgggagaagagcaaggccaagaagtttgacatcaaggtggatgccatccccctgctggccgccaaggccaacaccaagaacaccagtgatgtgatgtacaagaaggactatgagaagaacaagggcaagatgattggagtgctgagcatcaatgatgaccccaagatgctgcacagcctgaaggtggccaagaaccagagcgaccggctgtacaaggaaaattatgagaagaccaaggccaagtccatgaactactgtgagacccccaagtaccagctggacacccagctgaagaacttcagcgaggcccgctacaaggacctgtatgtgaaggatgtgctgggccactacgtgggctccatggaggacccctaccacacccactgcatgaaggtggccgcccagaacagcgacaagagctacaaggccgagtatgaagaagataaaggcaagtgctacttcccccagaccatcacccaggagtatgaggccatcaagaagctggaccagtgcaaggaccacacctacaaggtgcacccagacaagaccaagttcaccgctgtgacagacagccctgtgctgctgcaggcccagctgaacaccaagcagctgagtgacctgaactacaaggccaagcatgaaggagagaagttcaagtgccacatcccagcagatgccccccagttcatccagcaccgggtgaatgcctacaacctgagtgacaacgtgtacaagcaggactgggagaagagcaaggccaagaagtttgacatcaaggtggatgccatccccctgctggccgccaaggccaacaccaagaacaccagtgatgtgatgtacaagaaggactatgagaagagcaagggcaagatgattggagccctgagcatcaatgatgaccccaagatgctgcacagcctgaagacagccaagaaccagagcgaccgggagtacaggaaggactatgagaagagcaagaccatctacacagcccccctggacatgctgcaggtgacccaggccaagaagagccaggccatcgccagtgatgtggactacaagcacatcctgcacagctacagctaccccccagacagcatcaacgtggacctggccaagaaggcctatgccctgcagagtgatgtggagtacaaggctgactacaacagctggatgaagggctgcggctgggtgcccttcggcagcctggagatggagaaggccaagagggccagtgacatcctgaatgagaagaagtaccggcagcacccagacaccctgaagttcaccagcattgaagatgcccccatcaccgtgcagagcaagatcaaccaggcccagaggagtgacatcgcctacaaggccaagggggaggagatcatccacaagtacaacctgcccccagacctgccccagttcatccaggccaaggtgaatgcctacaacatcagcgagaacatgtacaaggctgacctgaaggacctgagcaagaagggctatgacctgaggacagatgccatccccatccgggccgccaaggccgcccggcaggccgccagtgatgtgcagtacaagaaggactatgagaaggccaagggcaagatggtgggcttccagagcctgcaggatgaccccaagctggtgcactacatgaatgtggccaagatccagagcgaccgggagtacaagaaggactatgagaagaccaagagcaagtacaacacccctcatgacatgtttaatgtggtggccgccaagaaggcccaggatgtggtgtccaatgtgaactacaagcacagcctgcaccactacacctacctgcctgatgccatggacctggagctgagcaagaacatgatgcagatccagagcgacaacgtgtacaaggaggactacaacaactggatgaagggcatcggctggatccccatcggcagcctggatgtggagaaggtgaagaaggctggagatgccctgaatgagaagaagtaccggcagcacccagacaccctgaagttcaccagcatcgtggacagccctgtgatggtgcaggccaagcagaacaccaagcaggtgtctgacatcctgtacaaggccaagggggaggatgtgaagcacaagtacaccatgagcccagacctgccccagttcctgcaggccaagtgcaatgcctacaacatcagtgatgtgtgctacaagagggactggtatgacctgattgccaagggcaacaacgtgctgggagatgccatccccatcacagctgccaaggccagcaggaacatcgccagtgactacaagtacaaggaggcctatgagaagagcaagggcaagcacgtgggcttccgcagcctgcaggatgaccccaagctggtgcactacatgaatgtggccaagctgcagagcgaccgggagtacaagaagaactatgagaacaccaagaccagctaccacacccctggggacatggtgtccatcacagctgccaagatggcccaggatgtggccaccaacgtgaactacaagcagcccctgcaccactacacctacctgcctgatgccatgagcctggagcacaccagaaatgtgaaccagatccagagcgacaacgtgtacaaggatgagtacaacagcttcctgaagggcatcggctggatccccatcggcagcctggaggtggagaaggtgaagaaggctggagatgccctgaatgaaaggaagtaccggcagcacccagacacagtgaagttcacctctgtgcctgacagcatgggcatggtgctggcccagcacaacaccaagcagctgagtgacctgaactacaaggtggagggggagaagctgaagcacaagtacaccatcgaccctgagctgccccagttcatccaggccaaggtgaatgccctgaacatgtctgatgcccactacaaggctgactggaagaagaccatcgccaagggctatgacctgcggccagatgccatccccatcgtggccgccaagagcagcaggaacatcgccagtgactgcaagtacaaggaggcctatgagaaggccaagggcaagcaggtgggcttcctgagcctgcaggatgaccccaagctggtgcactacatgaatgtggccaagatccagagcgaccgggagtacaagaagggctatgaggccagcaagaccaagtaccacacccccctggacatggtgtctgtgacagctgccaagaagagccaggaggtggccaccaatgccaactaccggcagagctaccaccactacaccctgctgcctgatgccctgaatgtggagcacagcagaaatgccatgcagatccagagcgacaacctgtacaagagtgacttcaccaactggatgaagggcatcggctgggtgcccatcgagagcctggaggtggagaaggccaagaaggccggggagatcctgtctgagaagaagtaccggcagcaccctgagaagctgaagttcacctacgccatggacaccatggagcaggccctgaacaagagcaacaagctgaacatggacaagaggctgtacacagagaagtggaacaaggacaagaccaccatccacgtgatgccagacaccccagacatcctgctgagccgggtgaaccagatcaccatgtctgacaagctgtacaaggccggctgggaggaggagaagaagaagggctatgacctgcggccagatgccatcgccatcaaggccgcccgggccagccgggacatcgccagtgactacaagtacaagaaggcctatgagcaggccaagggcaagcacatcggcttccgcagcctggaggatgaccccaagctggtgcacttcatgcaggtggccaagatgcagagcgaccgggagtacaagaagggctatgagaagagcaagaccagcttccacacccctgtggacatgctgtctgtggtggccgccaagaagagccaggaggtggccaccaatgccaactacagaaatgtcatccacacctacaacatgctgcctgatgccatgagctttgagctggccaagaacatgatgcagatccagagcgacaaccagtacaaggctgactatgctgacttcatgaagggcatcggctggctgcccctgggcagcctggaggccgagaagaacaagaaggccatggagatcatcagcgagaagaagtaccggcagcacccagacaccctgaagtacagcaccctgatggacagcatgaacatggtgctggcccagaacaatgccaagatcatgaatgagcacctgtacaagcaggcctgggaggccgacaagaccaaggtgcacatcatgccagacatcccccagatcatcctggccaaggccaatgccatcaacatgtctgacaagctgtacaagctgagcctggaggagagcaagaagaagggctatgacctgcggccagatgccatccccatcaaggccgccaaggccagccgggacatcgccagtgactacaagtacaagtacaactatgagaagggcaagggcaagatggtgggcttccgcagcctggaggatgaccccaagctggtgcacagcatgcaggtggccaagatgcagagcgaccgggagtacaagaagaactatgagaacaccaagaccagctaccacaccccagctgacatgctgtctgtgacagctgccaaggatgcccaggccaacatcaccaacaccaactacaagcacctgatccacaagtacatcctgctgcctgatgccatgaacatcgagctgaccaggaacatgaaccgcatccagagcgacaatgagtacaagcaggactacaatgagtggtacaagggcctgggctggagccctgctggcagcctggaggtggagaaggccaagaaggccacagaatatgccagtgaccagaagtaccggcagcaccccagcaacttccagttcaagaagctgacagacagcatggacatggtgctggccaagcagaatgcccacaccatgaacaagcacctgtacaccatcgactggaacaaggacaagaccaagatccacgtgatgccagacaccccagacatcctgcaggccaagcagaaccagaccctgtacagccagaagctgtacaagctgggctgggaggaggccctgaagaagggctatgacctgcctgtggatgccatctctgtgcagctggccaaggccagccgggacatcgccagtgactacaagtacaagcagggctacaggaagcagctgggccaccacgtgggcttccgcagcctgcaggatgaccccaagctggtgctgtccatgaatgtggccaagatgcagagcgagcgggagtacaagaaggactttgagaagtggaagaccaagttcagcagccctgtggacatgctgggcgtggtgctggccaagaagtgccaggagctggtgtctgatgtggactacaagaactacctgcaccagtggacctgcctgcctgaccagaatgatgtggtgcaggccaagaaggtgtatgagctgcagagtgaaaatctctacaagagtgacctggagtggctgcggggcatcggctggagccccctgggcagcctggaggccgagaagaacaagagggccagcgagatcatcagcgagaagaagtaccggcagcccccagacaggaacaagttcaccagcatcccagatgccatggacatcgtgctggccaagaccaatgccaagaacagaagtgaccggctgtaccgggaggcctgggacaaggacaagacccagatccacatcatgccagacaccccagacatcgtgctggccaaggccaacctgatcaacaccagtgacaagctgtacaggatgggctatgaggagctgaagaggaagggctatgacctgcctgtggatgccatccccatcaaggccgccaaggccagccgggagatcgccagcgagtacaagtacaaggagggcttcaggaagcagctgggccaccacatcggggccaggaacattgaagatgaccccaagatgatgtggagcatgcacgtggccaagatccagagcgaccgggagtacaagaaggactttgagaagtggaagaccaagttcagcagccctgtggacatgctgggcgtggtgctggccaagaagtgccagaccctggtgtctgatgtggactacaagaactacctgcaccagtggacctgcctgcctgaccagagtgatgtgatccacgcccggcaggcctatgacctgcagagcgacaacctgtacaagagtgacctgcagtggctgaagggcatcggctggatgaccagcggcagcctggaggatgagaagaacaagagggccacccagatcctgagtgaccacgtgtaccggcagcacccagaccagttcaagttcagcagcctgatggacagcatccccatggtgctggccaagaacaatgccatcaccatgaaccaccggctgtacacagaggcctgggacaaggacaagaccaccgtgcacatcatgccagacaccccagaggtgctgctggccaagcagaacaaggtgaactacagcgagaagctgtacaagctgggcctggaggaggccaagaggaagggctatgacatgagggtggatgccatccccatcaaggccgccaaggccagccgggacatcgccagcgagttcaagtacaaggagggctacaggaagcagctgggccaccacatcggggcccgggccatcagagatgaccccaagatgatgtggagcatgcacgtggccaagatccagagcgaccgggagtacaagaaggactttgagaagtggaagaccaagttcagcagccctgtggacatgctgggcgtggtgctggccaagaagtgccagaccctggtgtctgatgtggactacaagaactacctgcaccagtggacctgcctgcctgaccagagtgatgtgattcatgcccggcaggcctatgacctgcagagcgacaacatgtacaagagtgacctgcagtggatgaggggcatcggctgggtgtccatcggcagcctggatgtggagaagtgcaagagggccacagagatcctgagtgacaagatctaccggcagcccccagaccgcttcaagttcacctctgtgacagacagcctggagcaggtgctggccaagaacaatgccatcaccatgaacaagaggctgtacacagaggcctgggacaaggacaagacccagatccacatcatgccagacaccccagagatcatgctggccaggatgaacaagatcaactacagcgagagcctgtacaagctggccaatgaggaggccaagaagaagggctatgacctgcggagtgatgccatccccatcgtggccgccaaggccagccgggacatcatcagtgactacaagtacaaggatggctactgcaagcagctgggccaccacatcggggccaggaacattgaagatgaccccaagatgatgtggagcatgcacgtggccaagatccagagcgaccgggagtacaagaaggactttgagaagtggaagaccaagttcagcagccctgtggacatgctgggcgtggtgctggccaagaagtgccagaccctggtgtctgatgtggactacaagaactacctgcacgagtggacctgcctgcctgaccagagtgatgtgatccacgcccggcaggcctatgacctgcagagcgacaacatctacaagagtgacctgcagtggctgcggggcatcggctgggtgcccatcggctccatggatgtggtgaagtgcaagagggccacagagatcctgagtgacaacatctaccggcagcccccagacaagctgaagttcacctctgtgacagacagcctggagcaggtgctggccaagaacaatgccctgaacatgaacaagaggctgtacacagaggcctgggacaaggacaagacccagatccacatcatgccagacaccccagagatcatgctggcccggcagaacaagatcaactacagcgagaccctgtacaagctggccaatgaggaggccaagaagaagggctatgacctgcggagtgatgccatccccatcgtggccgccaaggccagcagagatgtgatcagtgactacaagtacaaggatggctacaggaagcagctgggccaccacatcggggccagaaatattgaagatgaccccaagatgatgtggagcatgcacgtggccaagatccagagcgaccgggagtacaagaaggactttgagaagtggaagaccaagttcagcagccctgtggacatgctgggcgtggtgctggccaagaagtgccagaccctggtgtctgatgtggactacaagaactacctgcacgagtggacctgcctgcctgaccagaatgatgtgattcatgcccggcaggcctatgacctgcagagcgacaacatctacaagagtgacctgcagtggctgcggggcatcggctgggtgcccatcggctccatggatgtggtgaagtgcaagagagctgctgagatcctgagtgacaacatctaccggcagcccccagacaagctgaagttcacctctgtgacagacagcctggagcaggtgctggccaagaacaatgccctgaacatgaacaagaggctgtacacagaggcctgggacaaggacaagacccaggtgcacatcatgccagacaccccagagatcatgctggcccggcagaacaagatcaactacagcgagagcctgtaccggcaggccatggaggaggccaagaaggagggctatgacctgcggagtgatgccatccccatcgtggccgccaaggccagccgggacatcgccagtgactacaagtacaaggaggcctacaggaagcagctgggccaccacatcggggcccgggctgtgcatgatgaccccaagatcatgtggagcctgcacatcgccaaggtgcagagcgaccgggagtacaagaaggactttgagaagtacaagacccgctacagcagccctgtggacatgctgggcatcgtgctggccaagaagtgccagaccctggtgtctgatgtggactacaagcaccccctgcacgagtggatctgcctgcctgaccagaatgacatcatccacgccaggaaggcctatgacctgcagagcgacaacctgtacaagagtgacctggagtggatgaagggcatcggctgggtgcccatcgacagcctggaggtggtgcgggccaagagagctggggagctgctgagtgacaccatctaccggcagaggcctgagaccctgaagttcaccagcatcacagacaccccagagcaggtgctggccaagaacaatgccctgaacatgaacaagaggctgtacacagaggcctgggacaatgacaagaagaccatccacgtgatgccagacaccccagagatcatgctggccaagctgaaccgcatcaactacagcgacaagctgtacaagctggccctggaggagagcaagaaggagggctatgacctgcggctggatgccatccccatccaggccgccaaggccagccgggacatcgccagtgactacaagtacaaggagggctacaggaagcagctgggccaccacatcggggccaggaacatcaaggatgaccccaagatgatgtggagcatccacgtggccaagatccagagcgaccgggagtacaagaaggagtttgagaagtggaagaccaagttcagcagccctgtggacatgctgggcgtggtgctggccaagaagtgccagatcctggtgtctgacatcgactacaagcaccccctgcacgagtggacctgcctgcctgaccagaatgatgtgatccaggccaggaaggcctatgacctgcagagtgatgccatctacaagagtgacctggagtggctgcggggcatcggctgggtgcccatcggctctgtggaggtggagaaggtgaagagagctggggagatcctgagtgacaggaagtaccggcagcctgctgaccagctgaagttcacctgcatcacagacaccccagaaattgtgctggccaagaacaatgccctgaccatgagcaagcacctgtacacagaggcctgggatgctgacaagaccagcatccacgtgatgccagacaccccagacatcctgctggccaagagcaacagcgccaacatcagccagaagctgtacaccaagggctgggatgagagcaagatgaaggactatgacctgcgggcagatgccatcagcatcaagagcgccaaggccagccgggacatcgccagtgactacaagtacaaggaggcctatgagaagcagaagggccaccacatcggggcccagagcattgaagatgaccccaagatcatgtgtgccatccacgccggcaagatccagagcgagcgggagtacaagaaggagttccagaagtggaagaccaagttcagcagccctgtggacatgctgagcatcctgctggccaagaagtgccagaccctggtgacagacatcgactacagaaactacctgcacgagtggacctgcatgccagaccagaatgacatcatccaggccaagaaggcctatgacctgcagagcgacagcgtgtacaaggctgacctggagtggctgcggggcatcggctggatgcctgagggctctgtggagatgaacagagtgaaggtggcccaggacctggtgaatgaaagactctaccgcaccaggcctgaggccctgtccttcaccagcatcgtggacaccccagaggtggtgctggccaaggccaacagcctgcagatcagcgagaagctgtaccaggaggcctggaacaaggacaagagcaacatcaccatccccagcgacaccccagagatgctgcaggcccacatcaatgccctgcagatcagcaacaagctgtaccagaaggactggaatgatgccaagcagaagggctatgacatccgggcagatgccatcgagatcaagcacgccaaggccagccgggagatcgccagcgagtacaagtacaaggagggctacaggaagcagctgggccaccacatgggcttccgcaccctgcaggatgaccccaagtctgtgtgggccatccatgctgccaagatccagagcgaccgggagtacaagaaggcctatgagaagagcaagggcatccacaacacccccctggacatgatgagcatcgtgcaggccaagaagtgccaggtgctggtgtctgacatcgactacagaaactacctgcaccagtggacctgcctgcctgaccagaatgatgtgatccaggccaagaaggcctatgacctgcagagcgacaacctgtacaagagtgacctggagtggctgaagggcatcggctggctgcctgagggctctgtggaggtgatgagggtgaagaatgcccagaacctgctgaatgaaaggctgtaccgcatcaagccagaggccctgaagttcaccagcatcgtggacaccccagaggtgatccaggccaagatcaatgctgtgcagatcagcgagcccctgtacagagatgcctgggagaaggagaaggccaacgtgaatgtgcctgctgacacccccctgatgctgcagagcaagatcaatgccctgcagatcagcaacaagcgctaccagcaggcctgggaggatgtgaagatgacaggctatgacctgcgggcagatgccatcggcatccagcacgccaaggccagccgggacatcgccagtgactacctgtacaagacagcctatgagaagcagaagggccactacatcggctgccgcagcgccaaggaggaccccaagctggtgtgggccgccaacgtgctgaagatgcagaatgaccggctgtacaagaaggcctacaatgaccacaaggccaagatcagcatccctgtggacatggtgtccatctctgctgccaaggagggccaggccctggccagtgatgtggactaccgccactacctgcaccactggagctgcttcccagaccagaatgatgtgatccaggccaggaaggcctatgacctgcagagcgacagcgtgtacaaggctgacctggagtggctgcggggcatcggctggatgcctgagggctctgtggagatgaacagagtgaaggtggcccaggacctggtgaatgaaagactctaccgcaccaggcctgaggccctgtccttcaccagcatcgtggacaccccagaggtggtgctggccaaggccaacagcctgcagatcagcgagaagctgtaccaggaggcctggaacaaggacaagagcaacatcaccatccccagcgacaccccagagatgctgcaggcccacatcaatgccctgcagatcagcaacaagctgtaccagaaggactggaatgacaccaagcagaagggctatgacatccgggcagatgccatcgagatcaagcacgccaaggccagccgggagatcgccagcgagtacaagtacaaggagggctacaggaagcagctgggccaccacatgggcttccgcaccctgcaggatgaccccaagtctgtgtgggccatccatgctgccaagatccagagcgaccgggagtacaagaaggcctatgagaagagcaagggcatccacaacacccccctggacatgatgagcatcgtgcaggccaagaagtgccaggtgctggtgtctgacatcgactacagaaactacctgcaccagtggacctgcctgcctgaccagaatgatgtgatccaggccaagaaggcctatgacctgcagagcgacaacctgtacaagagtgacctggagtggctgaagggcatcggctggctgcctgagggctctgtggaggtgatgagggtgaagaatgcccagaacctgctgaatgaaaggctgtaccgcatcaagccagaggccctgaagttcaccagcatcgtggacaccccagaggtgatccaggccaagatcaatgctgtgcagatcagcgagcccctgtacagaaatgcctgggagaaggagaaggccaacgtgaatgtgcctgctgacacccccctgatgctgcagagcaagatcaatgccctgcagatcagcaacaagcgctaccagcaggcctgggaggatgtgaagatgacaggctatgacctgcgggcagatgccatcggcatccagcacgccaaggccagccgggacatcgccagtgactacctgtacaagacagcctatgagaagcagaagggccactacatcggctgccgcagcgccaaggaggaccccaagctggtgtgggccgccaacgtgctgaagatgcagaatgaccggctgtacaagaaggcctacaatgaccacaaggccaagatcagcatccctgtggacatggtgtccatctctgctgccaaggagggccaggccctggccagtgatgtggactaccgccactacctgcaccactggagctgcttcccagaccagaatgatgtgatccaggccaggaaggcctatgacctgcagagcgacagcgtgtacaaggctgacctggagtggctgcggggcatcggctggatgcctgagggctctgtggagatgaacagagtgaaggtggcccaggacctggtgaatgaaagactctaccgcaccaggcctgaggccctgtccttcaccagcatcgtggacaccccagaggtggtgctggccaaggccaacagcctgcagatcagcgagaagctgtaccaggaggcctggaacaaggacaagagcaacatcaccatccccagcgacaccccagagatgctgcaggcccacatcaatgccctgcagatcagcaacaagctgtaccagaaggactggaatgacaccaagcagaagggctatgacatccgggcagatgccatcgagatcaagcacgccaaggccagccgggagatcgccagcgagtacaagtacaaggagggctacaggaagcagctgggccaccacatgggcttccgcaccctgcaggatgaccccaagtctgtgtgggccatccatgctgccaagatccagagcgaccgggagtacaagaaggcctatgagaagagcaagggcatccacaacacccccctggacatgatgagcatcgtgcaggccaagaagtgccaggtgctggtgtctgacatcgactacagaaactacctgcaccagtggacctgcctgcctgaccagaatgatgtgatccaggccaagaaggcctatgacctgcagagcgacaacctgtacaagagtgacctggagtggctgaagggcatcggctggctgcctgagggctctgtggaggtgatgagggtgaagaatgcccagaacctgctgaatgaaaggctgtaccgcatcaagccagaggccctgaagttcaccagcatcgtggacaccccagaggtgatccaggccaagatcaatgctgtgcagatcagcgagcccctgtacagagatgcctgggagaaggagaaggccaacgtgaatgtgcctgctgacacccccctgatgctgcagagcaagatcaatgccctgcagatcagcaacaagcgctaccagcaggcctgggaggatgtgaagatgacaggctatgacctgcgggcagatgccatcggcatccagcacgccaaggccagccgggacatcgccagtgactacctgtacaagacagcctatgagaagcagaagggccactacatcggctgccgcagcgccaaggaggaccccaagctggtgtgggccgccaacgtgctgaagatgcagaatgaccggctgtacaagaaggcctacaatgaccacaaggccaagatcagcatccctgtggacatggtgtccatctctgctgccaaggagggccaggccctggccagtgatgtggactaccgccactacctgcaccgctggagctgcttcccagaccagaatgatgtgatccaggccaggaaggcctatgacctgcagagtgatgccctgtacaaggctgacctggagtggctgcggggcatcggctggatgccccagggcagccctgaggtgctgcgggtgaagaatgcccagaacatcttctgtgacagcgtgtaccgcacccctgtggtgaacctgaagtacaccagcatcgtggacaccccagaggtggtgctggccaagagcaatgctgagaacatcagcatccccaagtaccgggaggtgtgggacaaggacaagaccagcatccacatcatgccagacaccccagagatcaacctggcccgggccaatgccctgaatgtgagcaacaagctgtaccgggagggctgggatgagatgaaggccggctgtgatgtgcggctggatgccatccccatccaggccgccaaggccagccgggagatcgccagtgactacaagtacaagctggaccacgagaagcagaagggccactacgtgggcaccctgacagccagagatgacaacaagatccgctgggccctgattgctgacaagctgcagaatgaaagagagtaccgcctggactgggccaagtggaaggccaagatccagagccctgtggacatgctgagcatcctgcacagcaagaacagccaggccctggtgtctgacatggactacagaaactacctgcaccagtggacctgcatgccagaccagaatgatgtgatccaggccaagaaggcctatgagctgcagagcgacaacgtgtacaaggctgacctggagtggctgcggggcatcggctggatgcccaatgacagcgtgtctgtgaaccacgccaagcatgctgctgacatcttcagcgagaagaagtaccgcaccaagattgagaccctgaacttcacccctgtggatgacagagtggactatgtgacagccaagcagagcggggagatcctggatgacatcaagtacaggaaggactggaatgccaccaagagcaagtacaccctgacagagacccccctgctgcacacagcccaggaggccgcccgcatcctggaccagtacctgtacaaggagggctgggagcggcagaaggccaccggctacatcctgcccccagatgctgtgccctttgtgcacgcccaccactgcaatgatgtgcagagcgagctgaagtacaaggccgagcacgtgaagcagaagggccactacgtgggcgtgcccaccatgagagatgaccccaagctggtgtggtttgaacatgctggccagatccagaatgaaaggctgtacaaggaggactaccacaagaccaaggccaagatcaacatcccagctgacatggtgtctgtgctggccgccaagcagggccagaccctggtgtctgacatcgactacagaaactacctgcaccagtggatgtgccacccagaccagaatgatgtgatccaggccaggaaggcctatgacctgcagagcgacaacgtgtacagagctgacctggagtggctgcggggcatcggctggatccccctggacagcgtggaccacgtgcgggtgaccaagaaccaggagatgatgagccagatcaagtacaagaagaatgccctggagaactaccccaacttccgctctgtggtggaccccccagagatcgtgctggccaagatcaacagcgtgaaccagagtgatgtgaagtacaaggagaccttcaacaaggccaagggcaagtacaccttctccccagacaccccccacatcagccacagcaaggacatgggcaagctgtacagcaccatcctgtacaagggggcctgggagggcaccaaggcctacggctacaccctggatgagcgctacatccccatcgtgggcgccaagcatgctgacctggtgaacagcgagctgaagtacaaggagacctatgagaagcagaagggccactacctggccggcaaggtgattggagagttccctggggtggtgcactgcctggacttccagaagatgaggtctgccctgaactacaggaagcactatgaggacaccaaggccaacgtgcacatccccaatgacatgatgaaccacgtgctggccaagcgctgccagtacatcctgagtgacctggagtaccgccactacttccaccagtggaccagcctgctggaggagcccaacgtcatccgggtgagaaatgcccaggagatcctgagtgacaacgtgtacaaggatgacctgaactggctgaagggcatcggctgctacgtgtgggacaccccccagatcctgcacgccaagaagagctatgacctgcagagccagctgcagtacacagctgctgggaaggagaacctgcagaactacaacctggtgacagacacccccctgtatgtgacagctgtgcagagcggcatcaatgccagcgaggtgaagtacaaggagaactaccaccagatcaaggacaagtacaccaccgtgctggagaccgtggactatgacaggaccaggaacctgaagaacctgtacagcagcaacctgtacaaggaggcctgggacagagtgaaggccaccagctacatcctgcccagcagcaccctgagcctgacccacgccaagaaccagaagcacctggccagccacatcaagtaccgggaggagtatgagaagttcaaggccctgtacaccctgcccaggtctgtggatgatgaccccaacacagcccgctgcctgcgggtgggcaagctgaacatcgaccggctgtacagatctgtgtatgagaagaacaagatgaagatccacatcgtgcctgacatggtggagatggtgacagccaaggacagccagaagaaggtgtctgaaattgactaccgcctgcggctgcacgagtggatctgccacccagacctgcaggtgaatgaccacgtgaggaaggtgacagaccagatcagtgacatcgtgtacaaggatgacctgaactggctgaagggcatcggctgctacgtgtgggacaccccagagatcctgcacgccaagcacgcctatgacctgagagatgacatcaagtacaaggcccacatgctgaagaccagaaatgactacaagctggtgacagacacccctgtgtatgtgcaggccgtgaagagcggcaagcagctgagtgatgctgtgtaccactatgactatgtgcacagcgtgcggggcaaggtggcccccaccaccaagacagtggacctggaccgggccctgcacgcctacaagctgcagagcagcaacctgtacaagaccagcctgcggaccctgcccaccggctaccgcctgcccggggacaccccccacttcaagcacatcaaggacacccgctacatgagcagctacttcaagtacaaggaggcctatgagcacaccaaggcctacggctacaccctgggccccaaggatgtgccctttgtgcacgtgagaagagtgaacaacgtgaccagcgagcggctgtaccgggagctgtaccacaagctgaaggacaagatccacaccaccccagacaccccagagatccggcaggtgaagaagacccaggaggccgtgtctgagctgatctacaagagtgacttcttcaagatgcagggccacatgatcagcctgccctacaccccccaggtgatccactgccgctacgtgggggacatcaccagtgacatcaagtacaaggaggacctgcaggtgctgaagggcttcggctgcttcctgtatgacaccccagacatggtgcgcagccgccacctgaggaagctgtggagcaactacctgtacacagacaaggccaggaagatgagggacaagtacaaggtggtgctggacaccccagagtacaggaaggtgcaggagctgaagacccacctgtctgagctggtgtacagagctgctgggaagaagcagaagagcatcttcacctctgtgcctgacaccccagacctgctgcgggccaagaggggccagaagctgcagagccagtacctgtatgtggagctggccaccaaggagcggccccaccaccacgccggcaaccagaccacagccctgaagcacgccaaggatgtgaaggacatggtgtctgagaagaagtacaagatccagtatgagaagatgaaggacaagtacacccctgtgcctgacacccccatcctgatccgggccaagagggcctactggaatgccagtgacctgcgctacaaggagaccttccagaagaccaagggcaagtaccacacagtgaaggatgccctggacatcgtgtaccacaggaaggtgacagatgacatcagcaagatcaagtacaaggagaactacatgagccagctgggcatctggaggagcatcccagacaggcctgagcacttccaccacagagctgtgacagacacagtgtctgatgtgaagtacaaggaggacctgacctggctgaagggcatcggctgctacgcctatgacaccccagacttcaccctggccgagaagaacaagaccctgtacagcaagtacaagtacaaggaggtgtttgagaggaccaagagtgacttcaagtatgtggccgacagccccatcaacagacacttcaagtatgccacccagctgatgaatgaaaggaagtacaagagcagcgccaagatgttcctgcagcacggctgcaatgagatcctgcggccagacatgctgacagccctgtacaacagccacatgtggagccagatcaagtacaggaagaactatgagaagagcaaggacaagttcaccagcatcgtggacaccccagagcacctgcggaccaccaaggtgaacaagcagatcagtgacatcctgtacaagctggagtacaacaaggccaagccccggggctacaccaccatccatgacacccccatgctgctgcacgtgaggaaggtgaaggatgaggtgtctgacctgaagtacaaggaggtgtaccagaggaacaagagcaactgcaccatcgagccagatgctgtgcacatcaaggccgccaaggatgcctacaaggtgaacaccaacctggactacaagaagcagtatgaggccaacaaggcccactggaagtggaccccagacagaccagacttcctgcaggccgccaagagcagcctgcagcagagcgactttgagtacaagctggaccgggagttcctgaagggctgcaagctgtctgtgacagatgacaagaacacagtgctggccctgaggaacaccctcatcgagagtgacctgaagtacaaggagaagcacgtgaaggagcggggcacctgccacgctgtgcctgacaccccccagatcctgctggccaagacagtgagcaacctggtgtctgagaacaagtacaaggaccacgtgaagaagcacctggcccagggcagctacaccaccctgcctgagacccgggacacagtgcacgtgaaggaggtgaccaagcacgtgtctgacaccaactacaagaagaagtttgtgaaggagaagggcaagagcaactacagcatcatgctggagcccccagaggtgaagcacgccatggaggtggccaagaagcagagtgatgtggcctacaggaaggatgccaaggagaacctgcactacaccaccgtggccgacagaccagacatcaagaaggccacccaggccgccaagcaggccagcgaggtggagtaccgggccaagcacaggaaggagggcagccacggcctgtccatgctgggccgcccagacatcgagatggccaagaaggccgccaagctgagcagccaggtgaagtaccgggagaactttgacaaggagaagggcaagacccccaagtacaaccccaaggacagccagctgtacaaggtgatgaaggatgccaacaacctggccagcgaggtgaagtacaaggctgacctgaagaagctgcacaagcctgtgacagacatgaaggagagcctcatcatgaaccacgtgctgaacaccagccagctggccagcagctaccagtacaagaagaagtatgagaagagcaagggccactaccacaccatcccagacaacctggagcagctgcacctgaaggaggccacagagctgcagagcatcgtgaagtacaaggagaagtatgagaaggagcggggcaagcccatgctggactttgagacccccacctacatcacagccaaggagagccagcagatgcagagcggcaaggagtacaggaaggactatgaggagagcatcaagggcaggaacctgaccggcctggaggtgaccccagccctgctgcacgtgaagtatgccaccaagatcgccagcgagaaggagtacaggaaggacctggaggagagcatccggggcaagggcctgacagagatggaggacaccccagacatgctgcgggccaagaatgccacccagatcctgaatgagaaggagtacaagagggacctggagctggaggtgaagggccggggcctgaatgccatggccaatgagaccccagacttcatgagggccagaaatgccacagacatcgccagccagatcaagtacaagcagagcgctgagatggagaaggccaacttcacctctgtggtggacaccccagagatcatccacgcccagcaggtgaagaacctgagcagccagaagaagtacaaggaggatgctgagaagtccatgagctactatgagaccgtgctggacaccccagagatccagagggtgcgggagaaccagaagaacttcagcctgctgcagtaccagtgtgacctgaagaacagcaagggcaagatcaccgtggtgcaggacaccccagagatcctgcgggtgaaggagaaccagaagaacttcagctctgtgctgtacaaggaggatgtgtccccaggcacagccatcggcaagaccccagagatgatgagggtgaagcagacccaggaccacatcagctctgtgaagtacaaggaggccatcggccagggcacccccatcccagacctgcctgaggtgaagagggtgaaggagacccagaagcacatcagctctgtgatgtacaaggagaacctgggcaccggcatccccaccaccgtgaccccagaaattgagcgggtgaagaggaaccaggagaacttcagctctgtgctgtacaaggagaacctgggcaagggcatccccacccccatcaccccagagatggagcgggtgaagaggaaccaggagaacttcagcagcatcctgtacaaggagaacctgagcaagggcacccccctgcctgtgaccccagagatggagcgggtgaagctgaaccaggagaacttcagctctgtgctgtacaaggaaaatgtgggcaagggcatccccatccccatcaccccagagatggagcgggtgaagcacaaccaggagaacttcagctctgtgctgtacaaggagaacctgggcaccggcatccccatccccatcaccccagagatgcagagggtgaagcacaaccaggagaacctgagctctgtgctgtacaaggagaacatgggcaagggcacccccctgcctgtgaccccagagatggagcgggtgaagcacaaccaggagaacatcagctctgtgctgtacaaggagaacatgggcaagggcacccccctgcctgtgaccccagagatggagcgggtgaagcacaaccaggagaacatcagctctgtgctgtacaaggagaacatgggcaagggcacccccctggccgtgaccccagagatggagcgggtgaagcacaaccaggagaacatcagctctgtgctgtacaaggaaaatgtgggcaaggccacagccacccctgtgaccccagagatgcagagggtgaagaggaaccaggagaacatcagctctgtgctgtacaaggagaacctgggcaaggccacccccacccccttcaccccagagatggagcgggtgaagaggaaccaggagaacttcagctctgtgctgtacaaggagaacatgaggaaggccacccccacccctgtgaccccagagatggagcgggccaagaggaaccaggagaacatcagctctgtgctgtacagcgacagcttcaggaagcagatccagggcaaggccgcctacgtgctggacaccccagagatgagaagagtgcgggagacccagaggcacatcagcacagtgaagtaccacgaggactttgagaagcacaagggctgcttcacccctgtggtgacagaccccatcacagagcgggtgaagaagaacatgcaggacttcagtgacatcaactaccggggcatccagaggaaggtggtggagatggagcagaagagaaatgaccaggaccaggagaccatcaccggcctgcgggtgtggaggaccaaccctggctctgtgtttgattatgaccctgctgaggacaacatccagagccgcagcctgcacatgatcaacgtgcaggcccagaggaggagccgggagcagagccgcagcgccagcgccctgagcatctctggaggagaggagaagtctgagcacagcgaggccccagaccaccacctgagcacctacagtgatggcggcgtgtttgctgtgtccacagcctacaagcacgccaagaccacagagctgccccagcagaggagcagctctgtggccacccagcagaccaccgtgagcagcatccccagccaccccagcacagctgggaagatcttccgggccatgtatgactacatggccgcagatgctgatgaggtgtccttcaaggatggagatgccatcatcaacgtgcaggccattgatgagggctggatgtatggaacagtgcagaggactggaagaacaggcatgctgcctgccaactacgtggaggccatctag

SEQ ID NO: 161326 - DNA, 20010 bp, Artificial Sequence
  Description of Artificial Sequence: Synthetic coding sequence
atggctgatgatgaagattatgaggaggtggtggagtactacacagaggaggtggtgtatgaggaggtgcctggagagaccatcaccaagatctatgagaccaccaccaccaggaccagtgactatgagcagagcgagaccagcaagccagccctggcccagcctgccctggcccagcctgccagcgccaagcctgtggagaggaggaaggtgatcaggaagaaggtggaccccagcaagttcatgaccccctacatcgcccacagccagaagatgcaggacctcttcagccccaacaagtacaaggagaagtttgagaagaccaagggccagccctatgccagcaccacagacaccccagagctgcggcgcatcaagaaggtgcaggaccagctgtctgaggtgaagtacaggatggatggagatgtggccaagaccatctgccacgtggatgagaaggccaaggacattgaacatgccaagaaggtgtcccagcaggtgtccaaggtgctgtacaagcagaactgggaggacaccaaggacaagtacctgctgcccccagatgcccctgagctggtgcaggccgtgaagaacacagccatgttcagcaagaagctgtacacagaggactgggaggccgacaagagcctcttctacccctacaatgacagccctgagctgcggcgggtggcccaggcccagaaggccctgagtgatgtggcctacaagaagggcctggccgagcagcaggcccagttcacccccctggccgaccccccagacatcgagtttgccaagaaggtgaccaaccaggtgtccaagcagaagtacaaggaggactatgagaacaagatcaagggcaagtggagcgagaccccctgctttgaggtggccaatgccaggatgaatgctgacaacatcagcaccaggaagtaccaggaggactttgagaacatgaaggaccagatctacttcatgcagacagagaccccagagtacaagatgaacaagaaggccggcgtggccgccagcaaggtgaagtacaaggaggactatgagaagaacaagggcaaggctgactacaacgtgctgcctgccagcgagaacccccagctgcggcagctgaaggctgctggagatgccctgagtgacaagctgtacaaggaaaattatgagaagaccaaggccaagagcatcaactactgtgagacccccaagttcaagctggacacagtgctgcagaacttcagcagtgacaagaagtacaaggacagctacctgaaggacatcctgggccactacgtgggcagctttgaggacccctaccacagccactgcatgaaggtgacagcccagaacagcgacaagaactacaaggccgagtatgaggaggaccggggcaagggcttcttcccccagaccatcacccaggagtatgaggccatcaagaagctggaccagtgcaaggaccacacctacaaggtgcacccagacaagaccaagttcacccaggtgacagacagccctgtgctgctgcaggcccaggtgaacagcaagcagctgagtgacctgaactacaaggccaagcatgagagcgagaagttcaagtgccacatccccccagacaccccagccttcatccagcacaaggtgaatgcctacaacctgagtgacaacctgtacaagcaggactgggagaagagcaaggccaagaagtttgacatcaaggtggatgccatccccctgctggccgccaaggccaacaccaagaacaccagtgatgtgatgtacaagaaggactatgagaagaacaagggcaagatgattggagtgctgagcatcaatgatgaccccaagatgctgcacagcctgaaggtggccaagaaccagagcgaccggctgtacaaggaaaattatgagaagaccaaggccaagtccatgaactactgtgagacccccaagtaccagctggacacccagctgaagaacttcagcgaggcccgctacaaggacctgtatgtgaaggatgtgctgggccactacgtgggctccatggaggacccctaccacacccactgcatgaaggtggccgcccagaacagcgacaagagctacaaggccgagtatgaagaagataaaggcaagtgctacttcccccagaccatcacccaggagtatgaggccatcaagaagctggaccagtgcaaggaccacacctacaaggtgcacccagacaagaccaagttcaccgctgtgacagacagccctgtgctgctgcaggcccagctgaacaccaagcagctgagtgacctgaactacaaggccaagcatgaaggagagaagttcaagtgccacatcccagcagatgccccccagttcatccagcaccgggtgaatgcctacaacctgagtgacaacgtgtacaagcaggactgggagaagagcaaggccaagaagtttgacatcaaggtggatgccatccccctgctggccgccaaggccaacaccaagaacaccagtgatgtgatgtacaagaaggactatgagaagagcaagggcaagatgattggagccctgagcatcaatgatgaccccaagatgctgcacagcctgaagacagccaagaaccagagcgaccgggagtacaggaaggactatgagaagagcaagaccatctacacagcccccctggacatgctgcaggtgacccaggccaagaagagccaggccatcgccagtgatgtggactacaagcacatcctgcacagctacagctaccccccagacagcatcaacgtggacctggccaagaaggcctatgccctgcagagtgatgtggagtacaaggctgactacaacagctggatgaagggctgcggctgggtgcccttcggcagcctggagatggagaaggccaagagggccagtgacatcctgaatgagaagaagtaccggcagcacccagacaccctgaagttcaccagcattgaagatgcccccatcaccgtgcagagcaagatcaaccaggcccagaggagtgacatcgcctacaaggccaagggggaggagatcatccacaagtacaacctgcccccagacctgccccagttcatccaggccaaggtgaatgcctacaacatcagcgagaacatgtacaaggctgacctgaaggacctgagcaagaagggctatgacctgaggacagatgccatccccatccgggccgccaaggccgcccggcaggccgccagtgatgtgcagtacaagaaggactatgagaaggccaagggcaagatggtgggcttccagagcctgcaggatgaccccaagctggtgcactacatgaatgtggccaagatccagagcgaccgggagtacaagaaggactatgagaagaccaagagcaagtacaacacccctcatgacatgtttaatgtggtggccgccaagaaggcccaggatgtggtgtccaatgtgaactacaagcacagcctgcaccactacacctacctgcctgatgccatggacctggagctgagcaagaacatgatgcagatccagagcgacaacgtgtacaaggaggactacaacaactggatgaagggcatcggctggatccccatcggcagcctggatgtggagaaggtgaagaaggctggagatgccctgaatgagaagaagtaccggcagcacccagacaccctgaagttcaccagcatcgtggacagccctgtgatggtgcaggccaagcagaacaccaagcaggtgtctgacatcctgtacaaggccaagggggaggatgtgaagcacaagtacaccatgagcccagacctgccccagttcctgcaggccaagtgcaatgcctacaacatcagtgatgtgtgctacaagagggactggtatgacctgattgccaagggcaacaacgtgctgggagatgccatccccatcacagctgccaaggccagcaggaacatcgccagtgactacaagtacaaggaggcctatgagaagagcaagggcaagcacgtgggcttccgcagcctgcaggatgaccccaagctggtgcactacatgaatgtggccaagctgcagagcgaccgggagtacaagaagaactatgagaacaccaagaccagctaccacacccctggggacatggtgtccatcacagctgccaagatggcccaggatgtggccaccaacgtgaactacaagcagcccctgcaccactacacctacctgcctgatgccatgagcctggagcacaccagaaatgtgaaccagatccagagcgacaacgtgtacaaggatgagtacaacagcttcctgaagggcatcggctggatccccatcggcagcctggaggtggagaaggtgaagaaggctggagatgccctgaatgaaaggaagtaccggcagcacccagacacagtgaagttcacctctgtgcctgacagcatgggcatggtgctggcccagcacaacaccaagcagctgagtgacctgaactacaaggtggagggggagaagctgaagcacaagtacaccatcgaccctgagctgccccagttcatccaggccaaggtgaatgccctgaacatgtctgatgcccactacaaggctgactggaagaagaccatcgccaagggctatgacctgcggccagatgccatccccatcgtggccgccaagagcagcaggaacatcgccagtgactgcaagtacaaggaggcctatgagaaggccaagggcaagcaggtgggcttcctgagcctgcaggatgaccccaagctggtgcactacatgaatgtggccaagatccagagcgaccgggagtacaagaagggctatgaggccagcaagaccaagtaccacacccccctggacatggtgtctgtgacagctgccaagaagagccaggaggtggccaccaatgccaactaccggcagagctaccaccactacaccctgctgcctgatgccctgaatgtggagcacagcagaaatgccatgcagatccagagcgacaacctgtacaagagtgacttcaccaactggatgaagggcatcggctgggtgcccatcgagagcctggaggtggagaaggccaagaaggccggggagatcctgtctgagaagaagtaccggcagcaccctgagaagctgaagttcacctacgccatggacaccatggagcaggccctgaacaagagcaacaagctgaacatggacaagaggctgtacacagagaagtggaacaaggacaagaccaccatccacgtgatgccagacaccccagacatcctgctgagccgggtgaaccagatcaccatgtctgacaagctgtacaaggccggctgggaggaggagaagaagaagggctatgacctgcggccagatgccatcgccatcaaggccgcccgggccagccgggacatcgccagtgactacaagtacaagaaggcctatgagcaggccaagggcaagcacatcggcttccgcagcctggaggatgaccccaagctggtgcacttcatgcaggtggccaagatgcagagcgaccgggagtacaagaagggctatgagaagagcaagaccagcttccacacccctgtggacatgctgtctgtggtggccgccaagaagagccaggaggtggccaccaatgccaactacagaaatgtcatccacacctacaacatgctgcctgatgccatgagctttgagctggccaagaacatgatgcagatccagagcgacaaccagtacaaggctgactatgctgacttcatgaagggcatcggctggctgcccctgggcagcctggaggccgagaagaacaagaaggccatggagatcatcagcgagaagaagtaccggcagcacccagacaccctgaagtacagcaccctgatggacagcatgaacatggtgctggcccagaacaatgccaagatcatgaatgagcacctgtacaagcaggcctgggaggccgacaagaccaaggtgcacatcatgccagacatcccccagatcatcctggccaaggccaatgccatcaacatgtctgacaagctgtacaagctgagcctggaggagagcaagaagaagggctatgacctgcggccagatgccatccccatcaaggccgccaaggccagccgggacatcgccagtgactacaagtacaagtacaactatgagaagggcaagggcaagatggtgggcttccgcagcctggaggatgaccccaagctggtgcacagcatgcaggtggccaagatgcagagcgaccgggagtacaagaagaactatgagaacaccaagaccagctaccacaccccagctgacatgctgtctgtgacagctgccaaggatgcccaggccaacatcaccaacaccaactacaagcacctgatccacaagtacatcctgctgcctgatgccatgaacatcgagctgaccaggaacatgaaccgcatccagagcgacaatgagtacaagcaggactacaatgagtggtacaagggcctgggctggagccctgctggcagcctggaggtggagaaggccaagaaggccacagaatatgccagtgaccagaagtaccggcagcaccccagcaacttccagttcaagaagctgacagacagcatggacatggtgctggccaagcagaatgcccacaccatgaacaagcacctgtacaccatcgactggaacaaggacaagaccaagatccacgtgatgccagacaccccagacatcctgcaggccaagcagaaccagaccctgtacagccagaagctgtacaagctgggctgggaggaggccctgaagaagggctatgacctgcctgtggatgccatctctgtgcagctggccaaggccagccgggacatcgccagtgactacaagtacaagcagggctacaggaagcagctgggccaccacgtgggcttccgcagcctgcaggatgaccccaagctggtgctgtccatgaatgtggccaagatgcagagcgagcgggagtacaagaaggactttgagaagtggaagaccaagttcagcagccctgtggacatgctgggcgtggtgctggccaagaagtgccaggagctggtgtctgatgtggactacaagaactacctgcaccagtggacctgcctgcctgaccagaatgatgtggtgcaggccaagaaggtgtatgagctgcagagtgaaaatctctacaagagtgacctggagtggctgcggggcatcggctggagccccctgggcagcctggaggccgagaagaacaagagggccagcgagatcatcagcgagaagaagtaccggcagcccccagacaggaacaagttcaccagcatcccagatgccatggacatcgtgctggccaagaccaatgccaagaacagaagtgaccggctgtaccgggaggcctgggacaaggacaagacccagatccacatcatgccagacaccccagacatcgtgctggccaaggccaacctgatcaacaccagtgacaagctgtacaggatgggctatgaggagctgaagaggaagggctatgacctgcctgtggatgccatccccatcaaggccgccaaggccagccgggagatcgccagcgagtacaagtacaaggagggcttcaggaagcagctgggccaccacatcggggccaggaacattgaagatgaccccaagatgatgtggagcatgcacgtggccaagatccagagcgaccgggagtacaagaaggactttgagaagtggaagaccaagttcagcagccctgtggacatgctgggcgtggtgctggccaagaagtgccagaccctggtgtctgatgtggactacaagaactacctgcaccagtggacctgcctgcctgaccagagtgatgtgatccacgcccggcaggcctatgacctgcagagcgacaacctgtacaagagtgacctgcagtggctgaagggcatcggctggatgaccagcggcagcctggaggatgagaagaacaagagggccacccagatcctgagtgaccacgtgtaccggcagcacccagaccagttcaagttcagcagcctgatggacagcatccccatggtgctggccaagaacaatgccatcaccatgaaccaccggctgtacacagaggcctgggacaaggacaagaccaccgtgcacatcatgccagacaccccagaggtgctgctggccaagcagaacaaggtgaactacagcgagaagctgtacaagctgggcctggaggaggccaagaggaagggctatgacatgagggtggatgccatccccatcaaggccgccaaggccagccgggacatcgccagcgagttcaagtacaaggagggctacaggaagcagctgggccaccacatcggggcccgggccatcagagatgaccccaagatgatgtggagcatgcacgtggccaagatccagagcgaccgggagtacaagaaggactttgagaagtggaagaccaagttcagcagccctgtggacatgctgggcgtggtgctggccaagaagtgccagaccctggtgtctgatgtggactacaagaactacctgcaccagtggacctgcctgcctgaccagagtgatgtgattcatgcccggcaggcctatgacctgcagagcgacaacatgtacaagagtgacctgcagtggatgaggggcatcggctgggtgtccatcggcagcctggatgtggagaagtgcaagagggccacagagatcctgagtgacaagatctaccggcagcccccagaccgcttcaagttcacctctgtgacagacagcctggagcaggtgctggccaagaacaatgccctgaacatgaacaagaggctgtacacagaggcctgggacaaggacaagacccagatccacatcatgccagacaccccagagatcatgctggcccggcagaacaagatcaactacagcgagaccctgtacaagctggccaatgaggaggccaagaagaagggctatgacctgcggagtgatgccatccccatcgtggccgccaaggccagcagagatgtgatcagtgactacaagtacaaggatggctacaggaagcagctgggccaccacatcggggccaggaacattgaagatgaccccaagatgatgtggagcatgcacgtggccaagatccagagcgaccgggagtacaagaaggactttgagaagtggaagaccaagttcagcagccctgtggacatgctgggcgtggtgctggccaagaagtgccagaccctggtgtctgatgtggactacaagaactacctgcacgagtggacctgcctgcctgaccagaatgatgtgatccacgcccggcaggcctatgacctgcagagcgacaacatctacaagagtgacctgcagtggctgcggggcatcggctgggtgcccatcggctccatggatgtggtgaagtgcaagagagctgctgagatcctgagtgacaacatctaccggcagcccccagacaagctgaagttcacctctgtgacagacagcctggagcaggtgctggccaagaacaatgccctgaacatgaacaagaggctgtacacagaggcctgggacaaggacaagacccaggtgcacatcatgccagacaccccagagatcatgctggcccggcagaacaagatcaactacagcgagagcctgtaccggcaggccatggaggaggccaagaaggagggctatgacctgcggagtgatgccatccccatcgtggccgccaaggccagccgggacatcgccagtgactacaagtacaaggaggcctacaggaagcagctgggccaccacatcggggcccgggctgtgcatgatgaccccaagatcatgtggagcctgcacatcgccaaggtgcagagcgaccgggagtacaagaaggactttgagaagtacaagacccgctacagcagccctgtggacatgctgggcatcgtgctggccaagaagtgccagaccctggtgtctgatgtggactacaagcaccccctgcacgagtggatctgcctgcctgaccagaatgacatcatccacgccaggaaggcctatgacctgcagagcgacaacctgtacaagagtgacctggagtggatgaagggcatcggctgggtgcccatcgacagcctggaggtggtgcgggccaagagagctggggagctgctgagtgacaccatctaccggcagaggcctgagaccctgaagttcaccagcatcacagacaccccagagcaggtgctggccaagaacaatgccctgaacatgaacaagaggctgtacacagaggcctgggacaatgacaagaagaccatccacgtgatgccagacaccccagagatcatgctggccaagctgaaccgcatcaactacagcgacaagctgtacaagctggccctggaggagagcaagaaggagggctatgacctgcggctggatgccatccccatccaggccgccaaggccagccgggacatcgccagtgactacaagtacaaggagggctacaggaagcagctgggccaccacatcggggccaggaacatcaaggatgaccccaagatgatgtggagcatccacgtggccaagatccagagcgaccgggagtacaagaaggagtttgagaagtggaagaccaagttcagcagccctgtggacatgctgggcgtggtgctggccaagaagtgccagatcctggtgtctgacatcgactacaagcaccccctgcacgagtggacctgcctgcctgaccagaatgatgtgatccaggccaggaaggcctatgacctgcagagtgatgccatctacaagagtgacctggagtggctgcggggcatcggctgggtgcccatcggctctgtggaggtggagaaggtgaagagagctggggagatcctgagtgacaggaagtaccggcagcctgctgaccagctgaagttcacctgcatcacagacaccccagagatcgtgctggccaagaacaatgccctgaccatgagcaagcacctgtacacagaggcctgggatgctgacaagaccagcatccacgtgatgccagacaccccagacatcctgctggccaagagcaacagcgccaacatcagccagaagctgtacaccaagggctgggatgagagcaagatgaaggactatgacctgcgggcagatgccatcagcatcaagagcgccaaggccagccgggacatcgccagtgactacaagtacaaggaggcctatgagaagcagaagggccaccacatcggggcccagagcattgaagatgaccccaagatcatgtgtgccatccatgctgggaagatccagagcgagcgggagtacaagaaggagttccagaagtggaagaccaagttcagcagccctgtggacatgctgagcatcctgctggccaagaagtgccagaccctggtgacagacatcgactacagaaactacctgcacgagtggacctgcatgccagaccagaatgacatcatccaggccaagaaggcctatgacctgcagagtgatgccctgtacaaggctgacctggagtggctgcggggcatcggctggatgccccagggcagccctgaggtgctgcgggtgaagaatgcccagaacatcttctgtgacagcgtgtaccgcacccctgtggtgaacctgaagtacaccagcatcgtggacaccccagaggtggtgctggccaagagcaatgctgagaacatcagcatccccaagtaccgggaggtgtgggacaaggacaagaccagcatccacatcatgccagacaccccagagatcaacctggcccgggccaatgccctgaatgtgagcaacaagctgtaccgggagggctgggatgagatgaaggccggctgtgatgtgcggctggatgccatccccatccaggccgccaaggccagccgggagatcgccagtgactacaagtacaagctggaccacgagaagcagaagggccactacgtgggcaccctgacagccagagatgacaacaagatccgctgggccctgattgctgacaagctgcagaatgaaagagagtaccgcctggactgggccaagtggaaggccaagatccagagccctgtggacatgctgagcatcctgcacagcaagaacagccaggccctggtgtctgacatggactacagaaactacctgcaccagtggacctgcatgccagaccagaatgatgtgatccaggccaagaaggcctatgagctgcagagcgacaacgtgtacaaggctgacctggagtggctgcggggcatcggctggatgcccaatgattctgtgtctgtgaaccacgccaagcacgccgctgacatcttcagcgagaagaagtaccgcaccaagattgagaccctgaacttcacccctgtggatgacagagtggactatgtgacagccaagcagagcggggagatcctggatgacatcaagtacaggaaggactggaatgccaccaagagcaagtacaccctgacagagacccccctgctgcacacagcccaggaggccgcccgcatcctggaccagtacctgtacaaggagggctgggagcggcagaaggccaccggctacatcctgcccccagatgctgtgccctttgtgcacgcccaccactgcaatgatgtgcagagcgagctgaagtacaaggccgagcacgtgaagcagaagggccactacgtgggcgtgcccaccatgagagatgaccccaagctggtgtggtttgagcacgccggccagatccagaatgaaagactctacaaggaggactaccacaagaccaaggccaagatcaacatcccagctgacatggtgtctgtgctggccgccaagcagggccagaccctggtgtctgacatcgactacagaaactacctgcaccagtggatgtgccacccagaccagaatgatgtgatccaggccaggaaggcctatgacctgcagagcgacaacgtgtacagagctgacctggagtggctgcggggcatcggctggatccccctggacagcgtggaccacgtgcgggtgaccaagaaccaggagatgatgagccagatcaagtacaagaagaatgccctggagaactaccccaacttccgctctgtggtggaccccccagaaattgtgctggccaagatcaacagcgtgaaccagagtgatgtgaagtacaaggagaccttcaacaaggccaagggcaagtacaccttctccccagacaccccccacatcagccacagcaaggacatgggcaagctgtacagcaccatcctgtacaagggggcctgggagggcaccaaggcctacggctacaccctggatgagcgctacatccccatcgtgggcgccaagcacgccgacctggtgaacagcgagctgaagtacaaggagacctatgagaagcagaagggccactacctggccggcaaggtgattggagagttccctggggtggtgcactgcctggacttccagaagatgaggtctgccctgaactacaggaagcactatgaggacaccaaggccaacgtgcacatccccaatgacatgatgaaccacgtgctggccaagcgctgccagtacatcctgagtgacctggagtaccgccactacttccaccagtggaccagcctgctggaggagcccaacgtcatccgggtgagaaatgcccaggagatcctgagtgacaacgtgtacaaggatgacctgaactggctgaagggcatcggctgctacgtgtgggacaccccccagatcctgcacgccaagaagagctatgacctgcagagccagctgcagtacacagctgctgggaaggagaacctgcagaactacaacctggtgacagacacccccctgtatgtgacagctgtgcagagcggcatcaatgccagcgaggtgaagtacaaggagaactaccaccagatcaaggacaagtacaccaccgtgctggagaccgtggactatgacaggaccaggaacctgaagaacctgtacagcagcaacctgtacaaggaggcctgggacagagtgaaggccaccagctacatcctgcccagcagcaccctgagcctgacccacgccaagaaccagaagcacctggccagccacatcaagtaccgggaggagtatgagaagttcaaggccctgtacaccctgcccaggtctgtggatgatgaccccaacacagcccgctgcctgcgggtgggcaagctgaacatcgaccggctgtacagatctgtgtatgagaagaacaagatgaagatccacatcgtgcctgacatggtggagatggtgacagccaaggacagccagaagaaggtgtctgaaattgactaccgcctgcggctgcacgagtggatctgccacccagacctgcaggtgaatgaccacgtgaggaaggtgacagaccagatcagtgacatcgtgtacaaggatgacctgaactggctgaagggcatcggctgctacgtgtgggacaccccagagatcctgcacgccaagcacgcctatgacctgagagatgacatcaagtacaaggcccacatgctgaagaccagaaatgactacaagctggtgacagacacccctgtgtatgtgcaggccgtgaagagcggcaagcagctgagtgatgctgtgtaccactatgactatgtgcacagcgtgcggggcaaggtggcccccaccaccaagacagtggacctggaccgggccctgcacgcctacaagctgcagagcagcaacctgtacaagaccagcctgcggaccctgcccaccggctaccgcctgcccggggacaccccccacttcaagcacatcaaggacacccgctacatgagcagctacttcaagtacaaggaggcctatgagcacaccaaggcctacggctacaccctgggccccaaggatgtgccctttgtgcacgtgcggcgggtgaacaacgtgaccagcgagcggctgtaccgggagctgtaccacaagctgaaggacaagatccacaccaccccagacaccccagagatccggcaggtgaagaagacccaggaggccgtgtctgagctgatctacaagagtgacttcttcaagatgcagggccacatgatcagcctgccctacaccccccaggtgatccactgccgctacgtgggggacatcaccagtgacatcaagtacaaggaggacctgcaggtgctgaagggcttcggctgcttcctgtatgacaccccagacatggtgcgcagccgccacctgaggaagctgtggagcaactacctgtacacagacaaggccaggaagatgagggacaagtacaaggtggtgctggacaccccagagtacaggaaggtgcaggagctgaagacccacctgtctgagctggtgtacagagctgctgggaagaagcagaagagcatcttcacctctgtgcctgacaccccagacctgctgcgggccaagaggggccagaagctgcagagccagtacctgtatgtggagctggccaccaaggagcggccccaccaccacgccggcaaccagaccacagccctgaagcacgccaaggatgtgaaggacatggtgtctgagaagaagtacaagatccagtatgagaagatgaaggacaagtacacccctgtgcctgacacccccatcctgatccgggccaagagggcctactggaatgccagtgacctgcgctacaaggagaccttccagaagaccaagggcaagtaccacacagtgaaggatgccctggacatcgtgtaccacaggaaggtgacagatgacatcagcaagatcaagtacaaggagaactacatgagccagctgggcatctggaggagcatcccagacaggcctgagcacttccaccacagagctgtgacagacacagtgtctgatgtgaagtacaaggaggacctgacctggctgaagggcatcggctgctacgcctatgacaccccagacttcaccctggccgagaagaacaagaccctgtacagcaagtacaagtacaaggaggtgtttgagaggaccaagagtgacttcaagtatgtggccgacagccccatcaacagacacttcaagtatgccacccagctgatgaatgagaagaagtacagagctgactatgagcagaggaaggacaagtaccacctggtggtggatgagcccaggcacctgctggccaagacagctggggaccagatcagccagatcaagtacaggaagaactatgagaagagcaaggacaagttcaccagcatcgtggacaccccagagcacctgcggaccaccaaggtgaacaagcagatcagtgacatcctgtacaagctggagtacaacaaggccaagccccggggctacaccaccatccatgacacccccatgctgctgcacgtgaggaaggtgaaggatgaggtgtctgacctgaagtacaaggaggtgtaccagaggaacaagagcaactgcaccattgaaccagatgctgtgcacatcaaggccgccaaggatgcctacaaggtgaacaccaacctggactacaagaagcagtatgaggccaacaaggcccactggaagtggaccccagacagaccagacttcctgcaggccgccaagagcagcctgcagcagagcgactttgagtacaagctggaccgggagttcctgaagggctgcaagctgtctgtgacagatgacaagaacacagtgctggccctgaggaacaccctgattgaaagtgacctgaagtacaaggagaagcacgtgaaggagcggggcacctgccacgctgtgcctgacaccccccagatcctgctggccaagacagtgagcaacctggtgtctgagaacaagtacaaggaccacgtgaagaagcacctggcccagggcagctacaccaccctgcctgagacccgggacacagtgcacgtgaaggaggtgaccaagcacgtgtctgacaccaactacaagaagaagtttgtgaaggagaagggcaagagcaactacagcatcatgctggagcccccagaggtgaagcacgccatggaggtggccaagaagcagagtgatgtggcctacaggaaggatgccaaggagaacctgcactacaccaccgtggccgacagaccagacatcaagaaggccacccaggccgccaagcaggccagcgaggtggagtaccgggccaagcacaggaaggagggcagccacggcctgtccatgctgggccgcccagacatcgagatggccaagaaggccgccaagctgagcagccaggtgaagtacagagaaaattttgacaaggagaagggcaagacccccaagtacaaccccaaggacagccagctgtacaaggtgatgaaggatgccaacaacctggccagcgaggtgaagtacaaggctgacctgaagaagctgcacaagcctgtgacagacatgaaggagagcctcatcatgaaccacgtgctgaacaccagccagctggccagcagctaccagtacaagaagaagtatgagaagagcaagggccactaccacaccatcccagacaacctggagcagctgcacctgaaggaggccacagagctgcagagcatcgtgaagtacaaggagaagtatgagaaggagcggggcaagcccatgctggactttgagacccccacctacatcacagccaaggagagccagcagatgcagagcggcaaggagtacaggaaggactatgaggagagcatcaagggcaggaacctgaccggcctggaggtgaccccagccctgctgcacgtgaagtatgccaccaagatcgccagcgagaaggagtacaggaaggacctggaggagagcatccggggcaagggcctgacagagatggaggacaccccagacatgctgcgggccaagaatgccacccagatcctgaatgagaaggagtacaagagggacctggagctggaggtgaagggccggggcctgaatgccatggccaatgagaccccagacttcatgagggccagaaatgccacagacatcgccagccagatcaagtacaagcagagcgctgagatggagaaggccaacttcacctctgtggtggacaccccagagatcatccacgcccagcaggtgaagaacctgagcagccagaagaagtacaaggaggatgctgagaagtccatgagctactatgaaacagtgctggacaccccagagatccagagggtgcgggagaaccagaagaacttcagcctgctgcagtaccagtgtgacctgaagaacagcaagggcaagatcaccgtggtgcaggacaccccagagatcctgcgggtgaaggagaaccagaagaacttcagctctgtgctgtacaaggaggatgtgtccccaggcacagccatcggcaagaccccagagatgatgagggtgaagcagacccaggaccacatcagctctgtgaagtacaaggaggccatcggccagggcacccccatcccagacctgcctgaggtgaagagggtgaaggagacccagaagcacatcagctctgtgatgtacaaggagaacctgggcaccggcatccccaccaccgtgaccccagaaattgaaagagtgaagaggaaccaggagaacttcagctctgtgctgtacaaggagaacctgggcaagggcatccccacccccatcaccccagagatggagcgggtgaagaggaaccaggagaacttcagctctgtgctgtacaaggagaacatgggcaagggcacccccctggccgtgaccccagagatggagcgggtgaagcacaaccaggagaacatcagctctgtgctgtacaaggaaaatgtgggcaaggccacagccacccctgtgaccccagagatgcagagggtgaagaggaaccaggagaacatcagctctgtgctgtacaaggagaacctgggcaaggccacccccacccccttcaccccagagatggagcgggtgaagaggaaccaggagaacttcagctctgtgctgtacaaggagaacatgaggaaggccacccccacccctgtgaccccagagatggagcgggccaagaggaaccaggagaacatcagctctgtgctgtacagcgacagcttcaggaagcagatccagggcaaggccgcctacgtgctggacaccccagagatgagaagagtgcgggagacccagaggcacatcagcacagtgaagtaccacgaggactttgagaagcacaagggctgcttcacccctgtggtgacagaccccatcacagagcgggtgaagaagaacatgcaggacttcagtgacatcaactaccggggcatccagaggaaggtggtggagatggagcagaagagaaatgaccaggaccaggagaccatcaccggcctgcgggtgtggaggaccaaccctggctctgtgtttgattatgaccctgctgaggacaacatccagagccgcagcctgcacatgatcaacgtgcaggcccagaggaggagccgggagcagagccgcagcgccagcgccctgagcatctctggaggagaggagaagtctgagcacagcgaggccccagaccaccacctgagcacctacagtgatggcggcgtgtttgctgtgtccacagcctacaagcacgccaagaccacagagctgccccagcagaggagcagctctgtggccacccagcagaccaccgtgagcagcatccccagccaccccagcacagctgggaagatcttccgggccatgtatgactacatggccgcagatgctgatgaggtgtccttcaaggatggagatgccatcatcaacgtgcaggccattgatgagggctggatgtatggaacagtgcagaggactggaagaacaggcatgctgcctgccaactacgtggaggccatctag

SEQ ID NO: 161327 - DNA, 25578 bp, Artificial Sequence
  Description of Artificial Sequence: Synthetic coding sequence
atggctgatgatgaagattatgaggaggtggtggagtactacacagaggaggtggtgtatgaggaggtgcctggagagaccatcaccaagatctatgagaccaccaccaccaggaccagtgactatgagcagagcgagaccagcaagccagccctggcccagcctgccctggcccagcctgccagcgccaagcctgtggagaggaggaaggtgatcaggaagaaggtggaccccagcaagttcatgaccccctacatcgcccacagccagaagatgcaggacctcttcagccccaacaagtacaaggagaagtttgagaagaccaagggccagccctatgccagcaccacagacaccccagagctgcggcgcatcaagaaggtgcaggaccagctgtctgaggtgaagtacaggatggatggagatgtggccaagaccatctgccacgtggatgagaaggccaaggacattgaacatgccaagaaggtgtcccagcaggtgtccaaggtgctgtacaagcagaactgggaggacaccaaggacaagtacctgctgcccccagatgcccctgagctggtgcaggccgtgaagaacacagccatgttcagcaagaagctgtacacagaggactgggaggccgacaagagcctcttctacccctacaatgacagccctgagctgcggcgggtggcccaggcccagaaggccctgagtgatgtggcctacaagaagggcctggccgagcagcaggcccagttcacccccctggccgaccccccagacatcgagtttgccaagaaggtgaccaaccaggtgtccaagcagaagtacaaggaggactatgagaacaagatcaagggcaagtggagcgagaccccctgctttgaggtggccaatgccaggatgaatgctgacaacatcagcaccaggaagtaccaggaggactttgagaacatgaaggaccagatctacttcatgcagacagagaccccagagtacaagatgaacaagaaggccggcgtggccgccagcaaggtgaagtacaaggaggactatgagaagaacaagggcaaggctgactacaacgtgctgcctgccagcgagaacccccagctgcggcagctgaaggctgctggagatgccctgagtgacaagctgtacaaggaaaattatgagaagaccaaggccaagagcatcaactactgtgagacccccaagttcaagctggacacagtgctgcagaacttcagcagtgacaagaagtacaaggacagctacctgaaggacatcctgggccactacgtgggcagctttgaggacccctaccacagccactgcatgaaggtgacagcccagaacagcgacaagaactacaaggccgagtatgaggaggaccggggcaagggcttcttcccccagaccatcacccaggagtatgaggccatcaagaagctggaccagtgcaaggaccacacctacaaggtgcacccagacaagaccaagttcacccaggtgacagacagccctgtgctgctgcaggcccaggtgaacagcaagcagctgagtgacctgaactacaaggccaagcatgagagcgagaagttcaagtgccacatccccccagacaccccagccttcatccagcacaaggtgaatgcctacaacctgagtgacaacctgtacaagcaggactgggagaagagcaaggccaagaagtttgacatcaaggtggatgccatccccctgctggccgccaaggccaacaccaagaacaccagtgatgtgatgtacaagaaggactatgagaagaacaagggcaagatgattggagtgctgagcatcaatgatgaccccaagatgctgcacagcctgaaggtggccaagaaccagagcgaccggctgtacaaggaaaattatgagaagaccaaggccaagtccatgaactactgtgagacccccaagtaccagctggacacccagctgaagaacttcagcgaggcccgctacaaggacctgtatgtgaaggatgtgctgggccactacgtgggctccatggaggacccctaccacacccactgcatgaaggtggccgcccagaacagcgacaagagctacaaggccgagtatgaagaagataaaggcaagtgctacttcccccagaccatcacccaggagtatgaggccatcaagaagctggaccagtgcaaggaccacacctacaaggtgcacccagacaagaccaagttcaccgctgtgacagacagccctgtgctgctgcaggcccagctgaacaccaagcagctgagtgacctgaactacaaggccaagcatgaaggagagaagttcaagtgccacatcccagcagatgccccccagttcatccagcaccgggtgaatgcctacaacctgagtgacaacgtgtacaagcaggactgggagaagagcaaggccaagaagtttgacatcaaggtggatgccatccccctgctggccgccaaggccaacaccaagaacaccagtgatgtgatgtacaagaaggactatgagaagagcaagggcaagatgattggagccctgagcatcaatgatgaccccaagatgctgcacagcctgaagacagccaagaaccagagcgaccgggagtacaggaaggactatgagaagagcaagaccatctacacagcccccctggacatgctgcaggtgacccaggccaagaagagccaggccatcgccagtgatgtggactacaagcacatcctgcacagctacagctaccccccagacagcatcaacgtggacctggccaagaaggcctatgccctgcagagtgatgtggagtacaaggctgactacaacagctggatgaagggctgcggctgggtgcccttcggcagcctggagatggagaaggccaagagggccagtgacatcctgaatgagaagaagtaccggcagcacccagacaccctgaagttcaccagcattgaagatgcccccatcaccgtgcagagcaagatcaaccaggcccagaggagtgacatcgcctacaaggccaagggggaggagatcatccacaagtacaacctgcccccagacctgccccagttcatccaggccaaggtgaatgcctacaacatcagcgagaacatgtacaaggctgacctgaaggacctgagcaagaagggctatgacctgaggacagatgccatccccatccgggccgccaaggccgcccggcaggccgccagtgatgtgcagtacaagaaggactatgagaaggccaagggcaagatggtgggcttccagagcctgcaggatgaccccaagctggtgcactacatgaatgtggccaagatccagagcgaccgggagtacaagaaggactatgagaagaccaagagcaagtacaacacccctcatgacatgtttaatgtggtggccgccaagaaggcccaggatgtggtgtccaatgtgaactacaagcacagcctgcaccactacacctacctgcctgatgccatggacctggagctgagcaagaacatgatgcagatccagagcgacaacgtgtacaaggaggactacaacaactggatgaagggcatcggctggatccccatcggcagcctggatgtggagaaggtgaagaaggctggagatgccctgaatgagaagaagtaccggcagcacccagacaccctgaagttcaccagcatcgtggacagccctgtgatggtgcaggccaagcagaacaccaagcaggtgtctgacatcctgtacaaggccaagggggaggatgtgaagcacaagtacaccatgagcccagacctgccccagttcctgcaggccaagtgcaatgcctacaacatcagtgatgtgtgctacaagagggactggtatgacctgattgccaagggcaacaacgtgctgggagatgccatccccatcacagctgccaaggccagcaggaacatcgccagtgactacaagtacaaggaggcctatgagaagagcaagggcaagcacgtgggcttccgcagcctgcaggatgaccccaagctggtgcactacatgaatgtggccaagctgcagagcgaccgggagtacaagaagaactatgagaacaccaagaccagctaccacacccctggggacatggtgtccatcacagctgccaagatggcccaggatgtggccaccaacgtgaactacaagcagcccctgcaccactacacctacctgcctgatgccatgagcctggagcacaccagaaatgtgaaccagatccagagcgacaacgtgtacaaggatgagtacaacagcttcctgaagggcatcggctggatccccatcggcagcctggaggtggagaaggtgaagaaggctggagatgccctgaatgaaaggaagtaccggcagcacccagacacagtgaagttcacctctgtgcctgacagcatgggcatggtgctggcccagcacaacaccaagcagctgagtgacctgaactacaaggtggagggggagaagctgaagcacaagtacaccatcgaccctgagctgccccagttcatccaggccaaggtgaatgccctgaacatgtctgatgcccactacaaggctgactggaagaagaccatcgccaagggctatgacctgcggccagatgccatccccatcgtggccgccaagagcagcaggaacatcgccagtgactgcaagtacaaggaggcctatgagaaggccaagggcaagcaggtgggcttcctgagcctgcaggatgaccccaagctggtgcactacatgaatgtggccaagatccagagcgaccgggagtacaagaagggctatgaggccagcaagaccaagtaccacacccccctggacatggtgtctgtgacagctgccaagaagagccaggaggtggccaccaatgccaactaccggcagagctaccaccactacaccctgctgcctgatgccctgaatgtggagcacagcagaaatgccatgcagatccagagcgacaacctgtacaagagtgacttcaccaactggatgaagggcatcggctgggtgcccatcgagagcctggaggtggagaaggccaagaaggccggggagatcctgtctgagaagaagtaccggcagcaccctgagaagctgaagttcacctacgccatggacaccatggagcaggccctgaacaagagcaacaagctgaacatggacaagaggctgtacacagagaagtggaacaaggacaagaccaccatccacgtgatgccagacaccccagacatcctgctgagccgggtgaaccagatcaccatgtctgacaagctgtacaaggccggctgggaggaggagaagaagaagggctatgacctgcggccagatgccatcgccatcaaggccgcccgggccagccgggacatcgccagtgactacaagtacaagaaggcctatgagcaggccaagggcaagcacatcggcttccgcagcctggaggatgaccccaagctggtgcacttcatgcaggtggccaagatgcagagcgaccgggagtacaagaagggctatgagaagagcaagaccagcttccacacccctgtggacatgctgtctgtggtggccgccaagaagagccaggaggtggccaccaatgccaactacagaaatgtcatccacacctacaacatgctgcctgatgccatgagctttgagctggccaagaacatgatgcagatccagagcgacaaccagtacaaggctgactatgctgacttcatgaagggcatcggctggctgcccctgggcagcctggaggccgagaagaacaagaaggccatggagatcatcagcgagaagaagtaccggcagcacccagacaccctgaagtacagcaccctgatggacagcatgaacatggtgctggcccagaacaatgccaagatcatgaatgagcacctgtacaagcaggcctgggaggccgacaagaccaaggtgcacatcatgccagacatcccccagatcatcctggccaaggccaatgccatcaacatgtctgacaagctgtacaagctgagcctggaggagagcaagaagaagggctatgacctgcggccagatgccatccccatcaaggccgccaaggccagccgggacatcgccagtgactacaagtacaagtacaactatgagaagggcaagggcaagatggtgggcttccgcagcctggaggatgaccccaagctggtgcacagcatgcaggtggccaagatgcagagcgaccgggagtacaagaagaactatgagaacaccaagaccagctaccacaccccagctgacatgctgtctgtgacagctgccaaggatgcccaggccaacatcaccaacaccaactacaagcacctgatccacaagtacatcctgctgcctgatgccatgaacatcgagctgaccaggaacatgaaccgcatccagagcgacaatgagtacaagcaggactacaatgagtggtacaagggcctgggctggagccctgctggcagcctggaggtggagaaggccaagaaggccacagaatatgccagtgaccagaagtaccggcagcaccccagcaacttccagttcaagaagctgacagacagcatggacatggtgctggccaagcagaatgcccacaccatgaacaagcacctgtacaccatcgactggaacaaggacaagaccaagatccacgtgatgccagacaccccagacatcctgcaggccaagcagaaccagaccctgtacagccagaagctgtacaagctgggctgggaggaggccctgaagaagggctatgacctgcctgtggatgccatctctgtgcagctggccaaggccagccgggacatcgccagtgactacaagtacaagcagggctacaggaagcagctgggccaccacgtgggcttccgcagcctgcaggatgaccccaagctggtgctgtccatgaatgtggccaagatgcagagcgagcgggagtacaagaaggactttgagaagtggaagaccaagttcagcagccctgtggacatgctgggcgtggtgctggccaagaagtgccaggagctggtgtctgatgtggactacaagaactacctgcaccagtggacctgcctgcctgaccagaatgatgtggtgcaggccaagaaggtgtatgagctgcagagtgaaaatctctacaagagtgacctggagtggctgcggggcatcggctggagccccctgggcagcctggaggccgagaagaacaagagggccagcgagatcatcagcgagaagaagtaccggcagcccccagacaggaacaagttcaccagcatcccagatgccatggacatcgtgctggccaagaccaatgccaagaacagaagtgaccggctgtaccgggaggcctgggacaaggacaagacccagatccacatcatgccagacaccccagacatcgtgctggccaaggccaacctgatcaacaccagtgacaagctgtacaggatgggctatgaggagctgaagaggaagggctatgacctgcctgtggatgccatccccatcaaggccgccaaggccagccgggagatcgccagcgagtacaagtacaaggagggcttcaggaagcagctgggccaccacatcggggccaggaacattgaagatgaccccaagatgatgtggagcatgcacgtggccaagatccagagcgaccgggagtacaagaaggactttgagaagtggaagaccaagttcagcagccctgtggacatgctgggcgtggtgctggccaagaagtgccagaccctggtgtctgatgtggactacaagaactacctgcaccagtggacctgcctgcctgaccagagtgatgtgatccacgcccggcaggcctatgacctgcagagcgacaacctgtacaagagtgacctgcagtggctgaagggcatcggctggatgaccagcggcagcctggaggatgagaagaacaagagggccacccagatcctgagtgaccacgtgtaccggcagcacccagaccagttcaagttcagcagcctgatggacagcatccccatggtgctggccaagaacaatgccatcaccatgaaccaccggctgtacacagaggcctgggacaaggacaagaccaccgtgcacatcatgccagacaccccagaggtgctgctggccaagcagaacaaggtgaactacagcgagaagctgtacaagctgggcctggaggaggccaagaggaagggctatgacatgagggtggatgccatccccatcaaggccgccaaggccagccgggacatcgccagcgagttcaagtacaaggagggctacaggaagcagctgggccaccacatcggggcccgggccatcagagatgaccccaagatgatgtggagcatgcacgtggccaagatccagagcgaccgggagtacaagaaggactttgagaagtggaagaccaagttcagcagccctgtggacatgctgggcgtggtgctggccaagaagtgccagaccctggtgtctgatgtggactacaagaactacctgcaccagtggacctgcctgcctgaccagagtgatgtgattcatgcccggcaggcctatgacctgcagagcgacaacatgtacaagagtgacctgcagtggatgaggggcatcggctgggtgtccatcggcagcctggatgtggagaagtgcaagagggccacagagatcctgagtgacaagatctaccggcagcccccagaccgcttcaagttcacctctgtgacagacagcctggagcaggtgctggccaagaacaatgccatcaccatgaacaagaggctgtacacagaggcctgggacaaggacaagacccagatccacatcatgccagacaccccagagatcatgctggccaggatgaacaagatcaactacagcgagagcctgtacaagctggccaatgaggaggccaagaagaagggctatgacctgcggagtgatgccatccccatcgtggccgccaaggccagccgggacatcatcagtgactacaagtacaaggatggctactgcaagcagctgggccaccacatcggggccaggaacattgaagatgaccccaagatgatgtggagcatgcacgtggccaagatccagagcgaccgggagtacaagaaggactttgagaagtggaagaccaagttcagcagccctgtggacatgctgggcgtggtgctggccaagaagtgccagaccctggtgtctgatgtggactacaagaactacctgcacgagtggacctgcctgcctgaccagagtgatgtgatccacgcccggcaggcctatgacctgcagagcgacaacatctacaagagtgacctgcagtggctgcggggcatcggctgggtgcccatcggctccatggatgtggtgaagtgcaagagggccacagagatcctgagtgacaacatctaccggcagcccccagacaagctgaagttcacctctgtgacagacagcctggagcaggtgctggccaagaacaatgccctgaacatgaacaagaggctgtacacagaggcctgggacaaggacaagacccagatccacatcatgccagacaccccagagatcatgctggcccggcagaacaagatcaactacagcgagaccctgtacaagctggccaatgaggaggccaagaagaagggctatgacctgcggagtgatgccatccccatcgtggccgccaaggccagcagagatgtgatcagtgactacaagtacaaggatggctacaggaagcagctgggccaccacatcggggccagaaatattgaagatgaccccaagatgatgtggagcatgcacgtggccaagatccagagcgaccgggagtacaagaaggactttgagaagtggaagaccaagttcagcagccctgtggacatgctgggcgtggtgctggccaagaagtgccagaccctggtgtctgatgtggactacaagaactacctgcacgagtggacctgcctgcctgaccagaatgatgtgattcatgcccggcaggcctatgacctgcagagcgacaacatctacaagagtgacctgcagtggctgcggggcatcggctgggtgcccatcggctccatggatgtggtgaagtgcaagagagctgctgagatcctgagtgacaacatctaccggcagcccccagacaagctgaagttcacctctgtgacagacagcctggagcaggtgctggccaagaacaatgccctgaacatgaacaagaggctgtacacagaggcctgggacaaggacaagacccaggtgcacatcatgccagacaccccagagatcatgctggcccggcagaacaagatcaactacagcgagagcctgtaccggcaggccatggaggaggccaagaaggagggctatgacctgcggagtgatgccatccccatcgtggccgccaaggccagccgggacatcgccagtgactacaagtacaaggaggcctacaggaagcagctgggccaccacatcggggcccgggctgtgcatgatgaccccaagatcatgtggagcctgcacatcgccaaggtgcagagcgaccgggagtacaagaaggactttgagaagtacaagacccgctacagcagccctgtggacatgctgggcatcgtgctggccaagaagtgccagaccctggtgtctgatgtggactacaagcaccccctgcacgagtggatctgcctgcctgaccagaatgacatcatccacgccaggaaggcctatgacctgcagagcgacaacctgtacaagagtgacctggagtggatgaagggcatcggctgggtgcccatcgacagcctggaggtggtgcgggccaagagagctggggagctgctgagtgacaccatctaccggcagaggcctgagaccctgaagttcaccagcatcacagacaccccagagcaggtgctggccaagaacaatgccctgaacatgaacaagaggctgtacacagaggcctgggacaatgacaagaagaccatccacgtgatgccagacaccccagagatcatgctggccaagctgaaccgcatcaactacagcgacaagctgtacaagctggccctggaggagagcaagaaggagggctatgacctgcggctggatgccatccccatccaggccgccaaggccagccgggacatcgccagtgactacaagtacaaggagggctacaggaagcagctgggccaccacatcggggccaggaacatcaaggatgaccccaagatgatgtggagcatccacgtggccaagatccagagcgaccgggagtacaagaaggagtttgagaagtggaagaccaagttcagcagccctgtggacatgctgggcgtggtgctggccaagaagtgccagatcctggtgtctgacatcgactacaagcaccccctgcacgagtggacctgcctgcctgaccagaatgatgtgatccaggccaggaaggcctatgacctgcagagtgatgccatctacaagagtgacctggagtggctgcggggcatcggctgggtgcccatcggctctgtggaggtggagaaggtgaagagagctggggagatcctgagtgacaggaagtaccggcagcctgctgaccagctgaagttcacctgcatcacagacaccccagaaattgtgctggccaagaacaatgccctgaccatgagcaagcacctgtacacagaggcctgggatgctgacaagaccagcatccacgtgatgccagacaccccagacatcctgctggccaagagcaacagcgccaacatcagccagaagctgtacaccaagggctgggatgagagcaagatgaaggactatgacctgcgggcagatgccatcagcatcaagagcgccaaggccagccgggacatcgccagtgactacaagtacaaggaggcctatgagaagcagaagggccaccacatcggggcccagagcattgaagatgaccccaagatcatgtgtgccatccacgccggcaagatccagagcgagcgggagtacaagaaggagttccagaagtggaagaccaagttcagcagccctgtggacatgctgagcatcctgctggccaagaagtgccagaccctggtgacagacatcgactacagaaactacctgcacgagtggacctgcatgccagaccagaatgacatcatccaggccaagaaggcctatgacctgcagagcgacagcgtgtacaaggctgacctggagtggctgcggggcatcggctggatgcctgagggctctgtggagatgaacagagtgaaggtggcccaggacctggtgaatgaaagactctaccgcaccaggcctgaggccctgtccttcaccagcatcgtggacaccccagaggtggtgctggccaaggccaacagcctgcagatcagcgagaagctgtaccaggaggcctggaacaaggacaagagcaacatcaccatccccagcgacaccccagagatgctgcaggcccacatcaatgccctgcagatcagcaacaagctgtaccagaaggactggaatgatgccaagcagaagggctatgacatccgggcagatgccatcgagatcaagcacgccaaggccagccgggagatcgccagcgagtacaagtacaaggagggctacaggaagcagctgggccaccacatgggcttccgcaccctgcaggatgaccccaagtctgtgtgggccatccatgctgccaagatccagagcgaccgggagtacaagaaggcctatgagaagagcaagggcatccacaacacccccctggacatgatgagcatcgtgcaggccaagaagtgccaggtgctggtgtctgacatcgactacagaaactacctgcaccagtggacctgcctgcctgaccagaatgatgtgatccaggccaagaaggcctatgacctgcagagcgacaacctgtacaagagtgacctggagtggctgaagggcatcggctggctgcctgagggctctgtggaggtgatgagggtgaagaatgcccagaacctgctgaatgaaaggctgtaccgcatcaagccagaggccctgaagttcaccagcatcgtggacaccccagaggtgatccaggccaagatcaatgctgtgcagatcagcgagcccctgtacagagatgcctgggagaaggagaaggccaacgtgaatgtgcctgctgacacccccctgatgctgcagagcaagatcaatgccctgcagatcagcaacaagcgctaccagcaggcctgggaggatgtgaagatgacaggctatgacctgcgggcagatgccatcggcatccagcacgccaaggccagccgggacatcgccagtgactacctgtacaagacagcctatgagaagcagaagggccactacatcggctgccgcagcgccaaggaggaccccaagctggtgtgggccgccaacgtgctgaagatgcagaatgaccggctgtacaagaaggcctacaatgaccacaaggccaagatcagcatccctgtggacatggtgtccatctctgctgccaaggagggccaggccctggccagtgatgtggactaccgccactacctgcaccactggagctgcttcccagaccagaatgatgtgatccaggccaggaaggcctatgacctgcagagcgacagcgtgtacaaggctgacctggagtggctgcggggcatcggctggatgcctgagggctctgtggagatgaacagagtgaaggtggcccaggacctggtgaatgaaagactctaccgcaccaggcctgaggccctgtccttcaccagcatcgtggacaccccagaggtggtgctggccaaggccaacagcctgcagatcagcgagaagctgtaccaggaggcctggaacaaggacaagagcaacatcaccatccccagcgacaccccagagatgctgcaggcccacatcaatgccctgcagatcagcaacaagctgtaccagaaggactggaatgacaccaagcagaagggctatgacatccgggcagatgccatcgagatcaagcacgccaaggccagccgggagatcgccagcgagtacaagtacaaggagggctacaggaagcagctgggccaccacatgggcttccgcaccctgcaggatgaccccaagtctgtgtgggccatccatgctgccaagatccagagcgaccgggagtacaagaaggcctatgagaagagcaagggcatccacaacacccccctggacatgatgagcatcgtgcaggccaagaagtgccaggtgctggtgtctgacatcgactacagaaactacctgcaccagtggacctgcctgcctgaccagaatgatgtgatccaggccaagaaggcctatgacctgcagagcgacaacctgtacaagagtgacctggagtggctgaagggcatcggctggctgcctgagggctctgtggaggtgatgagggtgaagaatgcccagaacctgctgaatgaaaggctgtaccgcatcaagccagaggccctgaagttcaccagcatcgtggacaccccagaggtgatccaggccaagatcaatgctgtgcagatcagcgagcccctgtacagaaatgcctgggagaaggagaaggccaacgtgaatgtgcctgctgacacccccctgatgctgcagagcaagatcaatgccctgcagatcagcaacaagcgctaccagcaggcctgggaggatgtgaagatgacaggctatgacctgcgggcagatgccatcggcatccagcacgccaaggccagccgggacatcgccagtgactacctgtacaagacagcctatgagaagcagaagggccactacatcggctgccgcagcgccaaggaggaccccaagctggtgtgggccgccaacgtgctgaagatgcagaatgaccggctgtacaagaaggcctacaatgaccacaaggccaagatcagcatccctgtggacatggtgtccatctctgctgccaaggagggccaggccctggccagtgatgtggactaccgccactacctgcaccactggagctgcttcccagaccagaatgatgtgatccaggccaggaaggcctatgacctgcagagcgacagcgtgtacaaggctgacctggagtggctgcggggcatcggctggatgcctgagggctctgtggagatgaacagagtgaaggtggcccaggacctggtgaatgaaagactctaccgcaccaggcctgaggccctgtccttcaccagcatcgtggacaccccagaggtggtgctggccaaggccaacagcctgcagatcagcgagaagctgtaccaggaggcctggaacaaggacaagagcaacatcaccatccccagcgacaccccagagatgctgcaggcccacatcaatgccctgcagatcagcaacaagctgtaccagaaggactggaatgacaccaagcagaagggctatgacatccgggcagatgccatcgagatcaagcacgccaaggccagccgggagatcgccagcgagtacaagtacaaggagggctacaggaagcagctgggccaccacatgggcttccgcaccctgcaggatgaccccaagtctgtgtgggccatccatgctgccaagatccagagcgaccgggagtacaagaaggcctatgagaagagcaagggcatccacaacacccccctggacatgatgagcatcgtgcaggccaagaagtgccaggtgctggtgtctgacatcgactacagaaactacctgcaccagtggacctgcctgcctgaccagaatgatgtgatccaggccaagaaggcctatgacctgcagagcgacaacctgtacaagagtgacctggagtggctgaagggcatcggctggctgcctgagggctctgtggaggtgatgagggtgaagaatgcccagaacctgctgaatgaaaggctgtaccgcatcaagccagaggccctgaagttcaccagcatcgtggacaccccagaggtgatccaggccaagatcaatgctgtgcagatcagcgagcccctgtacagagatgcctgggagaaggagaaggccaacgtgaatgtgcctgctgacacccccctgatgctgcagagcaagatcaatgccctgcagatcagcaacaagcgctaccagcaggcctgggaggatgtgaagatgacaggctatgacctgcgggcagatgccatcggcatccagcacgccaaggccagccgggacatcgccagtgactacctgtacaagacagcctatgagaagcagaagggccactacatcggctgccgcagcgccaaggaggaccccaagctggtgtgggccgccaacgtgctgaagatgcagaatgaccggctgtacaagaaggcctacaatgaccacaaggccaagatcagcatccctgtggacatggtgtccatctctgctgccaaggagggccaggccctggccagtgatgtggactaccgccactacctgcaccgctggagctgcttcccagaccagaatgatgtgatccaggccaggaaggcctatgacctgcagagtgatgccctgtacaaggctgacctggagtggctgcggggcatcggctggatgccccagggcagccctgaggtgctgcgggtgaagaatgcccagaacatcttctgtgacagcgtgtaccgcacccctgtggtgaacctgaagtacaccagcatcgtggacaccccagaggtggtgctggccaagagcaatgctgagaacatcagcatccccaagtaccgggaggtgtgggacaaggacaagaccagcatccacatcatgccagacaccccagagatcaacctggcccgggccaatgccctgaatgtgagcaacaagctgtaccgggagggctgggatgagatgaaggccggctgtgatgtgcggctggatgccatccccatccaggccgccaaggccagccgggagatcgccagtgactacaagtacaagctggaccacgagaagcagaagggccactacgtgggcaccctgacagccagagatgacaacaagatccgctgggccctgattgctgacaagctgcagaatgaaagagagtaccgcctggactgggccaagtggaaggccaagatccagagccctgtggacatgctgagcatcctgcacagcaagaacagccaggccctggtgtctgacatggactacagaaactacctgcaccagtggacctgcatgccagaccagaatgatgtgatccaggccaagaaggcctatgagctgcagagcgacaacgtgtacaaggctgacctggagtggctgcggggcatcggctggatgcccaatgacagcgtgtctgtgaaccacgccaagcatgctgctgacatcttcagcgagaagaagtaccgcaccaagattgagaccctgaacttcacccctgtggatgacagagtggactatgtgacagccaagcagagcggggagatcctggatgacatcaagtacaggaaggactggaatgccaccaagagcaagtacaccctgacagagacccccctgctgcacacagcccaggaggccgcccgcatcctggaccagtacctgtacaaggagggctgggagcggcagaaggccaccggctacatcctgcccccagatgctgtgccctttgtgcacgcccaccactgcaatgatgtgcagagcgagctgaagtacaaggccgagcacgtgaagcagaagggccactacgtgggcgtgcccaccatgagagatgaccccaagctggtgtggtttgaacatgctggccagatccagaatgaaaggctgtacaaggaggactaccacaagaccaaggccaagatcaacatcccagctgacatggtgtctgtgctggccgccaagcagggccagaccctggtgtctgacatcgactacagaaactacctgcaccagtggatgtgccacccagaccagaatgatgtgatccaggccaggaaggcctatgacctgcagagcgacaacgtgtacagagctgacctggagtggctgcggggcatcggctggatccccctggacagcgtggaccacgtgcgggtgaccaagaaccaggagatgatgagccagatcaagtacaagaagaatgccctggagaactaccccaacttccgctctgtggtggaccccccagagatcgtgctggccaagatcaacagcgtgaaccagagtgatgtgaagtacaaggagaccttcaacaaggccaagggcaagtacaccttctccccagacaccccccacatcagccacagcaaggacatgggcaagctgtacagcaccatcctgtacaagggggcctgggagggcaccaaggcctacggctacaccctggatgagcgctacatccccatcgtgggcgccaagcatgctgacctggtgaacagcgagctgaagtacaaggagacctatgagaagcagaagggccactacctggccggcaaggtgattggagagttccctggggtggtgcactgcctggacttccagaagatgaggtctgccctgaactacaggaagcactatgaggacaccaaggccaacgtgcacatccccaatgacatgatgaaccacgtgctggccaagcgctgccagtacatcctgagtgacctggagtaccgccactacttccaccagtggaccagcctgctggaggagcccaacgtcatccgggtgagaaatgcccaggagatcctgagtgacaacgtgtacaaggatgacctgaactggctgaagggcatcggctgctacgtgtgggacaccccccagatcctgcacgccaagaagagctatgacctgcagagccagctgcagtacacagctgctgggaaggagaacctgcagaactacaacctggtgacagacacccccctgtatgtgacagctgtgcagagcggcatcaatgccagcgaggtgaagtacaaggagaactaccaccagatcaaggacaagtacaccaccgtgctggagaccgtggactatgacaggaccaggaacctgaagaacctgtacagcagcaacctgtacaaggaggcctgggacagagtgaaggccaccagctacatcctgcccagcagcaccctgagcctgacccacgccaagaaccagaagcacctggccagccacatcaagtaccgggaggagtatgagaagttcaaggccctgtacaccctgcccaggtctgtggatgatgaccccaacacagcccgctgcctgcgggtgggcaagctgaacatcgaccggctgtacagatctgtgtatgagaagaacaagatgaagatccacatcgtgcctgacatggtggagatggtgacagccaaggacagccagaagaaggtgtctgaaattgactaccgcctgcggctgcacgagtggatctgccacccagacctgcaggtgaatgaccacgtgaggaaggtgacagaccagatcagtgacatcgtgtacaaggatgacctgaactggctgaagggcatcggctgctacgtgtgggacaccccagagatcctgcacgccaagcacgcctatgacctgagagatgacatcaagtacaaggcccacatgctgaagaccagaaatgactacaagctggtgacagacacccctgtgtatgtgcaggccgtgaagagcggcaagcagctgagtgatgctgtgtaccactatgactatgtgcacagcgtgcggggcaaggtggcccccaccaccaagacagtggacctggaccgggccctgcacgcctacaagctgcagagcagcaacctgtacaagaccagcctgcggaccctgcccaccggctaccgcctgcccggggacaccccccacttcaagcacatcaaggacacccgctacatgagcagctacttcaagtacaaggaggcctatgagcacaccaaggcctacggctacaccctgggccccaaggatgtgccctttgtgcacgtgagaagagtgaacaacgtgaccagcgagcggctgtaccgggagctgtaccacaagctgaaggacaagatccacaccaccccagacaccccagagatccggcaggtgaagaagacccaggaggccgtgtctgagctgatctacaagagtgacttcttcaagatgcagggccacatgatcagcctgccctacaccccccaggtgatccactgccgctacgtgggggacatcaccagtgacatcaagtacaaggaggacctgcaggtgctgaagggcttcggctgcttcctgtatgacaccccagacatggtgcgcagccgccacctgaggaagctgtggagcaactacctgtacacagacaaggccaggaagatgagggacaagtacaaggtggtgctggacaccccagagtacaggaaggtgcaggagctgaagacccacctgtctgagctggtgtacagagctgctgggaagaagcagaagagcatcttcacctctgtgcctgacaccccagacctgctgcgggccaagaggggccagaagctgcagagccagtacctgtatgtggagctggccaccaaggagcggccccaccaccacgccggcaaccagaccacagccctgaagcacgccaaggatgtgaaggacatggtgtctgagaagaagtacaagatccagtatgagaagatgaaggacaagtacacccctgtgcctgacacccccatcctgatccgggccaagagggcctactggaatgccagtgacctgcgctacaaggagaccttccagaagaccaagggcaagtaccacacagtgaaggatgccctggacatcgtgtaccacaggaaggtgacagatgacatcagcaagatcaagtacaaggagaactacatgagccagctgggcatctggaggagcatcccagacaggcctgagcacttccaccacagagctgtgacagacacagtgtctgatgtgaagtacaaggaggacctgacctggctgaagggcatcggctgctacgcctatgacaccccagacttcaccctggccgagaagaacaagaccctgtacagcaagtacaagtacaaggaggtgtttgagaggaccaagagtgacttcaagtatgtggccgacagccccatcaacagacacttcaagtatgccacccagctgatgaatgagaagaagtacagagctgactatgagcagaggaaggacaagtaccacctggtggtggatgagcccaggcacctgctggccaagacagctggggaccagatcagccagatcaagtacaggaagaactatgagaagagcaaggacaagttcaccagcatcgtggacaccccagagcacctgcggaccaccaaggtgaacaagcagatcagtgacatcctgtacaagctggagtacaacaaggccaagccccggggctacaccaccatccatgacacccccatgctgctgcacgtgaggaaggtgaaggatgaggtgtctgacctgaagtacaaggaggtgtaccagaggaacaagagcaactgcaccatcgagccagatgctgtgcacatcaaggccgccaaggatgcctacaaggtgaacaccaacctggactacaagaagcagtatgaggccaacaaggcccactggaagtggaccccagacagaccagacttcctgcaggccgccaagagcagcctgcagcagagcgactttgagtacaagctggaccgggagttcctgaagggctgcaagctgtctgtgacagatgacaagaacacagtgctggccctgaggaacaccctcatcgagagtgacctgaagtacaaggagaagcacgtgaaggagcggggcacctgccacgctgtgcctgacaccccccagatcctgctggccaagacagtgagcaacctggtgtctgagaacaagtacaaggaccacgtgaagaagcacctggcccagggcagctacaccaccctgcctgagacccgggacacagtgcacgtgaaggaggtgaccaagcacgtgtctgacaccaactacaagaagaagtttgtgaaggagaagggcaagagcaactacagcatcatgctggagcccccagaggtgaagcacgccatggaggtggccaagaagcagagtgatgtggcctacaggaaggatgccaaggagaacctgcactacaccaccgtggccgacagaccagacatcaagaaggccacccaggccgccaagcaggccagcgaggtggagtaccgggccaagcacaggaaggagggcagccacggcctgtccatgctgggccgcccagacatcgagatggccaagaaggccgccaagctgagcagccaggtgaagtaccgggagaactttgacaaggagaagggcaagacccccaagtacaaccccaaggacagccagctgtacaaggtgatgaaggatgccaacaacctggccagcgaggtgaagtacaaggctgacctgaagaagctgcacaagcctgtgacagacatgaaggagagcctcatcatgaaccacgtgctgaacaccagccagctggccagcagctaccagtacaagaagaagtatgagaagagcaagggccactaccacaccatcccagacaacctggagcagctgcacctgaaggaggccacagagctgcagagcatcgtgaagtacaaggagaagtatgagaaggagcggggcaagcccatgctggactttgagacccccacctacatcacagccaaggagagccagcagatgcagagcggcaaggagtacaggaaggactatgaggagagcatcaagggcaggaacctgaccggcctggaggtgaccccagccctgctgcacgtgaagtatgccaccaagatcgccagcgagaaggagtacaggaaggacctggaggagagcatccggggcaagggcctgacagagatggaggacaccccagacatgctgcgggccaagaatgccacccagatcctgaatgagaaggagtacaagagggacctggagctggaggtgaagggccggggcctgaatgccatggccaatgagaccccagacttcatgagggccagaaatgccacagacatcgccagccagatcaagtacaagcagagcgctgagatggagaaggccaacttcacctctgtggtggacaccccagagatcatccacgcccagcaggtgaagaacctgagcagccagaagaagtacaaggaggatgctgagaagtccatgagctactatgagaccgtgctggacaccccagagatccagagggtgcgggagaaccagaagaacttcagcctgctgcagtaccagtgtgacctgaagaacagcaagggcaagatcaccgtggtgcaggacaccccagagatcctgcgggtgaaggagaaccagaagaacttcagctctgtgctgtacaaggaggatgtgtccccaggcacagccatcggcaagaccccagagatgatgagggtgaagcagacccaggaccacatcagctctgtgaagtacaaggaggccatcggccagggcacccccatcccagacctgcctgaggtgaagagggtgaaggagacccagaagcacatcagctctgtgatgtacaaggagaacctgggcaccggcatccccaccaccgtgaccccagaaattgagcgggtgaagaggaaccaggagaacttcagctctgtgctgtacaaggagaacctgggcaagggcatccccacccccatcaccccagagatggagcgggtgaagaggaaccaggagaacttcagcagcatcctgtacaaggagaacctgagcaagggcacccccctgcctgtgaccccagagatggagcgggtgaagctgaaccaggagaacttcagctctgtgctgtacaaggaaaatgtgggcaagggcatccccatccccatcaccccagagatggagcgggtgaagcacaaccaggagaacttcagctctgtgctgtacaaggagaacctgggcaccggcatccccatccccatcaccccagagatgcagagggtgaagcacaaccaggagaacctgagctctgtgctgtacaaggagaacatgggcaagggcacccccctgcctgtgaccccagagatggagcgggtgaagcacaaccaggagaacatcagctctgtgctgtacaaggagaacatgggcaagggcacccccctgcctgtgaccccagagatggagcgggtgaagcacaaccaggagaacatcagctctgtgctgtacaaggagaacatgggcaagggcacccccctggccgtgaccccagagatggagcgggtgaagcacaaccaggagaacatcagctctgtgctgtacaaggaaaatgtgggcaaggccacagccacccctgtgaccccagagatgcagagggtgaagaggaaccaggagaacatcagctctgtgctgtacaaggagaacctgggcaaggccacccccacccccttcaccccagagatggagcgggtgaagaggaaccaggagaacttcagctctgtgctgtacaaggagaacatgaggaaggccacccccacccctgtgaccccagagatggagcgggccaagaggaaccaggagaacatcagctctgtgctgtacagcgacagcttcaggaagcagatccagggcaaggccgcctacgtgctggacaccccagagatgagaagagtgcgggagacccagaggcacatcagcacagtgaagtaccacgaggactttgagaagcacaagggctgcttcacccctgtggtgacagaccccatcacagagcgggtgaagaagaacatgcaggacttcagtgacatcaactaccggggcatccagaggaaggtggtggagatggagcagaagagaaatgaccaggaccaggagaccatcaccggcctgcgggtgtggaggaccaaccctggctctgtgtttgattatgaccctgctgaggacaacatccagagccgcagcctgcacatgatcaacgtgcaggcccagaggaggagccgggagcagagccgcagcgccagcgccctgagcatctctggaggagaggagaagtctgagcacagcgaggccccagaccaccacctgagcacctacagtgatggcggcgtgtttgctgtgtccacagcctacaagcacgccaagaccacagagctgccccagcagaggagcagctctgtggccacccagcagaccaccgtgagcagcatccccagccaccccagcacagctgggaagatcttccgggccatgtatgactacatggccgcagatgctgatgaggtgtccttcaaggatggagatgccatcatcaacgtgcaggccattgatgagggctggatgtatggaacagtgcagaggactggaagaacaggcatgctgcctgccaactacgtggaggccatctag

SEQ ID NO: 161328 - DNA, 864 bp, Artificial Sequence
  Description of Artificial Sequence: Synthetic coding sequence
atggctgatgatgaagattatgaggaggtggtggagtactacacagaggaggtggtgtatgaggaggtgcctggagagaccatcaccaagatctatgagaccaccaccaccaggaccagtgactatgagcagagcgagaccagcaagccagccctggcccagcctgccctggcccagcctgccagcgccaagcctgtggagaggaggaaggtgatcaggaagaaggtggaccccagcaagttcatgaccccctacatcgcccacagccagaagatgcaggacctcttcagccccaacaagtacaaggagaagtttgagaagaccaagggccagccctatgccagcaccacagacaccccagagctgcggcgcatcaagaaggtgcaggaccagctgtctgaggtgaagtacaggatggatggagatgtggccaagaccatctgccacgtggatgagaaggccaaggacattgaacatgccaagaaggtgtcccagcaggtgtccaaggtgctgtacaagcagaactgggaggacaccaaggacaagtacctgctgcccccagatgcccctgagctggtgcaggccgtgaagaacacagccatgttcagcaagaagctgtacacagaggactgggaggccgacaagagcctcttctacccctacaatgacagccctgagctgcggcgggtggcccaggcccagaaggccctgagtgatgtggcctacaagaagggcctggccgagcagcaggcccagttcacccccctggccgaccccccagacatcgagtttgccaagaaggtgaccaaccaggtgtccaagcagaaggagaagaagaggaagaagaagaggaagaaggtgtag

SEQ ID NO: 161329 - DNA, 1317 bp, Artificial Sequence
  Description of Artificial Sequence: Synthetic coding sequence
atgatgagggtgaagcagacccaggaccacatcagctctgtgaagtacaaggaggccatcggccagggcacccccatcccagacctgcctgaggtgaagagggtgaaggagacccagaagcacatcagctctgtgatgtacaaggagaacctgggcaccggcatccccaccaccgtgaccccagaaattgagcgggtgaagaggaaccaggagaacttcagctctgtgctgtacaaggagaacatgggcaagggcacccccctggccgtgaccccagagatggagcgggtgaagcacaaccaggagaacatcagctctgtgctgtacaaggaaaatgtgggcaaggccacagccacccctgtgaccccagagatgcagagggtgaagaggaaccaggagaacatcagctctgtgctgtacaaggagaacatgaggaaggccacccccacccctgtgaccccagagatggagcgggccaagaggaaccaggagaacatcagctctgtgctgtacagcgacagcttcaggaagcagatccagggcaaggccgcctacgtgctggacaccccagagatgagaagagtgcgggagacccagaggcacatcagcacagtgaagtaccatgaagattttgagaagcacaagggctgcttcacccctgtggtgacagaccccatcacagagcgggtgaagaagaacatgcaggacttcagtgacatcaactaccggggcatccagaggaaggtggtggagatggagcagaagagaaatgaccaggaccaggagaccatcaccggcctgcgggtgtggaggaccaaccctggctctgtgtttgattatgaccctgctgaggacaacatccagagccgcagcctgcacatgatcaacgtgcaggcccagaggaggagccgggagcagagccgcagcgccagcgccctgagcatcagcggcggggaggagaagtctgagcacagcgaggccccagaccaccacctgagcacctacagtgatggaggagtgtttgctgtgtccacagcctacaagcacgccaagaccacagagctgccccagcagaggagcagctctgtggccacccagcagaccaccgtgagcagcatccccagccaccccagcacagctgggaagatcttccgggccatgtatgactacatggctgctgatgctgatgaggtgtccttcaaggatggagatgccatcatcaacgtgcaggccattgatgagggctggatgtatggcaccgtgcagaggacaggccgcacaggcatgctgcctgccaactacgtggaggccatctag

SEQ ID NO: 161330 - DNA, 1014 bp, Artificial Sequence
  Description of Artificial Sequence: Synthetic coding sequence
cagaagtacaaggaggactatgagaacaagatcaagggcaagtggagcgagaccccctgctttgaggtggccaatgccaggatgaatgctgacaacatcagcaccaggaagtaccaggaggactttgagaacatgaaggaccagatctacttcatgcagacagagaccccagagtacaagatgaacaagaaggccggcgtggccgccagcaaggtgaagtacaaggaggactatgagaagaacaagggcaaggctgactacaacgtgctgcctgccagcgagaacccccagctgcggcagctgaaggctgctggagatgccctgagtgacaagctgtacaaggaaaattatgagaagaccaaggccaagagcatcaactactgtgagacccccaagttcaagctggacacagtgctgcagaacttcagcagtgacaagaagtacaaggacagctacctgaaggacatcctgggccactacgtgggcagctttgaggacccctaccacagccactgcatgaaggtgacagcccagaacagcgacaagaactacaaggccgagtatgaggaggaccggggcaagggcttcttcccccagaccatcacccaggagtatgaggccatcaagaagctggaccagtgcaaggaccacacctacaaggtgcacccagacaagaccaagttcacccaggtgacagacagccctgtgctgctgcaggcccaggtgaacagcaagcagctgagtgacctgaactacaaggccaagcatgagagcgagaagttcaagtgccacatccccccagacaccccagccttcatccagcacaaggtgaatgcctacaacctgagtgacaacctgtacaagcaggactgggagaagagcaaggccaagaagtttgacatcaaggtggatgccatccccctgctggccgccaaggccaacaccaagaacaccagtgatgtgatgtacaagaaggactatgagaagaacaaggtgaaggtgcagcagaggtag

SEQ ID NO: 161331 - DNA, 5193 bp, Artificial Sequence
  Description of Artificial Sequence: Synthetic coding sequence
atgaatgtgcagccctgcagccgctgtggctatggagtgtacccagctgagaagatcagctgcatcgaccagatctggcacaaggcctgcttccactgtgaggtgtgcaagatgatgctgtctgtgaacaactttgtgagccaccagaagaagccctactgccacgcccacaaccccaagaacaacaccttcacctctgtgtaccacacccccctgaacctgaatgtgaggaccttccctgaggccatcagcggcatccatgaccaggaggatggagagcagtgcaagtctgtgttccactgggacatgaagagcaaggacaaggagggcgcccccaaccggcagcccctggccaatgaaagagcctactggacaggctatggagagggcaatgcctggtgccctggggccctgcctgaccctgagatcgtgaggatggtggaggccaggaagagcctgggggaggagtacacagaagattatgagcagccccggggcaagggcagcttccctgccatgatcaccccagcctaccagagggccaagaaggccaaccagctggccagccaggtggagtacaagaggggccatgatgagcgcatcagccgcttcagcacagtggtggacaccccagagctgctgcggagcaaggccggggcccagctgcagagtgatgtgcgctacacagaggactatgagcagcagaggggcaagggcagcttccctgccatgatcaccccagcctaccagatcgccaagagggccaatgagctggccagtgatgtgcgctaccaccagcagtaccagaaggagatgaggggcatggccggccctgccatcggggctgagggcatcctgaccagagaatgtgccgaccagtatggccagggctacccagaggagtatgaggagcaccggggcaagggcagcttccctgccatgatcaccccagcctaccagaatgccaagaaggcccacgagctggccagtgacatcaagtaccggcaggacttcaacaagatgaagggggccgcccactaccacagcctgcctgcccaggacaacctggtgctgaagcaggcccagagcgtgaacaagctggtgtctgaggtggagtacaagaaggacctggagagcagccggggccacagcatcaactactgtgagaccccccagttcagaaatgtgtccaagatcagcaagttcaccagtgacaacaagtacaaggagaactaccagaaccacatgaggggccgctatgagggcgtgggcatggacaggaggaccctgcacgccatgaaggtgggcagcctggccagcaatgtggcctacaaggctgactacaagcatgacatcgtggactacaactacccagccaccctgacccccagctaccagacagccatgaagctggtgcccctgaaggatgccaactaccggcagagcattgacaagctgaagtacagctctgtgacagacaccccccagatcgtgcaggccaagatcaatgcccagcagctgagccacgtgaactacagagctgactatgagaagaacaagctgaactacaccctgccccaggatgtgccccagctggtgaaggccaagaccaatgccaagctgttcagcgaggtgaagtacaaggagggctgggagaagaccaagggcaaaggatttgagatgaagctggatgccatgagcctgctggccgccaaggccagcggggagctggccagcaacatcaagtacaaggaggagtatgagaagaccaagggcaaggccatgggcacagctgacagccggctgctgcacagcctgcagatcgccaagatgagcagcgaggtggagtacaagaagggctttgaggagagcaagacccgcttccacctgcccatggacatggtgaacatcagacatgccaagaaggcccagaccctggccagtgacctggactacaggaagaagctgcacgagtacacagtgctgcctgaggacatgaagacccagtgggccaagaaggcctacggcctgcagagcgagctgcagtacaaggctgacctggcctggatgaagggcgtgggctggctgacagagggcagcctgaacctggagcaggccaagaaggccggccagctggtgtctgagaagaactaccggcagagggtggatgagctgaagttcacctctgtgacagacagcagccagatggagcacgccaagaagagccaggagctgcagagcggcgtggcctacaaggctggaaatgagcagagcgtgcaccagtacaccatcagcaaggatgagcccctcttcctgcaggcccgggccaatgctgccaacctgtctgagaagctgtacaagagctcctgggagaaccagaaggccaagggctttgagctgcggctggacagcctgaccttcctggccgccaaggccaagagggacctggccagcgaggtgaagtacaaggaggactatgaaagaagccggggcaagctgattggagccaaggatgtgcagggcgacagccagatgagccacagcctgcagatgagcaagctgcagagcgagctggagtacaagaagggctttgaggacaccaagagccagtgccacgtgtccctggacatggtgcacctggtgcacgccaggaaggcccagcacctggccacagatgtgggctacaagacagctgagcaccacttcaccgccctgcccacagacatgaaggtggagtgggccaagaaggcctacggcctgcagagcgacaaccagtacagagcagatgtgaagtggatgaagggcatgggctgggtggccaccggcagcctgaatgtggagcaggccaagaaggccggggagctgatcagcgagaagaagtaccggcagcacccagatgccctgaagttcaccagcatcaaggacaccccagagatggtgcaggcccgcatctcctacacccaggccgtggaccggctgtaccgggagcagggcgagaacatcaagcaccactacacccccacagctgacctgcctgaggtgctgctggccaagctgaatgccatgaacatcagcgagacccgctacaaggagagctggagcaagctgagagatggcggctacaagctgcggctggatgccctgcccttccaggccgccaaggccagcggggagatcatcagtgactacaagtacaaggaggcctttgagaagatgaagggccagatgctgggcagccgcagcctggaggatgacatcagcctggcccacagcgtgtatgccaccagcctgcagagtgatgtgaactacaagaagggctttgagcacagcaaggcccagttccacctgcccctggacatggccgccctggtgcacgccaagaaggcccagaccctggccagcaaccaggactacaagcaccccctgccccagtacaccagcctggccgaggacctgcggctgagctgtgccaagaaggcccacaagctgcagagcgagaacctgtacagaagtgacctgaacttcatgaggggcgtggcctgtgtgattcctggcaccctggagattgagggcaggaagaaggccagcgagctgatcagcgagagcaagtaccggcagcacccccacagcttcaagtacacagctgtgacagacacccccaacctgctgcacgccaagttcagcaaccagatcaccaatgaaaggctgtacaaggccgccggggaggatgcccggcatgagtacaccatgaccctgggcctgcctgagttcatccgggccaagaccaatgctgccaacctgagtgatgcccgctacaaggagagctggaggaacctgcgggcccagggctacaagctgaccatcgaggccctgcccttccaggccgcccgggccagcggggacatcgccagtgacttcctgtacagacatgactttgtgaaggagcggggcaagctgattggcccccagagcgtgagagatgacccccgcatccagcactgcaggaggatgggccagctgcagagcgagctgcagtacagaagaggagccaccagcagccaggcccagttccacctgcccatggacatggtgcacctggtgcacgccaagaatgcccaggccctggccagtgaccatgactaccgcacccagtaccacaagttcaccgccctgcctgaggacctgaagatggcctgggccaagaaggcccacgccctgcagagcgagctgcgctacaagagtgacctgattggcatgaagggcatcggctggctggccctgcggagcccccagatggagagcgccaagaaggccggggagctgatcagcgagaccaagtacaggaagaagccagacagcatcaagttcaccaccgtggtggacagcccagacctggtgcacgccaagaacagctacatgcactgcaatgaaagaatgtacagaagtggagatgctgagagcctgcaccgctacaccctcatcccagaccacccagacttcacccgggcccggctgaatgccctgcacctgagtgacaaggtgtacagaaacagctgggagcagacccgggccggcagctatgacttccggctggatgccatccccttccagacagcccgggccagccgggagatcgccagtgacttccgctacaaggaggccttcctgcgggaccggggcctgcagatcggctacagatctgtggatgatgaccccaggatgaagcacttcctgaatgtgggccgcctgcagagcgacaatgagtacaagaaggactttgccaagagccgcagccagttccacagcagcacagaccagcccggcctgctgcaggccaagaggagccagcagctggccagtgatgtgcactaccggcagcccctgccccagcccacctgtgaccctgagcagctgggcctgcggcatgcccagaaggcccaccagctgcagagtgatgtgaagtacaagagtgacctgaacctgacccggggcgtgggctggaccccacctggcagctacaaggtggagatggccaggagagctgctgagctggccaatgcccggggcctgggcctgcagggcgcctacagaggagctgaggccgtggaggccggggaccaccagagcggggaggtgaacccagatgccacagagatcctgcacgtgaagaagaagaaggccctgctgctgtag

SEQ ID NO: 161332 - DNA, 5088 bp, Artificial Sequence
  Description of Artificial Sequence: Synthetic coding sequence
atgaatgtgcagccctgcagccgctgtggctatggagtgtacccagctgagaagatcagctgcatcgaccagatctggcacaaggcctgcttccactgtgaggtgtgcaagatgatgctgtctgtgaacaactttgtgagccaccagaagaagccctactgccacgcccacaaccccaagaacaacaccttcacctctgtgtaccacacccccctgaacctgaatgtgaggaccttccctgaggccatcagcggcatccatgaccaggaggatggagagcagtgcaagtctgtgttccactgggacatgaagagcaaggacaaggagggcgcccccaaccggcagcccctggccaatgaaagagcctactggacaggctatggagagggcaatgcctggtgccctggggccctgcctgaccctgagatcgtgaggatggtggaggccaggaagagcctgggggaggagtacacagaagattatgagcagccccggggcaagggcagcttccctgccatgatcaccccagcctaccagagggccaagaaggccaaccagctggccagccaggtggagtacaagaggggccatgatgagcgcatcagccgcttcagcacagtggtggacaccccagagctgctgcggagcaaggccggggcccagctgcagagtgatgtgcgctacacagaggactatgagcagcagaggggcaagggcagcttccctgccatgatcaccccagcctaccagatcgccaagagggccaatgagctggccagtgatgtgcgctaccaccagcagtaccagaaggagatgaggggcatggccggccctgccatcggggctgagggcatcctgaccagagaatgtgccgaccagtatggccagggctacccagaggagtatgaggagcaccggggcaagggcagcttccctgccatgatcaccccagcctaccagaatgccaagaaggcccacgagctggccagtgacatcaagtaccggcaggacttcaacaagatgaagggggccgcccactaccacagcctgcctgcccaggacaacctggtgctgaagcaggcccagagcgtgaacaagctggtgtctgagaacaagtacaaggagaactaccagaaccacatgaggggccgctatgaaggagtgggcatggacaggaggaccctgcacgccatgaaggtgggcagcctggccagcaatgtggcctacaaggctgactacaagcatgacatcgtggactacaactacccagccaccctgacccccagctaccagacagccatgaagctggtgcccctgaaggatgccaactaccggcagagcattgacaagctgaagtacagctctgtgacagacaccccccagatcgtgcaggccaagatcaatgcccagcagctgagccacgtgaactacagagctgactatgagaagaacaagctgaactacaccctgccccaggatgtgccccagctggtgaaggccaagaccaatgccaagctgttcagcgaggtgaagtacaaggagggctgggagaagaccaagggcaagggctttgagatgaagctggatgccatgagcctgctggccgccaaggccagcggggagctggccagcaacatcaagtacaaggaggagtatgagaagaccaagggcaaggccatgggcacagctgacagccggctgctgcacagcctgcagatcgccaagatgagcagcgaggtggagtacaagaagggctttgaggagagcaagacccgcttccacctgcccatggacatggtgaacatcagacatgccaagaaggcccagaccctggccagtgacctggactacaggaagaagctgcacgagtacacagtgctgcctgaggacatgaagacccagtgggccaagaaggcctacggcctgcagagcgagctgcagtacaaggctgacctggcctggatgaagggcgtgggctggctgacagagggcagcctgaacctggagcaggccaagaaggccggccagctggtgtctgagaagaactaccggcagagggtggatgagctgaagttcacctctgtgacagacagcagccagatggagcacgccaagaagagccaggagctgcagagcggcgtggcctacaaggctggaaatgagcagagcgtgcaccagtacaccatcagcaaggatgagcccctcttcctgcaggcccgggccaatgctgccaacctgtctgagaagctgtacaagagctcctgggagaaccagaaggccaagggctttgagctgcggctggacagcctgaccttcctggccgccaaggccaagagggacctggccagcgaggtgaagtacaaggaggactatgaaagaagccggggcaagctgattggagccaaggatgtgcagggcgacagccagatgagccacagcctgcagatgagcaagctgcagagcgagctggagtacaagaagggctttgaggacaccaagagccagtgccacgtgtccctggacatggtgcacctggtgcacgccaggaaggcccagcacctggccacagatgtgggctacaagacagctgagcaccacttcaccgccctgcccacagacatgaaggtggagtgggccaagaaggcctacggcctgcagagcgacaaccagtacagagcagatgtgaagtggatgaagggcatgggctgggtggccaccggcagcctgaatgtggagcaggccaagaaggccggggagctgatcagcgagaagaagtaccggcagcacccagatgccctgaagttcaccagcatcaaggacaccccagagatggtgcaggcccgcatctcctacacccaggccgtggaccggctgtaccgggagcagggcgagaacatcaagcaccactacacccccacagctgacctgcctgaggtgctgctggccaagctgaatgccatgaacatcagcgagacccgctacaaggagagctggagcaagctgagagatggcggctacaagctgcggctggatgccctgcccttccaggccgccaaggccagcggggagatcatcagtgactacaagtacaaggaggcctttgagaagatgaagggccagatgctgggcagccgcagcctggaggatgacatcagcctggcccacagcgtgtatgccaccagcctgcagagtgatgtgaactacaagaagggctttgagcacagcaaggcccagttccacctgcccctggacatggccgccctggtgcacgccaagaaggcccagaccctggccagcaaccaggactacaagcaccccctgccccagtacaccagcctggccgaggacctgcggctgagctgtgccaagaaggcccacaagctgcagagtgaaaatctctacagaagtgacctgaacttcatgagaggagtggcctgcgtcatccctggcaccctggagattgagggcaggaagaaggccagcgagctgatcagcgagagcaagtaccggcagcacccccacagcttcaagtacacagctgtgacagacacccccaacctgctgcacgccaagttcagcaaccagatcaccaatgaaagactctacaaggctgctggagaagatgcccggcatgagtacaccatgaccctgggcctgcctgagttcatccgggccaagaccaatgctgccaacctgagtgatgcccgctacaaggagagctggaggaacctgcgggcccagggctacaagctgaccatcgaggccctgcccttccaggccgcccgggccagcggggacatcgccagtgacttcctgtacagacatgactttgtgaaggagcggggcaagctgattggcccccagagcgtgagagatgacccccgcatccagcactgcaggaggatgggccagctgcagagcgagctgcagtaccgccgcggggccaccagcagccaggcccagttccacctgcccatggacatggtgcacctggtgcacgccaagaatgcccaggccctggccagtgaccatgactaccgcacccagtaccacaagttcaccgccctgcctgaggacctgaagatggcctgggccaagaaggcccacgccctgcagagcgagctgcgctacaagagtgacctgattggcatgaagggcatcggctggctggccctgcggagcccccagatggagagcgccaagaaggccggggagctgatcagcgagaccaagtacaggaagaagccagacagcatcaagttcaccaccgtggtggacagcccagacctggtgcacgccaagaacagctacatgcactgcaatgaaagaatgtacagaagtggagatgctgagagcctgcaccgctacaccctcatcccagaccacccagacttcacccgggcccggctgaatgccctgcacctgagtgacaaggtgtacagaaattcctgggagcagaccagggctggcagctatgacttccggctggatgccatccccttccagacagcccgggccagccgggagatcgccagtgacttccgctacaaggaggccttcctgcgggaccggggcctgcagatcggctacagatctgtggatgatgaccccaggatgaagcacttcctgaatgtgggccgcctgcagagcgacaatgagtacaagaaggactttgccaagagccgcagccagttccacagcagcacagaccagcccggcctgctgcaggccaagaggagccagcagctggccagtgatgtgcactaccggcagcccctgccccagcccacctgtgaccctgagcagctgggcctgcggcatgcccagaaggcccaccagctgcagagtgatgtgaagtacaagagtgacctgaacctgacccggggcgtgggctggaccccacctggcagctacaaggtggagatggcccggcgggctgctgagctggccaatgcccggggcctgggcctgcagggcgcctacagaggagctgaggccgtggaggccggggaccaccagagcggggaggtgaacccagatgccacagagatcctgcacgtgaagaagaagaaggccctgctgctgtag

SEQ ID NO: 161333 - DNA, 2559 bp, Artificial Sequence
  Description of Artificial Sequence: Synthetic coding sequence
atgaggggcatggccggccctgccatcggggctgagggcatcctgacccgggagtgtgccgaccagtatggccagggctacccagaggagtatgaggagcaccggggcaagggcagcttccctgccatgatcaccccagcctaccagaatgccaagaaggcccacgagctggccagtgacatcaagtaccggcaggacttcaacaagatgaagggagctgcccactaccacagcctgcctgcccaggacaacctggtgctgaagcaggcccagagcgtgaacaagctggtgtctgaggtggagtacaagaaggacctggagagcagccggggccacagcatcaactactgtgagaccccccagttcagaaatgtgtccaagatcagcaagttcaccagtgacaacaagtacaaggagaactaccagaaccacatgaggggccgctatgaaggagtgggcatggacaggaggaccctgcacgccatgaaggtgggcagcctggccagcaatgtggcctacaaggctgactacaagcatgacatcgtggactacaactacccagccaccctgacccccagctaccagacagccatgaagctggtgcccctgaaggatgccaactaccggcagagcattgacaagctgaagtacagctctgtgacagacaccccccagatcgtgcaggccaagatcaatgcccagcagctgagccacgtgaactacagagctgactatgagaagaacaagctgaactacaccctgccccaggatgtgccccagctggtgaaggccaagaccaatgccaagctgttcagcgaggtgaagtacaaggagggctgggagaagaccaagggcaagggctttgagatgaagctggatgccatgagcctgctggccgccaaggccagcggggagctggccagcaatgtgcacctgctgctgagcctgaagatcaagtacaaggaggagtatgagaagaccaagggcaaggccatgggcacagctgacagccggctgctgcacagcctgcagatcgccaagatgagcagcgaggtggagtacaagaagggctttgaggagagcaagacccgcttccacctgcccatggacatgggcgtgggctggctgacagagggcagcctgaacctggagcaggccaagaaggccggccagctggtgtctgagaagaactaccggcagagggtggatgagctgaagttcacctctgtgacagacagcagccagatggagcacgccaagaagagccaggagctgcagagcggcgtggcctacaaggctggaaatgagcagagcgtgcaccagtacaccatcagcaaggatgagcccctcttcctgcaggcccgggccaatgctgccaacctgtctgagttcctgtacagacatgactttgtgaaggagcggggcaagctgattggcccccagagcgtgagagatgacccccgcatccagcactgcaggaggatgggccagctgcagagcgagctgcagtacagaagaggagccaccagcagccaggcccagttccacctgcccatggacatggtgcacctggtgcacgccaagaatgcccaggccctggccagtgaccatgactaccgcacccagtaccacaagttcaccgccctgcctgaggacctgaagatggcctgggccaagaaggcccacgccctgcagagcgagctgcgctacaagagtgacctgattggcatgaagggcatcggctggctggccctgcggagcccccagatggagagcgccaagaaggccggggagctgatcagcgagaccaagtacaggaagaagccagacagcatcaagttcaccaccgtggtggacagcccagacctggtgcacgccaagaacagctacatgcactgcaatgaaagaatgtacagaagtggagatgctgagagcctgcaccgctacaccctcatcccagaccacccagacttcacccgggcccggctgaatgccctgcacctgagtgacttccgctacaaggaggccttcctgcgggaccggggcctgcagatcggctacagatctgtggatgatgaccccaggatgaagcacttcctgaatgtgggccgcctgcagagcgacaatgagtacaagaaggactttgccaagagccgcagccagttccacagcagcacagaccagcccggcctgctgcaggccaagaggagccagcagctggccagtgatgtgcactaccggcagcccctgccccagcccacctgtgaccctgagcagctgggcctgcggcatgcccagaaggcccaccagctgcagagtgatgtgaagtacaagagtgacctgaacctgacccggggcgtgggctggaccccacctggcagctacaaggtggagatggccaggagagctgctgagctggccaatgcccggggcctgggcctgcagggcgcctacagaggagctgaggccgtggaggccggggaccaccagagcggggaggtgaacccagatgccacagagatcctgcacgtgaagaagaagaaggccctgctgctgtag

SEQ ID NO: 161334 - DNA, 5217 bp, Artificial Sequence
  Description of Artificial Sequence: Synthetic coding sequence
atgaatgtgcagccctgcagccgctgtggctatggagtgtacccagctgagaagatcagctgcatcgaccagatctggcacaaggcctgcttccactgtgaggtgtgcaagatgatgctgtctgtgaacaactttgtgagccaccagaagaagccctactgccacgcccacaaccccaagaacaacaccttcacctctgtgtaccacacccccctgaacctgaatgtgaggaccttccctgaggccatcagcggcatccatgaccaggaggatggagagcagtgcaagtctgtgttccactgggacatgaagagcaaggacaaggagggcgcccccaaccggcagcccctggccaatgaaagagcctactggacaggctatggagagggcaatgcctggtgccctggggccctgcctgaccctgagatcgtgaggatggtggaggccaggaagagcctgggggaggagtacacagaagattatgagcagccccggggcaagggcagcttccctgccatgatcaccccagcctaccagagggccaagaaggccaaccagctggccagccaggtggagtacaagaggggccatgatgagcgcatcagccgcttcagcacagtggtggacaccccagagctgctgcggagcaaggccggggcccagctgcagagtgatgtgcgctacacagaggactatgagcagcagaggggcaagggcagcttccctgccatgatcaccccagcctaccagatcgccaagagggccaatgagctggccagtgatgtgcgctaccaccagcagtaccagaaggagatgaggggcatggccggccctgccatcggggctgagggcatcctgaccagagaatgtgccgaccagtatggccagggctacccagaggagtatgaggagcaccggggcaagggcagcttccctgccatgatcaccccagcctaccagaatgccaagaaggcccacgagctggccagtgacatcaagtaccggcaggacttcaacaagatgaagggggccgcccactaccacagcctgcctgcccaggacaacctggtgctgaagcaggcccagagcgtgaacaagctggtgtctgaggtggagtacaagaaggacctggagagcagccggggccacagcatcaactactgtgagaccccccagttcagaaatgtgtccaagatcagcaagttcaccagtgacaacaagtacaaggagaactaccagaaccacatgaggggccgctatgagggcgtgggcatggacaggaggaccctgcacgccatgaaggtgggcagcctggccagcaatgtggcctacaaggctgactacaagcatgacatcgtggactacaactacccagccaccctgacccccagctaccagacagccatgaagctggtgcccctgaaggatgccaactaccggcagagcattgacaagctgaagtacagctctgtgacagacaccccccagatcgtgcaggccaagatcaatgcccagcagctgagccacgtgaactacagagctgactatgagaagaacaagctgaactacaccctgccccaggatgtgccccagctggtgaaggccaagaccaatgccaagctgttcagcgaggtgaagtacaaggagggctgggagaagaccaagggcaaaggatttgagatgaagctggatgccatgagcctgctggccgccaaggccagcggggagctggccagcaatgtgcacctgctgctgagcctgaagatcaagtacaaggaggagtatgagaagaccaagggcaaggccatgggcacagctgacagccggctgctgcacagcctgcagatcgccaagatgagcagcgaggtggagtacaagaagggctttgaggagagcaagacccgcttccacctgcccatggacatggtgaacatcagacatgccaagaaggcccagaccctggccagtgacctggactacaggaagaagctgcacgagtacacagtgctgcctgaggacatgaagacccagtgggccaagaaggcctacggcctgcagagcgagctgcagtacaaggctgacctggcctggatgaagggcgtgggctggctgacagagggcagcctgaacctggagcaggccaagaaggccggccagctggtgtctgagaagaactaccggcagagggtggatgagctgaagttcacctctgtgacagacagcagccagatggagcacgccaagaagagccaggagctgcagagcggcgtggcctacaaggctggaaatgagcagagcgtgcaccagtacaccatcagcaaggatgagcccctcttcctgcaggcccgggccaatgctgccaacctgtctgagaagctgtacaagagctcctgggagaaccagaaggccaagggctttgagctgcggctggacagcctgaccttcctggccgccaaggccaagagggacctggccagcgaggtgaagtacaaggaggactatgaaagaagccggggcaagctgattggagccaaggatgtgcagggcgacagccagatgagccacagcctgcagatgagcaagctgcagagcgagctggagtacaagaagggctttgaggacaccaagagccagtgccacgtgtccctggacatggtgcacctggtgcacgccaggaaggcccagcacctggccacagatgtgggctacaagacagctgagcaccacttcaccgccctgcccacagacatgaaggtggagtgggccaagaaggcctacggcctgcagagcgacaaccagtacagagcagatgtgaagtggatgaagggcatgggctgggtggccaccggcagcctgaatgtggagcaggccaagaaggccggggagctgatcagcgagaagaagtaccggcagcacccagatgccctgaagttcaccagcatcaaggacaccccagagatggtgcaggcccgcatctcctacacccaggccgtggaccggctgtaccgggagcagggcgagaacatcaagcaccactacacccccacagctgacctgcctgaggtgctgctggccaagctgaatgccatgaacatcagcgagacccgctacaaggagagctggagcaagctgagagatggcggctacaagctgcggctggatgccctgcccttccaggccgccaaggccagcggggagatcatcagtgactacaagtacaaggaggcctttgagaagatgaagggccagatgctgggcagccgcagcctggaggatgacatcagcctggcccacagcgtgtatgccaccagcctgcagagtgatgtgaactacaagaagggctttgagcacagcaaggcccagttccacctgcccctggacatggccgccctggtgcacgccaagaaggcccagaccctggccagcaaccaggactacaagcaccccctgccccagtacaccagcctggccgaggacctgcggctgagctgtgccaagaaggcccacaagctgcagagcgagaacctgtacagaagtgacctgaacttcatgaggggcgtggcctgtgtgattcctggcaccctggagattgagggcaggaagaaggccagcgagctgatcagcgagagcaagtaccggcagcacccccacagcttcaagtacacagctgtgacagacacccccaacctgctgcacgccaagttcagcaaccagatcaccaatgaaaggctgtacaaggccgccggggaggatgcccggcatgagtacaccatgaccctgggcctgcctgagttcatccgggccaagaccaatgctgccaacctgagtgatgcccgctacaaggagagctggaggaacctgcgggcccagggctacaagctgaccatcgaggccctgcccttccaggccgcccgggccagcggggacatcgccagtgacttcctgtacagacatgactttgtgaaggagcggggcaagctgattggcccccagagcgtgagagatgacccccgcatccagcactgcaggaggatgggccagctgcagagcgagctgcagtacagaagaggagccaccagcagccaggcccagttccacctgcccatggacatggtgcacctggtgcacgccaagaatgcccaggccctggccagtgaccatgactaccgcacccagtaccacaagttcaccgccctgcctgaggacctgaagatggcctgggccaagaaggcccacgccctgcagagcgagctgcgctacaagagtgacctgattggcatgaagggcatcggctggctggccctgcggagcccccagatggagagcgccaagaaggccggggagctgatcagcgagaccaagtacaggaagaagccagacagcatcaagttcaccaccgtggtggacagcccagacctggtgcacgccaagaacagctacatgcactgcaatgaaagaatgtacagaagtggagatgctgagagcctgcaccgctacaccctcatcccagaccacccagacttcacccgggcccggctgaatgccctgcacctgagtgacaaggtgtacagaaacagctgggagcagacccgggccggcagctatgacttccggctggatgccatccccttccagacagcccgggccagccgggagatcgccagtgacttccgctacaaggaggccttcctgcgggaccggggcctgcagatcggctacagatctgtggatgatgaccccaggatgaagcacttcctgaatgtgggccgcctgcagagcgacaatgagtacaagaaggactttgccaagagccgcagccagttccacagcagcacagaccagcccggcctgctgcaggccaagaggagccagcagctggccagtgatgtgcactaccggcagcccctgccccagcccacctgtgaccctgagcagctgggcctgcggcatgcccagaaggcccaccagctgcagagtgatgtgaagtacaagagtgacctgaacctgacccggggcgtgggctggaccccacctggcagctacaaggtggagatggccaggagagctgctgagctggccaatgcccggggcctgggcctgcagggcgcctacagaggagctgaggccgtggaggccggggaccaccagagcggggaggtgaacccagatgccacagagatcctgcacgtgaagaagaagaaggccctgctgctgtag

SEQ ID NO: 161335 - DNA, 5112 bp, Artificial Sequence
  Description of Artificial Sequence: Synthetic coding sequence
atgaatgtgcagccctgcagccgctgtggctatggagtgtacccagctgagaagatcagctgcatcgaccagatctggcacaaggcctgcttccactgtgaggtgtgcaagatgatgctgtctgtgaacaactttgtgagccaccagaagaagccctactgccacgcccacaaccccaagaacaacaccttcacctctgtgtaccacacccccctgaacctgaatgtgaggaccttccctgaggccatcagcggcatccatgaccaggaggatggagagcagtgcaagtctgtgttccactgggacatgaagagcaaggacaaggagggcgcccccaaccggcagcccctggccaatgaaagagcctactggacaggctatggagagggcaatgcctggtgccctggggccctgcctgaccctgagatcgtgaggatggtggaggccaggaagagcctgggggaggagtacacagaagattatgagcagccccggggcaagggcagcttccctgccatgatcaccccagcctaccagagggccaagaaggccaaccagctggccagccaggtggagtacaagaggggccatgatgagcgcatcagccgcttcagcacagtggtggacaccccagagctgctgcggagcaaggccggggcccagctgcagagtgatgtgcgctacacagaggactatgagcagcagaggggcaagggcagcttccctgccatgatcaccccagcctaccagatcgccaagagggccaatgagctggccagtgatgtgcgctaccaccagcagtaccagaaggagatgaggggcatggccggccctgccatcggggctgagggcatcctgaccagagaatgtgccgaccagtatggccagggctacccagaggagtatgaggagcaccggggcaagggcagcttccctgccatgatcaccccagcctaccagaatgccaagaaggcccacgagctggccagtgacatcaagtaccggcaggacttcaacaagatgaagggggccgcccactaccacagcctgcctgcccaggacaacctggtgctgaagcaggcccagagcgtgaacaagctggtgtctgagaacaagtacaaggagaactaccagaaccacatgaggggccgctatgaaggagtgggcatggacaggaggaccctgcacgccatgaaggtgggcagcctggccagcaatgtggcctacaaggctgactacaagcatgacatcgtggactacaactacccagccaccctgacccccagctaccagacagccatgaagctggtgcccctgaaggatgccaactaccggcagagcattgacaagctgaagtacagctctgtgacagacaccccccagatcgtgcaggccaagatcaatgcccagcagctgagccacgtgaactacagagctgactatgagaagaacaagctgaactacaccctgccccaggatgtgccccagctggtgaaggccaagaccaatgccaagctgttcagcgaggtgaagtacaaggagggctgggagaagaccaagggcaagggctttgagatgaagctggatgccatgagcctgctggccgccaaggccagcggggagctggccagcaatgtgcacctgctgctgagcctgaagatcaagtacaaggaggagtatgagaagaccaagggcaaggccatgggcacagctgacagccggctgctgcacagcctgcagatcgccaagatgagcagcgaggtggagtacaagaagggctttgaggagagcaagacccgcttccacctgcccatggacatggtgaacatcagacatgccaagaaggcccagaccctggccagtgacctggactacaggaagaagctgcacgagtacacagtgctgcctgaggacatgaagacccagtgggccaagaaggcctacggcctgcagagcgagctgcagtacaaggctgacctggcctggatgaagggcgtgggctggctgacagagggcagcctgaacctggagcaggccaagaaggccggccagctggtgtctgagaagaactaccggcagagggtggatgagctgaagttcacctctgtgacagacagcagccagatggagcacgccaagaagagccaggagctgcagagcggcgtggcctacaaggctggaaatgagcagagcgtgcaccagtacaccatcagcaaggatgagcccctcttcctgcaggcccgggccaatgctgccaacctgtctgagaagctgtacaagagctcctgggagaaccagaaggccaagggctttgagctgcggctggacagcctgaccttcctggccgccaaggccaagagggacctggccagcgaggtgaagtacaaggaggactatgaaagaagccggggcaagctgattggagccaaggatgtgcagggcgacagccagatgagccacagcctgcagatgagcaagctgcagagcgagctggagtacaagaagggctttgaggacaccaagagccagtgccacgtgtccctggacatggtgcacctggtgcacgccaggaaggcccagcacctggccacagatgtgggctacaagacagctgagcaccacttcaccgccctgcccacagacatgaaggtggagtgggccaagaaggcctacggcctgcagagcgacaaccagtacagagcagatgtgaagtggatgaagggcatgggctgggtggccaccggcagcctgaatgtggagcaggccaagaaggccggggagctgatcagcgagaagaagtaccggcagcacccagatgccctgaagttcaccagcatcaaggacaccccagagatggtgcaggcccgcatctcctacacccaggccgtggaccggctgtaccgggagcagggcgagaacatcaagcaccactacacccccacagctgacctgcctgaggtgctgctggccaagctgaatgccatgaacatcagcgagacccgctacaaggagagctggagcaagctgagagatggcggctacaagctgcggctggatgccctgcccttccaggccgccaaggccagcggggagatcatcagtgactacaagtacaaggaggcctttgagaagatgaagggccagatgctgggcagccgcagcctggaggatgacatcagcctggcccacagcgtgtatgccaccagcctgcagagtgatgtgaactacaagaagggctttgagcacagcaaggcccagttccacctgcccctggacatggccgccctggtgcacgccaagaaggcccagaccctggccagcaaccaggactacaagcaccccctgccccagtacaccagcctggccgaggacctgcggctgagctgtgccaagaaggcccacaagctgcagagtgaaaatctctacagaagtgacctgaacttcatgagaggagtggcctgcgtcatccctggcaccctggagattgagggcaggaagaaggccagcgagctgatcagcgagagcaagtaccggcagcacccccacagcttcaagtacacagctgtgacagacacccccaacctgctgcacgccaagttcagcaaccagatcaccaatgaaagactctacaaggctgctggagaagatgcccggcatgagtacaccatgaccctgggcctgcctgagttcatccgggccaagaccaatgctgccaacctgagtgatgcccgctacaaggagagctggaggaacctgcgggcccagggctacaagctgaccatcgaggccctgcccttccaggccgcccgggccagcggggacatcgccagtgacttcctgtacagacatgactttgtgaaggagcggggcaagctgattggcccccagagcgtgagagatgacccccgcatccagcactgcaggaggatgggccagctgcagagcgagctgcagtaccgccgcggggccaccagcagccaggcccagttccacctgcccatggacatggtgcacctggtgcacgccaagaatgcccaggccctggccagtgaccatgactaccgcacccagtaccacaagttcaccgccctgcctgaggacctgaagatggcctgggccaagaaggcccacgccctgcagagcgagctgcgctacaagagtgacctgattggcatgaagggcatcggctggctggccctgcggagcccccagatggagagcgccaagaaggccggggagctgatcagcgagaccaagtacaggaagaagccagacagcatcaagttcaccaccgtggtggacagcccagacctggtgcacgccaagaacagctacatgcactgcaatgaaagaatgtacagaagtggagatgctgagagcctgcaccgctacaccctcatcccagaccacccagacttcacccgggcccggctgaatgccctgcacctgagtgacaaggtgtacagaaattcctgggagcagaccagggctggcagctatgacttccggctggatgccatccccttccagacagcccgggccagccgggagatcgccagtgacttccgctacaaggaggccttcctgcgggaccggggcctgcagatcggctacagatctgtggatgatgaccccaggatgaagcacttcctgaatgtgggccgcctgcagagcgacaatgagtacaagaaggactttgccaagagccgcagccagttccacagcagcacagaccagcccggcctgctgcaggccaagaggagccagcagctggccagtgatgtgcactaccggcagcccctgccccagcccacctgtgaccctgagcagctgggcctgcggcatgcccagaaggcccaccagctgcagagtgatgtgaagtacaagagtgacctgaacctgacccggggcgtgggctggaccccacctggcagctacaaggtggagatggcccggcgggctgctgagctggccaatgcccggggcctgggcctgcagggcgcctacagaggagctgaggccgtggaggccggggaccaccagagcggggaggtgaacccagatgccacagagatcctgcacgtgaagaagaagaaggccctgctgctgtag

SEQ ID NO: 161336 - DNA, 828 bp, Artificial Sequence
  Description of Artificial Sequence: Synthetic coding sequence
atggccacagagctggagtatgaatctgtgctgtgtgtgaagccagatgtgtctgtgtaccgcatccccccccgggccagcaacagaggctaccgggccagtgactggaagctggaccagcctgactggacaggccgcctgcgcatcaccagcaagggcaagacagcctacatcaagctggaggacaaggtgtctggagagctgtttgcccaggcccctgtggagcagtacccaggcattgctgtggagaccgtgacagacagcagccgctacttcgtcatccgcatccaggacggcaccggccgcagcgccttcatcggcatcggcttcacagacagaggagatgcctttgacttcaacgtgtccctgcaggaccacttcaagtgggtgaagcaggagagcgagatcagcaaggagagccaggagatggatgcccggcccaagctggacctgggcttcaaggagggccagaccatcaagctgtgcatcggcaacatcaccaacaagaagggcggggccagcaagcccaggacagcccggggcggcggcctgagcctgctgcccccacctcctgggggcaaggtgaccatccccccacccagcagctctgtggccatcagcaaccacgtgaccccaccacccatccccaagagcaaccacggcggcagtgatgctgacatcctgctggacctggacagccctgcccctgtgaccaccccagcccccacccctgtgtctgtgtccaatgacctgtggggagacttcagcacagccagcagctctgtgcccaaccaggccccccagcccagcaactgggtgcagttctag

SEQ ID NO: 161337 - DNA, 402 bp, Artificial Sequence
  Description of Artificial Sequence: Synthetic coding sequence
atggatgcccggcccaagctggacctgggcttcaaggagggccagaccatcaagctgtgcatcggcaacatcaccaacaagaagggcggggccagcaagcccaggacagcccggggcggcggcctgagcctgctgcccccacctcctgggggcaaggtgaccatccccccacccagcagctctgtggccatcagcaaccacgtgaccccaccacccatccccaagagcaaccacggcggcagtgatgctgacatcctgctggacctggacagccctgcccctgtgaccaccccagcccccacccctgtgtctgtgtccaatgacctgtggggagacttcagcacagccagcagctctgtgcccaaccaggccccccagcccagcaactgggtgcagttctag

SEQ ID NO: 161338 - DNA, 828 bp, Artificial Sequence; identical to SEQ ID NO: 161336
  Description of Artificial Sequence: Synthetic coding sequence

SEQ ID NO: 161339 - DNA, 558 bp, Artificial Sequence
  Description of Artificial Sequence: Synthetic coding sequence
atggaggagagcggctatgagagcgtgctgtgtgtgaagccagatgtgcacgtgtaccgcatccccccccgggccaccaacagaggctacagagctgctgagtggcagctggaccagcccagctggagcggccgcctgcgcatcacagccaagggccagatggcctacatcaagctggaggacaggaccagcggggagctgtttgcccaggcccctgtggaccagtttcctggaacagctgtggagagcgtgacagacagcagccgctactttgtgatcagaattgaagatggaaatggaagaagagccttcatcggcattggatttggagacagaggagatgcctttgacttcaacgtggccctgcaggaccacttcaagtgggtgaagcagcagtgtgaatttgccaagcaggcccagaacccagaccagggccccaagctggacctgggcttcaaggagggccagaccatcaagctgaacattgctgtgggcctgggcaacatcaacagacgctgcagctgcaccctggccacagcccagagctgccactgctag

SEQ ID NO: 161340 - DNA, 792 bp, Artificial Sequence
  Description of Artificial Sequence: Synthetic coding sequence
atggaggagagcggctatgagagcgtgctgtgtgtgaagccagatgtgcacgtgtaccgcatccccccccgggccaccaacagaggctacagagctgctgagtggcagctggaccagcccagctggagcggccgcctgcgcatcacagccaagggccagatggcctacatcaagctggaggacaggaccagcggggagctgtttgcccaggcccctgtggaccagtttcctggaacagctgtggagagcgtgacagacagcagccgctactttgtgatcagaattgaagatggaaatggaagaagagccttcatcggcattggatttggagacagaggagatgcctttgacttcaacgtggccctgcaggaccacttcaagtgggtgaagcagcagtgtgaatttgccaagcaggcccagaacccagaccagggccccaagctggacctgggcttcaaggagggccagaccatcaagctgaacatcgccaacatgaagaagaaggagggcgccgccggcaacccccgggtgcggcctgccagcactggaggcctgagcctgctgcccccacctcctgggggcaagaccagcaccctcatccccccacctggagagcagctggccgtgggcggcagcctggtgcagcctgctgtggcccccagcagcggcggggcccctgtgccctggccccagcccaacccagccacagctgacatctggggagacttcaccaagagcacaggcagcaccagcagccagacccagcccggcaccggctgggtgcagttctag

SEQ ID NO: 161341 - DNA, 792 bp, Artificial Sequence; identical to SEQ ID NO: 161340
  Description of Artificial Sequence: Synthetic coding sequence

SEQ ID NO: 161342 - DNA, 822 bp, Artificial Sequence
  Description of Artificial Sequence: Synthetic coding sequence
atggaggagagcggctatgagagcgtgctgtgtgtgaagccagatgtgcacgtgtaccgcatccccccccgggccaccaacagaggctacagagctgctgagtggcagctggaccagcccagctggagcggccgcctgcgcatcacagccaagggccagatggcctacatcaagctggaggacaggaccagcggggagctgtttgcccaggcccctgtggaccagtttcctggaacagctgtggagagcgtgacagacagcagccgctactttgtgatcagaattgaagatggaaatggaagaagagccttcatcggcattggatttggagacagaggagatgcctttgacttcaacgtggccctgcaggaccacttcaagtgggtgaagcagcagtgtgaatttgccaagcaggcccagaacccagaccagggccccaagctggacctgggcttcaaggagggccagaccatcaagctgaacatcgccaacatgaagaagaaggagggcgccgccggcaacccccgggtgcggcctgccagcactggaggcctgagcctgctgcccccacctcctgggggcaagaccagcaccctcatccccccacctggagagcagctggccgtgggcggcagcctggtgcagcctgctgtggcccccagcagtgaccagctgcctgcccggcccagccaggcccaggccggcagcagcagtgacctgagcaccgtcttcccccacgtgaccagcggcaaggccctgccccacctgggccagaggaaagaagatgaggccctgctgtcctggcctgtgtttggagcctag

SEQ ID NO: 161343 - DNA, 714 bp, Artificial Sequence
  Description of Artificial Sequence: Synthetic coding sequence
atggaggagagcggggctgctgagtggcagctggaccagcccagctggagcggccgcctgcgcatcacagccaagggccagatggcctacatcaagctggaggacaggaccagcggggagctgtttgcccaggcccctgtggaccagtttcctggaacagctgtggagagcgtgacagacagcagccgctactttgtgatcagaattgaagatggaaatggaagaagagccttcatcggcattggatttggagacagaggagatgcctttgacttcaacgtggccctgcaggaccacttcaagtgggtgaagcagcagtgtgaatttgccaagcaggcccagaacccagaccagggccccaagctggacctgggcttcaaggagggccagaccatcaagctgaacatcgccaacatgaagaagaaggagggcgccgccggcaacccccgggtgcggcctgccagcactggaggcctgagcctgctgcccccacctcctgggggcaagaccagcaccctcatccccccacctggagagcagctggccgtgggcggcagcctggtgcagcctgctgtggcccccagcagcggcggggcccctgtgccctggccccagcccaacccagccacagctgacatctggggagacttcaccaagagcacaggcagcaccagcagccagacccagcccggcaccggctgggtgcagttctag

SEQ ID NO: 161344 - DNA, 792 bp, Artificial Sequence; identical to SEQ ID NO: 161340
  Description of Artificial Sequence: Synthetic coding sequence
